United States Patent 12,371,699 (NUCLEIC ACIDS ENCODING CRISPR-ASSOCIATED PROTEINS AND USES THEREOF) - sequence listing, part 2

SEQ ID NO: 1394 - RNA, 2556 nt, synthetic construct
  misc_feature 1..2556: note = Cas9 variant
  source 1..2556: mol_type = other RNA
atgaccaacggcaagatcctggggctcgacatcggcgtggccagcgtcggggtgggcatcatcgaggccaagaccgggaaggtgatccacgcgaactcccgcctgttcagcgccgccaacgccgagaacaacgccgagcggcgcggcttccggggcgcgcgccggctgacgcgccggaagaagcaccgcgtcaagcgggtgcgcgacctcttcgagaagtacgacatcctgaccgacttccggaacctgaacctcaacccctacgagctgcgcgtgaaggggctgaccgagcagctcaccaacgaggagctgttcgccgccctgcggacgatcgccaagcgccggggcatctcctacctcgacgacgcggaggacgacagcaccgggtccagcgactacgccaagtccatcgacgagaaccgccggctgctcaagagcatgacccccggccagatccagctggagcgcctggagaagtacgggcagctgcggggcaacttcaccgtctacgacgagaacggcgaggcccaccgcctcatcaacgtgttctccacgagcgactacaagaacgaggcccggaagatcctggagacccagtccaactacaacaagcagatcaccgacgagttcatcgaggactacatcgagatcctgacccagaagcgcaagtactaccacgggcccggcaacgagaagtcccgcacggactacgggcggttccgcaccgacggcaccaccctcgagaacatcttcggcatcctgatcgggaagtgcagcttctaccccgaggagtaccgggccagcaaggcgtcctacacggcccaggagttcaacttcctgaacgacctcaacaacctgaaggtgcccaccgagaccggcaagctgagcaccgagcagaaggagtacctcgtcaacttcgccaagaactccaagacgctgggggccagcaagctgctcaaggagatcgccaagctggtggacggcgacgtgaaggacatctccgggtaccgcgaggacagcaagggcaagccggacctgcacaccttcgagccctaccggaagctcaagttcaacctgaccaccgtcgacatcgacaacctgagccgcgacatcctcgacaagctggcggacatcctgacgctcaacaccgagcgggagggcatcgaggacgccatcaaccagaacctgcccgagcagttcaccaaggagcagatctccgagatcgtgcagatccgcaagagccagtccagcgccttcaacaaggggtggcactccttcagcgccaagctgatgaacgagctcatccccgagctgtacgccacctccgaggagcagatgacgatcctgacccggctcgagaagttcaaggcgaccaagaagtccagcaagaacaccaagacgatcgacgagaaggagatcaccgacgagatctacaacccggtggtcgccaagagcgtgcgccagaccatcaagatcatcaacgccgccgtgaagaagtacggcgacttcgacaagatcgtcatcgagatgccccgggacaagaacgccgacgacgagaagaagttcatcgacaagaagaacaaggagaacaagaaggagaaggacgactccctgaagcgcgcggcctacctgtacaacgggaccgacaagctccccgacgacgtgttccacggcaacaagcagctggccacgaagatccggctgtggtaccagcagggggagcgctgcctgtacagcggcaagcccatcctcatccaggacctggtgcacaactccaacaacttcgagatcgaccacatcctgccgctcagcctgtccttcgacgacagcctggccaacaaggtcctcgtgtacgcgtgggccaaccaggagaaggagcagaagaccccctaccaggtgatcgactccatggacgccgcctggagcttccgggagatgaaggactacgtcctgaagcagaagggcatcgggaagaagaagcgcgagtacctgctcaccaccgagaacatcgacaagatcgaggtgaagaagaagttcatcgagcggaacctggtcgacacccgctacgcctcccgggtggtgctgaacagcctccagacggcgctgaaggagctgggcaaggacaccaaggtcagcgtggtgcgcgggcagttcacctcccagctccgccggaagtggaagatcgacaagagccgcgagacctaccaccaccacgccgtcgacgccctgatcatcgccgcctccagccagctgaagctctggcagaagcacgagaacctgatgttcgagaactacggcgagaaccaggtggtgaacaaggagacgggggagatcctgtccatcagcgacgacgagtacaaggagtccgtcttccagccgccctaccagggcttcgtgaacaccatcagctccaaggcgttcgaggacgagatcctcttcagctaccaggtggactccaagttcaaccggaaggtcagcgacgccaccatctactccacccgcaaggccaagctgggcaaggacaagaaggaggagacgtacgtgctggggaagtga

SEQ ID NO: 1395 - RNA, 2598 nt, synthetic construct
  misc_feature 1..2598: note = Cas9 variant
  source 1..2598: mol_type = other RNA
atgcgccacaagatcggcctggacatcgggatcaccagcgtgggctgggccgtcatcaacctcgacatcccccggatcgaggacctgggggtgcgcatcttcgaccgggccgagaacccccagaccggcgagtccctggcgctcccccgccggctggcccgcagcgcccggcgccggctgcgccggcgcaagcaccggctcgagcgcatccggcgcctgctgatccgggaggggatcctcacgaaggaggagctggacaagctgttcgaggagaagcacgagatcgacgtgtggcagctccgcgtcgaggccctggaccggaagctgaacaacgacgagctcgcccgcgtgctgctgcacctcgcgaagcggcgcggcttcaagtccaaccgcaagagcgagcggaacaacaaggagaactccaccatgctgaagcacatcgaggagaaccgcgccctgctcagcggctaccggaccgtggccgagatgatcgtcaaggaccccaagttcgccttccacaagcgcaacaagggggagaactacaccaacacgatcgcgcgggacgacctggagcgcgagatcaagctgatcttcaccaagcagcgggagtacggcaacatcgtgtgcaccgagaccttcgagaacgagtacatcatgatctgggcctcccagcgccccttcgccagcaagaacgacatcgagaagaaggtggggttctgcacgttcgagccgaaggagaagcgggcccccaaggccacctacaccttccagtccttcgtcgcgtgggagcacatcaacaagctccgcctggtgtaccccaccggcacgcgggggctgaccgacgaggagcgccggctcctgtacaagcaggccttccacaagaacaagatcacctaccacgacatccgcaccctgctccacctccccgacgacacgtacttcaagggcatcgtgtacgaccggggcgccccgctgaagcagagcgagaccatccgcttcctggagctggacgcctaccaccagatccggaaggccgtcgacaaggtgtacgggaagggcaagtccagctccttcctgcccatcgacttcgacaccttcgggtacgcgctcaccctgttcaaggacgacgccgacatccgcagctacctgcggaacgagtacgagcagaacggcaagcgcatgcccaacctcgccaacaaggtgtacgacaacgagcccatcgaggagctgctgaacctctccttcacgaagttcggccacctgagcctgaaggccctccgcaacatcctgccgtacatggagcagggggaggtctactccgtggcctgcgagcgggcgggctacaccttcaccgggcccaagaagaagcagaagaccctgctcctgcccaacatcccgcccatcgccaaccccgtggtcatgcgcgccctgacgcaggcccggaaggtggtgaacgccatcatcaagaagtacggcagccccgtctccatccacatcgagctggcgcgcgacctcagccagaccttcgacgagcggcgcaagaccaagcgggagcaggacgagaaccgcaagaagaacgagaccgccatccggcagctgatggagtacgggctgacgatcaaccccaccggccacgacatcgtgaagttcaagctctggagcgagcagaacggccgctgcgcctactccctgcagccgatcgagatcgagcggctgctcgagcccgggtacgtggaggtcgaccacgtgatcccctacagccgctccctggacgacagctacaccaacaaggtcctggtgctcaccaaggagaaccgggagaagggcaaccgcatccccgccgagtacctgggggtgggcacggagcggtggcagcagttcaagaccttcgtcctgaccaacaagcagttctccaagaagaagcgcgaccggctcctgcgcctgcactacgacgagaacgaggaggcggagtggaagaaccggaacctcaacgacacccgctacatcagccggttcttcgccaacttcatccgcgagcacctgaagttcgccgagtccgacgacaagcagaaggtgtacacggtgaacgggcgcgtcaccgcccacctccggagccgctgggacttcaacaagaaccgggaggagtccgacctgcaccacgccgtggacgcggccatcgtggcctgcaccagcccgtccgacatcgcccgcgtcaccgccttctaccagcggcgcgagcagtgcaaggagagcgcgaagaaggccgagccccacttcccccagccctggccgcacttcgccgacgagctgcgggcccgcctgtccaagaaccccaaggagagcatcaaggccctcaacctgggcaactacgacgaccagaagctggagtccctccagcccgtgttcgtgagccggatgccgaagcgctccgtcaccggcgcggcccaccaggagacgctgcggcgctacatcgggatcgacgagcggagcggcaagatccagaccgtggtgaagaccaagctgtccgagatcaagctcgacgagaccgggcacttccccatgtacggcaaggagagcgacccgcccgccagcgcctga

SEQ ID NO: 1396 - RNA, 2886 nt, synthetic construct
  misc_feature 1..2886: note = Cas9 variant
  source 1..2886: mol_type = other RNA
atggcccgcatcctggccttcgacatcggcatcagctccatcgggtgggcgttcagcgagaacgacgagctcaaggactgcggcgtgcggatcttcaccaaggccgagaaccccaagaccggggagtccctggccctgccgcgccggctcgcccgcagcgcccggaagcgcctggcgcggcgcaaggcccggctgaaccacctcaagcacctgatcgccaacgagttcaagctgaactacgaggactaccagtccttcgacgagagcctcgccaaggcgtacaagggctccctgatcagcccctacgagctgcgcttccgggccctcaacgagctgctgtccaagcaggacttcgcccgcgtcatcctccacatcgccaagcggcgcgggtacgacgacatcaagaacaacggcgacgaggagaagggcaagatcctgaaggccatcaagcagaacgaggagaagctggtgaactaccagagcgtgggggagtacctctacaaggagtacttccagaagttcaaggagaactccaaggagttcatcaacgtccggaacaagaaggagagctacgagcgctgcatcacgcagtccttcctgaagtacgagctgaagctcatcttccagaagcagcgggagttcggcttcagcttctccaagaagttcgaggaggaggtgctgagcgtggcgttctacaagcgcgccctgaaggacttctcccacctcgtcgggaactgcagcttcttctccgacgagaagcgggcccccaagaacagccccctggccttcatgttcgtggccctgacccgcatcatcaacctcctgaacaacctgaagaacaccgagggcatcctctacaccaaggacgacctgaacgcgctgctcaacgaggtgctgaagaacgggacgctgacctacaagcagaccaagaagctcctgggcctgagcgacgactacgagttcaagggcgagaaggggacctacttcatcgagttcaagaagtacaaggagttcatcaaggccctcggcgagcacaacctgtcccaggacgacctgaacgagatcgccaaggacatcacgctcatcaaggacgagatcaagctgaagaaggccctggccaagtacgacctcaaccagaaccagatcgacagcctgtccaagctggagttcaaggaccacctcaacatcgggttcaaggcgctgaagctgatcaccccgctgatgctcgagggcaagaagtacgacgaggcctgcaacgagctgaacctgaaggtcgccatcaacgaggacaagaaggacttcctccccgccttcaacgagacctactacaaggacgaggtgaccaaccccgtggtcctgcgggccatcaaggagtaccgcaaggtgctgaacgcgctcctgaagaagtacggcaaggtgcacaagatcaacatcgagctggcccgcgaggtcgggaagaaccacagccagcgggccaagatcgagaaggagcagaacgagaactacaaggccaagaaggacgcggagctcgagtgcgagaagctgggcctgaagatcaactccaagaacatcctcaagctgcgcctgttcaaggagcagaaggagttctgcgcctacagcggggagaagatcaagctctccgacctgcaggacgagaagatgctggagatcgaccacatctacccctacagccggtccttcgacgacagctacatgaacaaggtgctcgtgttcacgaagcagaaccaggagaagctgaacaagaccccgttcgaggccttcggcaacgacaacgtcaagtggcagaagatcgaggtgctggccaagaacctccccgagaagaagcagaagcgcatcctggacaagaactacaaggacaaggagcagaaggacttcaaggaccggaacctgaacgacacccgctacatcgcccggctcgtgctgaactacaccaaggactacctggacttcctccccctgtccgacgacgagaacacgaagctgaaggggagcaaggtccacgtggaggcgaagtccggcatgctcaccagcgccctgcgccacacctggggcttctccaccaaggaccggaacaaccacctccaccacgccatcgacgccgccatcatcgcgtacgccaacaacagcatcgtgaaggacttctccgacttcaagaaggagcaggagagcaactccgccgagctgtacgccaagaagatcagcgagctggactacaagaacaagcgcaagttcttcgagcccttcagcgggttccggcagaaggtcctggacaagatcgacgagatcttcgtgtccaagccggagcgcaagaagcccagcggcgccctccacgaggagacgttccggaaggaggaggagttctaccagtcctacgggggcaaggagggggtcctgaaggcgctggagctcggcaagatccgcaaggtgaacggcaagatcgtgaagaacggggacatgttccgggtcgacatcttcaagcacaagaagaccaacaagttctacgccgtgcccatctacaccatggacttcgccctgaaggtgctgcccaacaaggccgtcgcgcgcagcaagaagggcgagatcaaggactggatcctcatggacgagaactacgagttctgcttctccctgtacaaggacagcctgatcctcatccagaccaaggacatgcaggagccggagctggtgtacttcaacgccttcacgtccagcaccgtgtccctgatcgtcagcaagcacgacaacaagttcgagaccctctccaagaacctgaaggtgttcgagaagtacatcgtgagcgccctgggggaggtcaccaaggccgagttccggcagcgcgaggacttcaagaacgagctccggtga

SEQ ID NO: 1397 - RNA, 2955 nt, synthetic construct
  misc_feature 1..2955: note = Cas9 variant
  source 1..2955: mol_type = other RNA
atggccaagatcctggccttcgacatcggcatcagctccatcgggtgggcgttcagcgagaacgacgagctcaaggactgcggcgtgcgcatcttcaccaaggccgagaaccccaagaccggggagtccctggccctgccgcggcgcatcgcccggagcgcccgcaagcggctcgcgcgccggaaggcccgcctgaaccacctgaagcacctcatcgccaacgagttcaagctgaactacgaggactaccagtccttcgacgagatcctggccaaggcgtacaagggcagcctcatctccccctacgagctgcggttccgcgccctgaacgagctcctgagcaagcaggacttcgcccgggtcatcctgcacatcgccaagcgccgggggtacgacgacatcaagaacaacggcgacgaggagaagggcaagatcctcaaggccatcaagcagaacgaggagaagctggcgaactaccagtccgtgggggagtacctgtacaaggagtacttccagaagttcaaggagaacagcaaggagttcatcaacgtgcgcaacaagaaggagtcctacgagcggtgcatcgcccagagcttcctcaaggacgagctgaagctgatcttcaagaagcagcgcgagttcggcttctccttcagcaagaagttcgaggaggaggtcctctccgtggccttctacaagcgggccctgaaggacttcagccacctggtggggaactgctccttcttcacggacgagaagcgcgcccccaagaacagccccctcgcgttcatgttcgtcgccctgacccggatcatcaacctgctcaacaacctgaagaacaccctgtacaccaaggacgacctcaacgccctgctgaacgaggtgctcaagaacggcacgctgacctacaagcagaccaagaagctgctcgggctgtccgacgactacgagttcaagggcgagaagggcaactacttcatcgagttcaagaagtacaaggagttcatcaaggccctgggggagcacagcctcagccaggacgacctgaacgagatcgccaaggacatcaccctgatcaaggacgagatcaagctcaagaaggcgctggccaagtacgacctgaacgagaaccagatcgacaacctctccaagctggagttcaaggaccacctgaacatcagcttcaaggccctcaagctgatcacgccgctgatgctggagggcaagaagtacgacgaggcctgcaacgagctcaccctgaaggtggccatcaacgaggacaagaaggacttcctgcccgcgttcaacgagacctactacaaggacgaggtcaccaaccccgtggtgctccgcgccatcaaggagtaccggaaggtcctgaacgccctgctcaagaagtacgggaaggtgcacaagatcaacatcgagctggcccgcgaggtgggcaagaaccactcccagcgcgcgaagatcgagaaggagcagaacgagaactacaaggccaagaaggacgccgagctggagtgcgagaagctcggcctgaagatcaacagcaagaacatcctgaagctccggctgttcaaggagcagaaggagttctgcgtctactccggggagaagatcaagctgagcgacctccaggacgagaagatgctggagatcgaccacatctacccctactcccgcagcttcgacgactcctacatgaacaaggtgctggtgttcacgaagcagaaccaggagaagctcaaccagaccccgttcgaggccttcggcaacgacagcgccaagtggcagaagatcgaggtcctggcgaagaacctgcccaccaagaagcagaagcggatcctcgacaagaactacaaggacaaggagcagaaggacttcaaggaccgcaacctgaacgacacccggtacatcgcccgcctggtgctcaactacacgaaggactacctggacttcctgcccctctccgacgacgagaacaccaagctgaacgacacccagaaggggagcaaggtgcacgtcgaggccaagtccggcatgctgaccagcgccctccggcacacgtgggggttctccaccaaggaccgcaacaaccacctccaccacgccatcgacgcggtgatcatcgcctacgccaacaacagcatcgtgaaggccttctccgacttcaagaaggagcaggagagcaacaccgccgagctgtacgcgaagaagatctccgagctggactacaagaacaagcggaagttcttcgagcccttcagcggcttccgccagaaggtcctggacaagatcgacgagatcttcgtgagcaagccggagcggaagaagccctccggcgccctgcacgaggagaccttccgcaaggaggaggagttctaccagagctacgggggcaaggagggggtcctcaaggccctggagctgggcaagatccggaaggtgaacgggaagatcgtgaagaacggcgacatgttccgcgtcgacatcttcaagcacaagaagacgaacaagttctacgccgtgcccatctacaccatggacttcgcgctcaaggtgctgcccaacaaggccgtcgcccggtccaagaagggcgagatcaaggactggatcctgatggacgagaactacgagttctgcttcagcctctacaaggactccctgatcctgatccagaccaaggacatgcaggagccggagttcgtgtactacaacgccttcaccagctccacggtgagcctcatcgtctccaagcacgacaacaagttcgagaccctgagcaagaaccagaagatcctgttcaagaacgccaacgagaaggaggtgatcgcgaagtccatcgggatccagaacctcaaggtgttcgagaagtacatcgtcagcgccctgggcgaggtgaccaaggccgagttccgccagcgggaggagttcaagaacgagctgcgctga

SEQ ID NO: 1398 - RNA, 2955 nt, synthetic construct
  misc_feature 1..2955: note = Cas9 variant
  source 1..2955: mol_type = other RNA
atggcccgcatcctggccttcgacatcggcatcagctccatcgggtgggcgttcagcgagaacgacgagctcaaggactgcggcgtgcggatcttcaccaaggccgagaaccccaagaccggggagtccctggccctgccgcgccggctcgcccgcagcgcccggaagcgcctggcgcggcgcaaggcccggctgaaccgcctcaagcacctgatcgccaacgagttcaagctgaactacgaggactaccagtccttcgacgagagcctcgccaaggcgtacaagggctccctgatcagcccctacgagctgcggttccgcgccctcaacgagctgctgtccaagcaggacttcgcccgggtcatcctccacatcgccaagcgccgggggtacgacgacatcaagaacagcgacgacaaggagaagggcgccatcctgaaggcgatcaagcagaacgaggagaagctggccaactaccagtccgtgggcgagtacctctacaaggagtacttccagaagttcaaggagaacagcaaggagttcacgaacgtgcgcaacaagaaggagtcctacgagcggtgcatcgcccagagcttcctgaaggacgagctgaagctcatcttcaagaagcagcgcgagttcgggttctccttcagcaagaagttcgaggaggaggtcctgtccgtggccttctacaagcgggccctgaaggacttcagccacctcgtgggcaactgctccttcttcaccgacgagaagcgcgcgcccaagaacagccccctggccttcatgttcgtcgccctgacccggatcatcaacctcctgaacaacctgaagaacaccgaggggatcctctacacgaaggacgacctgaacgccctgctcaacgagttcctgaagaacggcaccctgacctacaagcagaccaagaagctcctggggctgagcgacgactacgagttcaagggcgagaagggcacgtacttcatcgagttcaagaagtacaaggagttcatcaaggccctcggggagcacaacctgtcccaggacgacctgaacgagatcgcgaaggacatcaccctcatcaaggacgagatcaagctgaagaaggccctggccaagtacgacctcaaccagaaccagatcgacagcctgtccaagctggagttcaaggaccacctcaacatcagcttcaaggccctgaagctgatcaccccgctgatgctcgagggcaagaagtacgacgaggcctgcaacgagctgaacctgaaggtggcgatcaacgaggacaagaaggacttcctccccgccttcaacgagacctactacaaggacgaggtgacgaaccccgtcgtgctgcgcgccatcaaggagtaccgcaaggtgctgaacgccctcctgaagaagtacgggaaggtccacaagatcaacatcgagctggcgcgggaggtgggcaagaactactcccagcgcgccaagatcgagaaggagcagaacgagaactacaaggccaagaaggacgccgagctcgagtgcgagaagctgggcctgaagatcaacagcaagaacatcctcaagctgcggctgttcaaggagcagaaggagttctgcgcctactccggggagaagatcaagatcagcgacctccaggacgagaagatgctggagatcgaccacatctacccctactcccgcagcttcgacgactcctacatgaacaaggtgctggtcttcaccaagcagaaccaggagaagctcaaccagaccccgttcgaggcgttcggcaacgacagcgccaagtggcagaagatcgaggtgctggccaagaacctgcccaccaagaagcagaagcggatcctcgacaagaactacaaggacaaggagcagaaggacttcaaggaccgcaacctgaacgacacgcggtacatcgcccgcctggtgctcaactacaccaaggactacctggacttcctgcccctctccgacgacgagaacaccaagctgaacgacacccacaaggggagcaaggtccacgtggaggccaagtccggcatgctgacgagcgcgctccggcacacctgggggttctccaccaaggaccgcaacaaccacctccggcacgccatcgacgccgtgatcatcgcctacgccaacaacagcatcgtcaaggcgttctccgacttcaagaaggagcaggagagcaacagcgccgagctgtacgccaagaagatctccgagctggactacaagaacaagcgcaagttcttcgagcccttcagcggcttccggcagaaggtgctggacaagatcgacgagatcttcgtgtccaagccggagcgcaagaagcccagcggcgccctgcacgaggagaccttccggaaggaggaggagttctaccagtcctacgggggcaaggagggggtcctcaaggcgctggagctgggcaagatccgcaaggtgaacgggaagatcgtcaagaacggcgacatgttccgggtggacatcttcaagcacaagaagacgaacaagttctacgccgtgcccatctacaccatggacttcgccctcaaggtcctgcccaacaaggccgtggcccgcagcaagaagggcgagatcaaggactggatcctgatggacgagaactacgagttctgcttctccctctacaaggacagcctgatcctgatccagaccaaggacatgcaggagccggagttcgtgtactacaacgcgttcacctccagcacggtctccctcatcgtgagcaagcacgacaacaagttcgagaccctgtccaagaaccagaagatcctgttcaagaacgccaacgagaaggaggtgatcgccaagagcatcgggatccagaacctcaaggtcttcgagaagtacatcgtgtccgccctgggcgaggtgaccaaggccgagttccggcagcgcgaggacttcaagaagtga

SEQ ID NO: 1399 - RNA, 2955 nt, synthetic construct
  misc_feature 1..2955: note = Cas9 variant
  source 1..2955: mol_type = other RNA
atggcccgcatcctggccttcgacatcggcatcagctccatcgggtgggcgttcagcgagaacgacgagctcaaggactgcggcgtgcggatcttcaccaaggtcgagaaccccaagaccggggagtccctggccctgccgcgccggctcgcccgcagcgcccggaagcgcctggcccggcgcaaggcgcggctgaaccacctcaagcacctgatcgccaacgagttcaagctgaactacgaggactaccagtccttcgacgagagcctcgccaaggcctacaagggctccctgatcagcccctacgagctgcgcttccgggcgctcaacgagctgctgtccaagcaggacttcgcccgcgtgatcctccacatcgccaagcggcgcgggtacgacgacatcaagaacagcgacgacaaggagaagggcgccatcctgaaggccatcaagcagaacgaggagaagctggcgaactaccagtccgtgggcgagtacctctacaaggagtacttccagaagttcaaggagaacagcaaggagttcacgaacgtccggaacaagaaggagtcctacgagcgctgcatcgcccagagcttcctgaaggacgagctgaagctcatcttcaagaagcagcgggagttcgggttctccttcagcaagaagttcgaggaggaggtgctgtccgtggccttctacaagcgcgccctgaaggacttcagccacctcgtcggcaactgctccttcttcaccgacgagaagcgggcccccaagaacagccccctggcgttcatgttcgtgaccctgacccgcatcatcaacctcctgaacaacctgaagaacacggaggggatcctctacaccaaggacgacctgaacgccctgctcaacgaggtgctgaagaacggcaccctgacctacaagcagacgaagaagctcctggggctgagcgacgactacgagttcaagggcgagaagggcacctacttcatcgagttcaagaagtacaaggagttcatcaaggccctcggggagcacaacctgtcccaggacgacctgaacgagatcgccaaggacatcaccctcatcaaggacgagatcaagctgaagaaggccctggcgaagtacgacctcaaccagaaccagatcgacagcctgtccaagctggagttcaaggaccacctcaacatcagcttcaaggccctgaagctgatcaccccgctgatgctcgagggcaagaagtacgacgaggcctgcaacgagctgaacctgaaggtcgccatcaacgaggacaagaaggacttcctccccgccttcaacgagacgtactacaaggacgaggtgaccaaccccgtggtcctgcgggcgatcaaggagtaccgcaaggtgctgaacgccctcctgaagaagtacgggaaggtgcacaagatcaacatcgagctggcccgcgaggtcggcaagaaccactcccagcgggccaagatcgagaaggagcagaacgagaactacaaggcgaagaaggacgccgagctcgagtgcgagaagctgggcctgaagatcaacagcaagaacatcctcaagctgcgcctgttcaaggagcagaaggagttctgcgcctactccggggagaagatcaagatcagcgacctccaggacgagaagatgctggagatcgaccacatctacccctactcccggagcttcgacgactcctacatgaacaaggtgctggtgttcaccaagcagaaccaggagaagctcaacaagaccccgttcgaggccttcggcaacgacagcgccaagtggcagaagatcgaggtcctggcgaagaacctgcccacgaagaagcagaagcgcatcctcgacaagaactacaaggacaaggagcagaaggacttcaaggaccggaacctgaacgacacccgctacatcgcccggctggtgctcaactacaccaaggactacctggacttcctgcccctctccgacgacgagaacaccaagctgaacgacacgcagaaggggagcaaggtgcacgtcgaggccaagtccggcatgctgaccagcgccctccgccacacctgggggttctccaccaaggaccggaacaaccacctccaccacgccatcgacgcggtgatcatcgcctacgccaacaacagcatcgtgaaggccttctccgacttcaagaaggagcaggagagcaacagcgccgagctgtacgcgaagaagatctccgagctggactacaagaacaagcgcaagttcttcgagcccttcagcggcttccggcagaaggtcctggacaagatcgacgagatcttcgtgtccaagccggagcgcaagaagcccagcggcgccctgcacgaggagacgttccggaaggaggaggagttctaccagtcctacgggggcaaggagggggtcctcaaggccctggagctgggcaagatccgcaaggtgaacgggaagatcgtgaagaacggcgacatgttccgggtcgacatcttcaagcacaagaagaccaacaagttctacgccgtgcccatctacaccatggacttcgcgctcaaggtgctgcccaacaaggccgtcgcccgcagcaagaagggcgagatcaaggactggatcctgatggacgagaactacgagttctgcttctccctctacaaggacagcctgatcctgatccagaccaaggacatgcaggagccggagttcgtgtactacaacgccttcacgtccagcaccgtgtccctcatcgtcagcaagcacgacaacaagttcgagaccctgtccaagaaccagaagatcctgttcaagaacgccaacgagaaggaggtgatcgccaagagcatcgggatccagaacctcaaggtgttcgagaagtacatcgtctccgcgctgggcgaggtgaccaaggccgagttccggcagcgcgaggacttcaagaagtga

SEQ ID NO: 1400 - RNA, 2955 nt, synthetic construct
  misc_feature 1..2955: note = Cas9 variant
  source 1..2955: mol_type = other RNA
atggcccgcatcctggccttcgacatcggcatcagctccatcgggtgggcgttcagcgagaacgacgagctcaaggactgcggcgtgcggatcttcaccaaggccgagaaccccaagaccggggagtccctggccctgccgcgccggctcgcccgcagcgcccggaagcgcctggcgcggcgcaaggcccggctgaaccacctcaagcacctgatcgccaacgagttcaagctgaactacgaggactaccagtccttcgacgagagcctcgccaaggcgtacaagggctccctgatcagcccctacgagctgcgcttccgggccctcaacgagctgctgtccaagcaggacttcgcccgcgtcatcctccacatcgccaagcggcgcgggtacgacgacatcaagaacagcgacgacaaggagaagggcgccatcctgaaggcgatcaagcagaacgaggagaagctggccaactaccagtccgtgggcgagtacctctacaaggagtacttccagaagttcaaggagaacagcaaggagttcacgaacgtgcggaacaagaaggagtcctacgagcgctgcatcgcccagagcttcctgaaggacgagctgaagctcatcttcaagaagcagcgggagttcgggttctccttcagcaagaagttcgaggaggaggtcctgtccgtggccttctacaagcgcgccctgaaggacttcagccacctcgtgggcaactgctccttcttcaccgacgagaagcgggcgcccaagaacagccccctggccttcatgttcgtcgccctgacccgcatcatcaacctcctgaacaacctgaagaacaccgaggggatcctctacacgaaggacgacctgaacgccctgctcaacgaggtgctgaagaacggcaccctgacctacaagcagaccaagaagctcctggggctgagcgacgactacgagttcaagggcgagaagggcacgtacttcatcgagttcaagaagtacaaggagttcatcaaggccctcggggaccactccctgagccaggacgacctgaacgagatcgcgaaggacatcaccctcatcaaggacgagatcaagctgaagaaggccctggccaagtacgacctcaaccagaaccagatcgactccctgagcaagctggagttcaaggaccacctcaacatctccttcaaggccctgaagctgatcaccccgctgatgctcgagggcaagaagtacgacgaggcctgcaacgagctgaacctgaaggtggcgatcaacgaggacaagaaggacttcctccccgccttcaacgagacctactacaaggacgaggtcacgaaccccgtggtgctgcgggccatcaaggagtaccgcaagatcctgaacgccctcctgaagaagtacgggaaggtccacaagatcaacatcgagctggcgcgcgaggtgggcaagaaccacagccagcgggccaagatcgagaaggagcagaacgagaactacaaggccaagaaggacgccgagatcgagtgcgagaagctcggcctgaagatcaactccaagaacatcctgaagctccgcctgttcaaggagcagaaggagttctgcgcctacagcggggagaagatcaagctgtccgacctccaggacgagaagatgctggagatcgaccacatctacccctacagccggtccttcgacgacagctacatgaacaaggtgctggtcttcaccaagcagaaccaggagaagctcaacaagaccccgttcgaggcgttcggcaacgactccaccaagtggcagaagatcgaggtgctggccaagaacctgcccgagaagaagcagaagcgcatcctcgacaagaactacaaggacaaggagcagaaggacttcaaggaccggaacctgaacgacacgcgctacatcgcccggctggtgctcaactacaccaaggactacctggacttcctgcccctcagcgacgacgagaacaccaagctgaacgacacccagaaggggtccaaggtccacgtggaggccaagagcggcatgctgacgtccgccctccgccacacctgggggttcagcgcgaaggaccggaacaaccacctccaccacgccatcgacgccgccatcatcgcctacgcgaacaactccatcgtgaaggccttcagcgacttcaagaaggagcaggagagcaactccgtcgagctgtacgccaagaagatcagcgagctggactacaagaacaagcgcaagttcttcgagcccttctccggcttccggcagaaggtgctggacaagatcgacgagatcttcgtgagcaagccggagcgcaagaagccctccggcgccctgcacgaggagaccttccggaaggaggaggagttctaccagagctacgggggcaaggagggggtcctcaaggcgctggagctgggcaagatccgcaaggtgaacgggaagatcgtcaagaacggcgacatgttccgggtggacatcttcaagcacaagaagaccaacaagttctacgccgtgcccatctacacgatggacttcgccctcaaggtcctgcccaacaaggccgtggcccgctccaagaagggcgagatcaaggactggatcctgatggacgagaactacgagttctgcttcagcctctacaaggactccctgatcctgatccagaccaaggacatgcaggagccggagctcgtgtacttcaacgcgttcaccagctccaccgtcagcctgatcgtgtccaagcacgacaacaagttcgagacgctgagcaagaaccagaagatcctcttcaagaacgccaacgagaaggaggtgatcgccaagtccatcgggatccagaacctgaaggtcttcgagaagtacatcgtgagcgccctgggcgaggtgaccaaggccgagttccggcagcgcgaggacttcaagaagtga

SEQ ID NO: 1401 - RNA, 2955 nt, synthetic construct
  misc_feature 1..2955: note = Cas9 variant
  source 1..2955: mol_type = other RNA
atggcccgcatcctggccttcgacatcggcatcagctccatcgggtgggcgttcagcgagaacgacgagctcaaggactgcggcgtgcggatcttcaccaaggtcgagaaccccaagaccggggagtccctggccctgccgcgccggctcgcccgcagcgcccggaagcgcctggcccggcgcaaggcgcggctgaaccacctcaagcacctgatcgccaacgagttcaagctgaactacgaggactaccagtccttcgacgagagcctcgccaaggcctacaagggctccctgatcagcccctacgagctgcgcttccgggcgctcaacgagctgctgtccaagcaggacttcgcccgcgtgatcctccacatcgccaagcggcgcgggtacgacgacatcaagaacagcgacgacaaggagaagggcgccatcctgaaggccatcaagcagaacgaggagaagctggcgaactaccagtccgtgggcgagtacctctacaaggagtacttccagaagttcaaggagaacagcaaggagttcacgaacgtccggaacaagaaggagtcctacgagcgctgcatcgcccagagcttcctgaaggacgagctgaagctcatcttcaagaagcagcgggagttcgggttctccttcagcaagaagttcgaggaggaggtgctgtccgtggccttctacaagcgcgccctgaaggacttcagccacctcgtcggcaactgctccttcttcaccgacgagaagcgggcccccaagaacagccccctggcgttcatgttcgtggccctgacccgcatcatcaacctcctgaacaacctgaagaacaccgaggggatcctctacacgaaggacgacctgaacgccctgctcaacgaggtgctgaagaacggcaccctgacctacaagcagaccaagaagctcctggggctgagcgacgactacgagttcaagggcgagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggcgctggccaagtacgacctcaaccagaaccagatcgacagcctgtccaagctggagttcaaggaccacctcaacatcagcttcaaggccctgaagctgatcaccccgctgatgctcgagggcaagaagtacgacgaggcctgcaacgagctgaacctgaaggtcgccatcaacgaggacaagaaggacttcctccccgcgttcaacgagacctactacaaggacgaggtgacgaaccccgtggtcctgcgggccatcaaggagtaccgcaaggtgctgaacgccctcctgaagaagtacgggaaggtgcacaagatcaacatcgagctggcccgcgaggtcggcaagaaccactcccagcgggcgaagatcgagaaggagcagaacgagaactacaaggccaagaaggacgccgagctcgagtgcgagaagctgggcctgaagatcaacagcaagaacatcctcaagctgcgcctgttcaaggagcagaaggagttctgcgcctactccggggagaagatcaagatcagcgacctccaggacgagaagatgctggagatcgaccacatctacccctactcccggagcttcgacgactcctacatgaacaaggtgctggtgttcaccaagcagaaccaggagaagctcaacaagaccccgttcgaggccttcggcaacgacagcgcgaagtggcagaagatcgaggtcctggccaagaacctgcccaccaagaagcagaagcgcatcctcgacaagaactacaaggacaaggagcagaaggacttcaaggaccggaacctgaacgacacgcgctacatcgcccggctggtgctcaactacaccaaggactacctggacttcctgcccctctccgacgacgagaacaccaagctgaacgacacccagaaggggagcaaggtgcacgtcgaggccaagtccggcatgctgacgagcgccctccgccacacctgggggttctccaccaaggaccggaacaaccacctccaccacgcgatcgacgccgtgatcatcgcctacgccaacaacagcatcgtgaaggccttctccgacttcaagaaggagcaggagagcaacagcgcggagctgtacgccaagaagatctccgagctggactacaagaacaagcgcaagttcttcgagcccttcagcggcttccggcagaaggtcctggacaagatcgacgagatcttcgtgtccaagccggagcgcaagaagcccagcggcgccctgcacgaggagaccttccggaaggaggaggagttctaccagtcctacgggggcaaggagggggtcctcaaggccctggagctgggcaagatccgcaaggtgaacgggaagatcgtgaagaacggcgacatgttccgggtcgacatcttcaagcacaagaagacgaacaagttctacgcggtgcccatctacaccatggacttcgccctcaaggtgctgcccaacaaggccgtcgcccgcagcaagaagggcgagatcaaggactggatcctgatggacgagaactacgagttctgcttctccctctacaaggacagcctgatcctgatccagaccaaggacatgcaggagccggagttcgtgtactacaacgccttcacctccagcacggtgtccctcatcgtcagcaagcacgacaacaagttcgagaccctgtccaagaaccagaagatcctgttcaagaacgcgaacgagaaggaggtgatcgccaagagcatcgggatccagaacctcaaggtgttcgagaagtacatcgtctccgccctgggcgaggtgaccaaggccgagttccggcagcgcgaggacttcaagaagtga

SEQ ID NO: 1402 - RNA, 2955 nt, synthetic construct
  misc_feature 1..2955: note = Cas9 variant
  source 1..2955: mol_type = other RNA
atggcccgcatcctggccttcgacatcggcatcagctccatcgggtgggcgttcagcgagaacgacgagctcaaggactgcggcgtgcggatcttcaccaaggccgagaaccccaagaccggggagtccctggccctgccgcgccggctcgcccgcagcgcccggaagcgcctggcgcggcgcaaggcccggctgaaccacctcaagcacctgatcgccaacgagttcaagctgaactacgaggactaccagtccttcgacgagagcctcgccaaggcgtacaagggctccctgatcagcccctacgagctgcgcttccgggccctcaacgagctgctgtccaagcaggacttcgcccgcgtcatcctccacatcgccaagcggcgcgggtacgacgacatcaagaacagcgacgacaaggagaagggcgccatcctgaaggcgatcaagcagaacgaggagaagctggccaactaccagtccgtgggcgagtacctctacaaggagtacttccagaagttcaaggagaacagcaaggagttcacgaacgtgcggaacaagaaggagtcctacgagcgctgcatcgcccagagcttcctgaaggacgagctgaagctcatcttcaagaagcagcgggagttcgggttctccttcagcaagaagttcgaggaggaggtcctgtccgtggccttctacaagcgcgccctgaaggacttcagccacctcgtgggcaactgctccttcttcaccgacgagaagcgggcgcccaagaacagccccctggccttcatgttcgtcgccctgacccgcatcatcaacctcctgaacaacctgaagaacaccgaggggatcctctacacgaaggacgacctgaacgccctgctcaacgaggtgctgaagaacggcaccctgacctacaagcagaccaagaagctcctggggctgagcgacgactacgagttcaagggcgagaagggcacgtacttcatcgagttcaagaagtacaaggagttcatcaaggccctcggggaccactccctgagccaggacgacctgaacgagatcgcgaaggacatcaccctcatcaaggacgagatcaagctgaagaaggccctggccaagtacgacctcaaccagaaccagatcgactccctgagcaagctggagttcaaggaccacctcaacatctccttcaaggccctgaagctgatcaccccgctgatgctcgagggcaagaagtacgacgaggcctgcaacgagctgaacctgaaggtggcgatcaacgaggacaagaaggacttcctccccgccttcaacgagacctactacaaggacgaggtcacgaaccccgtggtgctgcgggccatcaaggagtaccgcaaggtcctgaacgccctcctgaagaagtacgggaaggtgcacaagatcaacatcgagctggcgcgcgaggtgggcaagaactacagccagcgggccaagatcgagaaggagcagaacgagaactacaaggccaagaaggacgccgagctcgagtgcgagaagctgggcctgaagatcaactccaagaacatcctcaagctgcgcctgttcaaggagcagaaggagttctgcgcctacagcggggagaagatcaagatctccgacctccaggacgagaagatgctggagatcgaccacatctacccctacagccggtccttcgacgacttctacatgaacaaggtcctggtgttcaccaagcagaaccaggagaagctcaaccagaccccgttcgaggcgttcggcaacgacagcgccaagtggcagaagatcgaggtgctggccaagaacctgcccaccaagaagcagaagcgcatcctcgacaagaactacaaggacaaggagcagaaggacttcaaggaccggaacctgaacgacacgcgctacatcgcccggctggtcctcaactacaccaaggactacctggacttcctgcccctctccgacgacgagaacaccaagctgaacgacacccagaaggggagcaaggtgcacgtggaggccaagtccggcatgctgacgagcgcgctccgccacacctgggggttctccgccaaggaccggaacaaccacctccaccacgccatcgacgccgtcatcatcgcctacgcgaacaacagcatcgtgaaggccttctccgacttcaagaaggagcaggagagcaacagcgccgagctgtacgccaagaagatctccgagctggactacaagaacaagcgcaagttcttcgagcccttcagcggcttccggcagaaggtgctggacaagatcgacgagatcttcgtctccaagccggagcgcaagaagcccagcggcgcgctgcacgaggagaccttccggaaggaggaggagttctaccagtcctacgggggcaaggagggggtgctcaaggccctggagctgggcaagatccgcaaggtcaacgggaagatcgtgaagaacggcgacatgttccgggtggacatcttcaagcacaagaagaccaacaagttctacgccgtccccatctacacgatggacttcgccctcaaggtgctgcccaacaaggccgtggcgcgcagcaagaagggcgagatcaaggactggatcctgatggacgagaactacgagttctgcttctccctctacaaggacagcctgatcctgatccagaccaaggacatgcaggagccggagttcgtctactacaacgccttcacctccagcaccgtgtccctcatcgtgagcaagcacgacaacaagttcgagacgctgtccaagaaccagaagatcctgttcaagaacgccaacgagaaggaggtcatcgccaagagcatcgggatccagaacctcaaggtgttcgagaagtacatcgtgtccgccctgggcgaggtcaccaaggcggagttccggcagcgcgaggacttcaagaagtga

SEQ ID NO: 1403 - RNA, 2955 nt, synthetic construct
  misc_feature 1..2955: note = Cas9 variant
  source 1..2955: mol_type = other RNA
atggcccgcatcctggccttcgacatcggcatcagctccatcgggtgggcgttcagcgagaacgacgagctcaaggactgcggcgtgcggatcttcaccaaggccgagaaccccaagaccggggagtccctggccctgccgcgccggctcgcccgcagcgcccggaagcgcctggcgcggcgcaaggcccggctgaaccacctcaagcacctgatcgccaacgagttcaagctgaactacgaggactaccagtccttcgacgagagcctcgccaaggcgtacaagggctccctgatcagcccctacgagctgcgcttccgggccctcaacgagctgctgtccaagcaggacttcgcccgcgtcatcctccacatcgccaagcggcgcgggtacgacgacatcaagaacagcgacgacaaggagaagggcgccatcctgaaggcgatcaagcagaacgaggagaagctggccaactaccagtccgtgggcgagtacctctacaaggagtacttccagaagttcaaggagaacagcaaggagttcacgaacgtgcggaacaagaaggagtcctacgagcgctgcatcgcccagagcttcctgaaggacgagctgaagctcatcttcaagaagcagcgggagttcgggttctccttcagcaagaagttcgaggaggaggtcctgtccgtggccttctacaagcgcgccctgaaggacttcagccacctcgtgggcaactgctccttcttcaccgacgagaagcgggcgcccaagaacagccccctggccttcatgttcgtcgccctgacccgcatcatcaacctcctgaacaacctgaagaacaccgaggggatcctctacacgaaggacgacctgaacgccctgctcaacgagttcctgaagaacggcaccctgacctacaagcagaccaagaagctcctggggctgagcgacgactacgagttcaagggcgagaagggcacgtacttcatcgagttcaagaagtacaaggagttcatcaaggccctcggggagcacaacctgtcccaggacgacctgaacgagatcgcgaaggacatcaccctcatcaaggacgagatcaagctgaagaaggccctggccaagtacgacctcaaccagaaccagatcgacagcctgtccaagctggagttcaaggaccacctcaacatcagcttcaaggccctgaagctgatcaccccgctgatgctcgagggcaagaagtacgacgaggcctgcaacgagctgaacctgaagatcgcgatcaacgaggacaagaaggacttcctccccgccttcaacgagacctactacaaggacgaggtgacgaaccccgtggtcctgcgggccatcaaggagtaccgcaaggtgctgaacgccctcctgaagaagtacgggaaggtgcacaagatcaacatcgagctggcgcgcgaggtcggcaagaaccactcccagcgggccaagatcgagaaggagcagaacgagaactacaaggccaagaaggacgccgagctcgagtgcgagaagctgggcctgaagatcaacagcaagaacatcctcaagctgcgcctgttcaaggagcagaaggagttctgcgcctactccggggagaagatcaagatcagcgacctccaggacgagaagatgctggagatcgaccacatctacccctactcccggagcttcgacgactcctacatgaacaaggtgctggtgttcaccaagcagaaccaggagaagctcaaccagaccccgttcgaggcgttcggcaacgacagcgccaagtggcagaagatcgaggtcctggccaagaacctgcccaccaagaagcagaagcgcatcctcgacaagaactacaaggacaaggagcagaagaacttcaaggaccggaacctgaacgacacgcgctacatcgcccggctggtgctcaactacaccaaggactacctggacttcctgcccctctccgacgacgagaacaccaagctgaacgacacccagaaggggagcaaggtgcacgtcgaggccaagtccggcatgctgacgagcgcgctccgccacacctgggggttctccgccaaggaccggaacaaccacctccaccacgccatcgacgccgtgatcatcgcctacgcgaacaacagcatcgtgaaggccttctccgacttcaagaaggagcaggagagcaacagcgccgagctgtacgccaagaagatctccgagctggactacaagaacaagcgcaagttcttcgagcccttcagcggcttccggcagaaggtcctggacaagatcgacgagatcttcgtgtccaagccggagcgcaagaagcccagcggcgcgctgcacgaggagaccttccggaaggaggaggagttctaccagtcctacgggggcaaggagggggtgctcaaggccctggagctgggcaagatccgcaaggtcaacgggaagatcgtgaagaacggcgacatgttccgggtcgacatcttcaagcacaagaagaccaacaagttctacgccgtgcccatctacacgatggacttcgccctcaaggtgctgcccaacaaggccgtcgcgcgcagcaagaagggcgagatcaaggactggatcctgatggacgagaactacgagttctgcttctccctctacaaggacagcctgatcctgatccagaccaaggacatgcaggagccggagttcgtgtactacaacgccttcacctccagcaccgtgtccctcatcgtcagcaagcacgacaacaagttcgagacgctgtccaagaaccagaagatcctgttcaagaacgccaacgagaaggaggtgatcgccaagagcatcgggatccagaacctcaaggtgttcgagaagtacatcgtctccgccctgggcgaggtgaccaaggcggagttccggcagcgcgaggacttcaagaagtga

SEQ ID NO: 1404 - RNA, 2955 nt, synthetic construct
  misc_feature 1..2955: note = Cas9 variant
  source 1..2955: mol_type = other RNA
atggtgcgcatcctggccttcgacatcggcatcagctccatcgggtgggccttcagcgagaacgacgagctcaaggactgcggcgtccggatcttcaccaaggtggagaaccccaagaccggggagtccctggcgctgccgcgccggctcgcccgcagcgcccggaagcgcctggcccggcgcaaggcccggctgaaccacctcaagcacctgatcgcgaacgagttcaagctgaactacgaggactaccagtccttcgacgagagcctcgccaaggcctacaagggctccctgatcagcccctacgagctgcgcttccgggccctcaacgagctgctgtccaagcaggacttcgcgcgcgtgatcctccacatcgccaagcggcgcgggtacgacgacatcaagaacagcgacgacaaggagaagggcgccatcctgaaggccatcaagcagaacgaggagaagctggccaactaccagtccgtcggcgagtacctctacaaggagtacttccagaagttcaaggagaacagcaaggagttcacgaacgtgcggaacaagaaggagtcctacgagcgctgcatcgcgcagagcttcctgaaggacgagctgaagctcatcttcaagaagcagcgggagttcgggttctccttcagcaagaagttcgaggaggaggtgctgtccgtcgccttctacaagcgcgccctgaaggacttcagccacctcgtgggcaactgctccttcttcaccgacgagaagcgggcccccaagaacagccccctggccttcatgttcgtggcgctgacccgcatcatcaacctcctgaacaacctgaagaacaccgaggggatcctctacacgaaggacgacctgaacgccctgctcaacgaggtcctgaagaacggcaccctgacctacaagcagaccaagaagctcctggggctgagcgacgactacgagttcaagggcgagaagggcacgtacttcatcgagttcaagaagtacaaggagttcatcaaggccctcggggagcacaacctgtcccaggacgacctgaacgagatcgccaaggacatcaccctcatcaaggacgagatcaagctgaagaaggccctggcgaagtacgacctcaaccagaaccagatcgacagcctgtccaagctggagttcaaggaccacctcaacatcagcttcaaggccctgaagctgatcaccccgctgatgctcgagggcaagaagtacgacgaggcctgcaacgagctgaacctgaaggtggccatcaacgaggacaagaaggacttcctccccgccttcaacgagacctactacaaggacgaggtgacgaaccccgtcgtgctgcgggcgatcaaggagtaccgcaaggtgctgaacgccctcctgaagaagtacgggaaggtccacaagatcaacatcgagctggcccgcgaggtgggcaagaaccactcccagcgggccaagatcgagaaggagcagaacgagaactacaaggcgaagaaggacgccgagctcgagtgcgagaagctgggcctgaagatcaacagcaagaacatcctcaagctgcgcctgttcaaggagcagaaggagttctgcgcctactccggggagaagatcaagatcagcgacctccaggacgagaagatgctggagatcgaccacatctacccctactcccggagcttcgacgactcctacatgaacaaggtgctggtcttcaccaagcagaaccaggagaagctcaacaagaccccgttcgaggccttcggcaacgacagcgccaagtggcagaagatcgaggtgctggcgaagaacctgcccaccaagaagcagaagcgcatcctcgacaagaactacaaggacaaggagcagaaggacttcaaggaccggaacctgaacgacacgcgctacatcgcccggctggtgctcaactacaccaaggactacctggacttcctgcccctctccgacgacgagaacaccaagctgaacgacacccagaaggggagcaaggtccacgtggaggccaagtccggcatgctgacgagcgccctccgccacacctgggggttctccaccaaggaccggaacaaccacctccaccacgccatcgacgcggtgatcatcgcctacgccaacaacagcatcgtcaaggccttctccgacttcaagaaggagcaggagagcaacagcgccgagctgtacgcgaagaagatctccgagctggactacaagaacaagcgcaagttcttcgagcccttcagcggcttccggcagaaggtgctggacaagatcgacgagatcttcgtctccaagccggagcgcaagaagcccagcggcgccctgcacgaggagaccttccggaaggaggaggagttctaccagtcctacgggggcaaggagggggtgctcaaggccctggagctgggcaagatccgcaaggtgaacgggaagatcgtcaagaacggcgacatgttccgggtggacatcttcaagcacaagaagacgaacaagttctacgccgtgcccatctacaccatggacttcgcgctcaaggtcctgcccaacaaggccgtggcccgcagcaagaagggcgagatcaaggactggatcctgatggacgagaactacgagttctgcttctccctctacaaggacagcctgatcctgatccagaccaaggacatgcaggagccggagttcgtgtactacaacgccttcacctccagcacggtctccctcatcgtgagcaagcacgacaacaagttcgagaccctgtccaagaaccagaagatcctgttcaagaacgccaacgagaaggaggtgatcgccaagagcatcgggatccagaacctcaaggtcttcgagaagtacatcgtgtccgcgctgggcgaggtgaccaaggccgagttccggcagcgcgaggacttcaagaagtga

SEQ ID NO: 1405 - RNA, 2955 nt, synthetic construct
  misc_feature 1..2955: note = Cas9 variant
  source 1..2955: mol_type = other RNA
atggcccgcatcctggccttcgacatcggcatcagctccatcgggtgggcgttcagcgagaacgacgagctcaaggactgcggcgtgcggatcttcaccaaggccgagaaccccaagaccggggagtccctggccctgccgcgccggctcgcccgcagcgcccggaagcgcctggcgcggcgcaaggcccggctgaaccacctcaagcacctgatcgccaacgagttcaagctgaactacgaggactaccagtccttcgacgagagcctcgccaaggcgtacaagggctccctgatcagcccctacgagctgcgcttccgggccctcaacgagctgctgtccaagcaggacttcgcccgcgtcatcctccacatcgccaagcggcgcgggtacgacgacatcaagaacagcgacgacaaggagaagggcgccatcctgaaggcgatcaagcagaacgaggagaagctggccaactaccagtccgtgggcgagtacctctacaaggagtacttccagaagttcaaggagaacagcaaggagttcacgaacgtgcggaacaagaaggagtcctacgagcgctgcatcgcccagagcttcctgaaggacgagctgaagctcatcttcaagaagcagcgggagttcgggttctccttcagcaagaagttcgaggaggaggtcctgtccgtggccttctacaagcgcgccctgaaggacttcagccacctcgtgggcaactgctccttcttcaccgacgagaagcgggcgcccaagaacagccccctggccttcatgttcgtcgccctgacccgcatcatcaacctcctgaacaacctgaagaacaccgaggggatcctctacacgaaggacgacctgaacgccctgctcaacgaggtgctgaagaacggcaccctgacctacaagcagaccaagaagctcctggggctgagcgacgactacgagttcaagggcgagaagggcacgtacttcatcgagttcaagaagtacaaggagttcatcaaggccctcggggaccactccctgagccaggacgacctgaacgagatcgcgaaggacatcaccctcatcaaggacgagatcaagctgaagaaggccctggccaagtacgacctcaaccagaaccagatcgactccctgagcaagctggagttcaaggaccacctcaacatctccttcaaggccctgaagctgatcaccccgctgatgctcgagggcaagaagtacgacgaggcctgcaacgagctgaacctgaaggtggcgatcaacgaggacaagaaggacttcctccccgccttcaacgagacctactacaaggacgaggtcacgaaccccgtggtgctgcgggccatcaaggagtaccgcaaggtcctgaacgccctcctgaagaagtacgggaaggtgcacaagatcaacatcgagctggcgcgcgaggtgggcaagaactacagccagcgggccaagatcgagaaggagcagaacgagaactacaaggccaagaaggacgccgagctcgagtgcgagaagctgggcctgaagatcaactccaagaacatcctcaagctgcgcctgttcaaggagcagaaggagttctgcgcctacagcggggagaagatcaagatctccgacctccaggacgagaagatgctggagatcgaccacatctacccctacagccggtccttcgacgacagctacatgaacaaggtcctggtgttcaccaagcagaaccaggagaagctcaaccagaccccgttcgaggcgttcggcaacgactccgccaagtggcagaagatcgaggtgctggccaagaacctgcccaccaagaagcagaagcgcatcctcgacaagaactacaaggacaaggagcagaaggacttcaaggaccggaacctgaacgacacgcgctacatcgcccggctggtcctcaactacaccaaggactacctggacttcctgcccctcagcgacgacgagaacaccaagctgaacgacacccagaaggggtccaaggtgcacgtggaggccaagagcggcatgctgacgtccgcgctccgccacacctgggggttcagcgccaaggaccggaacaaccacctccaccacgccatcgacgccgtcatcatcgcctacgcgaacaactccatcgtgaaggccttcagcgacttcaagaaggagcaggagagcaactccgccgagctgtacgccaagaagatcagcgagctggactacaagaacaagcgcaagttcttcgagcccttctccggcttccggcagaaggtgctggacaagatcgacgagatcttcgtcagcaagccggagcgcaagaagccctccggcgcgctgcacgaggagaccttccggaaggaggaggagttctaccagagctacgggggcaaggagggggtgctcaaggccctggagctgggcaagatccgcaaggtcaacgggaagatcgtgaagaacggcgacatgttccgggtggacatcttcaagcacaagaagaccaacaagttctacgccgtccccatctacacgatggacttcgccctcaaggtgctgcccaacaaggccgtggcgcgctccaagaagggcgagatcaaggactggatcctgatggacgagaactacgagttctgcttcagcctctacaaggactccctgatcctgatccagaccaaggacatgcaggagccggagttcgtctactacaacgccttcaccagctccaccgtgagcctcatcgtgtccaagcacgacaacaagttcgagacgctgagcaagaaccagaagatcctgttcaagaacgccaacgagaaggaggtcatcgccaagtccatcgggatccagaacctcaaggtgttcgagaagtacatcgtgagcgccctgggcgaggtcaccaaggcggagttccggcagcgcgaggacttcaagaagtga

SEQ ID NO: 1406 - RNA, 2958 nt, synthetic construct
  misc_feature 1..2958: note = Cas9 variant
  source 1..2958: mol_type = other RNA
atggccaagatcctggccttcgacatcggcatcagctccatcgggtgggcgttcgtggagaacgacgagctcaaggactgcggcgtccgcatcttcaccaaggccgagaaccccaagaccggggagagcctggccctgccgcggcgcctcgcccggtccgcccgcaagcggctggcgcgccggaaggcccgcctgaaccacctcaagcacctgatcgccaacgagttcaagctgaactacgaggactaccagagcttcgacgagtccctcgccaaggcgtacaagggcacgctgatcagcccctacgagctgcggttcaaggccctcaacgagctgctgtccaagcaggacctcgcccgcgtgatcctgcacatcgccaagcggcgcgggtacgacaacatcaagaacagcgacgacaaggagaagggcgccatcctgaaggcggtgaaggagaacgaggagaagctcgccaactacaagtccgtcggcgagtacctgtacaaggagtacttccagaagttcaaggagaacagcaaggagttcatcaacgtgcggaacaagaaggagtcctacgagcgctgcatcgcccagagcttcctgaaggacgagctcaagctgatcttccagaagcagcgggagttcgggttcaacttctccaagaagttcgaggaggaggtgctgagcgtcgccttctacaagcgcgccctcaaggacttctcccacctggtgggcaactgcagcttcttcgtggacgagaagcgggcgcccaagaacagccccctggccttcgagttcgtcgccctcacccgcatcgtgaacctgctgaacaacctcaacaagaacaacagctacatcaaggacgacctgaacgccctgctctccgaggtgctgaagaacgggaccctgacctacaagcagacgaagaagatcctcggcctgagcgacgactacgagttcaaggggcagaagggcaactacttcatcgagttcaagaagtacaaggagttcatcaaggccctgtgcgagcacaacctcaaccaggacgacctgaacgagatcgcgaaggacatcaccctggtcaaggacgagaccaagctcaagaaggccctggccaagtacgacctgaaccagaaccagatcgagaacctcagcaagatcgagttcaaggaccacctgaacatctccttcaaggccctgaagctcatcgtgccgctgatgcgggagggcaagaagtacgacgaggtgtgcaacgagctgaacctgaagaccgccatcaacgaggacaagaaggagttcctccccgcgttcaacgagacgtactacaaggacgaggtcaacaaccccgtggtgctgcgcgccatcaaggagtaccggaaggtcctgaacagcctcctgaagaagtacgggaaggtgcacaagatcaacatcgagctggcccgcgaggtgggcaagaaccaccgcgagcggtccaagatcgagaaggagcagaacgagaacttcaaggccaagaaggacgcggagctcgagtgcgagaagctggggctgaagatcaacagcaagaacatcctcaagctgcgcctgttcaaggagcagaaggagttctgcgtctactccggcgagaagatcaagatcagcgacctccaggacgagaagatgctggagatcgaccacatctacccctactcccggagcttcgacgactcctacatgaacaaggtgctggtgttcaccaagcagaaccaggagaagctcaacaagaccccgttcgaggccttcggcaaggacgacgtcaagtggcagaagatcgagaccctggccaagaacctgcccgccaagaagcagaagcgcatcctcgacaagaactacaaggacaaggagcagaaggacttcaaggaccggaacctgaacgacacgcgctacatcgcccggctggtgctcaactacaccaaggactacctggagttcctgcccctcagcgacgacgagaacatcaagctgaacgacacccagaaggggtccaaggtccacgtggaggcgaagtccggcatgctgacctccgtgctccgccacacgtgggggttcagcaccaaggaccggaacaaccacctccaccacgccatcgacgccgtcatcatcgcctacgccaacgcgtccgtggtgaaggccttcagcgacttcaagaaggagcaggagaactacaccgccgagctgtacgccaagaagatcaacgagctggacttcaagaacaagcgcaagttcttcgagcccttctccaacttccggcagaaggtcctggagaagatcgacgagatcttcgtgagcaagccggagcgcaagaagccctccggcgccctgcacgaggagaccttctacaaggaggaggagttctacaaggagtacgggggcaaggagggcgtgctcaaggcgctggagctggggaagatccggaaggtcaacggcaagatcgtgagcaacgccaacatgttccgcgtggacatcttcaagtacaagaagacgaacaagttctacgccgtccccatctacaccatggacttcgccctcgggatcctgcccaacaaggcggtggtgggcgggaaggacaagcagggcatcatcaaggactggctgctcatggacgagaactacgagttctgcttcagcctgtacaaggactccctgatcctcctgcagaccaaggacatgcaggagccggagctggtctacttcaagagcttcaagtccagcaccgccggcctcgtggtgtccaagcacgacaacaagttcgagaacctgaacgagaaccagaagaagctgttcaagagcgccaacgagaagaaggtcgtggccgaggggatcggcatccagaacctcaaggtgttcgagaagtacatcgtctccgccctgggggagatcacgaaggcggagatcaaggagcgggagaacttcaagaagaagtga

SEQ ID NO: 1407 - RNA, 2961 nt, synthetic construct
  misc_feature 1..2961: note = Cas9 variant
  source 1..2961: mol_type = other RNA
atgcccagcgacccggccgaggccaagcccctggagctcctggacccctacgcgctgcgcgcccagggcctcgaccaggccctgcccctgacccacttcgggcgggccctcttccacctgaaccagcgccggggcttcaagtccaaccgcaagaccgaccgcggggacaacgagaacggcaagatcaaggacgccagccagcggctggactgggcgatgcacgaggccaaggcccggacgtacggggagttcctccacctccgccggcagaaggccccggacccccgccaggtgcccaccgtccggacccgcctgtccgtgggcaagcggggcgggcccgacgcgaaggaggaggccggctacgacttctacccggaccgccggcacctggaggaggagttccacgagctgtggagcgcccaggcccagttccaccccgagctgacccaggacctccgcgacctggtgttcgagaagatcttctaccagcggcccctgaaggagcccaaggtcgggctctgcctgttcacgtccgaggagcgcctggccaaggcgcacccgctcacccagcggcgcgtgctgtacgagaccgtgaaccagctgcggatcaccgccgacggccgcagcgtccgccccctctcccgggagcagcgcgaccagatcatcctggccctggacacgaagaagcccaccaagagcctcaactccatggtggtgaccctgcaggccctggggaaggtcctcaagctgcgggagggcgagcgcttcaccctggagagcggcgtgcgggaggccatcgcgtgcgaccccgtgcgcgccgccatgctcgccacgttcgggccgcggtggtccgccctggactggcccgagcagtggcaggtcatcagccgcgtgcggaagctgcaggacgacaaggacttcgcggagctcgtggagtggctgatcgagctgtacggcgtcgacaaggaggccgccgtgaagatcgccaacacccacctccccgaggggtacggccgcctgggcctgaccgccaccacgcggatcctcgaccgcctgaagtccaacgtgttcacctacgcgcaggccgtcgccgcctgcgggtggcaccacagcgaccagcggaccggcgagtgcctggaccgcctcccctactacggggcggtgctggaccggcacgtgatcccgggcacctacgacgagaacgacgacgacatcacgcgcttcgggcggatcaccaaccccaccgtccacatcggcctgaaccagctccgccggctggtgaacaagatcatcgaggtgtacggcaagcccaaccagatcgtcgtggagctggcccgcgagctgaagcagtccgagcagcagaagaacgacgccatcaagctcatccgcgacaccacgaccgccgccaagcagcggagcgagaagctggaggagctggggatcaccgacaacggccgcaaccggatgctcctgcgcctgtgggaggacctcaaccccgacgacgcgatgcggcgcttctgcccgtacaccgggcagcggatctccgccgccatgatcttcgacggcagctgcgacgtcgaccacatcctgccctactcccgcacgctggacgacgggttcgccaaccggaccctctgcctgcgcgaggccaaccgggagaagcgcaaccagaccccctgggaggcgtggggcggcacccccaactgggaggccatcgagacgaacctgaagaacctcccggagaacaagcggtggcgcttcgcccccgacgccatggcccggttcgagggggagaacgacttcctggaccgcgcgctggtggacacccagtacctcgcccggatcagccgcacctacctggacaccctgttcacggagggcgggcacgtgtgggtcgtgcccggccggctcaccgagatgctgcgccggcactgggggctgaacagcctcctgaccgacaaggaccgcggcgccgtgaagtccaagaaccgcaccgaccaccggcaccacagcatcgacgccgcggtcgtggccgccaccgaccgctccctgctcaaccggatcagccgcgccgccggccagggggaggtggcgggccagtccgccgagctgatcgcccgggagacgccgccgccctgggaggggttccgcaacgacctcaagagccagctgggccggatcatcgtctcccaccgcgccgaccacggccggatcgaccgccaggcccggaagcaggggcgcgacagcaccgcgggccagctgcaccaggagaccgcctactccatcgtggacgacacccgggtggccagccgcatcgacttcctgtccgtcaagcccgcccagctcctggaccagcccgggcggagcggccaggtgcgcgacctgcagctccggaaggccctgcgcgtggcgacgggggacctgaccggcaaggactacgagaaggccctccgggacttcgccgccaagcccggcccctacaaggggatccgccgcgtccggatcatcaagcccctgcaggagcaggcgcgcgtgccggtgcccgtcctggaccccatcaaggcctaccagggcgggtccaaccacgtgttcgagatctggcacctccccgacggcaaggtggagccgcaggtcatcaccagcttcgaggcccacgccctggaggtggagaagcggccccaccccgccgcgaagcgcctgctccgggtgcacaagggggacatggtcgccctgaagcgcgagggccggaccgtggtgggccacgtccagcagatgcacatcaagaacgggctgttcatcgtgccccacaacgaggccaacgccgacgcccgcaactccgaccggacggacccgttcaagtggatccagatcgcggcccagcccgccatcgccgccggcatccgccgggtggcggtcgacgagatcgggcgcctccgggacggcggggccaagaccatctga

SEQ ID NO: 1408 - RNA, 2964 nt, synthetic construct
  misc_feature 1..2964: note = Cas9 variant
  source 1..2964: mol_type = other RNA
atggcccgcatcctggccttcgacatcggcatcagctccatcgggtgggcgttcagcgagaacgacgagctcaaggactgcggcgtgcggatcttcaccaaggccgagaaccccaagaccggggagtccctggccctgccgcgccggctcagccgctccgcccggaagcgcctggcccggcgcaaggcgcggctgaaccacctcaagcacctgatcgccaacgagttcaagctgaactacgaggactaccagagcttcgacgagtccctcgccaaggcctacaagggcagcctgatctccccctacgagctgcgcttccgggcgctcaacgagttcctgagcaagcaggacttcgcccgcgtcatcctgcacatcgccaagcggcgcgggtacgacgacatcaagaacaacggcgacgaggagaagggcgagatcctcaaggccatcaagcagaacgaggagaagctggtgtcctaccagagcgtgggggagtacctgtacaaggagtacttccagaagttcaaggagaactccaaggagttcatcaacgtccggaacaagaaggagagctacgagcgctgcatcgcccagtccttcctcaaggacgagctgaagctgatcttccagaagcagcgggagttcggcttcagcttctccaagaagttcgaggaggaggtgctcagcgtggcgttctacaagcgcgccctgaaggacttctcccacctggtcgggaactgcagcttcttcacggacgagaagcgggcccccaagaacagccccctcgccttcatgttcgtggccctgacccgcatcatcaacctgctcaacaacctgaagaacaccgagggcatcctgtacaccaaggacgacctcaacacgctgctgaacgaggtgctcaagaacgggaccctgacctacaagcagaccaagaagctgctcggcctgtccaacgactacgagttcaagggcgagaaggggacgtacttcatcgagttccagaagtacaaggagttcgtcaaggcgctgggcgagcacaacctcagccaggacgacctgaacgagatcgccaaggacatcaccctgatcaaggacgagatcaagctcaagaaggccctggccaagtacgacctgaaccagaaccagatcgactccctcagcaagctggagttcaaggaccacctgaacatctccttcaaggccctcaagctgatcaccccgctgatgctggaggggaagaagtacgacgaggcgtgcaacgagctcaacctgaaggtggccatcaacgaggacaagaaggacttcctgcccgccttcaacgagacctactacaaggacgaggtgacgaaccccgtcgtgctccgggccatcaaggagtaccgcaaggtgctgaacgccctgctcaagaagtacggcaaggtccacaagatcaacatcgagctggcgcgcgaggtgggcaagaaccacagccagcgggccaagatcgagaaggagcagaacgagaactacaaggccaagaaggacgccgagctggagtgcgagaagctcgggctgaagatcaactccaagaacatcctgaagctccgcctgttcaaggagcagaaggagttctgcgtgtacagcggcgagaagatcaagatctccgacctgcaggacgagaagatgctcgagatcgaccacatctacccctacagccggtccttcgacgacagctacatgaacaaggtcctggtgttcaccaagcagaaccaggagaagctgaacaagaccccgttcgagaccttcgggaacgaccgcgtgaagtggcagaagatcgaggtcctcgcgaagaacctgcccacgaagaagcagaagcggatcctggacaagaactacaaggacaaggagcagaaggacttcaaggaccgcaacctcaacgacacccggtacatcgcccgcctggtgctgaactacaccaaggactacctcgacttcctgcccctgtccgacgacgagaacaccaagctcaacgacacgcagaagggcagcaaggtgcacgtcgaggccaagtccgggatgctgaccagcaccctgcggcacacctggggcttctccacgaaggaccgcgacaaccacctccaccacgccatcgacgccgcgatcatcgcctacgccaacaacagcatcgtgaaggccttctccgacttcaagaaggagcaggagagcaacaccgccgagctgtacgcgaagaagatcagcgagctggactacaagaacaagcggaagttcttcgagcccttctccggcttccgccagaagctcctggacaagatcgacgagatcttcgtcagcaagccggagcggaagaagccctccggggccctgcacgaggagaccttccgcaaggaggaggagttctaccagagctacggcgggaaggagggcgtgctcaaggccctggagctggggaagatccggaaggtgaacggcaagatggtcaagaacggcgacatgttccgcgtggacatcttcaagcacaagaagaccaacaagttctacgccgtgcccatctacacgatggacttcgccctcaaggtcctgcccaacaaggcggtggtgcaggggaaggacaagaagtccggcctgatcaaggactggatcctcatggacgagaactacgagttctgcttcagcctgtacaaggactccctgatcctcatccagaccaaggacatgcaggagccggagctggtctactacgagcggctggacagctccaacgccagcctcaccgtgtccaagcacgacaacaagttcgagaccctgagcaagaaccagaagatcctgttcaagaacgccaacgagaaggaggtgatcgccaagtccatcgggatccagaacctcaaggtcttcgagaagtacatcgtgagcgcgctgggcgaggtgacgaaggccgagttccgccagcgggaggacttcaagaagtga

SEQ ID NO: 1409 - RNA, 2964 nt, synthetic construct
  misc_feature 1..2964: note = Cas9 variant
  source 1..2964: mol_type = other RNA
atggcccgcatcctggccttcgacatcggcatcagctccatcgggtgggcgttcagcgagaacgacgagctcaaggactgcggcgtgcggatcttcaccaaggccgagaaccccaagaccggggagtccctggccctgccgcgccggctcgcccgcagcgcccggaagcgcctggcgcggcgcaaggcccggctgaaccacctcaagcacctgatcgccaacgagttcaagctgaactacgaggactaccagtccttcgacgagagcctcgccaaggcgtacaagggctccctgatcagcccctacgagctgcgcttccgggccctcaacgagctgctgtccaagcaggacttcgcccgcgtcatcctccacatcgccaagcggcgcgggtacgacgacatcaagaacagcgacgacaaggagaagggcgccatcctgaaggcgatcaagcagaacgaggagaagctggccaactaccagtccgtgggcgagtacctctacaaggagtacttccagaagttcaaggagaacagcaaggagttcacgaacgtgcggaacaagaaggagtcctacgagcgctgcatcgcccagagcttcctgaaggacgagctgaagctcatcttcaagaagcagcgggagttcgggttctccttcagcaagaagttcgaggaggaggtcctgtccgtggccttctacaagcgcgccctgaaggacttcagccacctcgtgggcaactgctccttcttcaccgacgagaagcgggcgcccaagaacagccccctggccttcatgttcgtcgccctgacccgcatcatcaacctcctgaacaacctgaagaacaccgaggggatcctctacacgaaggacgacctgaacgccctgctcaacgaggtgctgaagaacggcaccctgacctacaagcagaccaagaagctcctggggctgagcgacgactacgagttcaagggcgagaagggcacgtacttcatcgagttcaagaagtacaaggagttcatcaaggccctcggggaccactccctgagccaggacgacctgaacgagatcgcgaaggacatcaccctcatcaaggacgagatcaagctgaagaaggccctggccaagtacgacctcaaccagaaccagatcgactccctgagcaagctggagttcaaggaccacctcaacatctccttcaaggccctgaagctgatcaccccgctgatgctcgagggcaagaagtacgacgaggcctgcaacgagctgaacctgaaggtggcgatcaacgaggacaagaaggacttcctccccgccttcaacgagacctactacaaggacgaggtcacgaaccccgtggtgctgcgggccatcaaggagtaccgcaaggtcctgaacgccctcctgaagaagtacgggaaggtgcacaagatcaacatcgagctggcgcgcgaggtgggcaagaactacagccagcgggccaagatcgagaaggagcagaacgagaactacaaggccaagaaggacgccgagctcgagtgcgagaagctgggcctgaagatcaactccaagaacatcctcaagctgcgcctgttcaaggagcagaaggagttctgcgcctacagcggggagaagatcaagatctccgacctccaggacgagaagatgctggagatcgaccacatctacccctacagccggtccttcgacgacagctacatgaacaaggtcctggtgttcaccaagcagaaccaggagaagctcaaccagaccccgttcgaggcgttcggcaacgactccgccaagtggcagaagatcgaggtgctggccaagaacctgcccaccaagaagcagaagcgcatcctcgacaagaactacaaggacaaggagcagaaggacttcaaggaccggaacctgaacgacacgcgctacatcgcccggctggtcctcaactacaccaaggactacctggacttcctgcccctcagcgacgacgagaacaccaagctgaacgacacccagaaggggtccaaggtgcacgtggaggccaagagcggcatgctgacgtccgcgctccgccacacctgggggttcagcgccaaggaccggaacaaccacctccaccacgccatcgacgccgtcatcatcgcctacgcgaacaactccatcgtgaaggccttcagcgacttcaagaaggagcaggagagcaactccgccgagctgtacgccaagaagatcagcgagctggactacaagaacaagcgcaagttcttcgagcccttctccggcttccggcagaaggtgctggacaagatcgacgagatcttcgtcagcaagccggagcgcaagaagccctccggcgcgctgcacgaggagaccttccggaaggaggaggagttctaccagagctacgggggcaaggagggggtgctcaaggccctggagctgggcaagatccgcaaggtcaacgggaagatcgtgaagaacggcgacatgttccgggtggacatcttcaagcacaagaagaccaacaagttctacgccgtccccatctacacgatggacttcgccctcaaggtgctgcccaacaaggccgtggcgcgctccaagaagggcgagatcaaggactggatcctgatggacgagaactacgagttctgcttcagcctctacaaggactccctgatcctgatccagaccaaggacatgcaggagccggagctcgtctacttcaacgccttcaccagctccaccgtgagcctgatcgtgtccaagcacgacaacaagttcgagacgctgagcaagaaccagaagatcctcttcaagaacgccaacgagaaggaggtcatcgccaagtccatcgggatccagaacctgaaggtgttcgagaagtacatcgtgagcgccctgggcgaggtcaccaaggcggagttccggcagcgcgaggacttcaagaacgagctccggtga

SEQ ID NO: 1410 - RNA, 2964 nt, synthetic construct
  misc_feature 1..2964: note = Cas9 variant
  source 1..2964: mol_type = other RNA
atggcccgcatcctggccttcgacatcggcatcagctccatcgggtgggcgttcagcgagaacgacgagctcaaggactgcggcgtgcggatcttcaccaaggccgagaaccccaagaccggggagtccctggccctgccgcgccggctcgcccgcagcgcccggaagcgcctggcgcggcgcaaggcccggctgaaccacctcaagcacctgatcgccaacgagttcaagctgaactacgaggactaccagtccttcgacgagagcctcgccaaggcgtacaagggctccctgatcagcccctacgagctgcgcttccgggccctcaacgagctgctgtccaagcaggacttcgcccgcgtcatcctccacatcgccaagcggcgcgggtacgacgacatcaagaacaacggcgacgaggagaagtccgagatcctgaaggccatcaagcagaacgaggagaagctggtgaactaccagagcgtgggcgagtacctctacaaggagtacttccagaagttcaaggagaacagcaaggagttcatcaacgtccggaacaagaaggagtcctacgagcgctgcatcgcgcagagcttcctgaaggacgagctgaagctcatcttccagaagcagcgggagttcgggttctccttcagcaagaagttcgaggaggaggtgctgtccgtggccttctacaagcgcgccctgaaggacttcagccacctcgtcggcaactgctccttcttcacggacgagaagcgggcccccaagaacagccccctggtgttcatgttcgtggccctgacccgcatcatcaacctcctgaacaacctgaagaacaccgaggggatcctctacaccaaggacgacctgaacgcgctgctcaacgaggtcctgaagaacggcacgctgacctacaagcagaccaagaagctcctggggctgagcgacgactacgagttcaagggcgagaagggcacctacttcatcgagttcaagaagtacaaggagttcatcaaggccctcgacgagcactccctgagccaggacgacctgaacgagatcgccaaggacatcacgctcatcaaggacgagatcaagctgaagaaggccctggccaagtacgacctcaaggagaaccagatcgactccctgagcaagctggagttcaaggaccacctcaacatctccttcaaggcgctgaagctgatcaccccgctgatgctcgaggggaagaagtacgacgaggcctgcaacgagctgaacctgaaggtggccatcaacgaggacaagaaggacttcctccccgccttcaacgagacctactacaaggacgaggtgaccaaccccgtcgtgctgcgggccatcaaggagtaccgcaagatcctgaacgcgctcctgaagaagtacggcaaggtgcacaagatcaacatcgagctggcccgcgaggtcgggaagaaccacagccagcgggccaagatcgagaaggagcagaacgagaactacaaggccaagaaggacgcggagctcgagtgcgagaagctgggcctgaagatcaactccaagaacatcctcaagctgcgcctgttcaaggagcagaaggagttctgcgtgtacagcggcgagaagatcaagctctccgacctgcaggacgagaagatgctggagatcgaccacatctacccctacagccggtccttcgacgacagctacatgaacaaggtgctcgtcttcgccaagcagaaccaggagaagctgaacaagacgccgttcgaggccttcgggaacgactccaccaagtggcagaagatcgaggtgctgaccaagaacctccccaccaagaagcagaagcgcatcctggacaagaactacaaggacaaggagcagaaggacttcaaggaccggaacctgaacgacacgcgctacatcgcccggctcgtgctgaactacaccaaggactacctggacttcctccccctgagcgacgacgagaacaccaagctgaacgacacccagaagggctccaaggtccacgtggaggccaagagcgggatgctcacgtccgcgctgcgccacacctggggcttcagcaccaaggaccggaacaaccacctccaccacgccatcgacgccgtgatcatcgcctacgccaacaactccatcgtcaaggcgttcagcgacttcaagaaggagcaggagagcaactccgccgagctgtacgccaagaagatcagcgagctggactacaagaacaagcgcaagttcttcgagcccttctccgggttccggcagaaggtgctggacaagatcgacgagatcttcgtcagcaagccggagcgcaagaagccctccggcgccctccacgaggagaccttccggaaggaggaggagttctaccagagctacggcgggaaggagggcgtgctgaaggccctggagctcgggaagatccgcaaggtgaacggcaagatcgtcaagaacggggacatgttccgggtggacatcttcaagcacaagaagacgaacaagttctacgcggtgcccatctacaccatggacttcgccctgaaggtcctgcccaacaaggccgtggcccgctccaagaagggcgagatcaaggactggatcctcatggacgagaactacgagttctgcttcagcctgtacaaggactccctgatcctcatccagaccaaggacatgcaggagccggagctggtgtacttcaacgcgttcaccagctccacggtcagcctgatcgtgtccaagcacgacaacaagttcgagaccctcagcaagaaccagaagatcctgttcaagaacgccaacgagaaggaggtgatcgccaagtccatcggcatccagaacctgaaggtcttcgagaagtacatcgtgagcgccctcggggaggtgaccaaggccgagttccggcagcgcgaggacttcaagaacgagctgcggtga

SEQ ID NO: 1411 - RNA, 2964 nt, synthetic construct
  misc_feature 1..2964: note = Cas9 variant
  source 1..2964: mol_type = other RNA
atggcccgcatcctggccttcgacatcggcatcagctccatcgggtgggcgttcagcgagaacgacgagctcaaggactgcggcgtgcggatcttcaccaaggccgagaaccccaagaccggggagtccctggccctgccgcgccggctcgcccgcagcgcccggaagcgcctggcgcggcgcaaggcccggctgaaccacctcaagcacctgatcgccaacgagttcaagctgaactacgaggactaccagtccttcgacgagagcctcgccaaggcgtacaagggctccctgatcagcccctacgagctgcgcttccgggccctcaacgagctgctgtccaagcaggacttcgcccgcgtcatcctccacatcgccaagcggcgcgggtacgacgacatcaagaacagcgacgacaaggagaagggcgccatcctgaaggcgatcaagcagaacgaggagaagctggccaactaccagtccgtgggcgagtacctctacaaggagtacttccagaagttcaaggagaacagcaaggagttcacgaacgtgcggaacaagaaggagtcctacgagcgctgcatcgcccagagcttcctgaaggacgagctgaagctcatcttcaagaagcagcgggagttcgggttctccttcagcaagaagttcgaggaggaggtcctgtccgtggccttctacaagcgcgccctgaaggacttcagccacctcgtgggcaactgctccttcttcaccgacgagaagcgggcgcccaagaacagccccctggccttcatgttcgtcgccctgacccgcatcatcaacctcctgaacaacctgaagaacaccgaggggatcctctacacgaaggacgacctgaacaccctgctcaacgaggtgctgaagaacggcaccctgacctacaagcagacgaagaagctcctggggctgagcgacgactacgagttcaagggcgagaagggcacctacttcatcgagttcaagaagtacaaggagttcatcaaggccctcggggagcacaacctgtcccaggacgacctgaacgagatcgccaaggacatcaccctcatcaaggacgagatcaagctgaagaaggcgctggccaagtacgacctcaaccagaaccagatcgacagcctgtccaagctggagttcaaggaccacctcaacatcagcttcaaggccctgaagctggtgaccccgctgatgctcgagggcaagaagtacgacgaggcctgcaacgagctgaacctgaaggtcgccatcaacgaggacaagaaggacttcctccccgcgttcaacgagacgtactacaaggacgaggtgaccaaccccgtggtcctgcgggccatcaaggagtaccgcaaggtgctgaacgccctcctgaagaagtacgggaaggtgcacaagatcaacatcgagctggcccgcgaggtcggcaagaaccactcccagcgggcgaagatcgagaaggagcagaacgagaactacaaggccaagaaggacgccgagctcgagtgcgagaagctgggcctgaagatcaacagcaagaacatcctcaagctgcgcctgttcaaggagcagaaggagttctgcgcctactccggggagaagatcaagatcagcgacctccaggacgagaagatgctggagatcgaccacatctacccctactcccggagcttcgacgactcctacatgaacaaggtgctggtgttcaccaagcagaaccaggagaagctcaaccagaccccgttcgaggccttcggcaacgacagcgcgaagtggcagaagatcgaggtcctggccaagaacctgcccacgaagaagcagaagcgcatcctcgacaagaactacaaggacaaggagcagaagaacttcaaggaccggaacctgaacgacacccgctacatcgcccggctggtgctcaactacaccaaggactacctggacttcctgcccctctccgacgacgagaacaccaagctgaacgacacgcagaaggggagcaaggtgcacgtcgaggccaagtccggcatgctgaccagcgccctccgccacacctgggggttctccgcgaaggaccggaacaaccacctccaccacgccatcgacgccgtgatcatcgcctacgccaacaacagcatcgtgaaggcgttctccgacttcaagaaggagcaggagagcaacagcgccgagctgtacgccaagaagatctccgagctggactacaagaacaagcgcaagttcttcgagcccttcagcggcttccggcagaaggtcctggacaagatcgacgagatcttcgtgtccaagccggagcgcaagaagcccagcggcgccctgcacgaggagaccttccggaaggaggaggagttctaccagtcctacgggggcaaggagggggtcctcaaggcgctggagctgggcaagatccgcaaggtgaacgggaagatcgtgaagaacggcgacatgttccgggtcgacatcttcaagcacaagaagacgaacaagttctacgccgtgcccatctacaccatggacttcgccctcaaggtgctgcccaacaaggccgtcgcccgcagcaagaagggcgagatcaaggactggatcctgatggacgagaactacgagttctgcttctccctctacaaggacagcctgatcctgatccagaccaaggacatgcaggagccggagctcgtgtacttcaacgcgttcacctccagcacggtgtccctgatcgtcagcaagcacgacaacaagttcgagaccctgtccaagaaccagaagatcctcttcaagaacgccaacgagaaggaggtgatcgccaagagcatcgggatccagaacctgaaggtgttcgagaagtacatcgtctccgccctgggcgaggtgaccaaggccgagttccggcagcgcgaggacttcaagaacgagctccggtga

SEQ ID NO: 1412 - RNA, 2964 nt, synthetic construct
  misc_feature 1..2964: note = Cas9 variant
  source 1..2964: mol_type = other RNA
atggcccgcatcctggccttcgacatcggcatcagctccatcgggtgggcgttcagcgagaacgacgagctcaaggactgcggcgtgcggatcttcaccaaggccgagaaccccaagaccggggagtccctggccctgccgcgccggctcgcccgcagcgcccggaagcgcctggcgcggcgcaaggcccggctgaaccacctcaagcacctgatcgccaacgagttcaagctgaactacgaggactaccagtccttcgacgagagcctcgccaaggcgtacaagggctccctgatcagcccctacgagctgcgcttccgggccctcaacgagctgctgtccaagcaggacttcgcccgcgtcatcctccacatcgccaagcggcgcgggtacgacgacatcaagaacagcgacgacaaggagaagggcgccatcctgaaggcgatcaagcagaacgaggagaagctggccaactaccagtccgtgggcgagtacctctacaaggagtacttccagaagttcaaggagaacagcaaggagttcacgaacgtgcggaacaagaaggagtcctacgagcgctgcatcgcccagagcttcctgaaggacgagctgaagctcatcttcaagaagcagcgggagttcgggttctccttcagcaagaagttcgaggaggaggtcctgtccgtggccttctacaagcgcgccctgaaggacttcagccacctcgtgggcaactgctccttcttcaccgacgagaagcgggcgcccaagaacagccccctggccttcatgttcgtcgccctgacccgcatcatcaacctcctgaacaacctgaagaacaccgaggggatcctctacacgaaggacgacctgaacgccctgctcaacgaggtgctgaagaacagcaccctgacctacaagcagaccaagaagctcctgggcctgtccgacgactacgagttcaagggggagaagggcacgtacttcatcgagttcaagaagtacaaggagttcatcaaggccctcggcgaccacagcctgtcccaggacgacctgaacgagatcgcgaaggacatcaccctcatcaaggacgagatcaagctgaagaaggccctggccaagtacgacctcaaccagaaccagatcgacagcctgtccaagctggagttcaaggaccacctcaacatcagcttcaaggccctgaagctgatcaccccgctgatgctcgaggggaagaagtacgacgaggcctgcaacgagctgaacctgaaggtggcgatcaacgaggacaagaaggacttcctccccgccttcaacgagacctactacaaggacgaggtcacgaaccccgtggtgctgcgggccatcaaggagtaccgcaaggtcctgaacgccctcctgaagaagtacggcaaggtgcacaagatcaacatcgagctggcgcgcgaggtggggaagaactactcccagcgggccaagatcgagaaggagcagaacgagaactacaaggccaagaaggacgccgagctcgagtgcgagaagctgggcctgaagatcaacagcaagaacatcctcaagctgcgcctgttcaaggagcagaaggagttctgcgcctactccggcgagaagatcaagatcagcgacctccaggacgagaagatgctggagatcgaccacatctacccctactcccggagcttcgacgactcctacatgaacaaggtcctggtgttcaccaagcagaaccaggagaagctcaacaagaccccgttcgaggcgttcgggaacgacagcgccaagtggcagaagatcgaggtgctggccaagaacctgcccaccaagaagcagaagcgcatcctcgacaagaactacaaggacaaggagcagaaggacttcaaggaccggaacctgaacgacacgcgctacatcgcccggctggtcctcaactacaccaaggactacctggacttcctgcccctctccgacgacgagaacaccaagctgaacgacacccagaagggcagcaaggtgcacgtggaggccaagtccgggatgctgacgagcgcgctccgccacacctggggcttctccgccaaggaccggaacaaccacctccaccacgccatcgacgccgtcatcatcgcctacgcgaacaacagcatcgtgaaggccttcagcgacttcaagaaggagcaggagtccaacagcgccgagctgtacgccaagaagatctccgagctggactacaagaacaagcgcaagttcttcgagcccttcagcgggttccggcagaaggtgctggacaagatcgacgagatcttcgtctccaagccggagcgcaagaagcccagcggcgcgctgcacgaggagaccttccggaaggaggaggagttctaccagtcctacggcgggaaggagggcgtgctcaaggccctggagctggggaagatccgcaaggtcaacggcaagatcgtgaagaacggggacatgttccgggtggacatcttcaagcacaagaagaccaacaagttctacgccgtccccatctacacgatggacttcgccctcaaggtgctgcccaacaaggccgtggcgcgcagcaagaagggcgagatcaaggactggatcctgatggacgagaactacgagttctgcttctccctctacaaggacagcctgatcctgatccagaccaaggacatgcaggagccggagctcgtctacttcaacgccttcacctccagcaccgtgtccctgatcgtgagcaagcacgacaacaagttcgagacgctgtccaagaaccagaagatcctcttcaagaacgccaacgagaaggaggtcatcgccaagagcatcggcatccagaacctgaaggtgttcgagaagtacatcgtgtccgccctgggggaggtcaccaaggcggagttccggcagcgcgaggacttcaagaacgagctccggtga

SEQ ID NO: 1413 - RNA, 2964 nt, synthetic construct
  misc_feature 1..2964: note = Cas9 variant
  source 1..2964: mol_type = other RNA
atggcccgcatcctggccttcgacatcggcatcagctccatcgggtgggcgttcagcgagaacgacgagctcaaggactgcggcgtgcggatcttcaccaaggccgagaaccccaagaccggggagtccctggccctgccgcgccggctcgcccgcagcgcccggaagcgcctggcgcggcgcaaggcccggctgaaccacctcaagcacctgatcgccaacgagttcaagctgaactacgaggactaccagtccttcgacgagagcctcgccaaggcgtacaagggctccctgatcagcccctacgagctgcgcttccgggccctcaacgagctgctgtccaagcaggacttcgcccgcgtcatcctccacatcgccaagcggcgcgggtacgacgacatcaagaacagcgacgacaaggagaagggcgccatcctgaaggcgatcaagcagaacgaggagaagctggccaactaccagtccgtgggcgagtacctctacaaggagtacttccagaagttcaaggagaacagcaaggagttcacgaacgtgcggaacaagaaggagtcctacgagcgctgcatcgcccagagcttcctgaaggacgagctgaagctcatcttcaagaagcagcgggagttcgggttctccttcagcaagaagttcgaggaggaggtcctgtccgtggccttctacaagcgcgccctgaaggacttcagccacctcgtgggcaactgctccttcttcaccgacgagaagcgggcgcccaagaacagccccctggccttcatgttcgtcgccctgacccgcatcatcaacctcctgaacaacctgaagaacaccgaggggatcctctacacgaaggacgacctgaacgccctgctcaacgaggtgctgaagaacggcaccctgacctacaagcagaccaagaagctcctggggctgagcgacgactacgagttcaagggcgagaagggcacgtacttcatcgagttcaagaagtacaaggagttcatcaaggccctcggggaccactccctgagccaggacgacctgaacgagatcgcgaaggacatcaccctcatcaaggacgagatcaagctgaagaaggccctggccaagtacgacctcaaccagaaccagatcgactccctgagcaagctggagttcaaggaccacctcaacatctccttcaaggccctgaagctgatcaccccgctgatgctcgagggcaagaagtacgacgaggcctgcaacgagctgaacctgaaggtggcgatcaacgaggacaagaaggacttcctccccgccttcaacgagacctactacaaggacgaggtcacgaaccccgtggtgctgcgggccatcaaggagtaccgcaaggtcctgaacgccctcctgaagaagtacgggaaggtgcacaagatcaacatcgagctggcgcgcgaggtgggcaagaactacagccagcgggccaagatcgagaaggagcagaacgagaactacaaggccaagaaggacgccgagctcgagtgcgagaagctgggcctgaagatcaactccaagaacatcctcaagctgcgcctgttcaaggagcagaaggagttctgcgcctacagcggggagaagatcaagatctccgacctccaggacgagaagatgctggagatcgaccacatctacccctacagccggtccttcgacgacagctacatgaacaaggtcctggtgttcaccaagcagaaccaggagaagctcaaccagaccccgttcgaggcgttcggcaacgactccgccaagtggcagaagatcgaggtgctggccaagaacctgcccaccaagaagcagaagcgcatcctcgacaagaactacaaggacaaggagcagaaggacttcaaggaccggaacctgaacgacacgcgctacatcgcccggctggtcctcaactacaccaaggactacctggacttcctgcccctcagcgacgacgagaacaccaagctgaacgacacccagaaggggtccaaggtgcacgtggaggccaagagcggcatgctgacgtccgcgctccgccacacctgggggttcagcgccaaggaccggaacaaccacctccaccacgccatcgacgccgtcatcatcgcctacgcgaacaactccatcgtgaaggccttcagcgacttcaagaaggagcaggagagcaactccgccgagctgtacgccaagaagatcagcgagctggactacaagaacaagcgcaagttcttcgagcccttctccggcttccggcagaaggtgctggacaagatcgacgagatcttcgtcagcaagccggagcgcaagaagccctccggcgcgctgcacgaggagaccttccggaaggaggaggagttctaccagagctacgggggcaaggagggggtgctcaaggccctggagctgggcaagatccgcaaggtcaacgggaagatcgtgaagaacggcgacatgttccgggtggacatcttcaagcacaagaagaccaacaagttctacgccgtccccatctacacgatggacttcgccctcaaggtgctgcccaacaaggccgtggcgcgctccaagaagggcgagatcaaggactggatcctgatggacgagaactacgagttctgcttcagcctctacaaggactccctgatcctgatccagaccaaggacatgcaggagccggagttcgtctactacaacgccttcaccagctccaccgtgagcctcatcgtgtccaagcacgacaacaagttcgagacgctgagcaagaaccagaagatcctgttcaagaacgccaacgagaaggaggtcatcgccaagtccatcgggatccagaacctcaaggtgttcgagaagtacatcgtgagcgccctgggcgaggtcaccaaggcggagttccggcagcgcgaggacttcaagaacgagctgcggtga

SEQ ID NO: 1414 - RNA, 2979 nt, synthetic construct
  misc_feature 1..2979: note = Cas9 variant
  source 1..2979: mol_type = other RNA
atgcgcatcttcagcgacggccggaaccccaaggacgggtccagcctggccgtgacccgccgggccgcgcgcgccatgcggcgccggcgcgaccggctcctgaagcgcaagacccggatgcaggccaagctggtcgagcacggcttcttcccggccgacgccgggaagcgcaaggcgctcgagcagctgaacccctacgccctgcgggccaagggcctccaggaggccctgctgcccggggagttcgcgcgcgccctcttccacatcaaccagcggcgcggcttcaagtccaaccggaagacggacaagaaggacaacgacagcggcgtgctgaagaaggccatcgggcagctgcgccagcagatggccgagcagggctcccggaccgtgggggagtacctctggacccgcctgcagcagggccagggggtccgggcccgctaccgcgagaagccctacaccacggaggagggcaagaagcggatcgacaagagctacgacctgtacatcgaccgcgcgatgatcgagcaggagttcgacgccctctgggccgcccaggccgcgttcaacccgaccctgttccacgaggccgcccgggccgacctgaaggacaccctcctgcaccagcgccccctgcggcccgtgaagcccggccgctgcaccctcctgccggaggaggagcgggcgcccctggccctcccctccacgcagcgcttccggatccaccaggaggtgaaccacctccgcctgctcgacgagaacctgcgggaggtcgccctgaccctcgcccagcgcgacgccgtggtgaccgccctggagaccaaggcgaagctgagcttcgagcagatccggaagctcctgaagctgtccgggagcgtccagttcaacctcgaggacgccaagcgcacggagctgaagggcaacgccacctccgccgcgctggcccggaaggagctgttcggggccgcctggagcggcttcgacgaggccctgcaggacgagatcgtgtggcagctggtgaccgaggagggcgagggggcgctcatcgcctggctgcagacccacacgggcgtcgacgaggcccgcgcccaggccatcgtggacgtgtccctgcccgaggggtacggcaacctcagccggaaggcgctggcccgcatcgtcccggccctgcgggccgccgtgatcacctacgacaaggcggtgcaggccgccgggttcgaccaccactcccagctcggcttcgagtacgacgccagcgaggtcgaggacctggtgcaccccgagaccggcgagatccgctccgtgttcaagcagctgccctactacgggaaggcgctgcagcgccacgtcgccttcggcagcgggaagcccgaggacccggacgagaagcggtacggcaagatcgccaaccccaccgtgcacatcgggctcaaccaggtgcgcatggtcgtgaacgccctgatccggcgctacggccggcccacggaggtcgtgatcgagctggcccgcgacctcaagcagtcccgggagcagaaggtggaggcgcagcgccggcaggccgacaaccagcgccggaacgcccgcatccggcgcagcatcgccgaggtcctgggcatcggggaggagcgggtgcgcggcagcgacatccagaagtggatctgctgggaggagctgtccttcgacgccgcggaccggcgctgcccctacagcggggtgcagatctccgccgccatgctcctgagcgacgaggtcgaggtggagcacatcctgccgttctccaagaccctcgacgacagcctgaacaaccggaccgtggccatgcgccaggccaaccggatcaagcgcaaccgcaccccctgggacgcgcgggccgagttcgaggcccagggctggtcctacgaggacatcctgcagcgcgccgagcggatgcccctccgcaagcggtaccgcttcgcgcccgacgggtacgagcggtggctgggcgacgacaaggacttcctggcccgcgccctcaacgacacgcggtacctgagccgcgtcgccgccgagtacctgcggctcgtgtgcccgggcacccgcgtgatccccgggcagctgaccgcgctgctccggggcaagttcgggctgaacgacgtcctgggcctcgacggcgagaagaaccgcaacgaccaccggcaccacgccgtggacgcctgcgtgatcggggtcaccgaccagggcctgatgcagcgcttcgccacggcctccgcgcaggcccgcggggacggcctgacccggctcgtggacgggatgcccatgccctggccgacctaccgggaccacgtggagcgcgccgtccgccacatctgggtgagccaccggcccgaccacggcttcgagggcgccatgatggaggagacctcctacgggatccgcaaggacggcagcatcaagcagcggcgcaaggccgacgggtccgcgggccgggagatcagcaacctgatccgcatccacgaggccacgcagcccctgcggcacggggtgtccgccgacggccagccgctcgcctacaagggctacgtcgggggcagcaactactgcatcgagatcaccgtgaacgacaaggggaagtgggagggcgaggtgatctccaccttccgcgcctacggggtcgtgcgggcgggcggcatggggcgcctgcggaacccccacgagggccagaacgggcgcaagctgatcatgcggctcgtgatcggcgacagcgtccgcctggaggtggacggggccgagcggaccatgcgcatcgtgaagatctccggcagcaacggccagatcttcatggcccccatccacgaggccaacgtcgacgcgcggaacacggacaagcaggacgccttcacctacaccagcaagtacgccgggtccctgcagaaggccaagacccgccgggtgaccatcagccccatcggcgaggtgcgcgacccggggttcaagggctga

SEQ ID NO: 1415 - RNA, 2985 nt, synthetic construct
  misc_feature 1..2985: note = Cas9 variant
  source 1..2985: mol_type = other RNA
atgaccctgggcctcgacctggggaccaacagcatcggctgggccctgatcgacttcgacgacaaccagcagccccgcaacctcatcgcctgcgggtcccggatcttccaggaggcggtggaggccaagacgggcaccccgaagaaccacgcccgccggaccgcccgcgccgcgcggaagctggtcgcccgccggaagcagcgccggaccaagctgctcaacctgctgatccgccacgggctcctgccccaggacgtggccgagcggaacgccctgctcctggacaaccaggcgaacaacccctaccagctgcgcaagcggggcctcgacgagaagctggagcccttcgccttcggccgcgccctgtaccacctcgcccaccggcgcgggttccagagcaaccggaaggccgcgtccgacgaggacggcaaggtgaagacggccatcagcaccctgcgcgccgagatgcaggggcggaccctgggcgccttcctcgccgaccagccgacccagcgccggcgctacacggaccgcgcgatgtacgtcgaggagttcgagcagctgtggtccaagcaggccagcttcacccaggagcagctgacccaggccctcaaggtggccatccacaactccatcttcttccagcggcccctcaagagccagaagcacctggtggggaagtgcaccttcgagcccacgcgcaagcgggccgcgaaggccatcctcctgacccagcgcttccggatcctgcaggacgtcaaccacctcgccgtgaagaaccccatcacccgcgagttccggccgctgacccaggacgagcgcaacaagctggccgaggccctcgacaagcagaagtccatgacgtggggcgcggtgcggaaggtcatcggctggaacaagaaggacagcctgcacgagggggagaccttcaacctggaggagggcaagaaggacaagctcatcgggaaccgcaccgcctgcgacctgcggggcgccctgggcgaccgctgggacgccctcaccgcgcagcagcaggacgacctggtgacggacctgctcaccatcgacaacaccgacgggttcctgaagcggatgaagacccactgggagttcgacgacgccacggccgaggtgatcgccaagatcgagctggagcccggctacgcccgcctctccgcgaaggccatgcgggccatcctgccctacctggagcaggggatgatctacagcgacgcctgcaaggccgcgggctacgaccactccaaccccaaccagcgcaccatcaccgacaagctcgggctgccgagcaacgtccggaaccccgtggtgcagaaggccctgttcgagacccgcaaggtcgtgaacgccatcgtgcggaagtacggcaagcccgccgtcatccgcgtggagatggcccgcgacatgaagctgtccaagcggcagaaggaggagctccagaaggagcagaacaagcagaagaaggcgaacgagctggccgagggcatcctgcgcaaggagttcgggatccagcagcccgcccgggccgacatccagaagtacaacctctggctggagtgcaaggaggtgtgcccgtacacgggcaccaccatcagccgcgagatgctgttctcccccgaggtcgacgtggagcacatcctcccctacagccggtccctggacgacagctacatgaacaagaccctgtgcatggcgacgttcaaccgccaggtgaagctcaacaacaccccctacgagatcgggcagggcgacccgctggcctacgccgagatcttccagcggatcaagaccctgcccttccccaagcgccggcgcttcgagcagaaggagatcgagaccgacaagttcatcgagcggcagctcaacgacacgcgctacatctgcgtcgaggtgcgggacttcctgcagcagctgggggcccccgtcgaggtgagcaagggcgaggccaccgcgaagctccgcggccggtggaagctgaacaccctgctctccccggacgggagcaacgagaagtaccgcggcgaccaccggcaccacgccatcgacgccgtggtcatcgccctgaccaaccgctccctgttccacaagctcagccggctgtccgcccagagcatctccctggacaagagccgcttcgacgtgcccccgccctgggacgggttctacgacgacgtgtacgagaagatcgacaaggtcatcgtgtcccacgcgcccgcccggaagatcggcggggccctccacgaggacaccgcctacggccacttcaaggaggaggtggccgaccccaagacgggcaaggtcagcatcgaggaccgcttcgtgtaccgcaagcccctggcgaccctgaccgccaacgaggtggggaagatccgggacgccaaggtccgcgagttcgtggaggcccggctcgcgcagttcggcaacaactccaagaccgccttcggggacccgaacaaccccctgctgcacgccgacggcaagacgcccatccgcaccgtgcggctcgtcaccaacttcaacaaggccaccacgcacgccatccagaagggccaggggcgcgactacaagttcttcaagtacggcaacaaccaccacgtggagatcatcgagcacgtggagaccgggaagcggaagggcatcttcgtcaccgcgatggaggccgcccgccgggtgcgcggggtggccaacaccgagaagtccgacatcgtccagcggaaccacggcgaggagtggcgcttcgtgatgagcctgagcatcaacgacctggtgtccatccaggaggccgaccaggtccggatcatgcgcgtgcagctgttcgacgcgagcaacggcaacatcatcttccgggaccagaagtccgccatgctggacgacaagctgagccgctaccagacgaaggcccacctcctggtgtgccagaagatcaccaccgaccccctggggaacctcgccccgtgcaacgactga

SEQ ID NO: 1416 - RNA, 2988 nt, synthetic construct
  misc_feature 1..2988: note = Cas9 variant
  source 1..2988: mol_type = other RNA
atgagcaaggtgctgggcctcgacatcggggccaactccatcggctgggccctgatcgacgacgaggagaacgacatcatcggggcgggcgtccgcgtgttcaaggagggggtgaacctgaagggcgtcaaggaggagagcaagaacgtggagcggcgcgccgcccggctcgcccgccggcagcacaagcgccggtcccagcgccggaaccgcctggtggccctgctcaagaccctggagatgttccccgagaacaacgaggacatcagcgactactacgcgcaggacccgtacgagctgcggaagaagggcctctacgagaagctgaccatgtacgagttcgggcgcgtcctgctccacatctgccggcgccggggcttcaagtccagccgcaagacggacatctccgaggaggggaagatcttcgagggcaaggacgggatcgtgggcatcaaccagacccgggacagcatccgcgagggcgggttcaagaccatcggcgagtacctggcctccctggacccccacgtgatccggcgccggaaccgcttcaccctccgcgacatgtacgaggaggagttcaacctgatgtgggagaagcagcagagcttctaccccctgcagctctccaacgagttcaaggaggccatcgccgaggtcatcctgagccagcggaagctgaagtcccagaaggcgctcgtggggaactgcggcctggagcccaacaagaagacggcccccaagagctccccggccttccagtacttccgcatcctggagcagctcagccggatcctgatctccatcccccacaccggccgctacaacgaccccctgaacgaggaggagcggcgcatgctcatcgacaagctgagcgtgaccgagaagctgaagttctccgacatgcggaagatgctcaacctgccgggggagagcgacatcaacatcgaggaggagggcgggcgcctgctcggcaacaccacgtacgcccggctgatcaaggtcttcgggaagaagcgctgggccggcttcagcgaggaggagaaggagcagatctggcacaccttccacttcgcggacaaccacgagtggctgaaggagtacgccctcaagaagtggtccatcacccccgacgagatcaaggagctgggcaaggtggccctggagaaggagtacgcccggttcagcaagaagtccctcaagaagatcatcccccagctggaggaggggctgaccctcgacaaggccaagatcgaggcgggctacacgcccgagtacgagatcgagaagtccctgagcgcctacctgccgctccccgagaacatccgcaaccccatcgtgcagcaggccctgtacgagctgcggcacgtcgtgaacgccgtgatccgcacctacgggaagcccgacatcgcccgggtcgagctcgcgcgcgagatgaagaagccgaagcagaagcgggagaagatgcgcagcgagctgcggaagcgccagatgaagttcgaggagatcaagtccatcctgaaggagcgcctgggcttcatcgaccccaagcgggacgagatccacaagtacatgctctgggaggagtgccgcgagacctgcccctacaccgggcggaagatcagcctgtccgccctgtacggcggcgacttcgaggtggagcacatcatcccctacaagcgcagcctcgacgactccctgttcaacaagacggtgtgcctgcgggaggagaaccagatcaagggggaccgcaccccgtacgaggcctacagcggcgaccggcagaagtacgaggagatcatcctccgcgtccagaagacctccatgccccgggggaagaagaacctgttcgccatcaaggagctgaaggacgacttcgcccaccgccagctcagcgacaccgcgtacatctcccgggagacgcgcaagtacctgggcagcaccatcaagaaggtgcaggccgtgaagggcgggtccaccgccaagctgcggtactactggggcctcaacagcatcctgggggtccgcgacatcaagatgcgggacgaccaccgccaccacgccgtggacgcgctggtcatcgccaacaccacgtacgccttcgtgaacaccctctcccggtaccacagcatggacgtggagccccacgagagccgcttccccctgccgtgggagcagttccggaacgacgccgagtccgtcgtgcgcaacatcttcgtgagccaccggctgggcaagaaggccaccgggcagctccacgaggagacctactacggcaagatccgcaacacggacggcgagccctacttcgtcgtgcgcaagaagctggggaccctgaccgcgaagcagatcgccaacatcgtggaccccgtcgtgaagacccaggtgttcgagcggctcgaggagaagggcatcgacatcgagtccagcaacaagatccccgccgacgccttcgtcgagacgctgtacatgccggaccgcaagacccccatcaagtccgtgcgggtgaaggtccccagcaccaccatgatccagctgtacaaggacaaggagctctacgtggacccggggtccaaccaccacatcgtgatcttcgagaacgaggagggcaagcgcgacgggatcgtcgtgagcctgttcgaggccgcgcagcggctgcgccggaacgagcccgtgatccagaagacgtggaagcccgagtggcacttcgtcatgtccctcagcatcgacgagctgatcctgctcgacgtggacgagaagaacatcgactggggcgacaccggcctggccctgcgctactccaaggccctctaccgggtgcagaagatggacgtcaacaagatcatcaccctgcgccaccacctggtggcccggctcaaggacgacgaggggaaggagttcggccgcgagcaccggatccccagcaccctgcgcgggctgaaggtgaagatcgaccacatcggccggctccgccgggcctacgactga

SEQ ID NO: 1417 - RNA, 2988 nt, synthetic construct
  misc_feature 1..2988: note = Cas9 variant
  source 1..2988: mol_type = other RNA
atgaaggtgatcggcttcgacatcgggatcaacagcatcggctgggccttcgtcgagaacgacgagctgaaggactgcggggtgcgcatcttcaccaaggccgagaaccccaagaacaaggagtccctcgcgctgccgcggcgcaacgcccggagctcccgcaagcggctgaagcgccggaagctccgcctgatcgccatgaagcacatcctggccaaggagctcaacctgaactacaaggactacatcgccaacgacggcgagctgcccaaggcgtacgaggggaagctcatcagcccctacgagctgcggtacaaggccctgaaccagaagctcgaggccaaggacctggtgcgcgtcatcctgcacatcgccaagcaccggggctacatgaacaagaacgacaagaagtccaacgacgcggagaagggcaagatcctcagcgccctgaagaacaacgccctgaagctcgagaagtaccagtccgtgggggagtacttctacaaggagttcttccagaagtacaaggagaacaccaaggacttcatcaagatccgcaacatcaaggacaactacaacaactgcgtgctggccagcgacctggagaaggagctcaagctgatcctggagaagcagaaggagttcggctactcctacagcaacgacttcatcgaggaggtcatccaggtggccttcttccagcggcccctcaaggacttctcccacctggtggggacctgcaccttcttcgaggaggagaagcgcgcgtgcaagaacagctactccgcctgggagttcgtcgccctgaccaagatcgtgaacgagctcaagagcctggagaagatctccggcgagctgatcagcacccagacgatcaacgagatcctcaactacatcctggacaaggggtccatcacctacaagaagttccggagctacatcaacctgtacgagtccatcaagttcaagagcctcaagtacgacaaggacaacgccgagagcgccaagctgatcgacttccgcaagctggtggagttcaagaaggcgctcggcgagcactacttcaaccggcaggagctggaccagatctccacctacatcaccctgatcaaggacaacgtcaagctcaagacggccctggagaagtacaacctgagcaacgagcagatcaacaacctcctggagatcgagttcaacgaccacatcaacctgtccttcaaggccctcagcatgatcctgccgctgatgaaggagggcaagaagtacgacgaggcctgcgagatcgccaacctcaagcccaagaccaccaaccagaagcaggacttcctgcccgcgttctgcaactccatcttcgtgcacgagctgagcaaccccatcgtgaaccgcgccatctccgagtaccggaaggtcctgaacgccctcctgaagaagtacgggaaggtgcacaagatccacctggagctcgcccgcgacatcggcctgagcaagaaggcccgggagaagatcgagaaggagcagaaggagaaccaggcgatcaacacctgggccctgaacgagtgcgagaacatggggatcaaggccaacgccaagaacatcctcaagctgaagctgtggaaggagcagaaggagatctgcatctactccggcaagaagatcagcatcgagcacctcaaggacgagaaggcgctggaggtggaccacatctacccgtactcccgcagcttcgacgactcctacatgaacaaggtcctggtgttcacgaaggagaaccaggagaagctcaacaagacccccttcgaggccttcggcaagaacatcgagaagtggaacaagatccagaccctggcccagatcctgccctacaagaagaagaacaagatcctcgacgagaacttcaaggacaaccagcagcaggacttcatcagccgcaacctgaacgacacccggtacatcgccacgctgatcgccaagtacaccaaggagtacctcaacttcctgcccctgaacgagaacgagaacatcaacctcaagtccggggagaagggcagcaagatccacatccagaccgtgaacgggatgctgacctccgtcctgcgccacacgtggggcttcgacaagaaggaccggaacaaccacctccaccacgcgctggacgccatcatcgtggcctacagcaccaactccctgatcaaggccttcagcgacttcaagaagaaccaggagctcctgaaggccaagctgtacgcgaaggagctcaccaacgacaactacatccaccaggccaagttcttcgagccgttcgaggggttccgcgagaagatcctgaacaagatcgacgagatcttcgtgagcaagccgccccggaagcgcgcccggggcgccctgcacaaggagaccttctactccgagaagaagatgatcaagaagtacaacagcaaggagggcctcaacatcgccctggactgcgggaagatccgcaagatcggcacgaagtacgtcgagaacgacaccatggtgcgggtcgacatcttcaagaagcagaacaagttctacgcgatccccatctacaccatggacttcgccctggggatcctccccaacaagatcgtggtgatcggcaaggacaagaacaacaaccccaagcagtggcaggagatcgacgagtcctacgagttctgcttcagcctgtacaagaacgacctgatcctcctgcagaagaaggacatgcaggaggccgagttcgcctactacaacgggttcgacatcgactccagccgcatcaacatcaagaagcacgacaacaagttcgagaacctgacctccaaccagaagctcctgttcacgaacaaggagaagaaccggaccggcatccagaacctgaagatcttcgagaagtacatcgtcacgcccctcggcaacaagatcaaggcggacttccagccccgccagaacatcagcctgaagtccagcaagaagaacgggctgtga

SEQ ID NO: 1418 - RNA, 2988 nt, synthetic construct
  misc_feature 1..2988: note = Cas9 variant
  source 1..2988: mol_type = other RNA
atgaagatcctgggcttcgacatcgggatcaacagcatcggctgggccttcgtggagaacgacgagctcaaggactgcggggtccgcatcttcaccaaggccgagaaccccaagaacaaggagtccctggcgctgccgcggcgcaacgcccggagcaaccgccggcgcctcaagcggcgcaagtcccggctgatcgccatcaagcacatcctggccaaggagctcaacctgaactacaaggactacatcgccaacgacggcgagctgcccaaggcgtacgaggggaagctcaccaacgtgtacgagctgcgctacaaggccctgaaccagaagctcgaggccaaggacctggcccgggtgatcctgcacatcgcgaagcaccgcggctacatgaacaagaacgagaagaagtccaacgacagcgagaagggcaagatcctcagcgccctgaagaacaacgccctgaagctcgagaagtaccagtccgtcggggagtacttctacaaggagttcttccagaagtacaaggagaacaccaagaacttcatcaagatccggaacaccaaggacaactacaacaactgcgtgctggccagcgacctggagaaggagctcaagctgatcctggagaagcagaaggagttcggctactcctacaacgacgacttcatcaaggagatcatcaacatcgccttcttccagcgccccctcaaggacttcagccacctggtggggtcctgcaccttcttcgaggaggagaagcgggcgtgcaagaacagctactccgcctgggagttcgtcgccctgagcaagatcatcaacgagctcaagcgcctggagaagatctccggcgagctgatcagcgcccagaccatcaacgagatcctcaaccacatcctggacaaggggaacatcacgtacaagaagttccggtcctgcatcaacctgcacgagagcatcgagttcaagtccctcaactacgacaaggacaacgccgagagcgcgaagctggtggacttcaagaagctgatcgagttcaagaaggccctcggcgagcacagcttcaaccgccaggagctggacgagatcgccacccacatcaccctgatcaaggacaacgacaagctcaagaccgccctggagaagtacaacctgaacaacgagcagatcaacgccctcctggagatcgagttcaacgaccacatcaacctgtccttcaaggcgctcaacctgatcctgcccctcatgcgggagggcaagcgctacgacgaggcctgcgagatcgtgaacctcaagagcaagacgtccaaccagaagcaggacctgctgccggccttctgcgacagcatcttctcccaggagctgagcaaccccgtcgtgaaccgggccatctccgagtaccgcaaggtgctgaacgccctgctcaagaagtacgggaaggtccacaagatccacctggagctggcgcgcgacgtgggcctcagcaagaaggcccgggagaagatcgagaaggagcagaaggagaacaaggagatcaacgactgggccctggacgagtgcgagaagttcgggctgaaggccaacaacaagaacatcctcaagctgaagctgtggaaggagcagaaggagatctgcgcgtactccggcaagaagatcagcatcgagcacctcaaggacgagaaggccctggaggtggaccacatctacccctactcccgcagcttcgacgactcctacatgaacaaggtcctggtgttcaccaaggagaaccaggagaagctcaacaagacccccttcgaggccttcggcaagaacatcgagcggtggaacaagatccaggccctggcccagaacctgccgtacaagaagaagaacaagatcctcgacgagaacttcaaggacaagcagcagcaggacttcatcagccgcaacctgaacgacacccggtacatcgcgacgctgatcgccaagtacaccaaggagtacctcaacttcctgcccctgaacgagaacgagaacaccaacctcaagtccggggagaagggcagcaagatccacgtgcagaccatcaacgggatgctgacgtccgtcctgcgccacacctggggcttcgacaagaaggaccggaacaaccacctccaccacgccctggacgccatcatcgtggcctacagcaccaactccatcatcaaggcgttcagcgacttcaagaagaaccaggagctgctcaaggccaagctgtacgccaaggagctgaccagcgacaactacaagcaccaggccaagttcttcgagcccttcgaggggttccgcgagaagatcctcaacaagatcgacgagatcttcgtgtccaagcccccgcggaagcgcgcccggggcacgctgcacaaggagaccttctaccccgaggagaccatgatcaagaagtacaacagcaaggagggcctgaacatcgcgctcaactgcgggaagatccgcaagatcggcaccaagtacgtcgagaacgacacgatggtgcggctggacatcttcaagaagcagaacaagttctacgccatccccatctacaccatggacttcgccctggggatcctccccaacaagatcgtgatcgccggcaaggacaagaacaacaacccgaagcagtggcaggagatcgacgagtcctacgagttctgcttcagcctgtacaagaacgacctgatcctcctgcagaagaaggacatgcaggaggcggagttcgcctactacaactccttcgacatcgacagctcccgcatcaacatcaagaagcacgacaacaagttcgagaacctgaccgacaaccagaagctcctgttcaccaaccaggagaagaaccggacggggatccagaacctgaagatcttcgagaagtacatcgtcacgcccctcggcgacaagatcaaggccgacttccagccccgccagaacatcagcctgaagacctccaagaagtacggcctgtga

SEQ ID NO: 1419 - RNA, 2991 nt, synthetic construct
  misc_feature 1..2991: note = Cas9 variant
  source 1..2991: mol_type = other RNA
atgatgggcaacttcaccctggggctcgacctgggcaccaacagcatcgggtgggccctgatcgacttcgacgacaaccagcagccccagaacctcatcgcctgcggctcccgcatcttccaggaggcggtggaggccaagacggggaccccgaagaaccacgcccggcgcgccgcccgggcggcccgcaagctggtcgcccggcgcaagcagcggcgcaccaagctgctcaacctgctggtgtgccacgacctcctgccccaggacgaggccgagcggaacgcgctgctcctggacaaccaggccaacaacccctaccagctgcgcaagcggggcctcgacgagaagctggagcccttcgccttcggccgcgccctgtaccacctcgcccaccggcgcgggttccagagcaaccggaaggcggcctccgacgaggacggcaaggtgaagaccgccatcagcgccctgcgcgccgagatgcaggggcacacgctgggcgcgttcctcgccgaccagccgacccagcggcgccggtacaccgaccgcgccatgtacgccgaggagttcgagcagctgtggtccaagcagaccatcttcgcccccgagcagctgacgcaggcgctcaaggtcgagatcaagaacagcatcttcttccagcggcccctgaagtcccagaagcacctggtggggaagtgcaccttcgagcccacccgcaagcgcgccgccaaggccatcctcctggcccagcacttccggatcctgcaggacgtgaaccacctcgcggtcaagaacccgatcacccgcgagttccggcccctgacgcaggacgagcgcaacaagctggccgaggccctcgacaagcagaagggcatgaactggagcgccgtgcggaaggtgatcggctggaacaagaaggactccctgcacgagggggagaccttcaacctggaggagggcaagaaggacaagctcatcgggaaccgcaccgcgtgcgacctgcggggcgccctgggcgaccgctgggacgccttcaccgcgccccagcaggacgacctcgtcacggacctgctgaccatcgacaaccccgacgggttcctcaagcggatgaagacccactggggcttcgacgacgccaccgccgaggccctggccacgaccgagctggagccggggtacgcccgcctcagctccaaggccatgcgggcgatcctgccccacctggagcagggcatgatctacagcgacgcctgcaaggccgccgggtacgaccactccaaccccaaccagcgcaccatcaccgacaagctcggcctgcccagcaacgtgcggaacccggtggtccagaaggccctgttcgagacgcgcaaggtggtgaacgcgatcgtccggaagtacggcaagcccgccgtgatccgcgtggagatggcccgggacatgaagctgtccaagcgccagaaggaggagctccagaaggagcagaacaagcagaagaaggccaacgagctggcggaggggatcctgcggaaggagttcggcatccagcagcccgcccgcaccgacatccagaagtacaacctctggctggagtgcaaggaggtctgcccctacaccgggaccgtgatcagccgcgagatgctgtactccccggaggtggacgtcgagcacatcctcccctacagccggtccctggacgacagctacatgaacaagacgctgtgcatggccacctacaaccgccagaccaagctcaacaacaccccctacgagatcggccagggggaccccgtggcctacgccgagatcttccagcggatcaagacgctgccgttccccaagcgccggcgcttcgagcagaaggagatcgagaccgacaagttcatcgagcggcagctgaacgacacccgctacatctgcgtggaggtccgggacttcctccagcagctgggcgcgcccgtggaggtcagcaagggcgaggccaccgccaagctgcgcgggcggtggaagctcaacacgctgctgtcccccggcgggggcaacgagaagaaccgcgccgaccaccggcaccacgccatcgacgcggtggtgatcgccctcaccaaccgcagcctgttccacaagctgtcccggctcagcgcccagtccatcagcttcgacaagtcccgcttcgacgtcccgccgccctgggacgacttctacgacgacgtgtacgagaagatcgacaaggtgatcgtcagccacgcccccacccggaagatctccggggccctgcacgaggcgaccgcctacggccacttcaaggaggagatcgccgaccccaagaccggcaagttcagcatcgaggaccgcttcgtgtaccggaagcccctgacgaccctcaccgccaacgaggtggggaagatccgcgacgcgaaggtccgggagctggtggaggcccgcctggcccagttcggcaacaactccaaggccgccttcggggaccccaacgagccgctcctgcacgcggacggcaagacccccatccgcacgatccggctgaccaccaacttcaacaagaccacgacccacgccatccagaagggccaggaccgcgactacaagttcttcaagtacgggaacaaccaccacgtggagatcatcgagcacgtcgagaccggcaagcggaaggggatcttcgtgaccgccatggaggccgcccgccgggcgcgcggcgtggccaacacggagaagtccaacatcgtccagcggaaccacggggacggctggaagttcgtgatgagcctcgccgtgaacgacatggtccgcaccgaggacacccaggccatctaccgggtgcagaagctggacggcagcaacaaccgcttcaccctgcggtcccacaacgccgcgacgctcgacgacaagcagaccggggtggacaagacccccaacctgttcaagggcaccaagatcatcgtcgaccccctggggaacctcacgcagtgcaacgactga

SEQ ID NO: 1420 - RNA, 2994 nt, synthetic construct
  misc_feature 1..2994: note = Cas9 variant
  source 1..2994: mol_type = other RNA
atgaaggtgctggtcgacgccggcctcatgcccagcgaccccgccgcggccaaggccctggagaccctggacccctacgagctccgcgccaccgggctggacgtgatgctgcccctcacgcacctgggccgggccgtgttccacctgaaccagcgccgggggttcaagtccaaccgcaagaccgaccggggcgacaacgagagcgggaagatcaaggacgcgaccaagcgcctcacctgggccatgcaggaggccggcgcccggacgtacggcgagttcctgcacatgcgccgggcgcgcgcctccgacccccggcaggtcccgagcgtgcgcacccggctgtccgtggccagccgcgggggccccgactccaaggaggaggccgggtacgacttctaccccgagcgggcccacctcgaggacgagttccacgcgctgtggagcgcccaggccgccttccaccccgacctgacctgcgagctccgcgacgtcgtgttcgagaagatcttctaccagcggccgctgaaggagcccaaggtgggcctgtgcctcttcaccgccgaggagcgcctgcccaaggcgcaccccctgacggggcggcgcgtcctctacgagaccgtgaaccagctgcgggtgaccgccgacggccgcaccacgcgcccgctgaccctcgaggagcgggacatgatcgtctacgccctggacaacaagaagcccgtgaagtccctgagctccatgcacctcaagctggtggccctgggcaagctcgtcaagctgaaggacggggagcgcttcaccctggagagcggcgtgcgggacgccatcgcgtgcgaccccatccgcgccaccatggggcaccccgacggcttcggcccggcctggtcccggctcgactggcaggcccagtgggccctgatcgagaagctgcgccaggtgcagagcgacgacgacttcgcgtccctcgtcgcctggctgggggccacgcacaacctgagcgaggaccacgccaagcgggtggcgaacctccacctccccgagggctacgggcgcctgggcctcaccgccaccgaggccatcctgtgcaacctgaaggccgaggtgtgcacctactcccaggccgtcgagcggtgggggaagcaccacagcaaccagcgcacgggcgagtgcctcgaggcgctgccctactacggcgaggtgctggaccggcacgtgatccccgggacctacaacgaggacgacgacgacgtcacccgctacggccggatcaccaacccgacggtgcacatcgggctcaaccagctgcgccggctggtcaaccgcatcatcgccacctacggcaagcccgaccagatcgtggtggagctggcccgggagctcaagcagtccgaggcccagaagtccgaggccctgaagaagatccgcgacaccaccgcggacgccatccggcgcgggcgccagctggaggagatcggccagaagaacacgggcgccaaccggctcctgctgcgcctctgggaggacctggggcccgccgtcggcccccggtgctgcccgtacaccgggaagcccatcagcgtgaccatgctgttcgacggcgcctgcgacgtggaccacatcctcccctacagccgcaccctggacgacagcttcgcgaaccggacgatctgcctgcgcgaggccaaccggcagaagggggaccgcaccccctgggaggcctggggcggctccgaccagtgggacgccatcgaggcgaacctcaaggacctgccggagaacaagcggaagcgcttcgcccccgacgccatggagcggttcgagggggagcgcgacttcctggaccgggccctcgtcgacacccagtacctggcccgcatcagccgggcgtacctggacaccctcttcacggagggcgggcacgtgtgggtggtccccggccgcatgaccgagatgctgcggcgccactggggcctgaacgccctcctgtccgacaaggaccgcggggccggcaaggtgaagaaccggaccgaccaccggcaccacgccatcgacgccgcggtgatcgccgccaccgaccacagcctggtcaaccgcatctccaaggccgccgggcagggcgagagcgcggggcagtccgccgagctcatcgcccgcgacaccccggagccctgggagggcttccggaacgacatcagcgcccagatcgcgcgcatcgtggtgtcccaccgggccgaccacggccgcatcgacgtcgaggggcggaagcacggcaaggacagcacggccgggcgcctgcacaacgacaccgcctacggcatcgtggacgaccacaccgtggtctcccggacgcccctgctcagcctgaagcccggggacatcgaggtgaccaccaagggcaagaacatccgcgacacccagctgcagaaggccctctccgtggcgaccacgggcaaggacgggaagggcttcgaggaggccctgcggaacttcgccgagaaggaggggccgtaccagggcatccgccgggtccgcctgatcgagaccctccagagctccgcccgggtggaggtggggagcgacgaggacggccagcccctgaaggcctacaagggcgactccaaccactgctacgacctgtggaagctccccgacgggaaggtcgtgccccacgtggtcagcacctacgaggcgcacgccggcaccgacaagcgcccgcaccccgccgccaagcggatcctgcgcgtgttcaagaaggacatggtggccatcgagcaggacgaccagacggcgatcttctacgtccagaagctggaccgggccaacgggctgttcctggcgccccacctggaggccaacgccgacgcccgccaccggaaccccaacgacgccttcaagttcctccagatgggcgccgggagcgtggtgcgcaacaagctgcgccgggtctacgtggacgagatcggccgcatcaaggacccgggcccgcccaagcactga

SEQ ID NO: 1421 - RNA, 2994 nt, synthetic construct
  misc_feature 1..2994: note = Cas9 variant
  source 1..2994: mol_type = other RNA
atgaagatcctgggcttcgacatcgggatcaacagcatcggctgggccttcgtggagaacgacgagctcaaggactgcggggtccgcatcttcaccgaggccgagaacccctccaacaaggagagcctggcgctgccgcggcgcaacgcccggtccagccgccggcgcctcaagcggcgcaaggcccggctggtggccatcaagcgcatcctggccaaggagctcaagctgaacttcaaggactacgtggcggccgacggcgagctgcccaaggcctacgaggggaagctcacctccatctacgagctgcggtacaaggccctgatccagcagctcgagacgaaggacctggcgcgcgtcatcctgcacatcgccaagcaccggggctacatgaacaagaacgagaagaagtccaacgacaccaagaagggcaagatcctcagcgccctgaagaacaacgccctgaagctcgagaactaccagagcgtgggggagtacttctacaaggagttcttccagaagtacaaggagaacaccaagaacttcatcaagatccgcaacaccaaggacaactacaacaactgcgtgctgtccagcgacctggagaaggagctcaagctgatcctggagaagcagaaggagttcggctacaactactccgaggacttcatcaacgagatcctcaaggtcgccttcttccagcggcccctgaaggacttcagccacctggtgggggcgtgcacgttcttcgaggaggagaagcgcgcctgcaagaactcctacagcgcctgggagttcgtggccctcaccaagatcatcaacgagatcaagtccctggagaagatcagcggcgagatcgtccccacccagaccatcaacgagatcctgaacctcatcctggacaaggggtccatcacgtacaagaagttccggagctgcatcaacctgcacgagtccatcagcttcaagagcctcaagtacgacaaggagaacgccgagaacgcgaagctgatcgacttccgcaagctggtggagttcaagaaggccctcggcgtgcactccctgagccggcaggagctggaccagatctccacccacatcaccctcatcaaggacaacgtcaagctgaagaccgtgctggagaagtacaacctcagcaacgagcagatcaacaacctgctggagatcgagttcaacgactacatcaacctctccttcaaggccctgggcatgatcctgccgctcatgcgcgaggggaagcggtactacgaggcctgcgagatcacgaacctgaagcccaagaccgtggacgagaaggaggacttcctgcccgccttctgcgacagcatcttcgcgcacgagctgtccaaccccgtcgtgaaccgcgccatcagcgagtaccgcaaggtgctcaacgccctgctgaagaagtacggcaaggtccacaagatccacctcgagctggcccgggacgtggggctgtccaagaaggcccgcgagaagatcgaggaccagcagaagaacaacaaggcgatcaacgactgggccctcaaggagtgcgagaacatcggcatcaaggccagcgccaagaacatcctgaagctgaagctctggaaggagcagaaggagatctgcatctactccggcaacaagatcagcatcgagcacctgaaggacgagaaggcgctggaggtggaccacatctacccgtactcccggagcttcgacgactccttcatcaacaaggtcctcgtgttcaccaaggagaaccaggagaagctgaacaagacccccttcgaggccttcgggaagaacatcgagaagtggagcaagatccagacgctggcccagaacctcccctacaagaagaagaacaagatcctggacgagaacttcaaggacaagcagcagcaggacttcatctcccgcaacctgaacgacacccggtacatcaccaccctcatcgccaagtacacgaaggagtacctgaacttcctgcccctcagcgagaacgagaacaccaacctgaagtccggcgagaaggggagcaagatccacatccagaccatcagcggcatgctgacctccgtgctccgccacacgtgggggttcgacaagaaggaccggaacaaccacctccaccacgccctggacgcgatcatcgtcgcctacagcacctccagcatcatcaaggccttctccgacttcaagaagaaccaggagctcctgaaggcccgcttctacgccaaggagctgaccagcgacaactacaagcaccaggtgaagttcttcgagccgttcaagggcttccgggagaagatcctctccaagatcgacgagatcttcgtcagcaccccgccccgcaagcgggcgcgcggcgccctgcacgaggagacgttctactccgaggacaagatgatcaagaagtacaacagcaaggaggggctgcagatcgccctctcctgcggccgggtgcgcaagatcgggaccaagtacgtggagaacgacaccatggtccgggtggacatcttcaagaagcagaacaagttctacgccatccccatctacgtgatggacttcgccctgggcatcctgcccaacaagatcgtcatcaccgggaaggacaagaacaacaaccccaagcagtggcagacgatcgacgagagctacgagttctgcttctccctctacaagaacgacctgatcctgctccagaagaagaacatgcaggagcccgagttcgcgtactacaacagcttcgacatcgaccgctcccggatcaagatcaagaagcacgacaacaagttcgagaacctgaccagcaaccagaagctgctgttcaccaacaaggacaagggcaagaaccgcaccggcatccagaacctgaagatcttcgagaagtacatcgtgacgcccctgggggacaagatcaaggccgacttccagccgcgggagaacatctccctcaagaccagcaagaagcacggcctgtga

SEQ ID NO: 1422 - RNA, 2994 nt, synthetic construct
  misc_feature 1..2994: note = Cas9 variant
  source 1..2994: mol_type = other RNA
atgggcaactacaccctggggctcgacatcggcagcaactccatcgggtgggccctggtggaggacgccgtcgaggcgccccgcatcgtggacatgggcgtgcgggtcttcccggagggggtggaccgcgacaccaagggcctggagaagtccaagaacgccacgcggcgcgaggcccggggcgcccgccggacccaccagcgccggcgccagcggaagcagcgcctcgtgcgggccctgcgccaggtcgggctgctcccctgcgacaaggcggaggtgcggagcctgttccagaccgacccctacgagatccgcaagcggggcctggaccaccgcctcgagctgtacgagatcgggcgggccttctaccacctgagccagcgccggggcttcaagtccaaccgcaagagcggggccctcaaggaggacggcaccgtgaagaaggaggccggcgagctgcagcgcaagatcgacgaggcggggtgccggacgatcggcgagtacttcgccgggctggaccccgagcagcagcgcatccggggccgctacaccttccggtccatgtaccagaaggagttcgacctcctgtgggccaagcaggtcgagttctacccgaaggtgctgaccgaggacctccgcagcaaggtgcgggacgagatcatcttcttccagcgccccctgaagtccgccaaggacctgatcggcgactgcgagctcgagcccaccgagaagcggtgcccccgcgccgactggtacgcgcggcgcttccggctgctgcaggacatcaacaacctcatcatccagaacccggacgggacggagcagaagctgagccccgaccagcgcgccgccctgctcggcgagctggggcagcgggagaagctgaccttcgacaacatccgcgccaagctcggcctgctggagacccagaagttcaacgccgagtaccggatcgggcgcaagggcaagaaggtcgaggcgatcaagggcgacgtgttcgtgtggaccatgcgggggaagtccgtcttcggccccaaggcctgggacgccatggccgacgagcgcaaggtgagcctcaacgagctgttcgtggagctggaggacgacgacctcgcccgcaagctggagacggagtacgggctgaccgacaagcaggtccaggcggccatgaaggcctccctcccccagggctacatgagcttctcccggaaggccgtgctgaagctgctcccgttcatggaggccggggcgctgacccacgaggccatcgaccaggccggctaccgcaaggaggagcccacccagacggacgccatcgcgcgggtgagcttcccgcccgacctgcgcaacccgatcgtccagaaggccctcttcgaggtgcggaaggtggtcaacgccctggtgcgcgagtacggcaagcccacccggatcaagatcgagatggcccgcgacgtccaggggtccaagcggcagcgcgaggagctgcactggcggaacgaggacaaccgcaagaagaacgaggaggtgcgggaccgcctccggaccgacatccacatcgacgaccccagccgcgacgacgtgatcaagtacaagctgtggcaggagtccggcaagatgtgcccctacaccgggcggcagatctgccaggaggccctgttcggcccgaaccccgagttccaggtcgagcacatcctgccctacgaccgcagcctcgacgacagctacatgaacctgacgctgtgcgaggtgcacgagaacatccacgggaagcggaaccagacccccttcgaggcgtacggctccggcgccgagcgctacgagcagatcaagcagcggatcaaggtgctcccgtggcccaagcgccagaagttcctgcagcaggagatcaacctggacagccacatctcccgcgagctcaacgacacccggtacatctgccgcgagaccgtcgcctacctgaagcagctgggggtgcacgtgcggggcacgcgcgggaagatcaccgccgagctccggcaccagtggggcctggacggcatcttcagcgagctgggggtccgccgggacgacgaccaccgccggcacgccgtggacgcgctcgtggtcgccgtgaccgacaacgagcacctccgccggctggccgtgtccaagtacgtcctggccggcccccgcttcgagaccccctggagcgccttccgggacgaggcgcgcgggaacgtgaagcggatgaacgtgtcccaccgcgtctgccggaaggtgagcggcgccctgcacgaggagacgaactacgggccgaccggcgtgcgcgaccaggccggccaggacatctacgcctaccggaagaagctggaggacctcaccacccccatggtcgagaagatcgtggaccccgtggtccgcgacatcgtgcgccagcggctgctgatgaaggggatcgacccggcggccgccgaccgcaagatccccaaggacgtgtggaaggagcccctctacatgcggcgcacgaagtccgacaagatgatccagatccggcgcgtccggatccacgacgtgaagaacagcatcatcgtgctgaccgacgagtccggccgcccctaccgggccgtcgagcccgggggcaaccaccacgtggaggtgttcgagtacgtccacgggaccaagaccggcacgcgcgaggccgaggtggtgaccatgttcgaggcggtccggcgcagccgggcccgcgcccccgtggtgcggcgcgaccacggccccgggacccggttcgtctgctccctggccatcaacgacatggtgatgatgcccgacaagagcggcaagatggacctcttccgcatccagaagatgtccgccagcaagcaggtctacttccggcaccacaccgcggcccgcatcgactccgagcggaccctgatccgcaagcaggcccacctgttcaacgggtacaaggtgagcgtggacccgacgggcgccatctgccgcgccaacgactga

SEQ ID NO: 1423 - RNA, 3000 nt, synthetic construct
  misc_feature 1..3000: note = Cas9 variant
  source 1..3000: mol_type = other RNA
atgaagatcctgggcttcgacatcgggatcaacagcatcggctgggccttcgtggaggacaaccagctccaggactgcggggtccgcctgttcaccaaggccgaggaccccaagaccaaggagtccctggcgctcccgcggcgcaacgcccggagcaaccgccggcgcctgggccggcgccggtcccgcctgatcgccctcaagcacatcatcagcaaggggctgaagctgaactaccaggactacatcgccaacgacggcgagctccccaaggcctacgagggccggctgatctccccctacgagctgcgctacaaggcgctcaacgagaagatcgagcccaaggacctggcccgggtgatcctgcacatcgccaagcaccgcgggtacatgaacaagaacgagaagaagtccagcgacaacgagaagggcaagatcctcagcgccctgaagacgaacgcgctgaagctcgagaagtaccagtccgtgggggagtacttctacaaggagttcttccagaagtaccgggagaacaccaaggacttcatcaacatccgcaacaaggagggcagctacgagaactgcgtcctggcctccgacctggagaaggagctcaagctgatcctggagaagcagaaggagtgggggtacagctacaacgacaacttcatcaaggagatcctcaaggtggccttcttccagcggccgctgaaggacttctcctacctggtgggcgcctgcaccttcttcgaggacgagaagcgcgcctgcaagaacagctactccgcgtgggagttcgtcgccctcaccaagatcatcaacgagctcaagagcctggagaaggagtccggcgagctcgtgagctcccagatcatcaacgagatcctgaaccacatcctggacaaggggagcatcacgtacaagaagttccgggagtacatcaagctccacgagagcatgaagttcaagtccctgaagtacgacaaggacaacgtggagagcaccaagctgatcgagttccgcaagctcgtcgagttcaagaaggccctgggcgagcactccctgagccgggaggagctcgaccagatcgccacctacatcaccctgatcaaggacaacgagaagctgaagatcacgctcgagaagtactccctgaacaacgagcagatcaagaacctgctcgagatcgacttcaacgaccacatcaacctgagcttcaaggccctgaacctcatcctgcccctgatgaaggaggggaagcgctacgacgaggcgtgcaagctgctcaacctgaagaccaagtccaacaaccagaagttcgacttcctgcccgccttctgcgacagcatcttcgcccaggagctcaccaaccccatcgtgaaccgcgccatctccgagtaccggaaggtgctgaacgccctgctcaagaagtacggcaagatgcacaagatccacatcgagctggcgcgcgacatcggcctgagcaagaagctccgggccaagatcgagaaggagcagaaggagaactacgagaacaacatctgggccctgaacgagtgcgagaagttcgggctgaaggccaacgccaagaacatcctcaagctgaagctgtggaaggagcagaaggagttctgcatctactccggcaagaagatcagcatcgagcacctccgcgacgagaaggcgctggaggtcgaccacatctacccgtactcccggagcttcgacgactccttcctgaacaaggtgctcgtgttcaccaaggagaaccaggagaagctgaacaagacgcccttcgaggccttcggggccaacgaggagcgctggagcaagatccaggccctggcgcagaacctcccctacaagaagaagaacaagatcctggacgaggccttcaagggcaagcagcagcaggacttcatctcccggaacctgaacgacacccgctacatcagcaccctcatcgtcaagtacaccaaggagtacctggacttcctgcccctcgacgagaaggaggacgtgaacctgaagtccggggagaagggcagcaagatccacgtgcagacgatcaacggcatgctgaccagcgtcctccggcacacctgggggttcgcccagaaggaccgcaacaaccacctccaccacgccctggacgccaccatcgtggcgtactccacgaacgccatcatcaaggccttcagcgacttcaagaaggagcaggagctgctgaaggccaagctgtacgccaaggagctcacctccgacagctacaagcaccaggcgaagttcttcgagccgttcgagggcttccgggagcagatcctgaaccagatcaacaagctgttcgtgtccaagccgccccgcaagcgggcccgcggggccctccacaaggagaccttctacagcaaggacgagatgatcaagaagtacaactcccaggagggcgtcgagatcgccctgaactgcgggaagatccggaagatcggcaccaagtacgtggagaacgacacgatggtgcgcatcgacatcttcaagaagcagaacaagttctacgccatccccatctacaccatggacttcgcgctgggcgtcctccccaacaagatcgtgatcatcgggaaggacaagaagggcaaccccaagcagtggcaggagatcgacgagagctacgagttctgcttctccctgcacaaggacgacctggtcctcatccagaagaaggacatgcaggagcccgagttcgcctactacaacgggttcgacatcagcaactccagcatctgcgtggagaagcacgacaacaagttcgagaacctgaccgacaaccagcggctgctgttcaccaacgccgagggcaacgtgaaggccaagaagatcgggatccagggcctgcgcatcttcgagaagtacatcatcacgcccctgggcgagaagatcaaggcggacttcaagccgcgggaggacatcgccctcaagacctccaagaagcacgggctgtga

SEQ ID NO: 1424 - RNA, 3003 nt, synthetic construct
  misc_feature 1..3003: note = Cas9 variant
  source 1..3003: mol_type = other RNA
atgaagatcctgggcttcgacatcgggatcaacagcatcggctgggccttcgtggagaacgacgagctcaaggactgcggggtccgcatcttcaccaaggccgagaaccccaagaacaaggagtccctggcgctgccgcggcgcaacgcccggagctcccgccggcgcctcaagcggcgcaaggcccggctgatcgccatcaagcgcatcctggccaaggagctcaagctgaacttcaaggactacgtggcggccgacggcgagctgcccaaggcctacgaggggagcctcgcctccgtgtacgagctgcggtacaaggcgctgacccagaagctcgagacgaaggacctggcccgcgtcatcctgcacatcgccaagcaccggggctacatgaacaagaacgagaagaagtccaacgacgccaagaagggcaagatcctcagcgccctgaagaacaacgcgctgaagctcgagaactaccagagcgtgggggagtacttctacaaggagttcttccagaagtacaaggagaacaccaagaacttcatcaagatccgcaacaccaaggacaactacaacaactgcgtgctgtccagcgacctggagaaggagctcaagttcatcctggagaagcagaaggagttcggctacaagtactccgaggggttcatcaacgagatcctgaaggtcgccttcttccagcggcccctcaaggacttcagccacctggtgggcgcctgcaccttcttcgaggaggagaaccgcgcctgcaagaactcctacagcgcctgggagttcgtggcgctgacgaagatcatcaacgagatcaagtccctcgagaagatcagcggggagatcgtctccacccagaccatcaacgaggtgctgaacctgatcctcgacaagggcagcatcacctacaagaagttccggtcctgcatcaacctgcacgagagcatcagcttcaagtccctgaagtacgacaaggagaacgccgagaacgccaagctcatcgacttccgcaagctggtggagttcaagaaggccctgggcgtccacagcctctcccggcaggagctggaccagatcagcacgcacgtgaccctgatcaaggacaacgtgaagctcaagaccgtcctggagaagtacaacctgtccaacgagcagatcaacaacctcctggagatcgagttcaacgactacatcaacctgagcttcaaggccctcgggatgatcctgcccctgatgcgcgagggcaagcggtacgacgaggcgtgcgagatcaccaacctcaagccgaagacggtggacgagaagaaggacttcctgcccgccttctgcgactccatcttcgcccacgagctgagcaaccccgtggtcaaccgcgccatctccgagtaccgcaaggtgctgaacgccctcctgaagaagtacgacaaggtgcacaagatccacctggagctcgcgcgggacgtcgggctgagcaagaaggcccgcgagaagatcgagaaggagcagaaggagaaccaggccgtgaacgcctgggcgctgaaggagtgcgagaacatcggcctcaaggcctccgccaagaacatcctgaagctgaagctctggaaggagcagaaggagatctgcatctacagcggcaacaagatctccatcgagcacctgaaggacgagaaggccctggaggtggaccacatctacccctacagccggtccttcgacgacagcttcatgaacaaggtcctcgtgttcaccaaggagaaccaggagaagctgaacaagaccccgttcgaggccttcgggaagaacatcgagaagtggtccaagatccagaccctggcgcagaacctcccctacaagaagaagaacaagatcctggacgagaacttcaaggacaagcagcaggaggacttcatcagccgcaacctgaacgacacgcggtacatcgccaccctcatcaccaagtacaccaaggagtacctgaacttcctgcccctcaacgagaacgagaacacgaacctgaagtccggcgagaaggggagcaagatccacgtccagaccgtgaacggcatgctgaccagcgtgctccgccacacctgggggttcgacaagaaggaccggaacaaccacctccaccacgccctggacgccatcatcgtcgcctactccacgaacagcatcatcaaggcgttctccgacttcaagaagaaccaggagctgctgaaggcccgcttctacgccaaggagctgaccagcgacaactacaagcaccaggtgaagttcttcgagcccttcaagggcttccgggagaagatcctctccaagatcgacgagatcttcgtgagcaagccgccccgcaagcgggcccgcggcgccctgcacaaggagaccttctactccgaggacgagatgatcaagaagtacaacagcaaggaggggctgcagatcgcgctctcctgcggccgggtccgcaagatcgggaccaagtacgtggagaacgacacgatggtgcgggtcgacatcttcaagaagcagaacaagttctacgccatccccatctacgccatggacttcgccctgggcatcctgcccaacaagatcgtggtggtcgggaaggacaagaacaacaacccgaagcagtggcagaccatcgacgagagctacgagttctgcttctccctctacaagaacgacctgatcatgctgcagaagaaggacatgcaggaggcggagttcgcctactacaacggcttcgacatcagcacctccagcatctgcgtggagaagcacgactccaagttcgagaacctcaccagcaaccagaagctgctgttctccaacgccaaggagggcagcgtgaaggtcgagaacctcgggatccagaacctgaagatcttcgagaagtacatcatcacgcccctgggcgacaagatcaaggccgacttccagccccgcgagaacatcagcctcaagacctccaagaagaacgggctgtga

SEQ ID NO: 1425 - RNA, 3003 nt, synthetic construct
  misc_feature 1..3003: note = Cas9 variant
  source 1..3003: mol_type = other RNA
atggcccgcgcccagcggcgcctgatcagccggcgcgcgaaccggatgaacaagctccgccggctgctgaagcaggagaacgtgctccaggccaacgactacgacgagaagggcctgatcatcgggctgcccaaccaggcctgggagctccgcgcccagggcctggaccggaagctggagccgaaggagtgggccgcggtcctcatcaacctggtgaagcaccgcgggtacctgtcccagcggaagaacgagagccagaccgccgacaaggagctcggcgccctgctgtccgggatgaaccacaaccaccagctcctgcagagccagtccaaccagtaccgcacccccgccgagctggcgatcaagcagttcgccacgcaggacggccacatccggaaccagcgcggcgcctacacccacaccttcaaccggctcgacctgcagaacgagctgaaccagctgttcgacgcccagacccgcctggggaacccccacgtgagcggctccctgaagacggccatcaacgacctcctgatgaaccagaaggcggccctgagcggggacgccatcctcgagatgctgggccggtgcaccttcgagccctccgagtacaaggccgccaagaacacctacagcgcggagcgcttcgtctggctggggaagctcaccaacctgcggatccaggacaacggcctggagtccgccctcagccgcgagcagcgggagctgctgctcaacgagccgtacaacaagacgaagctgacctaccagcaggtccgcaagctgctccgcctgcccgagaccgccttcttcaagggcctgcggtacgggaaggacaacgccgagtccgccaccttcatggagatgaagtcctaccacgcgatccgcaagagcctcgagaacaagagcctgaagtccgagtgggagaagctgaagacgcagcccaagctcctggacctgatcggcaccgccttcagcatctacaagaccgacgacgagatcgccgggtgcctcaagaaccagctgcccgagaacgtgatcatcgccctgcaggagcagctgaacttctccaacttcatggagctcagcctgaaggccctggagaagctcctgccgctgatggagcagggcctccggtacgacgaggcgtgcacccagatctacggcaaccgccacgagaagatcgccgacaagacggagaagttcctgcccaacatccccgccgacaagctgcggaaccccgtggtgctccgcaccctgacccaggcccggaaggtgatcaacgcgatcatccgccggtacgggagcccggcccgcgtccacatcgagaccggccgggaggtggggaagtccttcagcgaccgcgacaagctgaagaagcagcaggaggagaaccaggagcagcggcgccgggccatcgacgagtggaagcagttcttccccaacgccgcccacgagcccaaggcggtggacatcctcaagctgcgcctgtaccagctccagcagggcaagtgcctgtactccgggctgcccatcgacgtccggcgcctcccggagaagggctacgtggagatcgaccacgccctgcccttcagccggacgtgggacgactccttcaacaacaagatcctggtgctcgccagcgagaaccagaacaagggcaaccagaccccctacgagtacctgcgcggggccgacaactccgagagctggcgcctgttcgtcgagaacgtgcagaactgccagttctcccccaacaagaagcagaagatcatggccaagcagctcgacgagaagggcttcctggagcggaacctgaacgacacccgctacgtgagccggttcctctgccagttcatctccgagcacctccacctgaccgggaagggcaagaagcgcgtcttcgcgagcaacgggcagatcacggccctcctgcggggccgctggggcctgtccaagaaccgggaggagaacgaccgccaccacgccgtggacgccgtggtcgtggcctgcagcaccgtggcgatgcagcagaagatcacccagttcgtccggtaccagaaggggaacgtgttcaccggcgagcgcatcgacaaggagacgggggaggtcatctccatccacttcccgaccccctgggagcacttccgggaggaggtgatgatccgcgtgttcgacgacaaccccctccggaccctgcccgagaagctgccgaaccgccccgaggccctccacgagtacgtcatgcccctgttcgtgagccggatgcccacccgcaagatgacgggccaggggcacaaggagaccatcaagtccgccaagcggctggacgagaagatcagcgtgctccgcgtcccgctgacccagctgaagctcaacgacctggagaacatggtgaaccgggagcgcgagcccgccctgtacgaggcgctcaaggcccggctggagcagttcaagaacgaccccgccaaggccttcgccgagccgttcttcaagcagggcggccagcaggtcaaggcggtgcgcgtggagatcgtgcagaagtccgggatgctgctccgcaagatcaacggcgtcgccgacaacgggagcatggtgcgggtggacgtcttcgagaagtccggcaagttctacctggtgcccatctacgcctggcaggtcgccgagggcatcctgcccaactacgccgtggtggcgcacaaggacgagagcgactggatcctcatggacgagagctaccacttcaagttcgccctgtacaagaacgacctgctcgaggtgcagaccaagaagggcgggatcatggggtacttcgcctccctggaccgcgccacgggcgccatcaccatccgggagcacgaccgcgacaagaagaagtgcaaggacggggagcaccggagcatcggcgtcaagatggcgtccagcttcaagaagctccaggtggacgagctgggcaagaacatccacgagacccgctcccggaagcgccccaacatcgggtga

SEQ ID NO: 1426 - RNA, 3012 nt, synthetic construct
  misc_feature 1..3012: note = Cas9 variant
  source 1..3012: mol_type = other RNA
atgcgcatcctgggcttcgacatcgggatcaacagcatcggctgggccttcgtggagaacgacgagctcaaggactgcggggtccggatcttcaccaaggccgagaaccccaagaacaaggagtccctggcgctgccgcgccggaacgcccgcagctcccggcgccggctcaagcgccggaaggcccgcctgatcgccatcaagcggatcctggccaaggagctcaagctgaactacaaggactacgtggcggccgacggcgagctgcccaaggcctacgaggggagcctcgcctccgtgtacgagctgcgctacaaggcgctgacccagaacctcgagaccaaggacctggcccgggtcatcctgcacatcgccaagcaccgcggctacatgaacaagaacgagaagaagtccaacgacgccaagaagggcaagatcctcagcgccctgaagaacaacgcgctgaagctcgagaactaccagagcgtgggggagtacttctacaaggagttcttccagaagtacaagaagaacaccaagaacttcatcaagatccggaacaccaaggacaactacaacaactgcgtgctgtccagcgacctggagaaggagctcaagctgatcctggagaagcagaaggagttcggctacaactactccgaggacttcatcaacgagatcctcaaggtcgccttcttccagcgccccctgaaggacttcagccacctggtgggggcctgcaccttcttcgaggaggagaagcgggcctgcaagaactcctacagcgcctgggagttcgtggcgctcacgaagatcatcaacgagatcaagtccctggagaagatcagcggcgagatcgtccccacccagaccatcaacgaggtgctgaacctcatcctggacaaggggtccatcacctacaagaagttccgcagctgcatcaacctgcacgagtccatcagcttcaagagcctcaagtacgacaaggagaacgccgagaacgccaagctgatcgacttccggaagctggtggagttcaagaaggccctcggcgtccactccctgagccgccaggagctggaccagatctccacgcacatcaccctcatcaaggacaacgtgaagctgaagaccgtgctggagaagtacaacctcagcaacgagcagatcaacaacctgctggagatcgagttcaacgactacatcaacctctccttcaaggccctgggcatgatcctgccgctcatgcgggaggggaagcgctacgacgaggcgtgcgagatcgccaacctgaagcccaagaccgtcgacgagaagaaggacttcctgcccgccttctgcgacagcatcttcgcccacgagctgtccaaccccgtggtgaaccgcgccatcagcgagtaccggaaggtcctcaacgcgctgctgaagaagtacggcaaggtgcacaagatccacctcgagctggcccgcgacgtggggctgtccaagaaggcccgggagaagatcgagaaggagcagaaggagaaccaggccgtcaacgcgtgggccctcaaggagtgcgagaacatcggcctgaaggccagcgccaagaacatcctgaagctcaagctgtggaaggagcagaaggagatctgcatctactccggcaacaagatcagcatcgagcacctgaaggacgagaaggccctcgaggtggaccacatctacccgtactcccgcagcttcgacgactccttcatcaacaaggtgctggtcttcacgaaggagaaccaggagaagctgaacaagacccccttcgaggcgttcgggaagaacatcgagaagtggagcaagatccagaccctcgcccagaacctgccctacaagaagaagaacaagatcctggacgagaacttcaaggacaagcagcaggaggacttcatctcccggaacctcaacgacacccgctacatcgccacgctgatcgccaagtacaccaaggagtacctgaacttcctcctgctgagcgagaacgagaacgccaacctcaagtccggcgagaaggggagcaagatccacgtgcagaccatcagcggcatgctgacctccgtcctgcggcacacgtgggggttcgacaagaaggaccgcaacaaccacctccaccacgcgctggacgccatcatcgtggcctacagcaccaactccatcatcaaggccttcagcgacttccggaagaaccaggagctgctcaaggcccgcttctacgcgaaggagctgacctccgacaactacaagcaccaggtgaagttcttcgagcccttcaagagcttccgggagaagatcctgtccaagatcgacgagatcttcgtcagcaagccgccccgcaagcgggcccgccgggccctccacaaggacaccttccactccgagaacaagatcatcgacaagtgcagctacaactccaaggagggcctgcagatcgccctgagctgcggccgcgtgcggaagatcgggacgaagtacgtggagaacgacaccatcgtccgcgtggacatcttcaagaagcagaacaagttctacgcgatccccatctacgccatggacttcgccctcggcatcctgcccaacaagatcgtgatcaccgggaaggacaagaacaacaacccgaagcagtggcagaccatcgacgagtcctacgagttctgcttcagcctgtacaagaacgacctcatcctgctgcagaagaagaacatgcaggagcccgagttcgcctactacaacgacttctccatcagcacgtccagcatctgcgtcgagaagcacgacaacaagttcgagaacctcaccagcaaccagaagctgctgttctccaacgccaaggagggcagcgtgaaggtggagtccctcgggatccagaacctgaaggtcttcgagaagtacatcatcacgcccctgggcgacaagatcaaggcggacttccagccccgggagaacatcagcctcaagacctccaagaagtacggcctgcgctga

SEQ ID NO: 1427 - RNA, 3012 nt, synthetic construct
  misc_feature 1..3012: note = Cas9 variant
  source 1..3012: mol_type = other RNA
atgatcgacgagagcctgaccttcggcatcgacctcgggatcggctcctgcgggtgggccgtgctgcgccggcccagcgccttcggccgcaagggggtcatcgagggcatgggctcctggtgcttcgacgtgccggagaccagcaaggagcggacgcccaccaaccagatccgccggtccaaccgcctgctccggcgcgtgatccggcgccggcgcaaccggatggcggccatccgccggctgctgcacgccgccgggctcctgcccagcaccgactccgacgccctgaagcgccccggccacgacccgtgggagctccgggcgcgcgggctggacaagcccctgaagcccgtcgagttcgccgtggtgctcggccacatcgccaagcggcgcgggttcaagagcgccgcgaagcggaaggccaccaacatctccagcgacgacaagaagatgctgacggccctggaggccacccgcgagcgcctcggccggtaccgcaccgtcggcgagatgttcgcccgggaccccgacttcgcgtcccgccggcgcaaccgggaggggaagtacgaccgcaccacggcccgggacgacctggagcacgaggtgcacgccctgttcgccgcccagcgccggctcggccaggggttcgcgagcccggagctggaggaggccttcaccgcctccgccttccaccagcgccccatgcaggacagcgagcggctggtgggcttctgccccttcgagcgcaccgagaagcgggccgcgaagctcaccccctccttcgagcgcttccggctgctggcccgcctcctgaacctgcggatcacgaccccggacggcgagcgccccctcaccgtcgacgagatcgccctggtgacccgcgacctggggaagacggccaagctcagcatcaagcgggtgcgcaccctgatcggcctggaggacaaccagcggttcaccaccatccgccccgaggacgaggaccgggacatcgtcgcccgcaccgggggcgcgatgacggggaccgccaccctccggaaggccctgggcgaggccctgtggacggacatgcaggagcgccccgagcagctcgacgcgatcgtccaggtgctgtccttcttcgaggccaacgagaccatcaccgagaagctgcgggagatcggcctcaccctggccgtgctggacgtgctcctgacggccctggacgccggggtgttcgcgaagttcaagggcgccgcccacatcagcaccaaggccgcccgcaacctcctgccgcacctggagcaggggcggcgctacgacgaggcgtgcaccatggccggctacgaccacgccgcctcccggctcagccaccacgggcagatcgtcgccaagacccagttcaacgcgctggtgacggagatcggcgagagcatcgccaaccccatcgcccgcaaggccctgatcgagggcctgaagcagatctgggcgatgcggaaccactgggggctccccggctccatccacgtggagctggcccgcgacgtcgggaacagcatcgagaagcggcgcgagatcgagaagcacatcgagaagaacaccgccctgcgggcccgcgagcggcgcgaggtgcacgacctcctggacctggaggacgtgaacggcgacaccctcctgcgctaccggctgtggaaggagcagggcgggaagtgcctctacaccggcaaggccatccacatccgccagatcgcggccacggacaactccgtccaggtggaccacatcctgccctggagccggttcggggacgactccttcaacaacaagaccctgtgcctcgccagcgccaaccagcagaagaagcgctccaccccgtacgagtggctgagcggccagaccggggacgcctggaacgcgttcgtccagcggatcgagaccaacaaggagctgcgcggcttcaagaagcggaactacctcctgaagaacgccaaggaggccgaggagaagttccgctcccggaacctgaacgacacgcgctacgccgcccgcctcttcgcggaggccgtgaagctgctgtacgccttcggcgagcggcaggagaagggcgggaaccggcgcgtgttcacccggcccggggccctcaccgcggccctgcgccaggcctggggcgtcgagagcctgaagaagcaggacgggaagcggatcaacgacgaccgccaccacgccctcgacgccctgaccgtggcggccgtggacgaggccgagatccagcggctgacgaagtccttccacgagtgggagcagcagggcctcggccgccccctgcgccgggtcgagcccccgtgggagagcttccgcgccgacgtggaggccacctaccccgaggtgttcgtcgcgcggcccgagcgccggcgcgcccggggcgaggggcacgccgccaccatccgccaggtgaaggagcgggagtgcacccccatcgtgttcgagcgcaaggccgtctccagcctgaaggaggcggacctcgagcggatcaaggacggggagcgcaacgaggccatcgtggaggccatccggtcctggatcgccacgggccgcccggccgacgcgccgccccggagcccccgcggggacatcatcaccaagatccggctggccaccaccatcaaggccgccgtgcccgtccgcggcggcacggcggggcggggcgagatggtgcgcgccgacgtgttctccaagcccaaccggcgcgggaaggacgagtggtacctggtccccgtgtacccgcaccagatcatgaaccgcaaggcctggcccaagccgcccatgcggagcatcgtggccaacaaggacgaggacgagtggaccgaggtcggccccgagcaccagttccgcttctccctctacccccggagcaacatcgagatcatccgccccagcggggaggtgatcgagggctacttcgtgggcctgcaccggaacaccggggccctgatccccaccccggtcggccccgactcctacgtgatcgcgtga

SEQ ID NO: 1428 - RNA, 3024 nt, synthetic construct
  misc_feature 1..3024: note = Cas9 variant
  source 1..3024: mol_type = other RNA
atgaaggtgctgggcttcgacatcgggatcaacagcatcggctgggccttcgtcgagaacaacgagctcaaggactgcggggtgcgcctgttcaccaaggccgagaaccccaagaccaaggagtccctggcgctcccgcggcgcaacgcccggagctcccgcgtgcggctgcgccggcgccggagccgcctgctctccctgaagcacatcatcagcaaggagttcggcctgcactacgaggactacatcgccctcgacgggaacctgcccaaggcctacacgggcaagatcgagtccatctacaagctgcggtacgaggccctcagccaggcgatctccaaggaggacctggcccgcgtcatcctgcacatcgccaagcaccggggctacatgaacaagaaccagaagaccagccaggactccgagaagggggccatcctcagcgcgatcaaggagaactccaacaagatcaagcactaccagaccgccggcgagtacttctacaaggagctgttcgagaacctgcgcgacgggaccaaggagttcaagaacatccggaacaaggccatgaagaacgagaagacgggcaacatggagagcacctactacaacaccatcctcgcctccgacctggagaaggagctgaagctcatcctggagaagcagcaggcctaccacaactacagcgacaccttcatcaaggaggtgctggagatcgcgttctaccagcgccccctcaaggacttctcccacctggtggggagctgcacgttctacgagaacgagaagcgggcctgcaagaactcctacagcgcctgggagttcatcgccctgggcaagatcatcaacaccctcgagagcatcaagaaggacaccggcgagatcttctccaacgagatcatcacccagatcctgaaggaggtcctggacaaggggagcctctcctacacgaagctgcgcaagatgatcaacctggacgagaaggtgaagttcaagggcctcaagtacgacaaggagggggtggagaagaccaacctgatcgagttcaagaagctgaaggagttcaagaaggccctcggcgagcacaacctggagcggaagaccctggacgagatcgcgacccacatcacgctcaccaaggacgagaaccagctgaagaagcagctggagcagtacgccctcagccagaaccagatcgacgccctggccgagctggacttcaacgaccacatcaacctctccttcaaggccctgtacgagatcctgcccctcatggagaagggcaagcgctacgacgaggcgtgcaacgagctggggctgaaggccaagaccagcaaccagaagtccgagttcctgccggccttctgcgacagcatcttcgcccaggagctcaccaaccccatcgtcaaccgggccatctccgagtaccgcaaggtgctgaaccgcctgctcaagaagtacggcaagatgcacaagatccacatcgagctggcgcgggacgccgggctgagcaaggaggcccgcaacaagatcgagaaggagcagaaggagaacaaggacatcaacgacaaggccgagaagacgtgcaaggagttcggcctcaagcccaacgcgaagaacatcctgaagatcaagctgtggcgggagcagggggagatctgcgcctactccggcaagaagatcaccatcgacgacctcaaggaggacaaggccctggaggtggaccacatctacccctacagccgctcctacgacgacagctacaacaacaaggtcctggtgttcatcaaggagaaccagctcaagctgaaccagaccccgtacgaggccttcggctccaaccaggagaagtggagcaagatccaggtgctggcccagaagctcccctacaagaagaagaaccggatcctggacgagaacttcaagaacaaggaccagatcgagttcatctcccgcaacctgaacgacacccggtacgcgacgagcctcatcgccaagtacaccaaggagtacctggagttcctgcccctctccgacgacgaggacatcagcctcaagagcggggagaagggctccaagacccacgtccagaccatgaacgggatgctgacgagcgtgctccgccacgcctggggcttctcccagaaggaccggaacaaccacctccaccacgccctggacgccatcatcatcgcgtacagcaccaactccatcatcaaggccttcagcgacttcaagaagaaccaggagatcctgaaggccaagctgtacgccaagaagctgacctccgaggagtacaagaaccagagcaagttcaccgggttcgagaagtaccgctccaagatcctcgagaagctggacagcatcttcgtgtccaagcccccgaacaagaacacgaagggcgccctgcacgagcagaccttctacagctaccaggacatcctcgaggagtacaagacccaggagggcctgaagcgggcgctggagtgcgggaaggtccgcaagatcggcaccaagtacgtggtgaacgaccggatggtccgcctcgacatcttcaagaaggacaacaagttctacgggatccccatctacacgatggacttcgccctgggcgtgctgcccaacaaggtggtcaccatcgggaccgacaaggacaagatcaagaaggagtggaagaccatcgacgagacctacgagttctgcttctccctctacaagggcgacctggtgctgatccagaagaaggagatgcaggagagcgagttcgcctactacaacggcttcgacatctccagcgcctccatcagcctcgagaagcacgacaacaagttcgagaacctgacggagaaccagaagctgctgttccccaaggcgaaggagggggacgtcgaggtgcggggcatcgggatccagggcctgaaggtgttcaagaagtacatggtcaccccgctgggcgagatccaggagacccgcaccgaggcccggcagaacatccagccccgcaagaagcacgggctccggtga

SEQ ID NO: 1429 - RNA, 3033 nt, synthetic construct
  misc_feature 1..3033: note = Cas9 variant
  source 1..3033: mol_type = other RNA
atgagcgactccagctacgtgctgggcctcgacctggggaccaactccatcggctgggcctgcgtccgcctgaacaaggggaagcccgacggcctcctggcccagggggtgcggatcttcgaggcgggcctggagatcgacgcctacggccgcgggaccccgctcaacacggagcggcgcaacgcccggcagcgccggcgcctgcacgaccggcgcaagcggcgcatcctgaaggtgcggcgcatcctccaggaggccggcatgctgcccgccaacaagcccgaccacaaggacgcggagtggaagatgctgctcgcccggaacccctaccgcctgcgggccaaggccctggacgagcagatcgacctcaaggagatcgggctgtgcatctaccagttcgcgcaccgccggggcttcctgagcaactccaagatcctcaagaaggacgacgaccgcgggaagctgaaggacgccaccaaggccttcgccgaggacatggagcagaagggcgcccggacctggggcgagtacctgagccacctcgacccgcacgagcagcgcatccgcaccaactacacgctgcgggagtggtacacctccgagttcgacctgatctgggagaagcagcagagcttctacccccacgtcctcaccgacgacctgtacaagcgcgtgaaggaggcgctgttctaccagcggcccctcaagtcccaggcccacctcctggggcagtgcgagctggagcccggccgcaagcgggccccgttcgccctgctgatggcccaggagttccgcctcctgcagagcctgaaccacctccgggtggtctccagcaccggggacgagcgcctgctgacggacgaggagcggaagcaggcgctcgccctgctgcgctcccggggcaaccagaagttcaccaccctccgcaaggtgctgaacctgcggggcaccaagttcaacctcgagcgcgggggcgagaagacgatccaggggaacaacaccgccgccgccctgggcaacctgttcggggaggcgtgggaccacttcagctccgagcagaagaaccagatcgtggaggaccggctcaccatcggcgacaccgacgccctgatccgccggatgaagaagacgtggggcctggacagcgtcaccgccgagatgttctccgagaccgagctggaggacgggtactgcggcttcagccgcaaggccctcgagaagctgctgcccctcctggagcgggggcacgccctgatggaggcggtgcaggccgcctaccccgactaccagaagaacctcccccgcaccgacacgctgccgcccctggagaacctccgcaaccccatcgtgcagcggaccctgtccgagctgcgccgggtcgtgaacgccatcatcaaggagtacggcaagagcgacaagatccgcatcgagctcgcgcgggacatgaagcagaccgccaagaaccgcgagaagtcctgggaccggatgcgcgtgcgggagcgccagcggaaggaggccgccaagaagatcctggaggagaccgggaaccccgccccgcgccggcacgagatcgagaaggtcctgctcgcggaggagtgcaactgggagtgcccctacacgggcaagcgcatctgcatgaacaccctgctgggcgacgcgccccagttcgacatcgagcacatcatccccttcagccggagcttcgacaactccttcagcaacaagaccctctgcgacgtgaactacaaccgcaacgtgaaggggaacaagaccccgtacgagtccgccagcgagacggagcacgaggagatggtctgccgggtgaagcgcttcaccggcgactacaaggagatcaagctggaccggttcaacacccgcgagaccgactcccgggccgacttcatcgaggagttcagcacgtcccagctgaacgacacccgctacgccagccgcctcgccggggagtacctgggcaagctgtacgggtccgagtggcggaagcacatccagatcgccaagggcggcaccaccaagtacctccgcgacgcctgggacctgaaccggatcctgagcgacgggggcacgaagtcccgcgacgaccaccggcaccacgccgtggacgccgtcgtggtggcgctcaccacgccccagaccgtcaaggccctgagcgacgccaaccagcgcgcccccgagcaccggcgctacgcgttctccgacatgcccctgccgtgggagaccttccggcaggacgtggagcaggccatcaacagcatcaccgtctcccacaaggtgtgccgcaaggccaacgggcagctccacaaggagaccttctacggcctgatcaaggaccggaagaccggcgacacccgcacggtgctgcggaagcccctccacgagctgaccgacaaggagatcaagcgcgccgagatcgtcgacagctccatccggaagctgatcgagcagaagctcaaggacctggaccagccgcccaagaccgccttcaaggaccgcaacaaccaccccttcatcatcgacaagaacgggaacaagcggttcatccacaaggtgcgcgtgtaccaggacgcgaagcccgtcaagatcgccgagaaccggcacgtgaagctgggcgggaaccaccacctcgagatcttcgaggtgatcgacaagaagggcaaccccacctggaagtgcgaggtcatcagcctgttcgacacgcgccagcgcgtgaaggagaagcggccggtgatcgtccgccaggaccagaacgggaaccccctgaagttcagcctctccatcggcgaggccgtgcagctggactggaacggcgggcgggagaccgccgtggtccagaagatgagcaagacccccaacaccgtggagtacgtgttccgcaagcacaacgacgcccggaaggcggccgacatcccctacaaggagacgatcaccgtcaagtccgacagcgccctgttcgcctccaacctccagaagatcgtgatcaccccgaccggcctgatccgccgggccaacgactga

SEQ ID NO: 1430 - RNA, 3033 nt, synthetic construct
  misc_feature 1..3033: note = Cas9 variant
  source 1..3033: mol_type = other RNA
atgaagaaccgcaacgtgatcggcatcgacgtcgggaccaacagcatcggctgggccctggtggaggagaacgagaacgggctcccccagtccctgaaggccgcgggcgtgcggatcttccaggaggccgtcgaggccaagacccgcacgccgaagaaccacaagcggcgccaggcccggctggcccgccgggtgctcgcgcgccgggcccgccggaagcagcgcctgcagaacctgctcctgaagcacgggctgctccccggcggcgtgaccgaccccgtccagcgggaggccgccttcaccaccctgggggacccctaccagctgcgcgcgaagggcctcaacctgccgctggggctccacgagttcggccgggtgctgttccagctgggggcccgccggggcttcctcagcaaccgcaagacgcggtacggccacctgaacaagctggacgagctcgccgacctgatcgaggccgaggacgccgcgcccaagaccggggacgccgaggagggcatcatccgcaaggagatcggggagctgcggcaggccatgtccgccgccggcagccgcaccctcggcgagtacctggcggggctggccaaggaggagcgcaagcggtgccgccacaccgagcgggccatgctcgaggaggagttcgagcgcctgtggatggtgcaggcccggttccaccccgagctgtccgacgagctcaaggtccaggtgcacacggtgatcttcttccagcgccccctcaagagcaaccgggcctccctgggcaagtgcagcctggagccgtcccgccggaaggcggcccgcgcctggcccgaggcccagcggttccgcctgctgcaggacctcaacaacctggagatcctggacccccggaccggggagctccgccggctgcgcgacaccgagcgggccatcctgctcaacgcgctggagcagcagaagtccatgacctggaacgccgtccgcaagaagctgggcctccaccagggggagaagttcaacctggagacgggcgccaaggccgagaccggcctgaaggggctccagaccctggcgagcctgcacgccatcctgcagggctggttcgacgagctcggggacaagcgggacctgctgatcgaggacctcatcaccatcgaggacagcgccggcctgtaccgccgcctgcgggagcactgggggttcgaccgcgagacggccttccggctcgccaccctggagctggagcccggctacgcgtccctcagcctgaaggccatccgcaagctgctcccgcacatgggcgccgggcaccggtactccgaggcccgccagcaggtcggctacgggtacgagaccggccagcgggacctgcaggagcgcctgggggagccgcccgacccccggaaccccgtggtggacaaggccctccacgagctgcgccgggtgatcaacgcgctgatccaccgcttcggccggcccgacgtggtccgcgtggagctcgcccgggacctgaagctggccaagcgcgacaaggagcggctcgagaagcagaaccgcgagaaccagcggctgaaccgcaaggccgaggccgcgctggccgagctcggcctggggcagcccagccgggacgacctgatcaagtaccgcctctgggaggagtccaagggcctgtgcccctacaccgggcgcgagatcggcctgagcaccctcttctccccggaggtggacgtcgagcacatcatcccctacagccggtgcctggacgacagctacatgaacaagacgctgtgcatgaccgaggagaaccgcatgcagaagggcaaccggaccccctgggaggcctacgggggcgaccccgcccgctacgagcagatcctccagtgcgcgcggtacttcccgatggccaagcgcaagcggttcctggagcaggggtccgacttcgtggaccagttcatccagcgccagctgaacgacacgcggtacatcgccaagctcgccaaggagtacctggccgcggtgtgcaccaacgtccaggtgaccaagggcgggaccacggccatgctgcgccaccactggggcctcaaccggctgctgggcgaggacgacgggcagaaggagcgcggcgaccaccggcaccacgccctcgacgccgccgtcatcgcggtgaccagccgctccctgtaccagcggctggcccgcatcgcccaccagcgggggcacgcccccagccagcgcggcttctacatcgacccgccctggcaggggtaccaggccgacctcgcgcagaccctggccggcatcgtggtctcccacgccaccaaccggaagctgacgggcgccctccacgaggagaccgcgtacgggcacatcccccacgtgggcttcgtgtaccgcaagaccctgaacaaggacttcaagctgggggacatcgaggccatctacgaccccagcctccaggagctggtcaaggcccacctggagcaccacggcaacgaccccaagcgcgccttcgccgaggggatccagtgctaccacaaggacggccacaccccgatcaagcgggtgcgcatccgggcgaagcaggtctccgagaagggcacgttcagcatctccgaccgcgccgggcgggcctacaagcaccacaagaccggcagcaaccaccacgtggagatcctccgccaccgggccaccgggaagatcgagcccgtgtacctgaccaccaaggaggccacggagcgcgcgcggcgcggcggggagcccgtgatccagcgggaccacggccccgagtgggagttcatcatctccctgtgcatcaacgacatggtccgcctcggcgagggcggccaggtggcctacttccgggtgcagaagatcgaggccaccaacaaccgcgtcaccctgcggagccacctggccgccaccctcgacgacgaggacatgaaggtgacgacctccgtgccgaagctggcggtcatgcccgggttccagaaggtgctggtgaccgccgtcggggaggtgctcgagctgcacgactga

SEQ ID NO: 1431 - RNA, 3033 nt, synthetic construct
  misc_feature 1..3033: note = Cas9 variant
  source 1..3033: mol_type = other RNA
atgaagcgcatggccgccgtgggcctgatgcccgcggacccgaccgaggccaaggccctcgagctgctggacccctacgccctccgggccgcggggctggaccaggccctgcccctcacccacttcggccgcgccctgttccacctgaaccagcggcgcgggttcaagagcaaccggaagacggacaagggcgacaacgagtccgggaagatcaaggacgccaccaagcgcctcgacgaggagatggcgatcaagaacgcccggacctacggcgagttcctgcacatgcgccggaccagcgccacggaccccaagaacgtcccgaccgtgcgcacccggctgtccatcgcccgccgggacaacgccgagaaggaggaggcgggctacgacttctaccccgaccgccggcacctcgccgaggagttcgacaagctgtggaaggcccaggccgggtacagccccgacgtgctgaccgacgagctccgcgacgagatctccgtcatcatcttccaccagcggcccctgaagacgccggaggtgggcctgtgcctcttcagcgggtcccacggcgtgcccaagaaggacaagcgcatccccagcgcccaccccctgaaccagcggcgcatcctgttcgagaccatcaacaacctccgggtcgcggcccgcggggagccggcccgcggcctgacccgggacgagcgcgacgccatcgtgcacgccctggacaacaaggcgcacaccaagtccctcagcggcatgtccatgaagctgaaggccctggggaaggtgatcaagctccggcccgagcagagcttcacgctgcagaccgccaaccgcgagaccatcgcctgcgaccccgtccgggcctccctgagccaccccgaccgcttcggcccgcggtggtccatgctcgacgcggacgcccagtgggacgtggtgcagcgcatccgggccgtccagagcgaggccgagcacgacgcgctggtgaagtggctgatggccacccacgggctcgaccgcgaccacgccgagtccacggccaaggcgcccctgcccgagggctacggccggctggggctcaccgccaccaagcgcatcctggccgccctggaggccgacgtgatcccctacagcgacgccgtcaaggcgtgcggctggcaccactccgacgggcggaccggcgaggtgctcacggagctgccgtactacgggcagatcctggaccgccacgtgatccccggcacctacaacgagagcgacgacgacgtcacccggtacggccgcatcaccaaccccacggtgcacatcgggctcaaccagctgcggcgcctggtgaacaagatcatcaccgtctacggcaagcccgacgagatcgtggtggagctcgcccgggacctgaagctgagcgaggaccagaagcgcgacgtccagcgcgacatcaagaagaacaccgacgccgccatcgcccgcggggcgaagctctccgagatgggcgtgccggacaccggggccaaccggatggtcctgcggctgtgggagagcctgggcgacgacgtgatgacgcgcaactgcccctactccggcaagcggatcagcgccaccatgctgttcgacgggtcctgcgacgtggaccacatcctgccctacagccgcaccctggacgacggcttcgccaaccggaccctctgcctgaaggagttcaaccgccagaagacggacaagaccccctgggaggcgtggggcgacaccccggcctgggccaccatcgaggccaacctgaagaacctccccgccaacaaggcgtggcggttcgcccccgacgccatggagcgcttcgagggggagaacgacttcacgtcccgggccctgaaggacgcccagtacctgagccgcatcgcgcggacctacctcgacgccctgtacgacggggccgacggcaagtcccacgtctgggtggtgccgggccgcctgaccgagatgctccggcgccactgggggctgaacagcctgctccccgacaaggacggcgccgtcaaggccaagaaccggaccgaccaccgccaccacgcgatcgacgccgccgtggtggccgcgaccgaccggtccctgatccagcgcatcagcaagatggcccggaaggacgaggtcaacggggccgaggaggtggcccgctccgtgcccccgccctgggagggcttccgcacggacatcgagacccagctggaccggatcatcatcagccaccgcgccgaccacggccggatcgaccccgcggcccgcaaggacgggcacgactccaccagcggccagctccacaacgacaccgcctacgggctgggcgaggggaactccgtcgtgagccggaagcccctgctctccctcaagagcaacgacatcgaggtgacgaccaagggcgccaacatccgcgacgtcgacctgcagcggcacctcgagcgcatcacccggggcctggacgggaaggccctggaggcggccctcgccgagttcgccgccaccgcgaagctgcccgacggcacggacaacccgtactacgggctgcgccgggtgcgcctcgaggagaccctgcagcagggcgcccgggtggaggtcaaggaccgcaacgggaagcccttcaaggcctacaagggcgacagcaaccactgctacgagatctggcggatgcccgacggcaaggtggtgccccaggtcatcaccacctacgaggcccaccagatcgacgtggagaagaagccgcaccccgccgcgaagcgcctgctccggatcttcaagcgcgacatggtggccatcgagcaggacgacaaggccatcatcgggtacgtccagtccatgcacgtggccaacggcctgttcatcgcgccccacacggaggccaacgccgacgcccggagccgcgacaagtccgacagcttccgcctgatccagatgtccgccgggcccctcgtgaaggcgaacgcccggcgcgtctacgtggacgagatgggccggctgcgcgacccgggggcccccagctga

SEQ ID NO: 1432 - RNA, 3039 nt, synthetic construct
  misc_feature 1..3039: note = Cas9 variant
  source 1..3039: mol_type = other RNA
atggccaacatgcgctaccggctggccctcgacctgggcagcacctccctggggtgggcgatggtgcgcctcgacgcccagaacgagacctgcgccgtcatcaaggccggcgtgcggatcttcagcgacgggcgcaaccccaaggacggctccagcctggccgtgtcccggcgcgaggcgcgggccatgcgccggcgccgggaccgcctgctcaagcggaagacgcgcatgatggccaccctgatgaagcacgggttcttcccgcaggacgaggccgcgcggcaggccctggtcaacaaggagcccttcgccctccgcgccaagggcctggaccacgccctgctccccgaggagttcgcgcgggccctgttccacatcaaccagcgccggggcttcaagagcaaccgcaagaccgacaagaaggagaccgactccagcgccctgaagaaggccatcgggcagctccgggaggccatgcaggcgtccggctgccgcacggtgggggagtggctgtgcgcccgccaccagcagggcctgagcgtgcgggcccgctaccgggagaaccgcatcaccaaggacgacgggaagaccaagatcgagaagtcctacgacctctacatcgaccgggccatgatcgaggccgagttcgacgcgctgtgggccaagcagagcgagctgaaccccgagctgttccacgagaccgcccgcgccgagctgaaggactgcctgctccaccagcggccgctgaagcccgtcaagcccggccgctgcacgctgctccccgacgaggagcgggccccgctggcgctgccctcccagcagcgcttccggatctaccaggaggtgaacaacctccgcctgctgcgggagggcctcaacgaggagcccctgaccctgacccagcgcgaccagctcatccaggccctggagaccaaccccaagcggagcttcacgcagatccagaagctgctcgggttctccggccagttcaacctgcaggacgacaagcgcaccgagctgaaggggaacagcacctccgccatgctcagcaagaaggagttcttcggctcccagtggctgagcttcgacgagacccaccaggacgagatcgtgatgcagctggtcagcgaggagaacgaggcccggctcatcgcgtggctgcaggccgagacgggcgtggacgagatcaccgccgagcgcatcgccaacaccccgctggccgaggggtacggctccctcagcgcgaaggccctggagaagatcctgcccgccctgcgggccgacgtgatcacctacgacaaggccgtcctcgcggccgggttcgaccaccactcccacatcagccacgccgccacgggcgagatcctgcccgacctgccctactacgggcagtacctccagcgccacgtgggcttcggcaccgggaagccggaggaccccgccgagaagcgctacggcaagatcgcgaaccccaccgtgcacatcgggctgaaccaggtccggaccgtggtgaacgccctgatcaagcgctacggccacccctccgaggtcgtggtggagctcgcccgggacctgaagcagagccaggagcagcgcaaggaggagcaggcccagcaggcgaagaaccagcggcgcaacgagcggatgcgccaggacatcgccgggctgctcaacacgtccaccgagcgggtccgcgccctggacctgcagaagatgatcctctgggaggagctgagcttcaacgtggccgaccggcgctgcccgtactccggcgtgcagatcagcgcccagatgctgttctccgaccaggtcgagatcgagcacatcctccccttcagccagaccctggacgactccctgaacaacaagaccgtggcgatgcggcaggccaaccgcatcaagggcaaccggacgcccgccgaggccgccgcggacttcgccgcccaggggtggcccgtcgaggacatgctccaccgcgccagcctgatgccgaagggcaagcggtaccgcttcgcccaggacgggatggcgcagtggctgcgggaggacaagggcttcctcgcccgcgccctgaacgacacccggcacctgtcccgcgtggcccgcgagtacctcagcctggtgtgcccccaggggacccgggtcatccccggccgcatgaccgcgatgctgcgggccaagttcggcctcaacgacatcctggggctgaacggcgagaagaaccgcaacgaccaccggcaccacgccgtggacgcctgcgtgatcgccgtcacggaccagtccatgctccagaagttcgcgaaggccagcgcctccgcccgcgagaagcagctgaacaagctggtggagagcatgcccctcccgtgggacagctaccgggaccacgtgcagcgcgccgtcgagcggatctgggtgtcccacaagcccgaccacgggcacgagggcgcgatgcacaacgacaccgcctacggcctgctcgggggcgggcacgtgcaggtccgcaagcggatggacggcgtgcgcacccgggagaccgccgccctcaaggtgatcgagttcgccgaccgccaggcgcacccccggcacgggctgctgccgaacggcgagcccatgccctacaagggctacaagggggacagcaactactgcatggagatcgtccgcaacgacaagggcaagtgggagggggaggtggtgtccacgttcgaggcctaccagctcgtccggcagcacggcctggcccgcctgcggcaccccgccctcagcgtgtccgggcgcccgctggtgatgcgcctgctccggaacgacaccctgcgcgtcatccacaacggcgagcagcggaccgtgcgcatctgcaagatgaccgccgagggcgtgatcgcgctggccgacaccacggagagcaacgtcgacgcccggacccgcaccaaggacctctcctacatcttcaagaccgccgggagcctgcagaagtccaagggccggcgcgtggcgatcagcccctccggggagatgaaggaccccggcttcttcgactga

SEQ ID NO: 1433 - RNA, 3051 nt, synthetic construct
  misc_feature 1..3051: note = Cas9 variant
  source 1..3051: mol_type = other RNA
atggaggtgttcgtcgacgtgagcgcccgccagctgggcatcgacctcgggatcgggacctgcgggtgggccctgctggcggaggactccctcatcgccctgggcacccggacgttcgacgtgcccgagaccgacaaggagcgcatcccgaccaaccagatccggcgccaggcccgggggatgcgccgggtcatcgaccgccggcgccagcggatgaacgccgtgcgccggctgctcgccgaccacggcctgctggcggacggcgggaagctcggcctggccaccgtgcgcctggacccctggcaggcccgggccgaggggctcgaccgcctgctgagcgcgggcgagctcgccgtcgccctggggcacatcgccaagcaccggggcttccgctccaacagcaagcgggaccgcggcgccaacgcgcccaaggagtccagcgccatgctgggggccatcgcccagacgggcgagcggctccagcactggcgcaccgtgggggagatgttctggaaggacgagttctaccagacccgccggcgcaaccgggacggcgactactcccgcaccgtgcagcggctggacctggagacggaggtccaccgcctcctggccgcgcagcggcgcctgggcaaccccctcgccaccttcgacctggagcagagcttcatcgacgtggccttcttccagcggccgctggccgactccgacgacaaggtggggccctgccccttcgagcccagcgagaagcgcgccgcgcggcactccccgagcttcgagcgcttccggctcctgtcccgcctggccgccctccggctgagctccggcgccggggagcgccccctgagcgacgccgagttcgcggccgcctgcgccgacttcggccggctccaggggttctccttcaagcgcctgcggcagcacctgaagctcgaccccagcatccgcttcgcgggcatcgcccccgacgaggagggcaagcgcgacgtcgtggcccggtccggggaggccaccccgggcagcgccgcgctgcgccactgcctgggggacaccgtgtgggacaacatgctcggcacgcggcccgccctgctggacgccatcgccgccatcctcaccttccgcgacgacgcggaccggatcgccgaggggctggccggcctgggcatcgaggagcccatcctcgacgccctgatggacggggtccgcaacggcagcttcgggaagttcaagggccccgggcacatctccgccaaggcgtgccgggccctgctcccgcacctggcccgcggccgggtgtacagcgacgcctgcgcggacgccggctacgaccactcccgccagaccgagaccaacctggacgacatccggaaccccgtggcccgcaaggccctgggggaggccctcaagcagatcaagatcatcatccacacgcacggccggcccaccgcgatccacgtcgagatggcccgcgacatcggcaagagcgccgacgagcgggacgagatcaagaagggcatcgacaagcgcaactccgagaaggaccgggcccgccagcagttccacgagatggtgggcacccccgccgcgggggccgaggacctgctgcggttcgagctctggaaggagcagaacggctggtgcctgtacaccgggcgcgagatcccgatcgacgccctggtgagctccgacaaccggatccaggtcgaccacatcctcccctggagccgctccggcgacgacagctacatcaacaagacgctgtgcttcaccgaggccaaccagcacaagaaggggatgaccccctgggagtggctgcacgacgaccccgagcgctgggagaagttcgcccggaccgtggagggctgcaagacgatgaagggccgcaagaagcggaacctcctgctgcgcgactccagccggctcgagaaggagttccgctcccggaacctgaacgacacccgctacgcgtgccggctgctcctggggatcctgaagcacacctacccggacatcgtggtcgccgcccgccccggccccctcaccgaccggctgcgccgggcctgggggctgcagagcctcaagaagcacgaggacggcacgcgcaaggacgacgaccggcaccacgcgctggacgccgccgtggtcgccgccacctcccagagcatgctgcagcgcctcaccaccctgttccagaaggcggagcgggagggcgggcgccgggacttcgtgggcctggagcccccgtggcccgggttccgcgccgacctcgaggccaagctggagggcgtggtcgtgtcccgcgccgagcggcgccgggcccgcggggcgggccacaaggacacgatccgggccatcggggagggcgacgccggccccgtggtctacgagcgcaagccggtggccgccctgaccgagaaggacctcgaccgggtgaaggaccccgagcgcaacaaggtcctgatcgagaacctgcggcagtggatcgcggccgggaagcccaaggaccccgacaaggccccgcgcagccccaagggcgaccccatgaccaaggtgaagctcgtgaccacggacgacgtccggatcctggtgcgcgggggcaccgccgaccgcggggacatggcccgggtggacgtcttccggcaggcggaccccaagggccgctggcggttcttcctggtgccggtgtacccccaccaggtcttcgaccccaccgactggccccagccgcccaaccgcgccgtggtggcctacaagcccgagaaggagtggaccgtcatgggccccgaccacgagttcctctggtccctgtacccgttcagctggatcgccgtggagaaggcggacgggacccggatcgagggctacttccgcgggatgcaccggagcacgggcgccatctccatcagcccccaccactccaagagcctggcctccaccggcatcggggccaagaccctcgccagcttccgcaagttcgcgatggaccgcatgggcaacctgtccgagatcgagcgggaggtgcgcacctggcacggggtcgcctgcacgtga

SEQ ID NO: 1434 - RNA, 3054 nt, synthetic construct
  misc_feature 1..3054: note = Cas9 variant
  source 1..3054: mol_type = other RNA
atgcgcgtggacagcctgggccggtgcctctccgacgaggagtgggcccgcgtcatctaccacctgtgcaagcaccgggggttccactggatcagccgcgccgaggcgaagcagaccgagggcgactccaagagcgagggcggcaaggtgaagcaggggctggccggcaccgccaagctcatggacgagaagggctaccggtccgccgccgagatggtgctggcggagttccccgaggcccagcgcaacaagcagggggagtaccggaaggccctgagccgcgagctcctggccaaggagctggcgctcctgttcgcccggcagcgcgtcttcggcaaccggcacgccacggacaccctggagaccgccatcctcgggaactccgacaagaagtccggcctgttctggcagcagaagcccgccctggcgggggccgacctcctgaagatgctggggacctgcacgttcgagaagaacgagtaccgcgcccccaaggccagcttcaccgccgagcggcacgtgtggctcacccgcctgaacaacctgcggatcgtgaccgacggcatcacgcgccagctcaccgagcaggagcggcagctggtcctgcccctcccctaccgccaggcgggggacctgacctacaagcagctgggcatggccctcaccaaggccgggctgctggaggccggctgcttcaagttcatcggcctcgcctacccgacggaggcgcagaaggccgaggggaagaccaaggaccccgagagcgccaccctggtgaagatccccgcctggcaggagctgcggcagaccctcaacaaggcctccctgaacgacgagtgggagaagctgagcggcgacgcgctctgcgggcagcccgagatcttcgacaagatcgcctggatcctgtccgtgtacaaggacgacgacgaggtccgcacggagctggccaagctcgtgctgccgaaccccgagggcctgaccgaggccctcctgaacatccggttcgacaagttccacgcgctgagcctcaaggccctgcgcgccatcgtgccccacatggagaaggggctgcgctacgacgaggcctgcgtccaggccggctaccaccactcccagctccacaagatcggcgagggggagcacaagtacctgcccccgctgtacgacggccgggacggggacggccgcatgatcttcgcggaggacgccgacatcccccggaaccccgtggtgctgcgcagcctcaaccaggcccggaaggtcgtgaacgccatcatccgccggtacgggtcccccagcgccgtgcacatcgagatggcgcgcgacctgtcccggccgttcgacgagcgcaacaagatcaagaaggaccaggacgagtaccaggcccggaaccagcgcgaccgggagcagttcatcgagctgttcggccacccgcccaagggcctcgagttcgagaagtggcgcctgtaccgggagcagaacgggcagtgcgcctacagccagaagcccctggccagctccggcgacgtcgccgagatcttcctcgacgggagcaccgagatcgaccacgcgctgccctactcccgcagcttcgacgactccaagaacaacaaggtgctggtgctcacccgggagaaccgcgacaagggcaaccggacgccctacgagtacctcgggggcgccgagaacagcgagcgctggcagcgcttcttctccttcgtcgagagcaacaaggcctaccggctggccaagcgcacccggctgctgcgcaaggacttcggcgcgaaggagtccgaggagttccgggagcgcaacctgaacgacacccggtacgtgtgccgcttcttcaagaactacgtggagcagcacctcaagctggccgaggggagcgaggccaagcggtgcgtcgtggtctccggccagctgaccaacttcctccgcacgcggtgggggctgctgaagatccgcagcgactccgaccggcaccacgccctcgacgccgcggtggtggccgcctgcagccactccatggtccagcgcctgagcaactactcccggacccgcgagctggagcaggtccgggacggcttcgtgaacatcgagaccggcgagatcgtgaaccccgccatgcaccagcagctccgcgagcacttccccgacccgtggccctacttccggcacgagctggaggcccgcctgaagatcgacagccccgcgctcctgcgggaggagatggcccgcctgtccagctacaccgaggaggagctcgccgccctgaagcccctgttcgtgagccgcgccccgcagcggcgcaacgggggcgcggcccacaaggacacgatctacgggcagcccgagaagctcaagaagaacggctccgtgagccagaaggtcgccctggcctccctggcgctcaaggacatcgacctgctggccgacccccaccggaacgccaagctctacggggccatccgcgagcggctggaggcccacggcggcaagggggacaaggcgttcccggccaccaaccccctgcgcaagcccgacaaggagggcaaccccaccgggccgatcgtgcggaccgtgacgaaggtcatcgacaagctcagcggcatccccgtgcgcgggggcatcgccaagaacgacaccatgctgcgggtggacgtcttcaccaaggccggccgcttccacctggtgcccgtgtacgtccaccaccgggtgaccgggctccccaaccaggccatcacgcgcggcaaggacgagaaccagtgggcgatcatcgacgacaccttcgagtggcggttctccctgtacccgaacgacctggtgcagatccgcctcaaggacgagacccacctggggtactacgccagcaccgaccggtccaccagctccatcagcatctgggcccacgaccgcaaccagtccgtcggcaaggacgggctgatccggagcatcggcgtgacgaccgccaaggacatcgagaagttccacgtggacaccctcggcaacgtctaccccgccccgcccgagaagcgccgggggctggcgtga

SEQ ID NO: 1435 - RNA, 3066 nt, synthetic construct
  misc_feature 1..3066: note = Cas9 variant
  source 1..3066: mol_type = other RNA
atgcgccggcgccgggaccgcttcaagcagcggcaggccgccctgctcaagcacctggcgggcgtggggctgttccccgccgacgaggccgcccgccgggagctcgccggcctggacccgtacgagctgcgcgcgcgggccctccacgaggccctgcccctgaaccacatcgggcgcgccctcttccacctgaaccagcggcgcggcttcaagagcaaccggaagaccgaccgcgggaaggcggacgacgagggcaagatccggctgggcgtcgcccgcctccaggaggccatgcacgagaaggggtccgccaccctgggcgagttcctgcacgggcggcgcgccgcggccacggaccccaaccagatccccagcgtgcggacccgcctccgggccgagtccggcgagggggcccgcggcgacggctacgacttctacccggaccgccggatgctggaggacgagttcgaggccatctgggagagccagcaggtccaccaccccgcggtgctgaccgacgagatcaagcagcgcttcttcgaggtgatcttctaccagcggcccctcaagcagcccgagatcgggacctgcacgctggtggccggcgagcgccggctgccgaaggcccaccccctcttccagaagcgccggctgctggaggagctcaacgccctgcgcatcgtctggcccggggtgcaggccgagctgctctcccgggagcagcgcgacctggcgtacctgaagctcaaggacaagcgggccgtgcgcttcgagagcctgcggaaggccctgaagctcgaccccgacgcccgcttcaacaaggagtccgagaaccggagcgagctgaagggcgacgaggtcgccgcggagctgggcgccaagtcccgcttcgggggccggtgggggcacaccgccccggccgaccagtgggagatcgtgagccgcatccaggcgctcgagtccgacgacgacgaggcccagttctgcgtgtggctgagcgagcggtacggcctggactccgagcaggcccgcgccgtcgccgcggcccgcctcccccaggggttcggccggttcggcctgaccgccaccacgcgcctgatcaaggccctccaggacgaggtgatcgtgtacagcgaggccgtccagaagaccgggctgggccaccactccgacttccggaacggggaggtgctggcggagctcccctactacggcatcgccctggagcgccacatcatgcccgggaccggcgacccgggcgacagcgacgagatgcgggtggggcgcgtcaccaaccccacggtgcacatcggcctgaaccagctccggcgcgtggtcaaccggctgatcaagcgctacgggccgccccggcagatcgccgtggagctggcccgcgagctgaagctcgacgaccagcacaagcgggagatcaacggccgcaaccggcagaaccgcgaggccgcggagcggcgctcccagaagctggtggacatcgggatcgccgacaagggcgccaaccgggccctgctcaagctgtgggaggagctgaaccccgacaacgcgctcgaccgccggtgcgtctacaccggccgccagatcagcatcgagatgctgttctccggggccgtggaggtcgaccacatcctgcccttcgccgccaccctcgacgacagcaacgccaacaagctgctgtgcctccgcgaggcgaaccggaacaagcgccggcgcagccccttcgaggccttcggccagggggccgactgggaggagatcgccgcccgggcggcccgcctgccccgggagaagcgctggcggttcgagccggacgccatggcccgcttcgacaccgaggagaagttcctggcccggcagctcgtggacacgcagtacctgtcccgcctggcgcgggagtacctcggcgtgctgttccccgacaagggcgaggggagcggccgcgtctgggtgtcccccgggcggctgaccgagatgctccgccggagctggggcctgaaccacctcctgcccgaccacaacctcgggggcggcgccgaccagccgaagaaccgccgggaccaccgccaccacgccatcgacgccatcgtggtcgcggtgaccgaccgccacctcctgcaggccatcgcccgggaggccgggcagcgcggccacgaggccgcgaaccggatgaccgccgacctgcccgtgccctggccggacttcgaccgcgacgtcggccaggtgatccgccaggtggtcgtgtcccaccgggccgaccacgggacggtgagcaaggccggggccgcgaagggccaggactccaccgccggccggctgcacaacgacaccgcctacgggctgaccggccagacggacgagaaggggaacaccatcgtcgtgcgccgggtgcccctgaccgccctgaagaagcccaccagcatcgaggccgtccgcgacgacgagctccggaaggcgctgtccgtgtggacgcgcggctacgacgggaaggccttcgaggcccggctgagccgcttccccgagctcggcccgctgcagttccggggcatccgccgggtgcgcgtcgtggagcccctgaccgtgatccccatccgggactccagcgggcgcgtctacaagggctacaagggggactccaactaccggtacgacgtgtgggagctcaaggacggcaagtgggtggccgaggtcgtgagcatgttcgacgcccaccagtccagctggacctcccccgtgcgccgcgagaacccgaccgcgcggaaggtcctgagcctgcagcagaacgacatcgtggccatcgagcccgaggggaaggagcgcgagctcatgcgggtggcccagctgcgccagggcggccagatcacgctggccgcgtgccacgaggccggggacctcaagcggcgcgacgccgagtccaacgaggtcgaccccttcaagtacttcagccccaccgccggcgggctgaagcgggtgcgcgcccgccaggtgcgggtcgacgagctgggccgggtgctcgacccgggcagccgcgaccgggagcgcggggcggcctga

SEQ ID NO: 1436 - RNA, 3066 nt, synthetic construct
  misc_feature 1..3066: note = Cas9 variant
  source 1..3066: mol_type = other RNA
atgaagtacaccctgggcctcgacgtggggatcgccagcgtcggctgggccgtgatcgacaaggacaacaacaagatcatcgacctgggggtgcgctgcttcgacaaggcggaggagtccaagaccggcgagagcctggccacggcccggcgcatcgcccgggggatgcgccggcgcatctcccggcgcagccagcggctccgcctggtcaagaagctgttcgtgcagtacgagatcatcaaggactccagcgagttcaaccggatcttcgacacctcccgcgacggctggaaggacccctgggagctccggtacaacgccctgagccgcatcctgaagccgtacgagctcgtgcaggtcctgacccacatcaccaagcggcgcggcttcaagtccaaccggaaggaggacctgagcacgaccaaggagggggtggtgatcacctccatcaagaacaacagcgagatgctccgcaccaagaactaccggacgatcggcgagatgatcttcatggagacccccgagaactccaacaagcgcaacaaggtcgacgagtacatccacaccatcgcgcgggaggacctgctgaacgagatcaagtacatcttcagcatccagcgcaagctcgggtcccccttcgtgaccgagaagctggagcacgacttcctgaacatctgggagttccagcgccccttcgccagcggcgactccatcctcagcaaggtggggaagtgcacgctgctgaaggaggagctccgggccccgacctcctgctacaccagcgagtacttcggcctgctgcagagcatcaacaacctcgtcctggtggaggacaacaacaccctgacgctcaacaacgaccagcgcgccaagatcatcgagtacgcgcacttcaagaacgagatcaagtactccgagatccggaagctgctggacatcgagcccgagatcctcttcaaggcccacaacctgacccacaagaaccccagcggcaacaacgagtccaagaagttctacgagatgaagtcctaccacaagctcaagagcaccctgcccaccgacatctgggggaagctgcacagcaacaaggagtccctggacaacctcttctactgcctgacggtgtacaagaacgacaacgagatcaaggactacctgcaggccaacaacctcgactacctgatcgagtacatcgccaagctgccgaccttcaacaagttcaagcacctcagcctggtcgccatgaagcgcatcatccccttcatggagaagggctacaagtactccgacgcgtgcaacatggccgagctggacttcaccgggagctccaagctcgagaagtgcaacaagctgaccgtggagcccatcatcgagaacgtgacgaaccccgtcgtgatccgggccctgacccaggcccgcaaggtgatcaacgccatcatccagaagtacggcctcccgtacatggtcaacatcgagctggcgcgggaggccggcatgacccgccaggaccgggacaacctgaagaaggagcacgagaacaaccgcaaggcccgggagaagatcagcgacctgatccgccagaacgggcgggtggcctccggcctcgacatcctgaagtggcgcctgtgggaggaccagggcgggcggtgcgcctacagcgggaagcccatccccgtgtgcgacctcctgaacgactccctgacccagatcgaccacatctacccctacagccgctccatggacgacagctacatgaacaaggtcctcgtgctgacggacgagaaccagaacaagcggtcctacaccccgtacgaggtctggggcagcaccgagaagtgggaggacttcgaggcgcgcatctacagcatgcacctcccccagtccaaggagaagcggctgctgaaccgcaacttcatcaccaaggacctggacagcttcatctcccgcaacctcaacgacacgcggtacatcagccgcttcctgaagaactacatcgagtcctacctgcagttcagcaacgactcccccaagagctgcgtggtgtgcgtcaacggccagtgcaccgcccagctccggtcccgctgggggctgaacaagaaccgggaggagagcgacctgcaccacgccctcgacgccgccgtgatcgcgtgcgccgaccgcaagatcatcaaggagatcaccaactactacaacgagcgggagaaccacaactacaaggtgaagtaccccctgccgtggcactccttccgccaggacctgatggagaccctcgccggcgtcttcatcagccgggcgccccgccggaagatcacggggcccgcccacgacgagaccatccgctcccccaagcacttcaacaagggcctgaccagcgtgaagatcccgctgaccaccgtgacgctcgagaagctggagaccatggtcaagaacaccaagggcgggatctccgacaaggccgtgtacaacgtgctgaagaaccggctcatcgagcacaacaacaagcccctgaaggccttcgccgagaagatctacaagcccctgaagaacggcaccaacggggccatcatccgcagcatccgggtcgagacgccctcctacaccggcgtgttccgcaacgaggggaagggcatcagcgacaacagcctcatggtgcgggtcgacgtgttcaagaagaaggacaagtactacctggtgccgatctacgtcgcgcacatgatcaagaaggagctgccctccaaggccatcgtgcccctcaagccggagagccagtgggagctgatcgactccacccacgagttcctgttcagcctctaccagaacgactacctggtgatcaagaccaagaaggggatcacggagggctactaccgctcctgccaccggggcaccgggagcctgtccctcatgccccacttcgccaacaacaagaacgtcaagatcgacatcggcgtgcgcaccgccatcagcatcgagaagtacaacgtggacatcctggggaacaagtccatcgtcaagggcgagccccggcgcggcatggagaagtacaacagcttcaagtccaactga

SEQ ID NO: 1437 - RNA, 3072 nt, synthetic construct
  misc_feature 1..3072: note = Cas9 variant
  source 1..3072: mol_type = other RNA
atgaagatcctgggcttcgacatcggggtggccagcatcggctgggccttcgtcgagggggacgagatccgcgactgcggcgtgcggatcttcaccaaggcggagaaccccaagaccggggagtccctcgccctgccgcgccgggaggcccgcggcgtgcggcgccggctggcccgccggcgcgtccggctcaacacgatcaagaagatcatctgcaaggagttcgacctgcgcctgagcgactacatcgccgacgacggcgagctccccaaggcgtaccagaccaacaaggacaccaagtccccctacgagctgcggtacaaggccctgaacgagcgcctcagcaaggaggagctggcccgggtgatcctgcacatcgccaagcaccgcgggtacggcaacaagcacgcgaaggacggggacgacaaggactccggcaaggtgaagaaggccatcggggagaacaagaccctcctggagcagaagggctacgagagcgtcggcgagtactgcttccgggagttcttcaagtccatcaaggacaaggacggggagacgcacaacatccccagccagaacatccgcaacaagaagggcaactacgaccggtgcgtgtcccagaagcagctggaggacgagctcaagctgatcttcgccaagcagcgcaagctggggttcaacaaggagttcgaggacgccatcctcgaggtggccttctaccagcggccgctgaaggacttcgacgacaagatcggcgactgcatcttcttcgacaacgagaagcgcgcgcccaaggagagcatctccgccatcgagttcgtcgccctgacccgcatcatcaacaccctcaagtacctgagcaagaccacgggcgaggtgtacgagaaggagatcatcaacaagatctggcagaagatcctggagaacgggaagatgacctacgccgagctccggaagatcctggccctggactccagcgtgttcttcaaggacaaggacctcgactacaccctgggcatcaaggaggcggagaagatcaagttcatcgagttcaagaagctgatcaagttcaagaaggccctcgggtccttcgacggcctgagccgcgagatcctggacaacatcgccatgcagatcgccatcaccaaggaccggcagcgcctcctggagaagctggaggtcttccccctcaacaaggagcagaaggagaacctgtcccagctgaacttcagcaagtacatcgacctctccctgaaggccctgaaccagatcctccccttcatgcgggaggggcgccggtacgacgaggcgaaggacgacgccaagctgcaggagaaggccaagaacacgaagaaggaggagttcctgccgcccctcaaggagttcgacctgaacctgaccaaccccgtggtggcccgcgccctcgcggagttccggaaggtcctgaacgccctgctgaagaagtacggcaaggtgcacaagatccacctcgagttcgcccgcgacatgcggctggacttcgacgagcgcgagcggctgatcagcatccagaacgacaacttcaacaagcgccagctcgccgaggacttctgcaaggagcacggcctggagcccagcaacgcgaacatcctgaagatcaagctctggcaggagcagcagtggcactgcatgtactccggggagctgatcggcatcccggacctgaaggaccccaccaagctccaggtggaccacatctacccctacagccggtccttcgacgacagctacaccaacaaggtcctggtgcgcgccgagtggaaccaggagaaggggaaccacacgcccttcgaggccttcggcggggacaagaacaagtgggacaagatcgtggccctggccgagaagctcccgccctccaagaagctgaaccggagcgagaagtccaagaaggacaagctgctcgacgagaagttcaacgacaaggagctgggcttcctggcgcgcaacatcgtcgacaccggctacatcgcccggctcgtggccaagtacatcgacatgtacctggagttcctgcccctcgaggagaacgagaacaccagcctggcccgcggggagaagggctccaagaagcacatcgggatcgtgaacggccgcctgaccagcgaggtccggcacaactgggggctcgaccccaaggaccgcgacaaccacctccaccacgccatcgacgcgatcgtgatcgcctacatgaacgacaagcggatcaaggccttcgccgacttccgccggctgaaggagctgaagatcaagcgctacggccgggagatcacggaggacgagtaccaggagaagaagaaggagctgtcctgcgccccgttcgacgacttccgcaaccggaccctggagaacatcgacaagatcttcgtcagccgcccgccccggaagcgcgcgcggggcaccctccacgaggagaccttctactccatcgacgacaagaagctgctgaaggcctacgggggcaaggaggggatgcagcgcgccctcagcctgggcaagatccggcagatcggcacgaagatcgtgaagaacgggaccatggtgcgcgtcgacatcttcaaggacaagcggggccgcttctacggggtgcccatctacaccatggacttcgccctgggcgtgctccccaacaaggcggccgtctccgggaaggacaagaacggcctgatcaaggagtgggccgagatggacagcggctacgagttctgcttctccctgttcaaggacgacctcatcctggtgcagcggaaggagatgcaggagcccgagctgtgctacttcgtgagcttcgactccagcaacgcccagatcgacgtccgcagccacaacaaccacttctccgtgctcaacgagaaccagaagctgctgttcaagagcgccacccaggcggaggtgatcggggagtccatcggcatccagaacctcaaggtcttcgagaagtggcacgtgagccccctgggggaggtgcggaaggccgagttcagcccccgcggcgaggccaagctgaagacgtccaagaagcgcaagaagtga

SEQ ID NO: 1438 - RNA, 3072 nt, synthetic construct
  misc_feature 1..3072: note = Cas9 variant
  source 1..3072: mol_type = other RNA
atgaagatctacagcttcgacatcggcgtggcctccatcgggtgggccttcatcgagaacgaggtcctgcaggactgcggcatccgcatcttcaccaaggcggagaaccccaagaacggggccagcctcgccctgccgcggcgcgaggcccggggcgtgcgcaagcggctggcccgccggcgcgggcggctcaacaccatcaagcagctgctgtgcaaggagttcggcctccagctggaggactacctgtccaacgacggcgagctccccaaggcgtacacggccagcaaggccaaccccctgaagtccccctacgagctgcgcaccctcgccctgagccagaagctggactccaaggacctcgtgcgggtcatcctgcacatcgcgaagcaccgcgggtacggcaacaagcacgccaaggacagcaaggacaccgagtccgggaaggtgaagaaggccatcgagttcaaccggaagaccctggccgagaagggctaccgcagcgtgggggagtacctctaccgggagttcttccagcagtcccgcatcagccagaacaacggcgccacggagttcatcaacgtccggaacaaggcgggcaactacgagcactgcgtggcccaggacatgctgaaggaggagctggagtccatcctcaacgcccagcgccagttcgggttcagcctgaagcaggacttcgagtccaagctgctcaccaagatcttcgagcagcggccgctcaagagcttcgccgacaaggtgggcaactgctgcttcatcgccggggagaagcgcgcgcccaaggactcccccagcgccatcgagttcatcgccctgtcccggaccatcaacaccctgatcaacctgagcaaggagagcggcgagatctacaaccgcgccatcatcctgcagatcgtcgagtccacgctcaagaagggcgagatcagctacaaggagctgcgcgagatcatccggctggacgagcgcctccggttcaaggacccccgcctggactactcccgggagatcaaggaggccgagaaggtgaagttcctggagttcaagcagctcaaggggttcaagaaggcgctgggcgagagcttcaccaccctggccatctcccagctcgacgagatcgccgagcacatcgccctgatcaaggaccgcgtgaagctgaacgagaagctcgagagctacgccctgaccaaggagcagcgggaggcgctgtccaacctcagcttctccgcccacatcaacctgagcctgcaggccctcaagcagatcctgccgttcatgcgcggggacaacggcgagcagtgcctggactacgacgagtccgtcgagaaggccgggctgaaggcgctcagcaaggacacgctgaagggccagatgctgccgcccctcaacgagttcgagccctacctgtccaaccccgtggtggcccgggccctggccgagtaccgcaaggtcctcaacgtgctgctgaagcagtacggcagcccccacaagatccacatcgagtacgcccgggaggcgaagctctccagcaccgagcgccagaagtacgagaaggagcagaaggacaactacgccgccaaccaggccgcccacaagaagtgccaggagctggggctggagccctccagcaccaacctcctgaagctgaagctctggcaggagcagggcgggctgtgcctgtactccggcgcgaagatcaccatcagctacctccaggaccccacggccctccaggtggaccacatctacccgtacagccggtccttcgacgacagctacatgaacaagtgcctggtcctgaccaaggccaaccaggagaaggggaaccgcacccccttcgaggccttcggcaccgactccgccaagtggggcgtgatcacgaccctggcgcagaagctgccccacaagaagcggcgccggatcctcaacaccgccttcaacgacaaggaggccgggttcaagctgcgcaacctgaacgacaccagctacatcgcccggctcgtggcggactacacggagacctacctggagttcctgcccctcgtcgagtccgagaacaccaccctgagcaagggccagaaggggtccaagaagcacatcgccatcgtgaacggcgtgctgacgagcaccatgcgctactacctcgggttcgcctccaaggaccgcgacaaccacctccaccacgccctggacgccgtcatcatcggcttcatgaacgacagcgtgatcaaggcgttctccgacttcaagaagacccaggagaccagcaaggccgcctactacgcccacacgctgtccaagcaggagtacaagaagcagcgggccttcatccagctgccgagcggcgagaacttccgcgtctccgtgctggagaaggtggagagcgtcttcgtgtccaagccgccccggaagcgcgtgcgcggggcgctccacgaggccaccttctacagccccaacgaccccaagctgctgaagaactacggcgggaccaagggcgtcgagcgggccctcgccctgggcaagatgcggaaggtgggggccaagatcgtgagcaacggcgcgatggtccgcgtggacatcttccggcacaagtccagcgggaagttctacggcgtgcccgtctacaccatggacttcgccctggggatcctccccaacaaggccgtggtggtcggcaaggaccagaacggcgtgatcaaggactggctggagatggactccagctacgagttcatcttctccctgtacaaggacgacgtgatcctcgtccagaagaaggagatgcagcgccccgagctgtgctacttcgtgagcttcgacacgtccggggccagcatcaaggtggcgaagcacgacaacaacttctccaccctgaccgagaaccagaagctcctgttcagcaacgccaccaaggaggaggtcgtgggcaagtccatcgggatccagaacctgaaggtgttcgagaagtggcaggtcagcgtgctcggcgaggtgaagcggacccagtcctacccgcgcgagaacatcagcctggcctccaaggccaagaagtga

SEQ ID NO: 1439 - RNA, 3075 nt, synthetic construct
  misc_feature 1..3075: note = Cas9 variant
  source 1..3075: mol_type = other RNA
atgatccgcaccctgggcatcgacatcgggatcgccagcatcggctgggccgtgatcgagggggagtacaccgacaagggcctcgagaacaaggagatcgtcgcgtccggggtgcgggtgttcacgaaggccgagaaccccaagaacaaggagagcctggccctgccgcgcaccctcgcccggtccgcccgccggcgcaacgcgcggaagaagggccgcatccagcaggtcaagcactacctgagcaaggccctgggcctcgacctggagtgcttcgtgcagggggagaagctggccaccctcttccagacctccaaggacttcctgagcccctgggagctgcgggagcgcgccctctaccgggtgctggacaaggaggagctggcgcgcgtcatcctccacatcgccaagcggcgcggctacgacgacatcacgtacggggtggaggacaacgactccggcaagatcaagaaggccatcgccgagaacagcaagcggatcaaggaggagcagtgcaagaccatcggggagatgatgtacaagctgtacttccagaagtccctgaacgtgcgcaacaagaaggagagctacaaccggtgcgtcggccgctccgagctccgggaggagctgaagaccatcttccagatccagcaggagctcaagagcccctgggtgaacgaggagctgatctacaagctgctgggcaaccccgacgcccagtccaagcaggagcgcgaggggctcatcttctaccagcggccgctgaagggcttcggggacaagatcggcaagtgcagccacatcaagaagggcgagaactccccctaccgcgcgtgcaagcacgcccccagcgccgaggagttcgtggccctgaccaagtccatcaacttcctcaagaacctgacgaaccgccacgggctgtgcttcagccaggaggacatgtgcgtctacctcggcaagatcctgcaggaggcccagaagaacgagaaggggctgacctactccaagctcaagctgctgctcgacctgcccagcgacttcgagttcctgggcctcgactacagcgggaagaacccggagaaggcggtgttcctgtccctgcccagcaccttcaagctcaacaagatcacccaggaccggaagacgcaggacaagatcgccaacatcctgggcgccaacaaggactgggaggccatcctgaaggagctcgagtccctgcagctgagcaaggagcagatccagaccatcaaggacgccaagctcaacttctccaagcacatcaacctgagcctggaggcgctgtaccacctcctgcccctgatgcgcgagggcaagcggtacgacgagggggtggagatcctccaggagcgcggcatcttctccaagccccagccgaagaaccggcagctgctgccgcccctcagcgagctggccaaggaggagtcctacttcgacatccccaaccccgtcctgcgccgggccctcagcgagttccgcaaggtggtgaacgccctgctggagaagtacgggggcttccactacttccacatcgagctcacccgggacgtctgcaaggccaagtccgcgcgcatgcagctggagaagatcaacaagaagaacaagagcgagaacgacgccgcctcccagctgctcgaggtgctggggctgcccaacacctacaacaaccggctcaagtgcaagctgtggaagcagcaggaggagtactgcctgtacagcggcgagaagatcacgatcgaccacctcaaggaccagcgcgccctgcagatcgaccacgcgttccccctgtcccggagcctcgacgactcccagagcaacaaggtgctgtgcctgacctccagcaaccaggagaagtccaacaagaccccctacgagtggctcggcagcgacgagaagaagtgggacatgtacgtcgggcgcgtgtacagctccaacttcagcccgtccaagaagcggaagctgacccagaagaacttcaaggagcgcaacgaggaggacttcctggcccggaacctcgtggacacgggctacatcgggcgcgtcaccaaggagtacatcaagcacagcctgtccttcctgcccctccccgacggcaagaaggagcacatccggatcatcagcgggtccatgaccagcaccatgcgctccttctggggcgtgcaggagaagaaccgcgaccaccacctccaccacgcccaggacgccatcatcatcgcctgcatcgagcccagcatgatccagaagtacacgacctacctgaaggacaaggagacccaccggctgaagtcccaccagaaggcgcagatcctgcgcgagggcgaccacaagctgagcctccggtggccgatgtccaacttcaaggacaagatccaggagagcatccagaacatcatcccctcccaccacgtcagccacaaggtgaccggggagctgcaccaggagacggtgcgcaccaaggagttctactaccaggccttcggcggggaggagggcgtcaagaaggccctgaagttcggcaagatccgggagatcaaccaggggatcgtggacaacggcgccatggtgcgcgtcgacatcttcaagagcaaggacaaggggaagttctacgccgtgcccatctacacctacgacttcgcgatcggcaagctccccaacaaggccatcgtgcaggggaagaagaacggcatcatcaaggactggctggagatggacgagaactacgagttctgcttctccctgttcaagaacgactgcatcaagatccagaccaaggagatgcaggaggccgtcctcgccatctacaagagcacgaactccgccaaggcgaccatcgagctggagcacctgagcaagtacgccctcaagaacgaggacgaggagaagatgttcaccgacaccgacaaggagaagaacaagacgatgacccgggagtcctgcggcatccaggggctgaaggtgttccagaaggtgaagctgagcgtcctcggcgaggtgctggagcacaagccgcgcaaccggcagaacatcgccctgaagaccacccccaagcacgtgtga

SEQ ID NO: 1440 - RNA, 3078 nt, synthetic construct
  misc_feature 1..3078: note = Cas9 variant
  source 1..3078: mol_type = other RNA
atgggcgggtacatgccccagctgatgcgctaccggctcgccctggacatcggcagcacctccatcgggtgggccatgatccgcctgagcatgcagaacgagccgatcgcgatcatccggatgggcgtgcgcatcttctccgacgggcggaaccccaaggacggcagctccctcgccgtcacccgccgggtggcccgccagatgcggcgccggcgcgaccggctgctgaagcgcaagacgcggctcctgaacgccctggtgcagaagaagttcttccccgaggacgccgacgcgcgcaaggccctcgtcgtgctgaacccctacgagctgcggaaggagggcctctaccgccagctgagcgggccggagttcggccgggccctgttccacatctcccagcgccgggggttcctcagcaaccgcaagaccgacaagaaggacaacgactccagcgtgctgaagaaggccatcgtcgacctgcgccagcagctcgaggtggagaactgccagaccatcggcgagtggctgttcaagcagcagcagtccggcaagagcgtgcgggcgcgcctgcgggggaagacccagaaggacaaggcctacgacttctacatcgaccgcgccatgatcgcccacgagttcgacacgctctgggtctcccaggccaagtacgaccccctgctgttcaacgaggacgcgcgggccatcctccgcgacatcctgctgtaccagcggcccctcaagcccgtgaagccgggccgctgcaccctgatccccgacgagagccgggcgcccctggccctccccctgacccagcaggcccgcatctaccaggagctgaaccacctccggatcaccacgccggccctgggggcccaggccctgaccgtggcccagcgcaacaccatcgccgcgctcctggagaagtccgacgtcaccttcgtgaagatcgccaaggccctgggcctcacgagcaccaccgagttcaacctgcaggacatcaagcgggaccgcctgaaggggaacgccaccgccatcatcctcgcgcggaaccagtacttcggccgccggtggcacgacttcaacgccgacctgcagaacctgatcgtggacaagctcgtcaacgagggctccgagacggccctgatcgagtggctgaaggccaacaccgacgtggacgagagcgcggccgagcgcgtgtccggggtcaccctccccgagggctacgggagcctgagcgtggccgccctgcggcgcctgctccccgccctgaaggaggacgtggtcgtgtactccgaggcggtgaagcgcgccggcttcgacagccactccgccctgagcctcatcgagcagaccggggagctgtaccaggagctgccctactacggcgaggtcctccagcggcacgtgggcttcgggtccggcgacccgaacgacagccccgagcgccggttcgggaagatcgccaaccccacggtccacatcggcctgaacgagctgcgcaagatcatcaacgccctcatcaagcggtacgggaaccccgcggaggtggtggtcgagctggcccgcgacctgaagctctcccgggagaagcgcaaggagatccaggaggagcagaagcagcggcaggaccgcaacgagaagcggatcaaggacgcctgcgagatcctgggcatcgacccgctggtgatcgaccgcggcaagcggcgcgagatcagccagaagatgcagctctgggacgagctgaaccccaaggacgccgccaaccggcgctgcccctacaccggggaccagatctccatcgagaagctgctcagcgcggaggtggagatcgagcacatcctgcccttctccaagaccctggacgacagcctcaacaacaagaccgtcgccatgcggcgcgccaaccgggacaagggcaaccgcacgccgtacgaggccttcggggagtccctgaaccccgactacgactacgacgcgatcctgcagcgggccagcctcatgccccgcgagaagcgcaagcggttcgcctccgacggctaccagcagtggctgcgcgacgacaaggacttcctgagccgggccctcaacgacaccgcctacctgtcccgcatcgcgaaggagtacctgaccctcatctgcccgcccaacagcgtgcgggccatccccgggcgcatgaccgcccagctgcgggccatgttcggcctgaaccgcctcctgtccgagggcgggatcaagaaccgggaggaccaccgccaccacgccatcgacgcggccgtgatcggcgtcacggaccaggggctgctccagaagttcagccgggccagcgcccgcacccgggagctgcagctgtcccgcctcgtggacgacatgcccctgccgtgggacacctaccgggagcacgtgacccgcgccctggagcacctcgtcgtgagccacaagcccgaccacggctaccagggcaagatgcacgaggacacggcgtgggggctgcgggacaacggccaggtgacccgccgggtccgctccgaggacgggggcccccgccagcggctgctcgagaacaagaacgtggtgaagatcaacagcacccgcgacttctcccggcacgggatcgacgagcagggccaggtcaacgcctacaagggctacgtcgggggcagcaactactgcatcgagatctggatcgacgagaaggggaagtggaactccgacgtggtgagcaccttccaggcctaccagatcgtgcgcgagctgggcgagaaggccgcgtggcagaagctgcggaaccccctcctgtccctgagcgccaagccgctcgtgatgcgcctgatcatcgacgacgtcgtgaagatgcagatcgccgggcagaacaagatcatgcgggtggtcaagatcgcccagaacggccagatcttcttcgccgagcacaacgaggcgaacgtggacgcccgcgacaaggacaagaacaaccccttcaagtacatctccaagacggccggcagcctgcagaaggccgggggcatccacatggccatctcccccatcggggacgcgcggcccgtgcgctacggccggtga

SEQ ID NO: 1441 - RNA, 3084 nt, synthetic construct
  misc_feature 1..3084: note = Cas9 variant
  source 1..3084: mol_type = other RNA
atgaagtacaccctgggcctcgacgtggggaccaacagcatcggctgggccgtcctggagctgaacacgaacggggagccccagcgcatcgagaagctcggctcccggatcttcaccgacgggcgccacccgaaggacggcaccaccctggccagcaagcggcgccagaagcggcacgagcgccggcgccgggaccgcctgcaccagcggaagaagctcgtgctgaaccagctggtgtccatgggcctcttcccccagagcgagcaggagcagcaggacctgaagtccctggacgtcctcacgctgcgcgcgaacggggtgagcaagcagctgtccgcctacgagctcggccgggtgttctactacctgaacctgaagcgcgggttcaagagcaaccggaagggcgggtccgaggaggacaaggccaacaagatcagcgagcgcatcaagaagctccaggagcagctgaaggagaacgacttcaagaccgtcggccagtacctgcacgaccggtacatcaagggcctctccaccaaggccaccatcgagaacgacttccacctcctgcgccagctgatcgaggacgagttcgacttcatcgtggagacgcagagcaagttcttccccgagatctccgacgagcagtggaacaccctgcggaaccgcatgttccaccagcggcccctgaagccggtggagaccgggacctgcagcctcttcgaggacaagaagcgcacgtacaagtacatgccctccttcgaggagtaccgcttcctgaccgagctgttcaacctcagctaccaggacgagaacttccactcccacagcctgtccagcgagcagatcttcaaggtcttccacgagctgaagaacacccgggaggccacctacacgaagatcaagaagctcctgaagctgcccagcgacctctccttcagcatcgagcgctccaagagcaaggacaagatcaagatctccaccaccaaccacttcttcagcaagtccctgctgttcgcggaggagtgggccagcctcgacctgaagctgaaggacgaggtggccgagatctacttctccgacatgagcgtggaggagatcaagaagggcctcctgcagctgaagatcgactccgagatcatcgagaacctcctggaggagaaggtccccaacgtgcaggaggcgacctgcagctactccaaggaggccctgcagaagatcgtgagcctcatcctggaggaggagcggcacccgacgctgatcgtcgacgacctgttcaagaacgagaaggaggagacctccctcatcgaccgcctggactactacggggccagcatccccgactccatgcagcccatcccccagcacatcaaggacaacaacctgaccctcaacgaggacgagaagcggtacggcaagatcgccaacccgaccgtgcacgccgccctgaaccagatccgccaggtggtcaacgacctgatcgagcagtacggcaagcccacgaacatccacatcgagttcgcgcgggacctcaagaagtccaaggaggagcgcgacttcgacaaccggaagaagaagaagaacgaggagctgaacgagcaggtccgcgacttcatcgagaagcacaaccagaagcccagcgccttcaacttcgagcgggtgaagctgtggttcgagctcgacgccatgaacaaccaggtgtgcgcctacagcgggaagaccatcagcgcccgcatggtgctgtccgacgaggtgcaggtcgaccacatcctgcccttcagccggaccctcgacgactccctggcgaacaaggtgctggtcctcgccagcgagaacgtgaagaagcgcaaccggaccccgtacgaggccttcggccaggacacggagaagtgggcctccatccaggagctggccaagcgcctgccctaccacaagcagtggcggttcgcggaggacgccatcaagaagttcgaggagaaggaccagttcctccagcgccacctgaacgacacccggtacatcagcaagatcgccaagaagtacctggggtccatcaccgacccctacaagatcgtggccagccgcggccagatgacctccatcatccgcgggaagctcggcctgaaccagttcatccagaagcccgacggcacgaagaaccgggaggaccaccgccaccacgccatcgacgcgctgaccgtcgccctcaccagccggtcctacctgaagcgcatcagcgacgcctccgcccggaaccaggacccgaaccgcatccccatccccgagccctggaaggggttcatcaaggacgcggacgtgaagttcaacgagatcatcgtgagccacaaggtcgaccacggcaagaacgggccgttcatggaggagacctgcttcggcctgatcaagaaccccaacaagtacgaggaggagaacgacttcaagctcatcacgaccaagtccctggacagcgtgaaggacccctccaccatccggagccagagcctgcagaacctcgccgagaagtccggggtgatcagcctggccaagtccggcgtcaagaagctgcgcgtgtacgacgtgaccaaggagaaccccgccgacatcggcctcatcgagagcgggctggccaagatcacccacggcaaggacaagcagcacgtcaagcactaccagaagggggacatcaactacctggcgatctggtgcctcccgcagaacatcacgctgaagtccgacaaccacaagaagcggaagaccgactacatcttcaccgccatcaagaccttcgacctgaacagcaagaaccccaacgacctccgcccccacccggccgccaagctggtgacgaaggtgtacaagggcgacaccgtcgccctggaggtgaacaaccagctcaactactacatcgtgaagtccatccgggcggccaacaagaagctgtacttcctgaagatcaaccagagctccgagctcgccaacgagacccagttcatccccgcctacaccaagctggtcgactacaagttccgcaaggtgagcgtgtcccccacgggggtcatcaccgacaacggccccctgctcaagtga

SEQ ID NO: 1442 - RNA, 3090 nt, synthetic construct
  misc_feature 1..3090: note = Cas9 variant
  source 1..3090: mol_type = other RNA
atgcgcagcctgcggtaccgcctcgccctggacctgggctccaccagcctcgggtgggccctgttccggctggacgcgtgcaaccgccccaccgccgtgatcaaggccggcgtccggatcttctccgacgggcgcaacccgaaggacggcagctccctcgccgtgacgcggcgcgccgcgcgggccatgcgccggcgccgggaccgcctgctgaagcggaagacccgcatgcaggccaagctcgtggagcacgggttcttccccgccgacgcgggcaagcggaaggccctggagcagctgaacccctacgccctccgcgccaagggcctgcaggaggccctgctccccggggagttcgcgcgggccctgttccacatcaaccagcgccggggcttcaagagcaaccgcaagaccgacaagaaggacaacgactccggggtcctgaagaaggccatcggccagctccgccagcagatggccgagcaggggagccggaccgtgggcgagtacctgtggacgcgcctgcagcagggccagggggtgcgggcccgctaccgggagaagccgtacaccaccgaggagggcaagaagcgcatcgacaagtcctacgacctctacatcgaccgggcgatgatcgagcaggagttcgacgccctgtgggccgcccaggccgcgttcaaccccaccctgttccacgaggccgcccgcgccgacctcaaggacacgctgctgcaccagcggcccctccgccccgtcaagccggggcggtgcaccctgctgcccgaggaggagcgcgcgcccctcgccctgcccagcacccagcggttccgcatccaccaggaggtgaaccacctccggctgctggacgagaacctgcgcgaggtggccctcaccctggcccagcgggacgccgtcgtgacggcgctggagaccaaggccaagctctccttcgagcagatccgcaagctgctgaagctcagcggctccgtgcagttcaacctggaggacgccaagcggaccgagctgaagggcaacgccaccagcgccgcgctcgcccgcaaggagctgttcggggccgcctggtccggcttcgacgaggccctgcaggacgagatcgtctggcagctcgtgacggaggagggggagggcgcgctgatcgcctggctgcagacccacaccggggtggacgaggcccgcgcccaggccatcgtcgacgtgagcctgccggagggctacggcaacctctcccggaaggcgctggcccgcatcgtgcccgccctgcgggccgcggtcatcacctacgacaaggccgtgcaggccgccgggttcgaccaccacagccagctcggcttcgagtacgacgcctccgaggtggaggacctggtccaccccgagacgggggagatccgcagcgtgttcaagcagctgccctactacggcaaggcgctccagcggcacgtggccttcgggagcggcaagccggaggaccccgacgagaagcgctacggcaagatcgccaaccccaccgtccacatcgggctgaaccaggtgcggatggtcgtgaacgccctgatccgccggtacggccgccccaccgaggtggtcatcgagctcgcccgggacctgaagcagtcccgcgagcagaaggtggaggcgcagcggcgccaggccgacaaccagcggcgcaacgcccggatccgccggagcatcgccgaggtgctggggatcggcgaggagcgcgtccgggggtccgacatccagaagtggatctgctgggaggagctcagcttcgacgccgcggaccgccgctgcccgtactccggcgtgcagatcagcgccgccatgctgctgtccgacgaggtggaggtcgagcacatcctccccttcagcaagaccctggacgactccctgaacaaccggacggtggccatgcgccaggcgaaccggatcaagcgcaaccggaccccctgggacgcccgcgccgagttcgaggcccagggctggagctacgaggacatcctccagcgggccgagcgcatgcccctgcggaagcgctaccggttcgcgccggacgggtacgagcgctggctgggcgacgacaaggacttcctcgcccgggccctgaacgacacccgctacctgtcccgggtggccgccgagtacctccgcctggtctgccccgggacccgggtgatccccggccagctgacggcgctcctgcgcggcaagttcgggctgaacgacgtgctcggcctggacggggagaagaaccggaacgaccaccgccaccacgccgtcgacgcctgcgtgatcggcgtgaccgaccaggggctgatgcagcgcttcgccaccgccagcgcgcaggcccggggcgacggcctcacccgcctggtcgacgggatgcccatgccgtggcccacgtaccgggaccacgtggagcgcgccgtgcggcacatctgggtctcccaccgccccgaccacggcttcgagggggccatgatggaggagaccagctacggcatccggaaggacgggtccatcaagcagcgccggaaggccgacggcagcgcgggccgcgagatctccaacctgatccggatccacgaggccacccagccgctccgccacggggtgagcgccgacggccagcccctggcctacaaggggtacgtgggcgggtccaactactgcatcgagatcaccgtcaacgacaagggcaagtgggagggcgaggtgatcagcacgttccgggcgtacggggtggtccgcgccggcgggatgggccggctgcgcaacccccacgaggggcagaacggccggaagctcatcatgcgcctggtgatcggcgacagcgtgcggctggaggtcgacggggccgagcgcaccatgcggatcgtgaagatctccggcagcaacgggcagatcttcatggcccccatccacgaggccaacgtggacgcgcgcaacaccgacaagcaggacgccttcacctacacctccaagtacgccggcagcctccagaaggccaagacgcgccgggtcaccatctccccgatcggcgaggtgcgcgaccccgggttcaagggctga

SEQ ID NO: 1443 - RNA, 3090 nt, synthetic construct
  misc_feature 1..3090: note = Cas9 variant
  source 1..3090: mol_type = other RNA
atgaagtaccgcctggccctcgacctgggcagcacctccctggggtgggccatcgtgcagctcaacgcgaaggacgagccctgcgccatcgtccgggccggcgtgcgcatcttcccggacgggcggaaccccaaggacggcagctccctggccgtgacccgccggaacgcccgcgcgatgcggcgccggcgcgaccggctgctcaagcgcaaggcccggatgcagcgcctgctgatcgagcacgacctcttccccgccgacgaggccgcgcggaaggccctggagacgctgaacccctacgagctccgcgccaaggggctggacgccgccctgaccccggcggagttcgcccgggccctcttccacctgaaccagcgccggggcttcaagagcaaccgccggaccgaccgcaaggacaacgactccggcgccctgaaggccgcgatcgggggcctccgcgcccagctggacaccgccggggccgacggccgggcccgcacggtcggggagctgctctggcggcgcatgagcgaccccaacgtgctgaccgtgcgggcgcgctaccgggagcagcgcatcaccaaggacgacggcaagacccgggtcgacaagtcctacgacctgtacgtggaccgcgccatggtggaggccgagttcgacgccctctgggccaagcaggcggagctgagccccacgcagttcggcgaggccgcccgggccaccctgaaggactgcctcctgcaccagcgcaacctgcggcccgtccgcccggggcggtgcaccctcgagcccgacgagccccgcgcgcccctggccctgccgtcccagcagcggttccgcatcctccaggaggtgaaccacctccggctgctgggcgggcgcctgctggaggagagcctctccgtggagcagcgcgacaagctggtcgccgccctggaggacggcagcaagtccttcaagaccgccatccccaagctcctgggcctgcccgggacggtgcagttcaacctcgcggacgccaagcggaccgagctgaagggcaacgccaccagcatgctgctcgggaagaaggacttcttcggccccgcctggcacgggttctccgaggcccgccaggacgagatcgtgatgcggatccaggaggaggagagcgaggcgcgcctggtcgactggctggccacctccacgggcgtggacgaggcccacgccctgaagatcgccaacgcggccctcccggagggctacgggagcctgtccgccaaggccctggcgaagatcctccccgccatgcgggccgaggtgatcacctacgacaaggccgtcctggccgcgggctacgaccaccacagccacatcagccacgccgcctccaccggggagatcctgcccgagctcccctactacggcgagtacctgcagcgccacgtggggttcggcaccggcgagctgaacgacacgccggagaagcggttcgggcgcatcgccaaccccaccgtgcacatcggcctcaaccaggtccgggtggtggtcaacgccctgatcaagcgctacgggcaccccaccgaggtgatcgtcgaggtggcgcgggacctgaagcagagccaggaccagcgccgggagacccaggagcagcaggccaagaaccagaagcgcaacgagcggctccgcaaggacgccgccgccatcctgggcatcgcggacgagcgggtgcgcctggccgacatccagaagctcatcctgtgggaggagctgtccttcgacatcgccgaccggcgctgcccctacagcggggtccagctctccgccgcgatggtgctgagcgagcaggtcgagatcgagcacatcctgccgttctccatgacgctcgacgacagcctgaacaacaagaccgtggccatgcggctggtgaaccgcctcaagggcaaccgcaccccctgggacgcccgggaggccttcgccggccaggggtgggactacgacggcatcctgatgcgcgcggagcggatgccccgcgccaagcggcagcgcttcgcccccgacgggctggagaagtggctcaaggaggacaaggacttcctggcccgggccctgaacgacacccgccacctctcccgggtggcgcgcgagtacctgagcctggtctgcccggcctccacgcgggtgatccccggccagatgaccgccatgctccgcgccaagttcggcctgaacgacatcctggggctcaacggcgagaagaaccggaacgaccaccgccaccacgccgtggacgcgtgcgtcgtggccgtgaccgaccaggggctgctgcagcggttcgcccaggccagcgccgacgcgcgcggcaaggggctcgaccggctggtcgagaccatgcccgacccgtgggactcctaccgcgagcacgtgcagcgggccgtgaacagcatctgggtctcccacaagcccgaccacggcttcgagggcgccatgcacgaggacacgacctaccgcccgccccacctggaccccaagaacatgtggcgcacccgggggatcggcgggggcaagcccaacgagaaggaggccgacagcaaggcgatggtggggttcaccggccccgagcacctccagcgccaccaccgggacaaggccggccagcagctgccctacaaggggtacgtggcctccccgaagttctgcatggacatcgtccgcaacgacaagggccggtgggagggggaggtggtgagcacgttcgaggcctaccgcctggtctccgagttcggccgggacgccgcgctcgcccacatccagagcaagagccgctccatcagcgggaagcccctggtgatgcggctgcagggcggcgacatggtgcgcttcgacgacgacgaggggcggcccgtcgtgctccgcgtggtcaacatgaccggcaacgggcagatcttcttcgcgccccacaacgaggccaacggcgacgcccggaaccgcgacaagcaggaccagttcgtgtacctgtccaagtacgccgggagcctgcagaaggcccggggccgccgggtgaccgtctccccggccggcgagctccgcgaccccgggttcaaggagtga

SEQ ID NO: 1444 - RNA, 3090 nt, synthetic construct
  misc_feature 1..3090: note = Cas9 variant
  source 1..3090: mol_type = other RNA
atgcgcagcctgcggtaccgcctcgccctggacctgggctccaccagcctcgggtgggccctgttccggctggacgcgtgcaaccgccccaccgccgtgatcaaggccggcgtccggatcttctccgacgggcgcaacccgaaggacggcagctccctcgccgtgacgcggcgcgccgcgcgggccatgcgccggcgccgggaccgcctgctgaagcggaagacccgcatgcaggccaagctcgtggagcacgggttcttccccgccgacgcgggcaagcggaaggccctggagcagctgaacccctacgccctccgcgccaagggcctgcaggaggccctgctccccggggagttcgcgcgggccctgttccacatcaaccagcgccggggcttcaagagcaaccgcaagaccgacaagaaggacaacgactccggggccctgaagaaggccatcggccagctccgccagcagatggccgagcaggggagccggaccgtcggcgagtacctgtggacgcgcctgcagcagggccagggggtgcgggcgcgctaccgggagaagccgtacaccaccgaggagggcaagaagcgcatcgacaagtcctacgacctctacatcgaccgggccatgatcgagcaggagttcgacgccctgtgggccgcccaggcggccttcaaccccaccctgttccacgaggccgcccgcgccgacctcaaggacacgctgctgcaccagcggcccctccgccccgtgaagccggggcggtgcaccctgctgcccgaggaggagcgcgcgcccctcgccctgcccagcacccagcggttccgcatccaccaggaggtcaaccacctccggctgctggacgagaacctgcgcgaggtggccctcaccctggcccagcgggacgcggtggtcacggccctggagaccaaggccaagctctccttcgagcagatccgcaagctgctgaagctcagcggctccgtgcagttcaacctggaggacgccaagcggaccgagctgaagggcaacgccaccagcgcggccctcgcccgcaaggagctgttcggggccgcctggtccggcttcgacgaggcgctgcaggacgagatcgtgtggcagctcgtcacggaggagggggagggcgccctgatcgcctggctgcagacccacaccggggtggacgaggcccgcgcccaggcgatcgtggacgtcagcctgccggagggctacggcaacctctcccggaaggccctggcccgcatcgtgcccgccctgcgggcggccgtgatcacctacgacaaggccgtccaggccgccgggttcgaccaccacagccagctcggcttcgagtacgacgcgtccgaggtggaggacctggtgcaccccgagacgggggagatccgcagcgtcttcaagcagctgccctactacggcaaggccctccagcggcacgtggccttcgggagcggcaagccggaggaccccgacgagaagcgctacggcaagatcgccaaccccaccgtgcacatcgggctgaaccaggtccggatggtggtcaacgccctgatccgccggtacggccgccccaccgaggtggtgatcgagctcgcgcgggacctgaagcagtcccgcgagcagaaggtcgaggcccagcggcgccaggccgacaaccagcggcgcaacgcccggatccgccggagcatcgccgaggtgctggggatcggcgaggagcgcgtgcgggggtccgacatccagaagtggatctgctgggaggagctcagcttcgacgcggccgaccgccgctgcccgtactccggcgtccagatcagcgccgccatgctgctgtccgacgaggtggaggtggagcacatcctccccttcagcaagaccctggacgactccctgaacaaccggacggtcgcgatgcgccaggccaaccggatcaagcgcaaccggaccccctgggacgcccgcgccgagttcgaggcccagggctggagctacgaggacatcctccagcgggcggagcgcatgcccctgcggaagcgctaccggttcgccccggacgggtacgagcgctggctgggcgacgacaaggacttcctcgcccgggccctgaacgacacccgctacctgtcccgggtggccgcggagtacctccgcctggtgtgccccgggacccgggtcatccccggccagctgacggccctcctgcgcggcaagttcgggctgaacgacgtgctcggcctggacggggagaagaaccggaacgaccaccgccaccacgccgtggacgcctgcgtcatcggcgtgaccgaccaggggctgatgcagcgcttcgccaccgcgagcgcccaggcccggggcgacggcctcacccgcctggtggacgggatgcccatgccgtggcccacgtaccgggaccacgtcgagcgcgccgtgcggcacatctgggtgtcccaccgccccgaccacggcttcgagggggccatgatggaggagaccagctacggcatccggaaggacgggtccatcaagcagcgccggaaggcggacggcagcgccggccgcgagatctccaacctgatccggatccacgaggccacccagccgctccgccacggggtcagcgccgacggccagcccctggcgtacaaggggtacgtgggcgggtccaactactgcatcgagatcaccgtgaacgacaagggcaagtgggagggcgaggtcatcagcacgttccgggcctacgggatcgtgcgcgccggcgggatgggccggctgcgcaacccccacgaggggcagaacggccggaagctcatcatgcgcctggtgatcggcgacagcgtccggctggaggtggacggggccgagcgcaccatgcggatcgtgaagatctccggcagcaacgggcagatcttcatggcccccatccacgaggcgaacgtcgacgcccgcaacaccgacaagcaggacgccttcacctacacctccaagtacgccggcagcctccagaaggccaagacgcgccgggtgaccatctccccgatcggcgaggtgcgcgaccccgggttcaagggctga

SEQ ID NO: 1445 - RNA, 3096 nt, synthetic construct
  misc_feature 1..3096: note = Cas9 variant
  source 1..3096: mol_type = other RNA
atgcccgccatctaccgcctggccctcgacctgggcagcacctccctggggtgggcggtgctccggctggagccggccgccctggagcccatcgccatcatcaaggccggcgtccgcatcttcagcgacgggcggaaccccaaggacggcgcgtccctcgccgtgacccgccgggccgcccgcgcgatgcggcgccggcgcgaccggctgctgaagcgcaaggcccggatgcaggacaagctcgtgaagcacgggttcttccccagcgacatggacgagcgcaaggccctggagcggctggacccgtacgccctccgcgccaagggcctgcgggaggcgctgacgcccggcgagttcgcccgcgccctcttccacatcaaccagcggcgcgggttcaagtccaaccggaagaccgacaagaaggacaacgacagcggcgccctgaagaaggccatctcccacctccgccagcagatggaggccgggggccaccgcaccgtcggggaccacctgtggagccggctgcagcagggcctgggcgtgcgcgcccggtaccgcgagacccccttcacgaacgacgaggggaagaagcggatcgacaagtcctacgacctctacatcgaccgcgccatgatcgagcaggagttcgacgccctgtgggccgcgcaggccgccttcaaccccgccctgttccacgaggtggcccgggcggacctcaaggacaccctgctgcaccagcgccggctccgcccggtcaagcccggccggtgcaccctgctgcccgaggaggagcgcgcgcccctcgccctgccgagcacccagcggttccgcatctaccaggaggtgaaccacctccggctgctgggggaggacctgcgcgaggtggccctcacgctggcgcagcgggacgccgtcgccaacgccctggagtccaaggcccgcctcaccttcgagcagatccggaagctgctgaagctcagcggctccgtgcagttcaacctggaggacgcgaagcgcaccgagctgaagggcaacgccaccagcgccgccctcgcccgcaaggagctgttcggggcggcctggggcgggttcggcgaggccctgcaggacgagatcgtgtggcagctcgtcacggaggagggggagggcgccctgatcgcctggctgcaggcgcacaccggcgtggacgaggcccgggcccaggccatcgcggacgcctccctgcccgaggggtacggcagcctctcccgcaaggccctggcccggatcgtgcccgccctgcgcgcgggggtcgtgacctacgacaaggccgtgcaggccgccggcttcgaccaccacagccagctcgggttcgagtacgacgccggcgaggtcgaggactgggtgcaccccgacaccggcgagatccggccggtgttcaagcagctgccctactacgggaagcccctgcagcgccacgtcgcgttcggctccgggaagcccgaggacccggacgagcggcgctacggcaagatcgccaaccccacggtgcacatcgggctcaaccaggtgcggaccgtcgtgaacgccctgatccgccggtacggccgccccaccgaggtcgtgatcgagctggcccgggacctcaagcagagccgcgagcagaaggtggaggcccagcggaagcaggcggagaaccagcgccggaacgcccgcatccgcaagagcatcgccgaggtcctgggcatcggggaggagcaggtccggggcgccgacatccagaagtggatctgctgggaggagctgtccttcgacgtggcggagcggcgctgcccctacagcggggtgcagatctccgcccgcatgctcctgagcgacgaggtggaggtggagcacatcctgccgttctccaagaccctcgacgacagcctgaacaaccggacggtcgccatgcgccaggccaaccggatcaagcgcaaccggaccccctggaccgcccgcgacgacttcgaggcgcagggctggtcctacgagggcatcctgcagcgggccgagcgcatgcccctccggaagcgctaccggttcgcccccgacgggtacgagcgctggctgggcgacgacaaggacttcctggcccgggccctcaacgacacccgctacctgagccgggtggcggccgagtacctgcgcctcgtgtgcccggggtccggcacgcgggtcatccccgggcagatgaccgcccgcctgcggggcaagttcggcctgaacggggtgctcggccccgacggggagaagaaccgcaacgaccaccgccaccacgccgtggacgcctgcgtcatcggcgtgaccgaccaggggctgatgcagcggttcgcgaacgccagcgcccaggcccgcgaggacggcctgacccggctcgtggacgacatgccgcgcccctggcccacgtaccgggcccacgtcgagcgcgcggtgcggcacatctgggtgtcccaccgccccgaccacggcttcgagggggccatgatggaggagaccagctacggcatcgggaaggacggctccatcaagcagcggcgcaaggccgacgggagcccgggccgggagatcaccaacctgatccgcatccacgaggccacccagccccagcggcacggcgcggggcccgacggccagcccctgccgtacaaggggtacgtcggcgggtccaactactgcatcgagatcacgcgcaacgacaagggcaagtgggagggcgaggtgatcagcaccttccgggcctacgggatcgtgcgcacctccggcctcgggcagctgcggcacccccgcgtcggccagaacggccgggagctggtgatgcgcctcgtgatcggggacagcgtccggctggagatcgacggcatcgagcgcaccatgcgcatcgtgaagatctccgggagcaacggccagatcttcatggcccccatccacgaggccaacgtggacgcccggaacagcgacaagcaggacgcgttcgcctacacgtccaagtacgccgggagcctgcagaagaccaaggcccgcttcgtcaccatctcccccatcggcgaggtgcgggacctcggcttcaaggggtga

SEQ ID NO: 1446 - RNA, 3099 nt, synthetic construct
  misc_feature 1..3099: note = Cas9 variant
  source 1..3099: mol_type = other RNA
atgaagaagcgcatcctgggcctcgacatcgggatcgccagcgtgggctgggccctggtcgagttcgacgacgagttccaggacaacaagaagaaggggaccatcatcaagtccggcgtgcggatcttcacccgcgcggagacgcccaaggagcgggagagcctggccaagccgcgccgggaggcccgctcccagcggcgccggatccgccggcgcgtggagcggctcaacagcatccgcgagctgttcgtcaagaacggggtggtggaggagtggtccgtcagcaagaagaaccccaacaacatctacatcaccctgaaccagatcaagaccccctggcagctccggatggagtccctggaccgcaagctgaccaacgagcagttcgccgtggtgctcacgcacctggccaagcaccggggctacaagagcctgcgcaaggacgacaaggcgggcaaggtcctcgaggccatctcccagaacaagaagcggctgaacgacagcgactaccgcaccctgggggagatgttctgcaagaacgagtcctacaaggagcacaagcggaacaagggcggggagtacatcaacagcgtggcccgcgagctcatcgaggaggaggtggagaagatcttcgtcaagcagcgcgagaagggcaacaacttcgccgacgtgaacaccgagcgggagtacctgaagatcgcgttctcccagaagcccgccgggagcatctccaagatggtgggcttctgcaccttcgagaacggcgagaagcgcgccccgcgggacagctactccgccgagctgttcaaggtcctctgcacgatcaacaacaccaccttcaccgacatgaagacgggggagatccgcagcttctccaaggaggagatcggcaagaccctggagaccgtgaagaacgtgaaggacgtcaagtacgccaagatccggaaggacctggggctcgaggacagcgtgaagttcagcggcgtggactaccgcgagaacgcgaagtccaagggcgagggggagatcttcgtcagcatgaagacctaccacgagatcaagtccaagatcgagaagctgagcaaggagaagtgggacaacctgaagggcaacacggagctcctggactccatcgtgaacatcatcgccaacctgaaggacgacgagagcatcaagaaggagttccagaagctcaagatcgacgaggacatcatcgacgtgctgctgaacttcgagttcaagaagttcatcaacctctccttcaaggccctgcggaagatcatccccttccagttccaggggcagaagtacatcaccgccagcacctccgccggctacagcctgaagcaggaggggatcaagaacaagctcgtcccgcccgcgaaggagaacatcaacgtggccgtcgtggcccgcgccttcgcccagacccggaaggtgatcaacgcggtcatccgcaagtacggccagttcgaccagatcaacatcgagctggccacggagctgaagaactccaagttcgaccggagcaagatcgaggagggccagaagaagttccagtcccagaaggacaagatcttcaaggaggtgcaggagctccgcgggggcatgacccccagctccagcctgctgctcaagtaccggctgtggcgcgagcaggacgagcggtgcgtgtactccgggcgcaagatcagcttcgaggacctgctcgacaccggcttcctggacatcgaccacatcatcccctactccaagagcatggacgacagcttcaacaacaaggtcctgtgcctcgccgaggagaaccggaacaagaagaacgacatccccttcaactactaccagcgcatcgaccgggactggaacctgctgatctccatcatcaccagcatgaagaacatgaagatcgccaagaagtcccgcctcctgaagcaggagctgagcgacatcgaggggttcatcgagcgcaacatcaacgacacgcggtacgccacccgctacatcaaggacttcctggagaacaacctcgagttcaaggagaacgagttcatcaaggtgaaggtgcaggcgcggtccggcggcctgaccagcgtcctgtcctacaactgggggatgagcaaggaccgcgaggagtcctacttccaccacgccaaggacgccatcatcgtggcctgcagcacccagggcatggtgcagtacatctccaagatcagccagcagtacgagaacgacaaggacaagatgaagaagatcaaggacaagacggagaactgcatccccaagccgtgggactccttccgggcggacgtcgaggagagcatcgaggggatcttcgtgtccttcgcgccccgccacaaggtgaccggcagcgcccacaaggagaccatctactccaagaagcacctcgagaaggagcggtacgtcaccgtgaagaagtccctggacaagatcaagctgagcgacctcgagaacatcccctgcaacgagaactgcgggatcatccgcgtgctgaaggagcggctggagaagttcaagaacgacagcctcaaggccttcgccgaccccgtccacatgccgacgaagtgccccaacaagaagggccccgtgatccgcagcgtgaagatcaaggagtccaacaagaccggcatcgaggtccggaaggggctggccgagcgcggcgagatggtgcgggtggacgtcttcatcaaggacaagaagtactacctggtgcccatctacgtgagcgacttcaagaacaaggacctcccgaacaaggccatcgccgccctgaagctggagaacgagtggatcatgatcgacaagacctactccttcaagttcagcctcttcaaggacgacctgatcaagatcaagaagaagaaggaggagatcttcgggtacttcggcggcgtccaccgctccaccgggacgatcaagatcaagagccggcacaagcccaaggagatcgacgagggcatcgggtcccgctgcctgctcgacttccggaagttccaggtggacgtgctgggcaactacaccgaggtcaagcacgagaagcgcatgcccgcctacatcacccggaaggacaagaagcactga

SEQ ID NO: 1447 - RNA, 3105 nt, synthetic construct
  misc_feature 1..3105: note = Cas9 variant
  source 1..3105: mol_type = other RNA
atgaagatcctgggcttcgacatcgggatcgccagcatcggctgggccttcgtggagaacggggagctccgcgactgcggcgtccggatcttcaccaaggcggagaaccccaagaccggggactccctggccatgccgcgccgggaggcccgcagcgtgcggcgccggctggcccgccggaagggccgcctcgagacgctgaagcggctgctcgccaaggagtgggacctgtgctacgaggactacatcgcggccgacggcgagctgcccaaggccttcatggggaagaacctcaccaacccctacgtgctgcgctacgaggccctgcagcggctcctgggcaaggaggagctggcgcgcgtcatcctccacatcgccaagcaccgggggtacggcaacaagaacgccaagatcaccaagtccgaggagagcaagcgcgagcaggggaagatcctgtccgccctggccaccaacgcgagcgtgatcgcccggtaccgcacggtgggcgagtacttctacaaggagttctgcgaggtcatcaagaacccccagggcctcaacaccaacgagaactgcacccagccgaaggtgcgggtgctgaagcccatccgcaacaagggcggggagtacaccaactgcatcctgcaggaggacctccagcgggagctgcgctgcatcttcgagcaccagaaggggttcggcttccccatcacgcaggagttccaggacaagatcctgaagatcgccttctaccagcgctccctcaaggacttcagccacctggtcggcaagtgcaccttctaccccgacgagccgcgggcccccaagttctccctgagcgccatcgagttcatcaccaaggcgaagaccatcaacctcctggtggggatcgtgaaggagtccggcgaggtctgggacaaggagcagtggcgcgagcggctggacagcgtgttctccgccgtgtgcgagcgcgggaacctcacgttcgcccagatgcggaagatcctgaagatcgacgagcgcatccagttcaaggaggtcgactacaccgccaagaaccccgagaacaagaagttcgtggagttcaagaacctgaagaagttctgcgagatcctcggcgccatcgtgggggaccgggcgctggccgacagcatcgcccgcgacatgaccctgatcaaggacgaggaggagctcgcccagaagctgcggggctacggcaagttctcccaggagcagatcacccagctgggggccctcaacttcagccaccacatcaacctgtccctgaaggcgctcagcgagatcctgcccttcatgcgcgagggcatgcggtacgacgaggcctgccaggaggccaagctgcaggccaagcacaacgacaagaagtccaagttcctcccgcccttctgcgggagcatctacgcggacgagctgacgaaccccgtcgtgcaccgcgccatcgccgagtaccggaagatcctgaacgccctcatcgccaagtacggcaacgtgcacaagatccacatcgagctgacccgcgacgtcgggaagaacttccaggagcgggagaagtacaagaaggagatcgagagcaactacaaggcgcgcgtgcaggccatgcaggagtgcgagaagctgggcctgaccctctccgagggcaacatcctgaagctgcgcctcttcatggagcagaacgagcggtgcgtgtacagcgggcggaagatcaccctggccaacctgaaggagcagggcgccctcgagatcgaccacatcctgccctactcccgcagctccgacgacagctacatgaacaaggtcctggtgttcacgaacgagaaccagaacaaggggaacaagaccccgtacgaggccttcggcggggactcccagaagtggggcgagatcgagagcctcgcgctgcgctccggctaccccaagaagaaggccaagcggatcctggacaaggggttcggcgaccgcgaggccgggttcaagagccggaacatcgtcgactccggctacatcgcccgcctcatcgccaactacaccaaggagtacctgaagttcctgcccctcgacagccacgagaacaccgcgctgatcgccggcgagaaggactccaagatccacgtggaggccgtgaaggggatgctgacggccaccatgcggcacttctggggcctcgggagcaagaaccgctacgagcacacccaccacgcgatcgacgccatcatcatcgcctacatcaacgccgccatgatccagcggttctcccagttccgccagaaccaggagagcctgaaggcgcggttctacgccaaggagctggccaaggaggagttcaagacccagcgcgccttcttcgagcccttctccggcttccgggagcaggtcctcgccaaggtggggcagatcttcgtgagccgcccgccccggaagcgcgcgcggggcgccctgcacgaggagacgttctactccatcgacgacaagaagctgagcgagacctacggcgggaaggagggcgtccagcgcgccctcagcctggggaagatccggcagatcggcaccaagatcgtggccaacgggcccatggtgcgcgtcgacatcttcaagcacaagaagtccggccggttctacgccgtgcccatctacaccatggacttcgcgctgggcatcctcccgaacaaggccgtggtcagcgggaaggacaacgaccgcatcatcaaggactggctggagatggactccaactacgagttctgcttcagcctgttcaaggacgacgtgatcgaggtgcagaagaaggacatggagaagcccgagctcgcctacttcgtctccctgaacacgagctccgccagcatcgcgctggtgaagcacgacaacaagttcgagaccctcacctccaaccaggccaagctgttcagcaacgccaaggagaacaacgtgatcgccgagtccctgggcatccagaacctcaaggtcttcaagaagtacaaggtgagccccctgggggagatcaaggaggccaagtacgagccccggcagccgatcgcgctgaagacctcccccaagaagcaccgcaagcagaacaacgcccagtga

SEQ ID NO: 1448 - RNA, 3108 nt, synthetic construct
  misc_feature 1..3108: note = Cas9 variant
  source 1..3108: mol_type = other RNA
atgcgccggctgggcctcgacctggggaccaacagcatcggctggtgcctgctcgacctgggggacgacggcgagcccgtgtccatcttccgcaccggggcccggatcttcagcgacggccgcgacccgaagtccctgggcagcctcaaggccacgcggcgcgaggcgcggctgacccgccggcgccgggaccgcttcatccagcggcagaagaacctgatcaacgccctcgtcaagtacgggctgatgcccgccgacgagatccagcgccaggccctggcctacaaggacccctaccccatccggaagaaggcgctcgacgaggccatcgacccgtacgagatgggccgcgccatcttccacatcaaccagcggcgcgggttcaagtccaaccgcaagagcgccgacaacgaggcgggcgtggtgaagcagtccatcgccgacctggagatgaagctgggggaggccggcgcccggaccatcggcgagttcctcgccgaccggcaggcgaccaacgacacggtccgcgcccgccggctgagcgggaccaacgccctgtacgagttctaccccgaccgctacatgctcgagcaggagttcgacaccctgtgggccaagcaggccgcgttcaacccctccctgtacatcgaggccgcccgggagcgcctcaaggagatcgtgttcttccagcggaagctgaagccccaggaggtgggccgctgcatcttcctgagcgacgaggaccggatctccaaggccctcccgagcttccagcgcttccggatctaccaggagctgtccaacctggcctggatcgaccacgacggggtcgcgcaccgcatcaccgccagcctcgccctgcgggaccacctgttcgacgagctcgagcacaagaagaagctgacgttcaaggccatgcgcgccatcctgcggaagcagggcgtggtggactaccccgtcggcttcaacctcgagtccgacaaccgcgaccacctgatcgggaacctgaccagctgcatcatgcgggacgcgaagaagatgatcggctccgcctgggaccgcctcgacgaggaggagcaggacagcttcatcctgatgctgcaggacgaccagaagggggacgacgaggtgcggtccatcctcacccagcagtacggcctgagcgacgacgtggccgaggactgcctggacgtccgcctccccgacgggcacggcagcctgtccaagaaggccatcgaccggatcctgcccgtgctccgcgaccagggcctgatctactacgacgcggtgaaggaggccgggctgggcgaggccaacctctacgacccgtacgccgccctgagcgacaagctggactactacgggaaggcgctggccggccacgtcatgggggcctccggcaagttcgaggacagcgacgagaagcgctacggcaccatctccaaccccacggtgcacatcgccctcaaccaggtgcgggccgtcgtgaacgagctgatccgcctgcacgggaagcccgacgaggtggtcatcgagatcggccgggacctccccatgggggcggacggcaagcgcgagctggagcggttccagaaggaggggcgcgccaagaacgagcgggcccgcgacgagctgaagaagctcggccacatcgacagccgggagtcccgccagaagttccagctgtgggagcagctggccaaggagccggtggaccggtgctgccccttcaccggcaagatgatgagcatctccgacctcttcagcgacaaggtggagatcgagcacctcctgcccttctccctgaccctggacgacagcatggccaacaagaccgtctgcttccgccaggcgaaccgggacaaggggaaccgcgcccccttcgacgccttcggcaactccccggccgggtacgactggcaggagatcctgggccggagccagaacctcccctacgcgaagcgctggcggttcctgcccgacgccatgaagcgcttcgaggccgacggcgggttcctggagcggcagctcaacgacacgcgctacatctcccggtacaccaccgagtacatcagcaccatcatccccaagaacaagatctgggtggtcacgggccgcctgacctccctgctccgcgggttctggggcctgaacagcatcctgcgggggcacaacaccgacgacggcaccccggccaagaagtcccgcgacgaccaccggcaccacgccatcgacgcgatcgtggtgggcatgacgagccgcgggctcctgcagaaggtcagcaaggccgcccggcgctccgaggacctggacctcacccggctgttcgagggccgcatcgacccctgggacgggttccgggacgaggtgaagaagcacatcgacgccatcatcgtgagccaccgcccccggaagaagtcccagggcgccctgcacaacgacaccgcgtacgggatcgtcgagcacgccgagaacggcgccagcaccgtggtgcaccgcgtccccatcacgtccctcggcaagcagagcgacatcgagaaggtgcgggacccgctgatcaagtccgccctgctcaacgagaccgccgggctgagcggcaagtccttcgagaacgcggtgcagaagtggtgcgccgacaacagcatcaagtccctgcgcatcgtcgagaccgtgagcatcatccccatcaccgacaaggagggggtggcctacaagggctacaagggggacggcaacgcctacatggacatctaccaggaccccacgtccagcaagtggaagggcgagatcgtctcccggttcgacgcgaaccagaaggggttcatcccgagctggcagtcccagttccccaccgcccgcctcatcatgcggctgcgcatcaacgacctgctcaagctgcaggacggcgagatcgaggagatctaccgggtgcagcgcctgagcgggagcaagatcctcatggcgccccacaccgaggccaacgtggacgcccgcgaccgggacaagaacgacaccttcaagctgacgtccaagagccccggcaagctgcagtccgccagcgcccgcaaggtccacatctccccgaccgggctcatccgggagggctga

SEQ ID NO: 1449 - RNA, 3108 nt, synthetic construct
  misc_feature 1..3108: note = Cas9 variant
  source 1..3108: mol_type = other RNA
atggagcagctgaactacatcctcggcctggacatcgggatcgccagcgtgggctgggccgtcgtggagatcgaccacaacgaggaccccatccgcctgatcgacgtgggggtccggaccttcaacaaggcggaggtggccaagaccggcgagtccctcagcctgatccgccggctggcccgcgggtcccggcgcctcgtgcggcgcaagaagatgcggctgctgacggccaagcgcctcctcaagagcgagggcatcctgtccgacctcgacttcaacaagggcgccatcctgaacctgccgaacaactgctgggagctccgggtcaaggggctggacaagaagctgagcgacaaggagtgggcggccgtgctcctgcacatcatcaagcaccgcggctacctgtcccagcggaagcacgaccgcaagaccgacgacaaggagctcggggccctgctgagcggcgtgtccaagaaccacagcctcctggaggagggggagttccggaccgccgcggagctggccatcaacgtcttctgcaactccaagggccacatccgcaaccagtggggcgactacagccacaccttctcccggctcgacctgcagaaggagatcaagcagctgttcgtgagccagcgcgagctcgggaacccctacacgtccagctccttcgaggagaacatcatcagcctgctgatgaagcagaaggaggccatctccggcaacgacatcctcaagatgctggggaagtgcacctacgagaagaacgagtacaaggccgccaagaacacctacagcgcggagcggttcgtgtggctgaccaagctcaacaacctgcgcatcgtcgacgacggcgtggagcgggccctgaacagctccgagcgcaagctcctgatcgacgagccctacaagaaggccaagctgacgtacgcccaggtgcgcaagatcctcgagctgcccgacagcgccgtcttcaagggcgtgcggtacttcgcggacaacgccgagtccagcaccctgatggagatgaagttctggcactccatccgcaaggccctcgagagcaacaacctgaaggacgagtggctggtgctcaagaccaagccggagctgctggacgagatcgggaccggcttctccatctacaagacggacgacgacatcaccagctacctgtccaacaagctcgacaagaaggtcctggacatcctgctcgtggaggtgagcttcgacaagttcatcgagctgtccctgaagtgcctccggaagatcatccccctgatggagaaggggtaccgctacgacgaggcctacaagtacatctacggcgaggtcaacatcgagtacaacctgaacgacatcaagaaccccgtggtgctccggagcttctcccagagccgcaaggtcatcaacgccgtgatccggctgtacgggtcccccgcgcgcatccacatcgagaccgcccgggacatcggcaagagcttcaaggagcgcaaggccatcgagaagcagcaggagaagaaccggctggagaaggtccgcgccgccgagcacttcaagcagctgttcccgaactacgtgggcgagcccaaggcgaaggacatcctgaaggtgcggctgtacgagcagcagcaggggaagtgcctctactccggcaagatcctggacatcaagcgcctgatggagcacgggtacgtcgagatcgaccacgccctccccttcagccggacctgggacgactccttcaacaacaaggtgctggtgctggccaacgagaaccagaacaagggcaacaagacgccctacgagtggttcaacgggaaggacaacagcgacagctggaagcgcttcctcgccctggtcaacaactccggcttcagcgcggtgaagaagcagcacatcctgatgaaggagatcgacgaggagggcttcaagcagcggaacctcaacgacacccgctacatcacccggttcctgtgcaactgggtggagaacaacatcccgctgctcgggaagggcgtcaagcgcgtgttcgcgccccaggggaagatcaccgccctgctgcgctccaactggggcatccggaaggtgcgcgaggacaacgaccggcaccacgccatcgacgccatcgtcgtggcctgcacgaccgtgagcatccagcagcgcatcaccaactacgtcaagaactccgagatcaaccggaagatcaagcgccagaactacctcaagttccccgagccctggaagttcttccgggaggacatcagcatccgcgtgttctccaacaacccgatcgaggagctgaagcagcagctgagcgaccggcccgaggccaaccaccagttcgtgacgcccctcttcgtctcccgcgcccccgtgcggaagatgaccgggcagggccacgaggacaccatccgcagcgccaagcggatctccgagggcatcagcgtgctgcgcgtcccgctgaccaagctcaacgacaagtccctggagctgatggtgaaccgggagcgcgagaaggagctctacgacgccctgaagcagcggctgctcgagttcaagaacgaccccgagaaggcgttcgccgagcccttctacaagaagggcgggcagcaggtcaagaccgtgcgcatcgagcgggtgcagaagaacggggtgctggtcaacaacaacacgggcatcgccgacaacggcaacatcgtgcgcgtggacgtcttcctgaagaagaagaagtacttcctcgtgcccatctacagctggcaggtcgccaaggggatcctgccgaacaaggccatcgtggcgcacaagaacgagtgcgactgggccgacatggacggctccgcccagttcctgttcagcctctacaccaacgacctgatcgaggtggtgctgaaggactccaccatcctcgggtacttcagcagcatcgaccgggccaccgcggccatcatcatcaaggagcccgacatggagaagtccaagggcaaggaggggatccaccgcgtcggcgtgaagacggcccgcagcttcatcaagtacaacgtggacgtcctgggcaagaacatctcccggtgccgcaaggccaagcggctgcccgtgcgctga

SEQ ID NO: 1450 - RNA, 3108 nt, synthetic construct
  misc_feature 1..3108: note = Cas9 variant
  source 1..3108: mol_type = other RNA
atgctgcgcaagatgcactaccggctcgccctggacctgggcagcacctccctcgggtgggccatgatccgcctgaacgcgggcaacgagccctgcgccgtgatcaaggccggggtccggatcttcagcaacggccgcaacccgaaggacgggtccagcctggccgtgacccggcgcgaggcccgggcgatgcgccggcgccgggaccgcctcctgaagcggaaggcccgcatgatccagacgctgatcgagtacggcttcttccccgccaaggaggaccagcggaaggccctcgagatcatgaaccccttcgcgctgcgcgccaagggcctgaacgaggccctcacccccgccgagttcgcccgggcgctgttccacatcaaccagcgccgggggttcaagtccaaccgcaagaccgacaagaaggacaacgacagcggcgccctgaagaccgccatcaacaagctccgggagacgctgaagaccgagaactgccgcaccgtgggggagtggctgaacaagcgcgacgtcgccggcctcaccgtgcgggcccgctaccaccaggacaagacgatcaaggaggacgggaagtccaagatcaacaagtactacgacctgtacatcgaccgggcgatgatcgagcacgagttcgacgagctgtggaagaagcaggccgagctcaacccgaccctgttcaccgaggccgcccgcgccgacctgaaggacgtgctcctgcaccagcgggcgctgaagcccgtcaagcccggccgctgcaccttcatgcccgacgaggagcgggccccgctcgccctgcccagcacgcagcgcttccggatgtaccaggaggtgaacaacctgcgcatcctccgggacggcctgaaggaggagtccctgaccctcaaccagcgcgacgacctgatcgccgccctggaggagaacaacaagcggaccttcacccagatcaagaagctcctggggctgggcggggtggtcaagttcaacttcgaggaccccaagcgcgaggagctcaagggcaacacgaccagcgcgatcctgggcaaggacgagcacttcgggtccgtgtggttcaagttcgacgaggccaagcaggacgccatcgtgatgcagctgttcaaggaggagaacgaggccaagctcctgcggtggctgcagaacgagaccggcatcgacgagaagcgcgcggagaccatcgccaacgtcgggctccccgagggctacgggagcctgtgcgccctggccctcgcccggatcctgccggagctgcgccgggacgtggtgccctactccgacgcggccaaggccgccggcttccaccacagcgacacgtccaacaaccaggaggtccccggcctgaccttccccatcgagctcgtggtgaccgagaccggggagatcaagacgaagcacatcttccacgagctgccgtactacggcgagtacctgcagcgccacgtcgggttcggcagcgggaagcccgaggactccgccgagaagcgctacggcaagatcgcgaaccccaccgtgcacatcggcctcaaccaggtgcggctggtcgtgaacaccctgatcaagcgctacgggcaccccagcgaggtgatcgtcgaggtggcccgggacctcaagcagtccaaggacctgcgcgacgaggagggcaagcggcaggccgagaaccagaagcgcaacaagcggatccgcaccgccatcgccggggtcctgcagacgagcgaggagcgggtgcgccgggacgacatcgagaagatgatcctctgggaggagctgagcttcgacccggcggaccgccggtgcccctactccggcgtgcagatcagcgccgccatgctgctctccgacgaggtcgagatcgagcacatcctgcccttcagccagaccctggacgactccctcaacaacaagaccgtggccctgcgccaggcgaaccgggtgaaggggaaccgcaccccctgggaggccttcggcgcccagagcacggccggcttcgactacgccaccatcctggcgcgggccgagcacatgccgaaggggaagcgctaccggttcgccgaggacggctaccagcgctggctcaaggacgacgccgggttcctgccccgggccctgaacgacacccgccacatgtccaaggtcgcgcgcgagtacatgagcctcatctgccccaacacccgggtgatccccggccgcatgacggccatgctgcggggcaagttcgggctgaacgacgtgctcggcctgaacggggagaagaaccgcaacgaccaccggcaccacgccgtcgacgcctgcgtgatcgccgtgaccgaccagggcctgctccagcgcttcgcgaaggcctccgccagcgcccgggagcagcagctgaaccgcctggtcgagaacatgccgctcccctgggagtcctaccgggagcacgtggagcgcgcgatcgacgccatctgggtgagccacaagcccgaccactcccacgagggggccatgcacaacgacaccgcctacggcctgctgggcgacgggaaggtcagcatccacaagatggtggagggcaagcgggagcgcatcgaggagtccctcaaggtgatcgccttcaccaacgcgaaggccaacgaccggcacgggctgctggacaacggcgagccgcgcccctacaaggggtacaagggcgacagcaactactgcatcgagatcatccggaacgagaagggcaagtgggagggggaggtcatctccaccttcgacgcctaccagctcgtgcgcgagcacggcgtggcccggctgcgccaccccacgctgagcgtctccgggaagcccctcgtgatgcggctgatgaaggacgagaccatccgcatggtgaccaacgagaagccgatcaccgcccgcgtctgctgggtgcggagcgacacgcgcatcgcgttcgccagcacctccgaggccaacgtggacgcccgggaccgcgacaagaacgacagcttctcctacatcgtcaagaccgccagcgtgctgcagaagctccaggcgcggcgcatctccatcagccccaccggcgagctgcgggaccccgggttcaaggagtga

SEQ ID NO: 1451 - RNA, 3108 nt, synthetic construct
  misc_feature 1..3108: note = Cas9 variant
  source 1..3108: mol_type = other RNA
atggagcagctgaactacatcctcggcctggacatcgggatcgccagcgtgggctgggccgtcgtggagatcgaccacaacgaggaccccatccgcctgatcgacgtgggggtccggaccttcaacaaggcggaggtggccaagaccggcgagtccctcagcctgatccgccggctggcccgcgggtcccggcgcctcgtgcggcgcaagaagatgcggctgctgacggccaagcgcctcctcaagagcgagggcatcctgtccgacctcgacttcaacaagggcgccatcctgaacctgccgaacaactgctgggagctccgggtcaaggggctggacaagaagctgagcgacaaggagtgggcggccgtgctcctgcacatcatcaagcaccgcggctacctgtcccagcggaagcacgaccgcaagaccgacgacaaggagctcggggccctgctgagcggcgtgtccaagaaccacagcctcctggaggagggggagttccggaccgccgcggagctggccatcaacgtcttctgcaactccaagggccacatccgcaaccagtggggcgactacagccacaccttctcccggctcgacctgcagaaggagatcaagcagctgttcgtgagccagcgcgagctcgggaacccctacacgtccagctccttcgaggagaacatcatcagcctgctgatgaagcagaaggaggccatctccggcaacgacatcctcaagatgctggggaagtgcacctacgagaagaacgagtacaaggccgccaagaacacctacagcgcggagcggttcgtgtggctgaccaagctcaacaacctgcgcatcgtcgacgacggcgtggagcgggccctgaacagctccgagcgcaagctcctgatcgacgagccctacaagaaggccaagctgacgtacgcccaggtgcgcaagatcctcgagctgcccgacagcgccgtcttcaagggcgtgcggtacttcgcggacaacgccgagtccagcaccctgatggagatgaagttctggcactccatccgcaaggccctcgagagcaacaacctgaaggacgagtggctggtgctcaagaccaagccggagctgctggacgagatcgggaccggcttctccatctacaagacggacgacgacatcaccagctacctgtccaacaagctcgacaagaaggtcctggacatcctgctcgtggaggtgagcttcgacaagttcatcgagctgtccctgaagtgcctccggaagatcatccccctgatggagaaggggtaccgctacgacgaggcctacaagtacatctacggcgaggtcaacatcgagtacaacctgaacgacatcaagaaccccgtggtgctccggagcttctcccagagccgcaaggtcatcaacgccgtgatccggctgtacgggtcccccgcgcgcatccacatcgagaccgcccgggacatcggcaagagcttcaaggagcgcaaggccatcgagaagcagcaggagaagaaccggctggagaaggtccgcgccgccgagcacttcaagcagctgttcccgaactacgtgggcgagcccaaggcgaaggacatcctgaaggtgcggctgtacgagcagcagcaggggaagtgcctctactccggcaagatcctggacatcaagcgcctgatggagcacgggtacgtcgagatcgaccacgccctccccttcagccggacctgggacgactccttcaacaacaaggtgctggtgctggccaacgagaaccagaacaagggcaacaagacgccctacgagtggttcaacgggaaggacaacagcgacagctggaagcgcttcctcgccctggtcaacaactccggcttcagcgcggtgaagaagcagcacatcctgatgaaggagatcgacgaggagggcttcaagcagcggaacctcaacgacacccgctacatcacccggttcctgtgcaactgggtggagaacaacatcccgctgctcgggaagggcgtcaagcgcgtgttcgcgccccaggggaagatcaccgccctgctgcgctccaactggggcatccggaaggtgcgcgaggacaacgaccggcaccacgccatcgacgccatcgtcgtggcctgcacgaccgtgagcatccagcagcgcatcaccaactacgtcaagaactccgagatcaaccggaagatcaagcgccagaactacctcaagttccccgagccctggaagttcttccgggaggacatcagcatccgcgtgttctccaacaacccgatcgaggagctgaagcagcagctgagcgaccggcccgaggccaaccaccagttcgtgacgcccctcttcgtctcccgcgcccccgtgcggaagatgaccgggcagggccacgaggacaccatccgcagcgccaagcggatctccgagggcatcagcgtgctgcgcgtcccgctgaccaagctcaacgacaagtccctggagctgatggtgaaccgggagcgcgagaaggagctctacgacgccctgaagcagcggctgctcgagttcaagaacgaccccgagaaggcgttcgccgagcccttctacaagaagggcgggcagcaggtcaagaccgtgcgcatcgagcgggtgcagaagaacggggtgctggtcaacaacaacacgggcatcgccgacaacggcaacatcgtgcgcgtggacgtcttcctgaagaagaagaagtacttcctcgtgcccatctacagctggcaggtcgccaaggggatcctgccgaacaaggccatcgtggcgcacaagaacgagtgcgactgggccgacatggacggctccgcccagttcctgttcagcctctacaccaacgacctgatcgaggtggtgctgaaggactccaccatcctcgggtacttcagcagcatcgaccgggccaccgcggccctgatcatcaaggagcccgacatggagaagtccaagggcaaggaggggatccaccgcgtcggcgtgaagacggcccgcagcttcatcaagtacaacgtggacgtcctgggcaagaacatctcccggtgccgcaaggccaagcggctccccgtgcgctga

SEQ ID NO: 1452 - RNA, 3111 nt, synthetic construct
  misc_feature 1..3111: note = Cas9 variant
  source 1..3111: mol_type = other RNA
atgcgcatcttcggcttcgacatcgggatcaccagcatcggctgggcctacgtggagtccaacgagctgaaggactgcggggtccggatcttcaccaaggccgagaaccccaagaacggcaagagcctcgcgctgccgcgccgggaggcccgcggggcccggcgccggctggcccgccggaaggcccgcctcaacgcgatcaagcggctgctgtgcaaggagttcggcctcaacgtgtccgactacttcgccaacgacggcgagctgcccaaggcctacgagacgaccaaggacaccaagagcccctacgagctgcgctccctcgccctggagcagaagctggagcccaaggagctcgcgcgggtgatcctgcacatcgccaagcaccgcgggtacggcaacaagcacgccaagaccgggagcgacaaggactccggcaaggtcctgagcgccatcaaggtgaacgagacggccatgaaggacaagtaccagtccgtgggggagtacctctacaaggagttctaccagaagctgcggctggagagcgagaagaagggcaacaacatcaccaaggagttcaagaacgtccgcaacaagggcgagaactacgagcactgcgtggcgcaggagcaggtccgggccgagctcgagctgatcttcgccaagcagaaggacttcggggccaccttctccgagaacttcgagagccagatcatcgagaccgccttctaccagcgcgacctgaagtccttcgaggacaaggtgggcaagtgcgtgttctacgagaacgagaaccgggcgccgaaggacagcctctccgccatggagttcgtggccctgacgcgcatcatcaacaccctgaagaacctcgaggagaagtccaagaacctggggatcggcgaggtctacggcaaggacaagatccaggagatcctgaagatcgtgctcgacaagggggagatgagctacaagaagctgcgggagatcctgcacctcgacgagcacatcctgttcgccaaggacagcaagctggactacacccagggcgtgcaggaggccgagaaggcgaagttcatcgagctcaagaacctgaaggccttcaagaaggccatgggcggggacttctccaacttcgcccgcgaggagctggacaagatcgccaccgacatcacgctcgtcaagagcaaggagaacctggcgaagaagctgcagaactacagcgccctctccaaggagcaggtcgaggccctgagcaacctgtccttcgccaagcacatcgacctcagcctgaaggcgctggagcagatcctccccttcatgcgcggggacaagaccggcaagtgcctgcggtacgacgaggccgtgaagaaggccgagctgcaggagcaccgcaagcacaagcagaagggcgagttcctcatccccctgaaggactacgagccctacctggccaacccggtggtggcccgggcgctgtccgagtaccgcaaggtgctcaacgccctgctgcggaagtacgggaaggtccacaagatccacctcgagttcacccgcgaggccaagctgagcgccaaggagcggcagaagtacgagaaggagcagaaggagcacttcgaggccaaccagcgcgcgatccagcagtgcgagatcctgggcctccccatcaacgggaccaacatcctgaagatgaagctgtggctcgagcagggcgagtgctgcgcctactccggggagaagatcacgcgggagcacctcctggacagcaacgccctccaggtggaccacatctacccctactcccgcagcttcgacgactcctacatgaacaaggtgctggtcttcgccaaggagaaccaggacaagggcaacaagacccccttcgaggccttcggcggggacaaggagaagtgggaccggatcctgagcctgtccgcgaagctgccgaagcagaagcagcgccggatcagcaacaccaacttcaaggacaaggagggcgggttcctggcccgcaacctcaacgacaccggctacatcgccaagctggcctcccagtggacgaaggactgcctggagttcgaggacctccgggagaacgaggtgaccatcgcgggggagaagggcagctccgtccacatcgaggtggtgagcggccagctgacctccatgctgcgccactactgggggctcggcaacaaggaccggaacaaccacctccaccacgccgtcgacgccgtgatcctggcctacaccaacaacgccatgatcaaggcgttcgccaacttccgcaagaaccaggaggagaacaagaagaagttctacgccaagcagatcgccgagagcgagtacaaggccaagaaggcgttcttcgagccctgcaagaacttccggcagcgcgtggaggagaagatcaaggagatcttcgtcagcaagccgccccgcaagcgggtgcgcggggccctgcaccaggagacgttctaccccttcgagaagctgtgcaacgacaaggagtactccgagaagctgaagatggactacggcggcgagaaggggatgcagaaggccatcgccctcggcaagatccggcagatcgggaccaagatcgtgagcaacggcgccatggtccgcgtggacatcttcaaggacaagaaggggaagttctacgcggtgcccatctacaccatggacttcgccctgggcatcctgcccaacaaggccgtcgccatcggcaaggacaaggacggggtgatcaaggactggatcgagatggactccaactacgacttctgcttcagcctcttcaaggacgacctgatcctggtgcagaagaaggagatggagcgggcggagctctgctacttcgtctccttcggcagcaccaacgcccagatcaacgtggagaagcacaacaacaagttcgaggggctgtccgagaacgagaagatcctgtacagcaacgccacgcagaaggaggtggccggcaagtccatcgggatccagaacctcaagaccttcgagaagtaccaggtcagccccctgggcgaggtgcagaaggccgagttcgagccgcaccaggagatcaagctgaagtccagccccaagcgcaaggactga

SEQ ID NO: 1453 - RNA, 3111 nt, synthetic construct
  misc_feature 1..3111: note = Cas9 variant
  source 1..3111: mol_type = other RNA
atgctgcacaagatgcactaccgcctcgccctggacctgggcagcacctccctcgggtgggccatgatccggctggacgcggacaaccagccctgcgccgtgatcaaggccggcgtccgcatcttcagcaacgggcggaacccgaaggacggctccagcctggccgtgacccgccgggaggcccgcgcgatgcggcgccggcgcgaccggctcctgaagcgcaaggcccggatgatgcgcacgctgatcgagtacgggttcttccccgccgaggccgcgcagcggaaggccctcgagaccatcaaccccttcgccctgcgcgccaagggcctggacgaggccctcacccccgcggagttcggccgggccctgttccacatcaaccagcgccgggggttcaagtccaaccgcaagaccgacaagaaggacaacgacagcggcgccctgaagacggccatcgggaaggtgcgggccaccatcgaggcggagggctgccgcaccgtcggggagtggctccacaagcgcgacgtggccggcctgaccgtgcgggcccgctaccaccaggacaaggtcatcaaggaggacggcaagacgaagatcgacaagtactacgacctgtacatcgaccgggccatgatcgagcaggagttcgacgagctctggaagaagcaggccgagctgaacccggcgctgttcaccgaggccgcccgcgccgacctcaaggacgtgctgctgcaccagcggcccctcaagcccgtgaagtccgggcgctgcaccttcatgcccgacgaggagcgggccccgctggcgctgcccagcacccagcgcttccggatgtaccaggaggtcaacaacctccgcatcctgcgggacggcctgaaggaggagcccctcacgctgaagcagcgcgacgacctgatcgccgccctcgagaagaactccaagcacagcttcacccagatcaagaccctgctgggggtgggcggcgccgtgcagttcaacttcgaggacctcaagcggcaggagctgaaggggaacaccacgtccgcgatcctgagcaacgacaagcacttcggcaaggcctggttcaccttcgacgaggccaagcaggacgccatcgtcctccagctggtgaaggaggagaacgaggccaagctggtgcgctggctccaggacgagaccgggatcgacgagaagcgggcggaggccatcgccaacgtcggcctgcccgaggggtacggctccctgtgcgccaaggccctcgcgcgcatcctgccggagctgcggcgcgacgtgatgacctacgacaaggccgtgcaggccgccggcttcgagcaccacagccggctcgggtccaacacggagatccccggcctgaccttcaagatcgagagcatcgaccaggactccggggaggtcaagcagttccacatccacaaggtgctgccctactacggcgagtacctgcagcgccacgtggggttcggcagcggcgagcccgaggacccggccgagaagcgctacgggaagatcgcgaaccccaccgtccacatcggcctcaaccagatccggctggtggtgaacgccctgctcaagcgctacgggcacccctccgaggtcatcgtggagctggcccgggacctgaagcagagcaaggaccagcgcgacgaggagagcaagcggcaggccgagaaccagaagcgcaacaagcggctccgcgacgcgatcgccggcaccctgaagatctccgaggagcgggtccgccgggacgacatccagaagatgatcctgtgggaggagctcagcttcgaccccgccgaccgccggtgcccgtactccggggcccagatcagcgccacgatgctgctgtccgacgaggtggaggtggagcacatcctccccttcagccagaccctggacgactccctgaacaacaagaccgtcgcgctccgccaggccaaccggatcaagggcaaccgcaccccctgggacgccttcggcgcccaggccgtggcggggttcgactacgagagcatcctggtgcgggccgagggcatgcccaaggccaagcgctaccggttcgccgagaacgggtaccagcgctggctgaaggacgacgcctccttcctcgcgcgggccctgaacgacacgcgccacatgagcaaggtcgccttcgagtacctgaagctcatctgcccgaacacccgcgtgatccccggccggatgaccgccatgctgcgcgcgaagttcggcctgaacgacgtgctcgggctgaacggcgagaagaaccggaacgaccaccgccaccacgccgtcgacgcctgcgtgatcgccgtgaccgaccaggggctgctccagcggttcgccaaggcgtccgccagcgcccgcgagcagcagctgaaccggctggtcgagaacatgcccctcccctggggctcctaccgcgagcacgtgcagcgggccatcaacgccatctggatcagccacaagccggaccactcccacgagggggcgatgcacaacgacacggcctacggcctgcgcggcgacgggaaggtgagcttccacaagatggtcgagggcgtgcggacccactccgaggacaacctgaaggtgatcgagatcagcaacgccaaggccaccgaccgccacgggctcctgcccaacggcgagccccggccgtacaaggggtacaagggcgactccaactactgcatcgagatcgtccgcaacgagaagggcaagtgggagggggaggtgatcagcaccttcgaggcctaccagctggtgcgggagcacggcatcgcgcgcctccggcacagcacgctgtccgtcagcgggaagctgctcgtgatgcgcctgatgatcgacgacgtggtccggctgatcatcgacgagcagacccgcaccatgcgcatcgccaccctctccggcaacgggcagatcttcatggccgacaccagcgaggccaacgtggacgcccggaaccgctccaaggaggagacgttcgcgtacgtgagcaagatggccggctccctgcagaaggccaacgcccggcgcatcaacatcagccccatcggcgagctgcgggaccccgggttcaaggagtga

SEQ ID NO: 1454 - RNA, 3114 nt, synthetic construct
  misc_feature 1..3114: note = Cas9 variant
  source 1..3114: mol_type = other RNA
atggagcgcatcttcggcttcgacatcgggaccaccagcatcggcttctccgtgatcgactacagctccacgcagagcgccgggaacatccagcggctgggcgtccgcatcttccccgaggcccgggacccggacgggacgcccctcaaccagcagcgccggcagaagcgcatgatgcggcgccagctgcggcgccggcgcatccggcgcaaggcgctgaacgagaccctccacgaggccggcttcctgcccgcctacggctccgccgactggcccgtggtgatggccgacgagccgtacgagctgcggcgccgggggctcgaggagggcctgagcgcgtacgagttcgggcgcgccatctaccacctggcccagcaccggcacttcaagggccgcgagctcgaggagtccgacacccccgaccccgacgtcgacgacgagaaggaggccgcgaacgagcgggccgccaccctgaaggccctgaagaacgagcagaccaccctcggggcctggctggcgcgccggcccccgagcgaccggaagcgcggcatccacgcccaccggaacgtggtggccgaggagttcgagcgcctgtgggaggtccagtccaagttccaccccgccctcaagagcgaggagatgcgggcccgcatctccgacaccatcttcgcgcagcggcccgtgttctggcgcaagaacacgctgggcgagtgccggttcatgcccggggagccgctgtgccccaagggcagctggctctcccagcagcgccggatgctggagaagctgaacaacctcgccatcgccgggggcaacgcccgccccctggacgccgaggagcgggacgcgatcctgagcaagctccagcagcaggcctccatgagctggcccggcgtgcgctccgccctgaaggccctgtacaagcagcgcggggagccgggcgccgagaagtccctcaagttcaacctggagctcgggggcgagagcaagctgctggggaacgcgctggaggccaagctcgccgacatgttcggccccgactggcccgcccacccccgcaagcaggagatccggcacgcggtccacgagcgcctgtgggccgccgactacggcgagaccccggacaagaagcgggtgatcatcctgagcgagaaggaccgcaaggcccaccgcgaggccgcggccaacagcttcgtggccgacttcgggatcaccggcgagcaggccgcccagctccaggcgctgaagctgcccaccgggtgggagccctactccatccccgccctcaacctgttcctggccgagctcgagaagggcgagcggttcggggccctggtcaacggcccggactgggagggctggcgccggacgaacttcccccaccgcaaccagcccaccggggagatcctggacaagctccccagcccggcctccaaggaggagcgggagcgcatcagccagctgcggaaccccaccgtggtgcgcacccagaacgagctgcggaaggtcgtgaacaacctcatcggcctgtacgggaagcccgaccgcatccggatcgaggtgggccgcgacgtcgggaagtccaagcgggagcgcgaggagatccagagcggcatccggcgcaacgagaagcagcggaagaaggcgacggaggacctgatcaagaacggcatcgccaacccgtcccgcgacgacgtggagaagtggatcctgtggaaggaggggcaggagcggtgcccctacaccggcgaccagatcgggttcaacgccctcttccgcgagggccggtacgaggtggagcacatctggccccgcagccgctccttcgacaacagcccccggaacaagaccctgtgccgcaaggacgtcaacatcgagaagggcaaccggatgccgttcgaggccttcgggcacgacgaggaccgctggtccgcgatccagatccggctgcagggcatggtgagcgccaagggcgggaccgggatgtcccccggcaaggtgaagcgcttcctcgccaagacgatgcccgaggacttcgccgcccggcagctgaacgacacccgctacgcggccaagcagatcctggcccagctcaagcggctgtggcccgacatgggcccggaggcccccgtcaaggtggaggccgtcaccggccaggtgaccgcgcagctgcgcaagctctggacgctgaacaacatcctggccgacgacggggagaagacccgggccgaccaccgccaccacgccatcgacgccctcaccgtggcgtgcacccaccccgggatgacgaacaagctgagccggtactggcagctgcgcgacgacccccgggccgagaagccggccctcaccccgccctgggacaccatccgcgccgacgcggagaaggccgtctccgagatcgtggtgagccaccgggtccgcaagaaggtgtccggccccctgcacaaggagaccacgtacggggacaccggcaccgacatcaagaccaagagcggcacgtaccggcagttcgtgacccgcaagaagatcgagtccctgagcaagggggagctcgacgagatccgcgacccccggatcaaggagatcgtcgccgcccacgtggccggccgcgggggcgaccccaagaaggcgttcccgccctacccctgcgtgagccccgggggccccgagatccggaaggtccgcctgacctccaagcagcagctgaacctcatggcccagaccggcaacgggtacgccgacctgggcagcaaccaccacatcgccatctaccggctgcccgacgggaaggccgacttcgagatcgtgtccctcttcgacgcgagccgccggctggcccagcgcaacccgatcgtgcagcggacccgcgccgacggcgcctccttcgtcatgagcctggccgcgggggaggccatcatgatccccgagggctccaagaagggcatctggatcgtgcagggggtgtgggccagcggccaggtcgtgctcgagcgggacacggacgccgaccactccaccaccacccgccccatgccgaaccccatcctgaaggacgacgccaagaaggtgagcatcgaccccatcgggcgggtccgcccctccaacgactga

SEQ ID NO: 1455 - RNA, 3117 nt, synthetic construct
  misc_feature 1..3117: note = Cas9 variant
  source 1..3117: mol_type = other RNA
atggccaagcaggtccgctaccggctgagcctcgacctgggctccaccagcctggggtgggccatcttccgcctcgacgcggacgcccaccccaccgccatcatcaaggccggcgtgcggatcttctccgacgggcgcaacgccaaggacggcagctccctggcggtgacgcggcgcgccgcccggagcatgcgccggcgccgggaccgcctgctccggcgcaagacccggatgctggacgccctgctcgagtacgggttcttcccgcaggacgcggcccagcgcaaggccctggagcggctgaacccctacgccctccgcgccgagggcctggcgcggcccctgacccccggcgagttcgcccgcgccatcttccacctcaaccagcggcgcgggttcaagtccaaccgcaagaccgacaagaacgacaacgacagcggcgccctgaagacggccacctcccagctgcggcaggacatccaggcgagcgggtgccgcaccgtgggcgagtggctctggacccagcggctgcagaagaagccggagggggtcccccaccagggcgtgcgcgcccggtaccgcgagacgccccacatcaactccgagggcaagaagcggatcgagaagaagtacgacctgtacatcgaccgcagcatgatcgaggccgagttcgacgccctctggtccgcccaggcgaccttcaaccccgtggtcttccacgccaccgcccacgagaagctgaaggacatcctgctctaccagcggccgctgcgccccgtgaagcccgggcggtgcaccctgctccccgaggaggagcgcgccccgctggccctgcccagcacgcagcggttccgcatctaccaggagctcaacaacctgcggctgctcgtggaccagctgaacgagcagcccctgaccctcgcgcagcgcgacaccatcgccaccctgatggagggccgggccaagatctccttcgaccagatccgcaaggccctgaagctcgggagcatgacgaagttcaacctggaggacgacaagcggaacgagctgaagggcaacgcgaccggctcccagctcgccaagaaggagttcttcgggcccgcctggcaccagttcgacgaggccctgcaggacgacatcgtctggcacctcctgagcgaggagaacgagtccgccctgatcagctggctgcaggaccgcaccggcatcgacgcggccaccgcccaggccgtgagcaacgcctccctcccggaggggtacggcagcctgtcccgcaaggcgctggaggtgatcctgccccggctccgcagcgaggtcatcacgtacgacaaggccgtgcaggccgccgggttctcccaccacagccagctgggcttcgagtacgaccccgacgacgtggaggactggatcgaccacgccaccggcgaggtcaagcccatcttcaagcggctgccgtactacgggaaggcgctccagcgccacgtggccttcggctccgggaagcccgaggacagccaggagaagcggtacggcaagatcgccaaccccaccgtgcacatcgggctgaaccaggtccgcgtggtggccaacgcgctgatcgcccggtacggccgccccaccgagatcatcatcgagctcgcccgggacctgaagcagtcccgcgagcagcggcagcaggaccagcgccggcaggccgacaaccagaagcgcaacgcccggatccgcaacagcatcgcgcaggccctgggcatcgccgaggcccgggtccgccgggaggacatccagaagtggatcctctgggaggagctggacccgggggacgccatgcaccgctgctgcccctactccggcgtgcccatcagcgcgtccatgctgctcagcgagcaggtcgagatcgagcacatcctgcccttctccatgacgctggacgacagcctcaacaaccggaccgtgtccctgcgccaggccaaccgcatcaagcggaaccgcagcccgtgggacgcccgggaggacttcgaggcccaggggtggcactacgacggcatcctgcagcgcgccgggctcatgcccgtgcagaagcggtaccgcttcgcggccgacggctaccagcggtggctgcgcgacgaccaggacttcctggcccgggccctcaacgacacccgctacctgtcccggatcgcggccgagtacctgcgcctcgtctgcccccagggcacccgggtgatcccggggcagctgacggccctgctccgccggcgcttcggcctgaacgacatcctggggctcgagggcgagaagaaccggaacgaccaccgccaccacgccgtggacgcctgcgtcatcggcatcaccgaccacgggctgatgcagcggttcgcgcgcgccagcgcccaggcccgcgagcagggcctgacccggctcgccgaggagatgcccctgccctggcccacctaccgcgaccacgtggaccgggcggtgagcctgatctgggtctcccacaagccggaccacgggcacgagggcgccatgatggaggagacggcctacgggctcatgaaggacggcaccatccgccagcggcacaaggccgacggcaccaaggggcgcgaggtggccaacgtgatccggatcgcggagcccgcccagcccacccgccacggcgtcgacgaccaggggcggcccctgccgtacaagggctacatcgggggcagcaactactgcatcgagatcacgcgcggcgcccaggggaagtgggagggcaccgtgatctccaccagcgacgcctacgggatcgtgcgggcccgcggcatcgcggggctgcggaacacctcccagggccagaacggccaccccctcgtcatgcgcctggtgatcggggacagcctgcggctccgcatcaacgacgccctgcagaccatgcgggtgacgaagatctccggcaacgggcaggtcttcatggccggcgtgcacgaggccaacgtggacgcgcgcaaccgggacaagagccaggccttcgccctggtctccaagatggccgggagcctccaggccgcgcaggcccgccaggccaccatctcccccatcggcgagatccgggaccccggcttcccggggtga

SEQ ID NO: 1456 - RNA, 3120 nt, synthetic construct
  misc_feature 1..3120: note = Cas9 variant
  source 1..3120: mol_type = other RNA
atgaagaagcgcatcctgggcctcgacatcgggatcgccagcgtgggctgggccctgatcgagttcgacgacgagttccaggacaacaagaagaaggggaccatcatcaagtccggcgtccggatcttcacccgcgcggagacgcccaaggagcgggagccgctggccaagccccgccgggaggcccgcagccagcggcgccggatctcctgccgcgtggagcggctcaacttcgtgcgcgagctgttcgtcaagaacgggctggtggccaaggagagcgtgaacaagaacaaccccaacaacatctacatcaccctcaaccagatcaagaccccctggcagctgcggatggaggccctggaccgcaagctcaccaacgaggagttcgcggtcgtgctgacgcacctggccaagcaccggggctacaagtccctccgcaagaccgacagcaaggacaacaagaccggcgagatgctgaaggccatcaaccagaacaaggagcggctggacaactccgactaccgcaccctcggggagatgttctgcaagcacgagagctacaaggagcacaagcggaacaaggacggcgagtacatcaactccgtgacgcgcgagctgatcgaggaggaggccgagaagatcttcgcgaagcagcggaaggaggggaacaacttcgccgacgtcgacatcgagcgcgagtacctgaagatcgccttcagccagaagccgaccggctccatcaacaagatggtggggttctgcaccttcgagaacggcgagaagcgcgcgccccgggacagctactccgccgagctgttcaaggtgctcaacaccatcaacaacacgaccatcaccgacatgaagaccggcgagacgcgcaacttcaccggggccgagatcaagaagatcatcgagatcatcaaggacaccaagggcatcacctacgtcaagatcaagaaggagctgaagctcgggagctcccagttcagcggcgtggactaccgggagaacgccaagtccaagggcgagggggagatcttcgtgagcatgaagacgtaccacgagatcaagtccaagatcgagaagctgagcaaggagaagtggaacaagctgaaggagaacaccgagctcctggacagcatcgtcaacatcatcgccaacttcaaggacgacgagtccatcaagaaggagttccagaagctgaagatcgacgaggacatcatcgacgtgctcctgaacttcgagttcaagaagttcatcaacctgagcttcaaggccctccgcaagatcatccccttccagttccagggccagaagtacatcaccgcctccatgagcgtggggtactccctgaagcaggagggcatcaagaacaagttcctgcgggtccccagccaggaggagaacgtgaacgtgccggtcgtggcgcgcgccttcgcccagacccggaaggtgatcaacgccgtcatccgcgagtacgggcagttcgaccagatcaacatcgagctcgccacggacctgaagaactccaagttcgaccggagcaagatcgagaagggccagaaggagttccagtcccagaaggacaaggtgttccaggaggtccaggacctgaccggcgagatcatccccagctccagcctcctgctgaagtaccgcctctggcgggagcaggacgagcgctgcatctactccgggcggaagatcagccgcaaggacctgctggacaccggcttcctcgacatcgaccacatcatcccctactccaagagcatggacgacgggttcaacaacaaggtgctgtgcctggcggaggagaaccggaacaagaagaacgacatccccttcaactactaccagcgcatcggccgggactggaacttcctcatctccatcatcgccagcatgaagaacatgaagtacgtgaagaagaagcgcctgctgaagcaggagctctccgacatcgagatcgagagcttcatcgagcggaacatcaacgacacccgctacgccacgcgctacatcaagaacttcctggagaacaacctggagttcaaggagaacgagttcatcaaggccaaggtccaggcccggcacgggggcctgaccagcgtgctccgctacaactggggcatctccaagaaccgggaggagagctacctgcaccacgcgaaggacgccatcaccgtggcctgctccacccaggggatggtccagtacatcagcaacatctcccagaagtacgagaacggcaagtacaagatgaagcagatcaaggagcgcacggagaaccggatcccgaagccctgggacagcttcaaggacgacgtggagcgctccatcaacgacatcttcgtgagcttcgcgccccggcacaaggtcaccgggtccgcccacaaggagaccatctacagcaagaagcacctggagaagggctacgtgaccatcaagaagtccctcgacaagatcaagctgagcgacctgaagaacatcccctgcgacgagaactgcgacatcatccgcgtgctcaaggagcggctggagaagttcaacgacgactccctgaaggccttcgccgacccggtccacatgcccacgaagtgcagcaacaagaaggggcccatcatccgctccgtgaagatcaaggagaacaacaagaccggcatcgaggtgcggaagggcctcgtcgagcgcggggacatggtgcgggtggacgtcttcatcaaggacaagaagtactacctggtgcccatctacgtgagcgacttcaagaacaaggacctgccgaacaaggccatcgtctccagcaagagcgagaacgagtggatcatgatcgacaagacctactccttcaagttcagcctcttcaaggacgacctgatcaagatcaagaacaagaagggcgagatcttcgggtacctgggcggcgtgcaccgcctcaccgggggcatcaacatcaagtcctgctacaagcccaaggagaaggacgggaacatcggcagcaagtgcctgctggacttccggaagttccaggtggggatcctcggcgactacaacgaggtcaagcacgagaagcgcatgcccgcctacatcaacaccaagaaggacaaggagcactga

SEQ ID NO: 1457 - RNA, 3123 nt, synthetic construct
  misc_feature 1..3123: note = Cas9 variant
  source 1..3123: mol_type = other RNA
atggaccgccgggacgcccgcgccatgcggcgccggcgcgaccggttccagcagcgccagcgggcgctgctcaagtacctggtggccgacggcctgttccccgaggacgagggggagcgcaaggccctcgccgccctggacccgtacgcgctgcgggcccgcgccctcgacgaggccctgagcctgcacgagctcggccgggcgctgttccacctgaaccagcgccgggggttcaagtccaaccgcaaggccgaccggaaggccgacgacgacgccggcaagatcgccatcggggtcgaccgcgcgcgggaggccatggccgagaacggcgcccgcacctacggcgagtggctccaccggcgccgcgccagcgcgaccgacgccaacgccatcccgcccgtgcggacgcgcctgcggcccgagtccggggaggacgccaagggcgacgggtacgacttctaccccggccgcgacctgctcgaggaggagttcgccgcgatctgggaggcccaggccgcccaccaccccgacgtgctgaccgacgacgtctacgagcggctgttcgagatcgtgttctaccagcgccccctcaaggcgccccagatcgggatgtgcaccctgatcgccggcgaccggcgcctgccgaaggcccaccccctcttccagcggcgccggctgctggaggagctcaacgccctgatgatcgtgcgccccggcgaggtcgcccagcggctgacccgcgaggagcgggacaccctcttcctgaagctgaaggaccgcaacaaggtgagcttcgagtccctccggaagacgctgaagctggaccccgacgcgcgcttcaacaaggagagcgagaaccggaccgagctcaagggggacgaggtggccgccgccatgggctccaagacccgcttcgggaaccgctgggtccacctgagcatcgaggagcagtgggccgtgatcgagcggctgggcgacgtggagtccgacgcggaggacgccgccttccgcgcctggctcgccgagcggtacgagctgacgccggagcagacccgcgcggtcaccaacgcgcccctgccccagggctacgggcggttcggcgagaccgccacgcgcaagctcatcgacgccctgcgggacggggagaaggacggccgcgtgctggtgtacagcgaggccgtcaccgccgccgggctcggccaccactccgaccggcgcaccggcgaggtgttcgaggacgaggaggggcggccccagctgccgtactacggcgtggccctggagcgccacatcatgcccgggaccggcgaccccagcgactccgacgagatgcgggtcgggcgcctcacgaaccccaccgtgcacatcggcctgaaccagctgcggcgcatcgtgaaccggctcatccgcgcctacggcccgcccgcggagatcgccatcgagctggcccgggagctgaagctgaccgacgaggacaagaagcgcatcaacaaggagaacaacagcaaccggctcgacgccgagcgccgctccgagaagctgctggccatcgggaagcccgacaccggcgcgaaccgggccctcctgaagctgtgggaggagctcaaccccgccaacgtcctggaccgccggtgcatctacagcggggtgcagatctccatcgacatgctgttcagcgccgccgtggaggtcgaccacatcctcccgttcacggcgaccctggacgactccaacggcaacaagatcgtgtgcacccgcgaggccaaccgggagaagcgcaagcggagcccctacgaggcctgggggcacagcgcccgctgggaggagatcgccgcgcgggccgcccagctgccccgcaacaagcggtggcgcttcgagcccgacgccatggagaagttcaaggacgacggcggcttccaggcgcggcacctcatcgacacccagtacctggcccgcctgtcccgggagtacctcgccacgctgtacccggacaagggggagggcagcgggcacatctgggtctcccccggccgcctgaccgagatggtgcggcgcaagctcggcctgaacgacctgctccccgaccacaacttcgggggcggggccgaccaggccaagaaccggctggaccaccgccaccacgcgatcgacgccgtggtcgtggccatcgtggaccgcggcatgctgaaccggatcgcccgcgccagcgggcaggagggcgcggagggccgggagcgcatcatcatcccggagccctgggaggggttccgggacgacctccgcaccgccgtcaacgccatcaccgtgtcccaccggacggaccacggcaccgccagcaaggccgggctgcccaagggcaaggacgcgaccgccgggcgcctgcacaacgacaccgcctacggcttcacgggcgagtccgacgccaaggggaacagcatcgtggtccggcgcgtgcccctctccagcttcaagaagctggccgacatcgaccgggtgcgcgacccggagctgaaggcggccctctaccagcacctggacggcctggaggggaaggccttcgagaaggccatcggcgagttcgggtcccgggagtggcacccctacggcggcgtccgccgggtgcgcgtgaccgagcccctcagcgtcatccccatccgggaccgcaacgggcacatctacaagggctacaagggggactccaactaccggtacgacgtgtgggagctgccgggcgggaagtgggtgaacgaggtcgtgagcatgttcgacgcgcaccagcccggctggcagtccgccatccgcgccgccaaccccaccgcccggaaggtgctgagcctccaccgcgacgacgtcctggcgatcgagcgcaacggcgccgagcgggagctggtgcgcgtggtcaagttctccgagaagcagttcgccgtggcgcccccgaacgagggcggggccctcaaggcccgggacgccgacaagggggaccccttcaagtacagctacccctcccccaacaccctgaaggccctgcgcgcccgccaggtgcggatcgacgagctcggccgggtcctggacccgggcttccccgcccgcacgaagcagcggaagacccgcaagcccaactga

SEQ ID NO: 1458 - RNA, 3132 nt, synthetic construct
  misc_feature 1..3132: note = Cas9 variant
  source 1..3132: mol_type = other RNA
atgcagcgcgacaaccccctggtgtaccggctcgccctggacctgggcagcacctccctcgggtgggccgtcttccgcctggacgcggagggcagcccgctggccatcatcaaggccggggcccggatcttctccgacggccgcaaccccaaggacgggagctccctcgccgtgacccggcgcgcggcccgggccatgcgccggcgccgggaccgcctgctgaagcggaaggcccgcatgctcggcgcgctggagcggcacggcttcttcccccaggacgagagcgcccgcaaggtgctggagacgctcaaccccttcctgctgcgggcccaggggctcgaggtcgccctgaagccggaggagttcggccgcgccctgttccacctcaaccagcggcgcgggttccagtccaaccggaagaccgaccgcaaggacagcgactccggcgcgctgaagcaggccatcgggaccctgcgcgcccagatgcacgagagcggctgccggaccgtgggcgagtggttctggaaggtgcgcatggagcacaagcccgagggggtcaagggccagggggtgcgggcccgctaccgggagacgcccttcaccaccgacgagggcaagaagcgcatcgacaagcggtacgacctctacgtggaccgcgccatggtcgcgcaggagttcgacgccctgtgggccgcccaggccgcgttcaaccccgccctgttcaacgaggccgcccgggccgagctccgcgacatcctgctgcaccagcggaagctccgcccggtgcagcccggccggtgcaccctggtgcccgaggagccccgcgcgctgctcgccctgtccagcacgcagcggttccgcatctaccaggaggtcaaccacctccgggtgctgcacgacgagctgcgcgaggagaccctgaccctcgcccagcgggaccagatcgtggccctgctggagaagcaggcgaaggtcaccttcacggccatgcgcaaggccctcgggttctccgccctgttcaacctggaggacgccaagcgcgacggcctcaaggggaacgcgaccgccgccgccctgagcaagaaggacctgttcggcccgctctgggccgggttcggcaccgcgctgcaggacgagatcgtgacccagctgatgacggaggagtccgagccccggctcatcgcctggctgcaggagcacaccggcgtggacgaggcccgcgcccaggccatcgcgaacaccgggctgcccgagggctacgggagcctgggccggaccgccctcgcccgcatcgtccccgagctgcagcgggacgtgatcacgtacgacaaggccgtgcaggcggccgggttcgcccaccactccgacctgggcttcagcttcgagcacggcgccgacgaggtcgagcgcatcggggagcggaccatcgcctccaccggcgagatcaagccggtgttcgcgttcaagcagctcccctactacgggcgcgccctgcagcggcacgtggccttcgccaaggacaacccccgcaacgacgaggagcggtacggcaagatcgccaaccccaccgtccacatcgggctgaaccaggtgcgcgtcgtggtgaacgcgctcatgcggcgctacggccggccggccgaggtcgtgatcgagctggcccgcgacctgaagcagagccgggagcagaagctcgaggcccagcagcgccaggccgacaaccagaagcggaacgcgcgcatccggcgcagcatcgccgaggtgctgggcatctccgaggagcgcgtccggacgctggacatccagaagtggatcctctgggaggagctgagccacgacgccgccgaccgccggtgcccctactccggggtgcagatcagcgcgtccatgctgctcggcgagcgcgtggagatcgagcacatcctgcccttcagcatgaccctggacgactccctcaacaaccggaccgtcgccctgcgcgaggccaaccggatcaagcgcaaccgggccccctgggaggcccgcgcggacttcgaggcccaggggtggagctacgacggcatcctgcagcgggccgagcgcatgccgctccggaagcgctaccggttcgcccccgacggctacgagcgctggctgggggaggacaaggacttcctggcccgggcgctcaacgacacccgctacctgtcccgggtggccgccgagtacctgcgcctcgtgtgccccggcagcgccacgcgcgtcatccccgggcagatgaccgccctgctgcggggcaagttcgggctcaacgacgtgctgggcctggacggcgagaagaaccgcaacgaccaccggcaccacgcggtggacgcctgcgtcatcggggtgaccgaccagcgcatgatgcagcggttcgcccaggccaacgcccaggcgcgcgaggacggcctcacccggctggtggaggacatgccgctgccctggcccacgtaccgcgaccacgtcgagcgggccgtgcaccacatctgggtgtcccacaagccggaccacgggttcgagggcgccatgatggaggagaccagctacgggatcctccgcgacggctccatcaagcagcggcgcaaggccgacggcagcgcggggcgggagatctccaacctgatccgcatcgccgagcccggccagccccagcggcacggggtcgacgccgagggccgccccctgccgtacaaggggtacgtgggcggcagcaactactgcatcgagatcaccgtgaacgacaaggggaagtgggagggccaggtcatctccaccttcgacgcctaccggatcgtgcgcgagggcgggctccggcagctgcgccaccccacgcaggggcagaacggccgggccctggcgatgcgcctcgtgatcggcgacagcgtccgcctggaggccggggagggctccctgcagaccctccgggtggccaagatgagcgccgccggccaggtgttcatgagcgaggtcaaccaggcgaacgtggacgcccgcaaccggaacggggacctgccctacgtgtccaagatggccggcagcttccagaaggcccgcgcccggcaggtcaccatctcccccatcggggagctgcgcgacccgggcttcaaggggtga

SEQ ID NO: 1459 - RNA, 3135 nt, synthetic construct
  misc_feature 1..3135: note = Cas9 variant
  source 1..3135: mol_type = other RNA
atgaagtacaccctgggcctcgacctggggtacaacagcatcggctgggccatcctggagaacgacgagaacgggtcccccatcaagctgttcaacgccggcgtgcacatcttcgagccgagcatcgaggacatcgagatcgacgggaagggcaagaccaagaacgtcaagcgccgggaggcgcgcctgcggcgccggcagctgttccgcaagacgaagcggctcgagaagctgctgaacttcttcatccaggagggcttcttccagaaccagaaggtgctcatcaacgaccccttcgagcgcgccgagttcctgtaccagctggacaagaagtcccggaacccctacatcctccgccgggaggccctggacaaccgcctgagcctcgaggagatcgcccggatcttctaccacatcgcccagcaccgcgggttcaagtccaccaagcgggagctggcggagatgaacaaggacgagaagaagaagaaggaggacggcatcatccagagcgagatcaacaccctgaaggaggagatcaagaagaactcctgccgcaccctcggggagtacttcgccaagctgttcgagaacggcgagaagatccgggggcgccacacggaccggaagatgtacgaggaggagttccagaagatcttcaacaagcagaaggagttctaccccaacatcttcaccgacgagttcaagaagaagctgtacaagctcatcttccaccagcgcgagctcaagagccagaaggacaaggtgggcttctgctccctggagcggggcaagaagcgcgccccgctcgccctgctggtcagccagcgctaccggtacatgtgcaaggtgaacaacctcaacgtgatcgacaccgagaccggggagaaccgcgagctgacggtcgacgagaagaagaagctgtacgagaagctcgagaactccgagaagctgagcttcaaggagatcaagaagatcctgaacctctccgagaagcggtacatcttcaacctggagaagtccgagaagtacatcatcggcaacaagaccaacgtgaagatgaagaacatcatcaaggactgggacaacttcgacgaggacaagaagaacttcttcatcaacgaggcgcgcaccgtggtcaagatcgagaccctggagcggcgcgggaagaagctcggcctgagcgacgaggagagcaaggagttctccaaggtggtgttcgaggacggctacctgaacttcagcaagaaggccgtcgagaagctcctgccctacctgaaggaggggaagaaggagtacgaggccatcaagctcgcctaccccgagaactccgtgcagaacgacaacctgaaggagctggacttcctgcccccgatcaagagcaaggagctcaagaagtacttcgaggtgcggaaccccatcgtcgagaaggccctgacggagacccgctacctcgtgaacttcctgatcaagaagtacggcaagcccgagaccatcaagatcgagctggcgcgggagctgaagctcagcaacaagcagaaggagcgcaagcacaaggagaaccaggagaaccggaagaagcgcgaggaggtgatcgagaagctgaagaacgacctgaagatctccgagcccaccgagacgcagatccagaagtacctcctggccgaggagtgcgactgcaagtgcccgtacaccgggcggagcatctccatggacagcctgttcggcgagcaccccctcttcgacatcgagcacatcatccccttcgaccgctccctggacaacagcttcctgaacaagaccctctgctactccgaggagaaccggaaggtcaagcacaacaagaccccctacgaggcctactacgggacggagaagtgggaggccatcatcgagcgcgtgaagaagttcaagagcaacgtgcggaacgagaagctgcgccggttccagatgaccaaggaggacgtcgagaactacatccagaacttctccacccagaacctgaacgacaccaagtacgccagcaagctcgcgaagaagtacctgggcctgctctacggctccatcaacgaggacgggatcgacaagaaccgcaagcgccggatcttcgccagctccggcaaggtgacgagcaccctgcgctacgccctggggctcaacaccatcctgaacgacgagaacatcaagacccgggaggaccaccgccaccacgccatcgacgccatcacgatcgcgctgaccgactccagcatgatcaagaagatctccgacgccagcaagcgggagaagaacatcaactccctcttcaaggacttccaggccccgtgggagaacttccgcaaggaggtggaggagatcatcgccaagatgaacatcagcatccggatcaacaagaaggtcagcggccagatccacgacgagaccttctacaagaagcccttcaaggaggaggagaagtcctacacccaccagcgcatcaacctggaggagctgacgatcaaggacgaggacaagaagaagcagagctccaagctcatcgacaacatcgtggacagcaagatccggaacatcatcatcaactccctgaacggggagaagcccaagatccgcttcaaggaccccaaggaccacccgtacatcatccagaagaacggcaagaagatccagatccacaaggtcaccatcaagaccaagctggagacctacaacgagatcggccccgagaaggccaagcggtacgtcaagagctccgacagccaccacatcgagatcttcgaggacctcaagacgaagaagtgggacgggtacgtggtgtccctgctggaggcgtacgagcgcaagaagaagaagctccccatcgtgaacaagaacctgggcgaggggaagaagttcctgttcagcctcgccaagggcgagatcatcgagctggacaccgagaacgggaagcgggagctgttcgtggtccgcatcatctccgccagcaacaaccagatcaagttcacccggatcaacgactcccgcaagatcaccgacatccccgccaccggcctcacggcgtgcccgagctccctgaagaagcggaactgcaagaaggtggtgatcaacatcctgggcgagaagcactacagcaacgactga

SEQ ID NO: 1460 - RNA, 3135 nt, synthetic construct
  misc_feature 1..3135: note = Cas9 variant
  source 1..3135: mol_type = other RNA
atggccgagaagaagttcaagtaccgcctgggcctcgacctggggaccaacagcatcggctggtgcatgctgcggctcaacaaggacaacgagcccgccgcggtgatcaagtccggggtccgcatcttccacgacggccggaacgagaagaccaaggagccgctggccgtggtgcgccggaacgcccgcagcatccggcgcaacctggaccggaagatctcccgccggaaccacctcctgaacacgctggtcaagtacttcctcctgcccagcaacgagatcgagcgcaaggccctggccgtgctcaacccctacgagctgcggtcccgcgcggtgaacgagcggctggagctgttcgagctcgggcgcctgctcatgcacctgagcaagcggcgcggcttcaagtccaaccggaaggtcgacaaggaggacagctccggcaagatcaagcccgccatcgagcgcctgaagaacaagatgcaggagaccaacaagaagaccgccggggagtacctctacagcctgatgcagaacggcaagccggtgcgggcccgcctggggcgcatcgacggctccaacgggtacgagatctacctcgaccgggcgctgatcgaggaggagtacaacctgatcatgaacgagcagaagaagcaccacaaggagctcaccgacgacatcatcaacgagatcttcaacatcatcttctaccagcgccccctgaagaagcagatcatcggcaagtgcagcctgacgggcgaggacaccaagctcaagaaggcccacgtgctggcccaggacttcatcctgctccagaaggtccaggacctgcgggtgttcgacgacaaccagctggagttccgccccctctccaacgacgagaaggacatcatcaagcgggagctgcgcaagaagaaggaggtgagctacgagaacatccggaagctgctcaagaagtactacgagaacgtcaagtacgggatgttctcccacgagaccctgtacaagaagctgcagggcaacaagaccaacgccctcatgagcgacaaggagatcatcggggactcctggtacagcctgtcccccgaggtgcagtacgacatcatcgaggagctgtacagcgacaaggacaacgacgagctcagcaagctgtactccgagaagttcaacctgaacgagagccagatcaacggcctcctgaacaaggccatctaccgcctggactccggctacatccggtacgggaagacggcggtgaccaacctgaacagcatcatggacaaggacaacctcaacctgcacgacgcccgcgaggaggccggctacgagaaggagaacaagcaggacgcctccgagtacctggagtactacgggaaggtcctcccggacagcgtggtggacccccagatcgagaaccccaagaacgacgaggagcggtacggcaagatcgccaaccccaccgtccacgcggccctgaaccagctgcgcaagctcgtgaacgagctgatcaagctgtacgggaagccggagcagatcgtgatcgagctcgcccgggacctgaagaactcccgcaaggccaaggacgtcatcaacaagaagatcgccgagaaccggaagctgaacgaggaggtggacaagaccctccaggagtacagcgagaagtacaacacgcacatcgtgaagaacaagctgaaccgcgacaaggtcaagctgtggcgggagctcggcaaggaccccctggagcgcaagtgcatctacaccggcgagcagatcaacatcgcgaagctgttctccgacgaggtgcagatcgagcacatcgtcccctacagcaagaccctcgacgactccttcaacaacaagaccctgagcatgaagcaggccaactactacaaggggaacaagacgccctacgaggccttcaaggactccaaggacggctacaactacgacgacatcatcgcccgggccaagctgctcaacaacgacaacaagttcaagcgcttcaccaaggacgcgatggacatctacaaccgcgacgggaaggacttcatcgcccggcagctgagcgacacccagtacctgtccacccgcgccctcatctacctgcagagcctgtacgagaaggcccaccactccagcatctggacgatcccgggccagctcaccgcgctgatccggaactacctggggctcaacaccctgatctccaacgacaagaacaagaaccgcaacgaccaccggcaccacgccgtggacgccttcgtggtcgccgtgaccagccgcagcctgctccagaagatctcctacgccgcgagcctgcaggaggacctggacaaccggaacgtgtccagctaccgcaacaagctcctggagaagatgcccgagcccttccccaactaccggaagtccctggagctcgccatcgacaacatcaagacgagccacaaggccgaccgctccatcagcggcaagctgcacgaggacaccgcctacggcatcgtcgagaacgacgacaagtacaacgtggtgacccggtggaccgtcgacaagttcaaggagcagaagcacttcgagacgatccgcgacaacgagctgaaggagatcgcctgctccgacaaggagctgttcgcgaagatcgtggagacccggaagatcaagagcatccgcaagctcgccaaggagaacccggtgatcaagatcaaggacaagtccgggcgggactacaaggccttcgccggcgggaacaacatctgcgtcgagatctacgaggtggacggcgtgcgcaagagcgaggtcatccagctgttcgacgccgcgcagaaggggttcatgcccgagtggatgaagaagtaccccaacggcaagctcctgatgcggctgttcaagggcgacgtgatcgggttcatcgagaaccgcaagtacaactactacaccatcaagggcatctccatcgccgaccagaacctcaagctgctggccatcaacaaggccgaggggatcttcaagaagggcctcaacatcctgttcgacagcaacaacaagaactccctgaacgcgaagcagttcaacatcagcgtgaccggcatcgtcacgaagaagaagaccgccgacgtgaacttctggaagaaccggaagtga

SEQ ID NO: 1461 - RNA, 3135 nt, synthetic construct
  misc_feature 1..3135: note = Cas9 variant
  source 1..3135: mol_type = other RNA
atgctgcacaagatgcgctaccggctcgccctggacctgggcagcacctccctcgggtgggccatggtgcgcctgaacgcgaaccagcagccctgcgccgtcatcaaggccggcgtgcggatcttcagcaacgggcgcaacccgaaggacggctccagcctggccgtgacccggcgcgaggcccggtccatgcgccggcgccgggaccgcctcctgaagcggaaggcgcgcatgatgcggacgctgatcgagtacgggttcttccccgccaacgagacccagcgcaaggccctcgagaacctgaacccctacgccctgcgggcgaagggcctcgacgaggccctgacccccagcgagttcgcccgcgccctgttccacatcaaccagcggcgcggcttcaagtccaaccggaagaccgacaagaaggacagcgactccggggccctcaagacggcgatcaagcagctgcacagcgtcctggacccgcagggcaacgacgggaagccccgcaccgtgggcgagctcctgtacaagcgcttcaccgacctgtccaagctccccaaggaccggaccgtgcgcgcccggtaccgccaggacaagatcgtcaaggacgacgggaagacgaagatcgacaagtactacgacctgtacatcgaccgggccatgatcgagcaggagttcgacgccctgtggaagaagcagagcgagctcaaccccatcctgttcaccgagaacgcccgcgcggacctgaaggacgtgctcctgtaccagcggtccctgaagccggtgaagcccggccgctgcaccttcatgagcgaggaggagcgggcgcccctcgccctgccctccacccagcgcttccggatgtaccaggaggtcaacaacctgcgcatcctccgggagggcctgaaggaggagagcctgacgctccagcagcgcgacgacctgatcaacgccctggagaagaacaaccggcgcaccttcacccagatcaagaagctcctgggggtgggcgggtccgtgcagttcaacttcgaggacccgaagcgggaggagctgaagggcaacaccacgagcgccatcctcggcaagtccgagcacttcggggaggcctggttcgccttcaacgaggccaagcaggacgccatcgtcctgcagctgatcaaggaggagaacgaggccaagctcgtgcgctggctgcaggacgagaccggcatcgacgagaagcgggcggaggtgatcgccaacgccgggctgcccgagggctacgggagcctctgcatcgaggccctggcgcgcatcctgcccgagctgcgccgggacgtcgtgacctacgacaaggccgtgcaggccgccggcttcgagcaccacagcaagctcaaccgcaacgaggagatccccgacatcaccttcaagatcgagtccatcgaccggaacagcggcgagatcaagcagttccacctccacaaggagctgccgtactacggggagtacctgcagcgccacgtcggcttcgggtccggcaagcccgaggacagcatcgagaagcggtacgggaagatcgccaaccccacggtgcacatcggcctgaaccaggtgcgcgtcgtggtgaacgcgctgatcaagcggtacggccacccctccgagatcatcgtcgaggtggcccgcgacctcaagcagagcaaggaccggcgcgacgaggagaacaagcggcaggccgagaaccagaagcgcaacgagcggctgcgcaaggacatcgccgacatcctggggatctccgaggagcgggtccgccgggacgacatcgagaagatgatcctctgggaggagctgagcttcgacccggccgaccgccggtgcccctactccggcgtccaggtgagcaccgtgatgctgctctccgacgaggtggaggtggagcacatcctgcccttcagccagaccctggacgactccctcaacaacaagaccgtcgcgctgcgccaggccaaccggatcaaggggaaccgcacgccctgggaggccttcggcaccagcaacatctccgggttcgactacagcggcatcctgacccgcgccgagctcatgccgaaggccaagcggtaccgcttcgcggaggacggctaccagcggtggctgaaggacgacgccgggttcctggcccgcgccctcaacgacacccggcacctgtccaagatcgcgcgcgagtacatgagcctgatctgccccaacacgcgggtgatccccggccagatgaccgccatgctccgccggaacttcgggctgaacgacgtgctgggcctcaacggcgagaagaaccgcaacgaccaccggcaccacgccgtcgacgcctgcgtgatcgccgtgaccgaccaggggctgctgcagcgcttcgcggccgcctccgccagcgcccgggagcgccagctcaaccggctggtcgagaacatgcccctgccgtgggagagctaccgcgagcacgtgcggcgcgcgatcgacggcatctgggtgtcccaccggcccgaccacagccacgagggggccatgcacaacgacaccgcctacggcctccgcgggaacggccgcgtctccttccacaagatggtggagggcaagcgggagtacatcgaggacaacctgaaggtgatcgagatcacggacaccaaggccatcgaccgccacgggctgctccccaccggcaagccgcggccctacaaggggtacaagggcgacagcaactactgcatcgagatcgtccgcaacgagaaggggcggtgggagggcgagatcatctccaccttcgacgcctaccagctggtgcgcaagtacggcatcgtgcagctgcggtaccccgtcctcagcgtgtccgggaagcccctggtgatgcgcctgatccggaacgacttcgtccgcctcgagcacgagggcatcacgcggaccctgcgcgtgtgcaagatgcgggaggacgggcaggtcgcgctggccgacgtgaccgaggccaacgtggacgcccgcacccggaccaaggagatctgctacgtgttcaagacgggcgggagcctccagaaggcgaaggcccgccggatcaccatctccccgatcggcgagctgcgcgaccccggcttcaaggagtga

SEQ ID NO: 1462 - RNA, 3138 nt, synthetic construct
  misc_feature 1..3138: note = Cas9 variant
  source 1..3138: mol_type = other RNA
atgcagaaggagaagcccctggcctaccgcctcgccctggacctgggcagcacctccctcgggtgggcggtgctgcggctgagcgccccgggcgagccctccgccgtcatccgcgccgggagccggatcttctccgacggccgcaaccccaaggacgggagctccctcgccgtgacccggcgcgcggcccgggccatgcgccggcgccgggaccgcctgctgaagcggaaggcccgcatgctcgcggccctggagcggcacggcttcttcccccaggacgaggccgcccgcaaggccctggagaagctcaacccgtacggcctgcgggcgcgcgggctggagagcgccctcaagcccgaggagttcggccgggccctgttccacctgaaccagcgccgggggttccagtccaaccgcaagacggaccgcaaggacagcgactccggcgccctcaagcaggccatcgggaccctgcgggcgcagatgcacgagagcggctgccgcaccgtgggcgagtggttctggaaggtccggatggagcgcaagcccgagggggtgaagggccagggggtgcgggcccgctaccgggagacccccttcacgaccgacgagggcaagaagcgcatcgacaagcggtacgacctgtacgtcgaccgcgccatggtggcccaggagttcgacgccctctgggcggcccaggccaccttcgccccggccctgttcaacgaggcggcccgggccgagctgcgcgacatcctcctgcaccagcggaagctgcgccccgtgcagcccggccggtgcaccctcgtccccgaggagccgcgcgccctgctggcgctcccctccacgcagcggttccgcatctaccaggaggtgaaccacctccgggtgctgcacgacgagctgcgcgaggaggccctgaccctggcccagcgcgaccagatcgtcgccctcctggagcggcaggccaaggtgaccttcaccgcgatgcgcaaggccctggggttcagcgccctcttcaacctggaggacgccaagcgggacggcctgaaggggaacgccacgaccgcggccctcggcaagaaggacctgttcgggcccctgtgggccggcttcgacaccgccctccaggacgagatcgtgacccagctgatgacggaggagtccgagccccgcctgatcgcctggctccaggagcacaccggcgtcgacgaggcgcgggcccaggccatcgccaacgcggggctgccggagggctacgggagcctgggccgcaccgccctggcccggatcgtgcccgagctccagcgcgacgtgatcacctacgacaaggccgtccaggccgcggggttcgcccaccactccgacctgggcttcagcttcgagcacgacgccgacgaggtggagcggatcggcgagcgcacgatcgcctccaccggggagatcaagcccgtgttcgccttcaagcagctgccctactacggccgggcgctccagcgccacgtcgccttcgccaaggagaacccgcggaacgacgaggagcgctacgggaagatcgccaaccccaccgtgcacatcggcctgaaccaggtgcgggtcgtggtcaacgccctgatgtgccgctacgggcggcccaccgaggtggtgatcgagctcgcgcgcgacctgaagcagagccgggagcagaagctggaggcccagcagcgccaggccgacaaccagaagcggaacgcccgcatccgccggagcatcgcggaggtcctcggcatctccgaggagcgcgtgcggacgctggacatccagaagtggatcctgtgggaggagctcagccacgacgccgccgaccgccggtgcccctactccggcgtgcagatcagcgcctccatgctgctgggggagcgcgtcgagatcgagcacatcctcccgttcagcatgaccctggacgactccctgaacaaccggaccgtggccctccgcgaggcgaaccggatcaagcgcaaccggaccccctgggacgcccgcacggacttcgaggcccacggctggagctacgacgggatcctgcagcgggccgagcgcatgccccagcggaagcgccaccggttcgcccccgacggctacgagcgctggctgggcgaggacaaggacttcctcgcgcgggccctgaacgacacccgctacctgtcccgcgtggccgccgagtacctccggctggtctgcccggggagcgccacccgcgtgatccccggccagatgaccgcgctgctccgggggaagttcggcctgaacgacgtgctggggctcgacggcgagaagaaccgcaacgaccaccggcaccacgccgtcgacgcctgcgtgatcggcgtgacggaccagcgcatgatgcagcggttcgcccaggccaacgcgcaggcccgcgaggacgggctgacccggctggtcgaggacatgcccctcccgtggcccacctaccgcgcccacgtggagcgggccgtgcgccacatctgggtctcccacaagcccgaccacggcttcgagggggcgatgatggaggagaccagctacggcatcctgcgggacgggacgatcaagcagcgccggaaggccgacggctccgccggccgcgagatcagccggctgatccgcatcaccgagccctcccagccgcagcggcacggggtggacgccgagggccgccccctcccctacaaggggtacgtgggcgggagcaactactgcctggagatcaccgtcaacgacaagggcaagtgggagggccaggtgatctccaccttcgacgcctaccggatcgtgcgcgagggcgggctgcgccagctccggcacagcacccaggggcagaacggccaggcgctggccatgcgcctggtcatcggggactccgtgcggctcgaggtggacgagcaggagcgcgtcatgcggatcgtgaagatcaacggcaacaacggccaggtgttcatggcccccgtccacgaggccaacgtggacgcccgcaacagcgacaagaacgaggcgttcgcctacacgagcaagatcgccgggtccttccagaagaccaaggcccgccaggtgaccatcagcccgatcggcgagctgcgggaccccgggttcaagggctga

SEQ ID NO: 1463 - RNA, 3138 nt, synthetic construct
  misc_feature 1..3138: note = Cas9 variant
  source 1..3138: mol_type = other RNA
atgaagccccgcaacctgaactacatcctcggcctggacctggggatcgccagcgtgggctggtccgtcgtggagatcgacgagaacgagtacccgatccggctcatcgacgtgggggtccgcaccttcgagcgggccgaggtgcccaagaccggcgagagcctggcgctggcccgccggctcgcccgctccacgcggcgcctgatccggcgccgggccttccgcctgctcaaggccaagcggctgctgaagcaccaccagatcgtgaacgcggaggagctcacccagctgcccaaccagtgctgggagctgcgcgtcaaggggctcgacagcctgctgtccaacaccgagtgggccgccgtgctcctgcacctcctcaagcaccggggctacctgagccagcgcaagaacgaggcccagaacgcggacaaggagctgggcaagctccgggaggggatggacaacaactccaagctgctgctcgagaacaactaccgcacccccgccgacatcgccgtgaagaagttcgccgtcgaggagggccacatgcggaaccagcgcggggcctacacgcacaccttcaaccggctggacatcctggcggagatgcagctcctgttcaagacccagcgcgagctgggcagcacctacgccaacggggagctcgagcaggccttctgcgagctgctgctctggcagaagcaggccctgaaccgctcccagatgctgagcctcgtgggcaagtgcacgttcgagaaggaggagaagcgggccgcgaaggcctcctacagcgccgagcgcttcgtggccatccagaagctgcagaacctgcggatcctcgagaacggcgaggagcgcgggctgttcgactccgagttcagcctgctcctggagaacgcctacaacctgaagtccggcctcacctacaagcaggtccggaagatcctgagcctgtccgagaacgcgatcttcaaggggctgccgtacctcagcgacgacctggagaagcccgagaagacccagttcctggccttcaagttctaccaccagctcgccgacatcctgaagaacaacggcttctccgacgagtggcagaagctgagccaggagcccaccctcctggacaagctgggcacggagctcagcctgtgcaaggaggagaacgagttcatcgcccagttcaacggggagctgcccgaggccatgctctccaccctgttcaaccacaccaacttcgacaagttcatccacatcagcctgaaggcgctcaacaacatcctgccgctgatggagcagggcaacgactacaccaaggcctggcgcaaggtgtaccccgagcccacgaagaaggacgagaagaccctgcccccgatccccgccgacgagatccggaaccccgtggtcctgcgctccctgagccaggcccggaaggtgatcaacgcggtgatccgcctctacgggtcccccgcccggatccacatcgagaccgcccgcgagctgggcaagagctacgacgaccggcagaagatcaagaagcagcaggacaagaactccgacgagcgcgaccaggccgtcaagaagttcctggaggagtgcccgaacttcgccaacaaggtgaaggggaaggacatcctcaagatccggctgtacatcaaccaggacggcaagtgcctgtacagcggcaagcccctcgacccccaccgcctgctggagatcgggtacgtggagatcgaccacgcgctccccttctcccggacctgggacgacagccagaacaacaaggtcctggtgctggccaacgagaaccagaacaagggcaaccagacgccgttcgagtggctcgggaaggacgagcaccagtgggccctgttcgtggcccgcgtcaacggctgccggttcccctacgccaagaagcagcgcatcctgaccaagaagctcgacgagcaggggttcctgaagcgcaacctgaacgacacccggtacgtgtccgcgtacctcatgaagcacatcaaggagaacctgcacctggtcggcaagggcagcgacaaggtgttcgcctccaacggccaggtgaccaacttcctccgccggtgctgggggctggagaagaagcgcgaggagggggaccggcaccacgccctggacgccatcgtcgtggcctgcagcacggcgtccatgcgccagaagatcaccctcttcaagaagtaccagcggtggaacctgaagaccggcaagcacatcgaccaggagaccggggagatcatccccctgcacttccccgccccgtgggacttcttccgccaggaggtgatgatccggatcttcagcgagatgccccaggaggacctcatcatgcagctgcccgaccgcccccaggccaaccacgagttcgtccagccgctgttcgtgtcccgggcccccagccgcaagatgtccggccagggccacgaggcgaagctccggagcgcccgcatgctggaggccacgggcaagagcatcaagaaggagttcctgaccgacctcaccatcaagaacctggagcacatggtgaacaaggagcgggagcccgagctgtaccaggccctcgtcgagcacttcaagaagtacggggacaagccgaaggagaagttcttcaagaagggcggggtggaggtgaagtccatccgcatcagcaagacccagaacaagtccgtcaacctgggcaacaagacgatcgccgacaacggggacatcgtgcggaccgacctgttcctcaagaacaagaagtactacttcgtgaacatctacgcgtggcaggtcagcaagggcatcctgcccaaggagaccaccacggggaacatcctggacaactcctacgagttccagttcagcctcttcaagaacgacctgctggagatcccccaccccaagaacgagaacgactccatcctcgcctacttcatccgcccggacgacgagcggcgctggatcctgaagttccacgacaacgccaagatccccgacatctacggcaagaaggacgagaccagcatccggctgtccatccaggggcagaagttcatcaagaagtaccaggtggacgagctcggcaagaacatccgcccctgccgccccaccaagcggcagggcgtgcgctga

SEQ ID NO: 1464 - RNA, 3141 nt, synthetic construct
  misc_feature 1..3141: note = Cas9 variant
  source 1..3141: mol_type = other RNA
atgaagatctacagcttcgacatcggcgtggcctccatcgggtgggccttcatcgagaacgaggtcctgcaggactgcggcatccgcatcttcaccaaggcggagaaccccaagaacggggccagcctcgccctgccgcggcgcgaggcccggggcgtgcgcaagcggctggcccgccggcgcgggcggctcaacaccatcaagcagctgctgtgcaaggagttcggcctccagctggaggactacctgtccaacgacggcgagctccccaaggcgtacacggccagcaaggccaaccccctgaagtccccctacgagctgcgcaccctcgccctgagccagaagctggactccaaggacctcgtgcgggtcatcctgcacatcgcgaagcaccgcgggtacggcaacaagcacgccaaggacagcaaggacaccgagtccgggaaggtgaagaaggccatcgagttcaaccggaagaccctggccgagaagggctaccgcagcgtgggggagtacctctaccgggagttcttccagcagtcccgcatcagccagaacaacggcgccacggagttcgtcaacgtgcggaacaagaccggcaactacgagcactgcgtggcgcaggacatgctgaaggacgagctggagctcatcttccgcaagcagaaggagctggggctgcacctctccgacggcttcgagaagcagctgctggacaagatcttcgagcagcggccgctcaagagcttcgccgacaaggtcgggaagtgccagttcatcgccggcgccaagcgcgcccccaaggactccatcagcgcgatcgagttcgtggccctgtcccggatcatcaacaccctggccaacctcagcaagaagtccggcgagatgtacgacaaggccatggtgctgaccatcctggacagcgtcctcgagaagggggagatgagctactacgccctgcgcgaggcgatcaacctggacgagaagatccgcttcgccgactcccggctcgactacagcaaggagatcaaggagacggagaaggtgaagttcgtggagtgcaagaacctgaagtccttcaagaaggtcctgggcaactgctacaagaccctcgagcgcaagcacatcgacagcatcgccgagcggatcgccgtgatcaaggacgtggagaagctgcacaaggagctggagtcctactgcgccaccgagcagctcagcctgacctccgagcagatccaggcgctgagccacctcaacttctccagccacatctccctgagcctgaaggccctcgagcagatcctgcccttcatgcgcggggagcgggaggcccgctccagcgacgccgactactgcatcggcatcgacgagtccggggagagccagtgcctgcggtacgacgagtccgtcgagaaggcgggcctgaaggccctcagcaaggacacgctgaagggccagatcctgcccccgctcaacgagttcgagccctacctggccaaccccgtggtggcccgcgccctggcggagtaccggaaggtcctcaacgccctgctgaagcagtacgggagcccccacaagatccacatcgagtacgcccgcgaggccaagctcaacaccaccgagcggcagaagtacgagaaggagcagaaggacaactacgccgcgaaccaggccgcccacaagaagtgccaggagctgggcctggagccgagcagcaccaacctcctgaagctgaagctctggcaggagcagggcgggctgtgcctgtactccggggccaagatcacgatcagctacctccaggaccccaccgccctccaggtggaccacatctacccctactcccgcagcttcgacgactcctacatgaacaagtgcctggtgctcaccaaggcgaaccaggagaagggcaaccggacccccttcgaggccttcggcacggacagcgccaagtggggcgtcatcaccaccctggcccagaagctgccgcacaagaagcgccggcgcatcctcaacaccgcgttcaacgacaaggaggccgggttcaagctgcggaacctgaacgacacgtcctacatcgcccgcctcgtggccgactacaccgagacctacctggagttcctgagcctcgtcgagtccgagaacaccacgctggggaagggccagaaggggagcaagaagcacatcgccatcgtgaacggcgcgctgacctccaccatgcggtactacctcggcttcgccagcaaggaccgcgacaaccacctccaccacgccctggacgccgtgatcatcgggttcatgaacgactccgtcatcaaggccttcagcgacttcaagaagacccaggagacgtccaaggcggcctactacgcccacaccctgagcaagcaggagtacaagaagcagcgcgccttcatccagctgccctccggcgagaacttccgggccaacgtgctggagaaggcggagagcgtgttcgtcagcaagccgccccgcaagcgggtgcgcggggccctccacgaggagtccttctacagccagaacgacaccaagctgctgaagtcctacggcggcgccgaggggatcgagaaggccctccagctgggcaagatccggcagatcgggaccaagatcgtgagcaacggcgcgatggtccgcgtggacatcttcaagcaccggaagtccgggaagttctacggcgtgcccgtctacacgatggacttcgccctgggcatcctccccaacaaggccgtggtgcaggggaaggacaagaacgacgtcatcaaggactggctggagatggacagctcctacgagttcatcttcagcctgtacaaggacgacctcctgctggtgcagaagaaggagatggccgagcccgagctctgctacttcgtgtccttcgacaccagcggcgcctccatcaaggtcgcgaagcacgacaacaacttcagcaccctgaccgagaaccagaagctgctgttctccaacgccaccaaggaggaggtggtggggaagtccatcggcatccagaacctgaaggtcttcgagaagtggcaggtctccgtgctgggggaggtgaagcgcacgcagagctacccccgggagaacatctccctcgccagcaaggccaagaagtga

SEQ ID NO: 1465 - RNA, 3144 nt, synthetic construct
  misc_feature 1..3144: note = Cas9 variant
  source 1..3144: mol_type = other RNA
atgaagctgctccgctacatcctgggcctggacctcgggatcgccagcgtgggctgggccatcgtcgagatcgacgagaacgacttccccatccggctgatcgacatcggggtgcgcaccttcgacaaggcggaggtgtccaagaccggcgagagcctggccctcgcccggcgcctggcccggtccacgcgccggctgatccgccggcgcgccttccggctcctgaaggggaagcgcctgctcaagcagcacaacgtcatcaacaaggaggcgctgaccaccctgccgaccgactgctgggccctccgggtgaagggcctggacgagcgcctgagccccacggagtggtccgccgtgctcctgcacctcctcaagcaccggggctacctgagccagcgcaagaacgaggccaagtccgcggacaaggagatgggggccctgctcagcggcgtcgcctccaaccaccagctgctggtggagaaccagttccggacccccgccgagatcgccgtgaagaagttcgcgctcgaggaggggcacatccgcaaccagctgggcgcctacacccacaccttcaaccggctggacctcctggccgagatgaagctgctgttccagacgcagcgcgagctggggaacccccacaccagcggccagctggagcaggagttctgcgagctcctgatgtggcagaagccggccctgtccggcgacgccatcctcaagatgctggggaagtgcaccttcgagaccaacgagtacaaggcggccaagcacagctacacggccgagcggttcgtctggctgaccaagctcaacaacctgcgcatcctggagcacggctccgagcgcgtgctcaacaccgacgagcggagcctgctgctcaaccagccctacgagaaggccaagctgacctacacccaggtgcgcaagctgctggggctctccgaggaggcccggttcaacggcgtccgctacggcaaggagaaggcggaggacgccacgctgatcgagctgaaggcctaccacgccatccggaaggccgtggagaaggcggacaagagcgcctgggagaccctcaagaaccagaccgccctgctggacgagatcgggacgaccttctccatctacaagaccgacgacgacatcaccgagcagctcaacggcaagctgagcgacacggtgctgaacgccctcctggagaacctgaacttcgacaagttcatccagctctccctcaagagcctgtacaacatcgtccccctcatggagcaggggctgcgctacgacgaggcgtgccagcagatctacggcgaccacttcgggaagaagtccggcgagatcaaccggctgctgcccccgatccccgccgacgagatccgcaaccccgtggtgctgcggagcctgacccaggcccgcaaggtcatcaacgccgtgatccggctctacggcagccccgcccgcatccacatcgagaccgcgcgggagctggggaagtcctacaaggaccgcaaggagatcgagaagcggcaggagcagaaccgcgccgagcgggagaaggccaccgcccagttcaagacgctgttcccgaccttcatcggcgagcccaaggggaaggacatcctcatgatgcgcctgtacgagcagcagaacggccagtgcctgtacagcgggaagcccctcaacctgaaccggctgctcgagaagggctacgtggagatcgaccactccctgcccttcagccgcacctgggacgactcccagaacaacaaggtcctggtgctcgccggcgagaaccagaacaaggggaaccagaccccgttcgagtggctgggcaaggacgagcaccagtgggcgctgttcgtggcccgcgtcaacgggtgccggttcccctacgccaagaagcagcgcatcctcacgcagaagctggacgagcagggcttcatcgagcggaacctgaacgacacccgctacatcgcccggttcctcgtgaacttcgtccgcgagaacctgcacctgaccgggaagggcaagaaccgggtgttcgccagcaacggccagatcaccgcgttcctccgcgggcggtggggcctgtccaaggtgcgcgaggagagcgaccggcaccacgccctggacgccgtcgtggtggcctgctccacggtcgcgatgcagcagaagatcacccgcttcgtgaagtaccaggaggggaacctccagaccgccgagcggatcgaccgcgagaccggcgagatcatccccctgcacttccccgacccgtggcacttcttccggcaggaggtgatgatccgcatcttcagcgagaacccccaggaggacctgatcatccagctccccgaccggcccgaggccaaccacgagttcgtccagccgctgttcgtgtcccgcatgcccacccggaagatgagcggccaggggcacatggagacgatcaagtccgccaagcgcctggacgagggcatcagcgtgtccaaggtccccctcacccagctgaagctgaaggacctcgacaacatggtgaaccgggagcgcgagaaggccctgtacgaggcgctgaaggcccgcctcaacgccttcaacgacgaccccaccaaggccttcgccgagccgttctacaagaagggcgggcagcaggtcaaggcggtgcgggtggagcaggtccagaagtccggggtggtggtgcgcaacggcaacggcgtcgccgacaacgccagcatggtgcgggtggacgtcttcatcaagggcgggaagtacttcctggtgcccatctacacctggcaggtcgccaaggggatcctgcccgaccgcgccgtggtggcggccaaggacgagagcgagtgggagctcatggacaagacggcccagttcctgttcagcatgttcccgaacgacctgatccaggtgaagaccaagaaggagaccttcttcggctactacaacgggctcgaccgggccaccggcgcgatcaacctgaaggagcccgactccaacatcaacaagggcaagagcgggctgcaccgctccatcggcgtcaagacggccctcagcgtggagaagtaccaggtggacgagctggggaagaacatccggccctgccgcccctccaagcggcaggccgtccgctga

SEQ ID NO: 1466 - RNA, 3147 nt, synthetic construct
  misc_feature 1..3147: note = Cas9 variant
  source 1..3147: mol_type = other RNA
atgaagcgcctgggcctcgacatcgggaccaacagcatcggctggtgcctgatcgaggacgacggggacggcaaggggcggatcatcgacatcggcgcccgcatcttctccgacggccgggaccccaagagcggggcctccctggcggtggaccgccgggccgcccgcgccatgcggcgccggcgcgaccggtacctcggccgccggaccgccttcctgaaggcgctgaagcgcttcgggctcatgccggccgacgagagcgccgccaagctgctggcggaccgggacccctacgagctccgcgcccgggccctggacgagcgcctggagccccacgagatcggccgggccctcttccacctgaaccagcgccgggggttcaagtccaaccgcaaggccgagcgcaagacgaaggacgcggaggacggcaagatcgccaacggcgccaaggccctggaccaggccatggcggagagcggggccgagaccctcggccagttcctgtccagccgggacaccaagcgcgtccggatggggtccgacgcccagggctacgacttctacccccagcgccggcacgtggagtacgagttcgacaccatctggagccgccagcagcagcaccacccggccctgctcacggaggaggcccggaagaagctgcacgacatcctgttcttccagcgccccctcaaggagcaggaggtgggcgtctgcaccttcgtgcacaacgagtgccggctgcccaaggcgcaccccctgttccaggagcgccggctctacgaggaggtgaaccagctggagatcaccaccccgggggcccccaaccgcaagctgacgatggacgagcgggacgccctcatcctggagctgcgctcccggaaggagcgcagcttcgactccctcgccaagcggctgaagctggcccccggccagagcttcaacaaggcgtccgagagccgcacccggctccgcggggacgaggtctacgccgtgatggcccacaagaagcgcttcggcgaccggtggccccacctggaccgcgaccggcagtgggccatcatcaagcgcatcatcgaggaggaggacccggacaagctgcacgcgttcctcaccggggagtggggcctgaccgacgagcaggccctggccacggcccgggcgcccctccccgagctgtacggccgcctggggcccaccgccaccgcccggatcctcgaggagctgaagaaggacgtgatcacctacgacgaggccgtccgccgggccggctggcaccactccgacgaccgcacgggggagatcctgccgcagctcccctactacggcgagctgctgacccgggacatcccgcccgggacccaggaccccaacgacccgcccgagcagcgctggggcaagatcaccaaccccacggtgcacatcggcctccggcagctggagaagctggtgaacgccatcatcaaggtccacgggcgccccgaccagatcgtggtggagctggcgcgggagctcaagctgaacgagaaggacaaggaggagcacaaccgccggatccgccgggacaccgccgccgcccagctgcgcagcgccaagctccagtccgagggcatccccgacaccggggcgaaccggatgctgctgcgcatctgggaggagctcaaccccggcgaggtcctggaccgccggtgcccctactgcggggagccggtgggcatgcgcatgctgttcgccggcgaggccgacatcgaccacatcatcccctacagccggagcctcgacgactccgccgggaacaaggtggtcgcgcaccgcagctgcaaccgggccaagggcaaccgcaccccctacgagaagtgggtgcacgacccggaccggtgggacgtgatctccacgcaggtcgcccgcctgcacaagagcaagcagtggcggttcgggcccgacgccatggcccgcgtggagaaggacggcggcttcatcgcgcggcagctgaccgacacccagtacctctcccgcctggccgggcggtacctgagctccctctaccccaccaaggacgacggcagcgtgtacgtcatccccgggcgcatgacggccatgctgcggcgccggtggggcctgaactccctcctgccggaccacaacttcgtggacaacgagcacagcaacgcccccaagaaccgcctggaccaccggcaccacgccatcgacgcggccgtcgtggccgtgaccacccgcgccctcatgcaggagatcgcccgcaccgcggggcgggccgaggacaaggacctggaccgcctgttcgaggacctcccccagccctgggagggcttccgggaggagctgggcgagaagctggtccgcgtgacggtgtcccacaagccggaccacgggcggaagggcctcccgcccaagaaccgcgacgtcaccgccgggcggctgcacaacgacaccgcctacggcctgaccggggacgtggcggccgacggcaagacgcccatcgtggtccaccgcgtgcccctcatgagcctgaagcccgccgacatctccgaccccgaccggatccccgacccggccctgcgcagcgccctccaccgggcgaccgacggcctgtccgggaaggcctacgacgccgccctggccggcttcgcgaagacccacccccagttcgccgggatccgccgggtgcgcgtccgggagcccctcaccgtgatccccatcgccgaccgcgacggccggccgttcaaggcctacaagggggacgccaacagccgcgtggacatctggcggatgcccgacggcaagtggctgtccgacgtcgtgaccatgtacgaggcgcaccgccgggaccacagcgaccgccgcccccaccccgccgccaagaagctgatgtccctccggcagaacgacatgatcgccgtggagcgcgacggcgccccgcggcagatcatggtcgtgaagcagatctggcccacgcagatcaacctggtggagcacaaggagaccgggaacctgaaggaccgccacagcaacgagaccgaccccttccggttcttcgcgccgaccgccggcgggctcaagaagatgaaggcccgccaggtccggatcgaccccctgggccgcatcttcgaccccgggccccggtga

SEQ ID NO: 1467 - RNA, 3147 nt, synthetic construct
  misc_feature 1..3147: note = Cas9 variant
  source 1..3147: mol_type = other RNA
atggccaacatcgccgagaacctggtgttcggcatcgacctcgggatcggcagctgcgggtgggcggtcctgaaccagaaggccaaggacgagaacatcgtggccctgggctcctggtgcttcgacgtgcccgagaccgacaaggagcgcatcccgaccaaccagatccggcgcgccaaccggctcctgcgccgggtcatccgccggcgccggaaccgcatggccgagatccggcgcctgttcgcgagcaaggggatgctcgacacggccgaccccgacgccctggccaagatctccgcggacccctgggagatgcgggccaagggcctggactaccagctcacgccccaggagttcgccgtggccctgggccacatcgccaagcgccgggggttcaagagcgcggccaagcgcgtgtccaccaacgccccgagcgaggactccaagatgctggccgccctcgagaagaccaaggagcagagcgcgcagtaccggaccatcggcgagatgttcgcccgcgaccccgcctacgccgaccggcgccggaaccgcgacgggtgcttcgaccgcaccatgtcccgggaggacctgttcaaggagacccagatcctgttcgagagccagcgccggctcggcaacttctccgccaccagcgagacggagcaggcgttcatcgacatcgccttccgccagaagcccatgcaggactccgagcggctggtcgagacctgcctgttcgagcccgacgagaagcgcgccagccggttcgccccgtccttcgagcgcttccggctcctgtgccgcctggtgaacctccgggtgaccgacgggctggaggaccgccccctgacccccgaggagctccggctggcctgcgaggacgcgggcaagacgcgcaagctgagcgtcaagaaggtgcggtccctcatcggcctgcgcgacgaccagcggttcaccaccatcccgcccgaccaggagcagcacgacatcgccgcccgcaccggggacgccctgacgggcaccgcgaccttccgggccatcctcggggagagcttctggcgccagctgctgccccaccccgagcagctcgaccgcgccgcctggatcatctccttccacgagctgaccgacacgatcatcagcaagctggccaccatcggcctccccagcgaggtgatggagctgatccggaaggcgctggaggacggcaagttctccaagttcaagggggccgccagcctctccgacaaggccgcccgcaagctgatcccgttcctgcaggagggcctcacctacgacaaggcgtgccagaaggccgggtacaaccacgccgccagcaagttcacccactacgactccatcgacacgaaggccaagttcaacagcctgatggacgacgtccgggactccatcaccaaccccgtggcgcgcaaggccatcagcgagggcatgaagcaggtctgggccatgcggaaccagtgggggctgcccggcgccatctgcatcgagctcgcgcgcgacgtgggcaactccgccgagaagcggcgcgagatcgagagcgggatcaagaagaacaccgcccagcgggagcgcgagcggcaggaggccaaggagcacctgaaccagtccgacatcagctccgagaccctgctccgctaccggctgtggaaggagcagggcgggcgctgctgctacacggaccagcccatcaccccgagccagctgatcgcctccgacaacagcgtccaggtggaccacatcctgccctggtcccggttcggcgacgacagctacctcaacaaggcgctgtgcaccgccaaggccaaccaggagaagaagaaccgcaccccctgggagtggatccacaaccagaagggggtggaggcctggaaccacttcacggccgcggtggagtcccggaaggagacccgcggcctgaagaagcggaacttcctcctcaagagcagcaaggagaccgaggagcgcttccggtcccgcaacctgaacgacacccgctacgccgcccgggtgatggccgaggccgtccgcctgctgtaccccagcggcaaccgggcggagaagggcggggtgaagcgcgtgttcacgcggccgggggccctgaccgccgccctccgccacgcgtggggcgtcgagtccctgaagaagatcaacgggaagcggctgaacgacgaccgccaccacgccctcgacgccgccgtggtcgccgcggtgagcgagaaggagatccagaagctgaccaagtccttccagatctgcgagcagaagggcctggcccggcccatgcgcgacgtgcccatgccctgggagggcttccggcaccagctcgagaccgcctacgccgacatccgcgtcgcccggccggagcgccggcgcgcgcgggggaagggccacgacgccaccatccgccagctgcgggaggagaaggacgggcccgtggtgtacgagcgccgcgccatcagcgacctgaagctcacggacctggagcggatcaaggaccccgagcgcaactccgccatcatcagctccctgcggacctggatcgagaagggcaagccggccgactacccgccccagagccccaagggcgacgagatccgcaagatccgggtcatgtcccgcaacaagcccgcggtgagcgtgcggggcgggaccgccgaccgcggggagatgacccgggtcgacgtgttcacgaagatgggcaagaaggggaagcccgagtggttcctcgtgcccatctaccgccaccaggtcatcgaccggatccagtggccccagccgcccaaccaggccgccgccaacggcaagtccgagaagaactggcccaccatgggcctggagcacgagttccgcttcagcctgtacccccggtcctacgtgcagatcgtgaagcgcgacggggagatcatcgagggctacttcgcggggctcgaccggaccgtcgccgccttcagcctgctgtccagcagcgacccgacctccatccagcgcggcatcggggccaagacgctcgagagcatccggaagtacaacgtgaaccgcttcggcgacatctccatggtggagcaggagacccggacctggcacggcgacgtctgcatcagccccgaccagcccgactccgcgtga

SEQ ID NO: 1468 - RNA, 3147 nt, synthetic construct
  misc_feature 1..3147: note = Cas9 variant
  source 1..3147: mol_type = other RNA
atggtggagaagatcctgggcatcgacctcgggatcagctccctgggctgggccgtcgtggagtacgacaaggacaacgacgagaacaacaagatcatcgactgcggggtgcgcctgttcaccgccgcggagacccccaaggagaaggagagcccgaacaaggcccggcgcgacgcccggggcctccgccgggtcatcaagcgccggcgcgtgcggatgaacacgatcaagaacctgctgatcacctacaagctcatcgacaagaccctgctggacgaggagatggggatgttccactcccagagcaaccgcgtggacgtctggaagctccggcacgacgccctgtaccacctcctgtccggcgacgagctggcccgcgtgctgatccacatcgcgaagcaccggggctacaagttcctcggggacgacgagagcgacgaggagtccggcaaggtgaagaaggccggggccgagctgaagaagaagttcctggaggccggctgccagagcgtcggggagtggctctggaaggagcgcggcctgcagggcaagaagcggaacaagtccggggactacgagatcagcatcccccgcgacttcctggtggaggagatccagcggatcttcgagacccagcagaagttcggctccacgttcgcgaccagcgagctccagaaggcctacaccgacatcgccttctacgtgaagcccatgcagtccatcgaggacatggtcgggtactgcaccttctaccccaagatcaagagcaagaaccaggacggcgagaagcgcgccccgaaggcctcccccagcgcggagcagttcgtgatcctgtccaagatcttcagcacgatcgtgatcgacgagaacaagcaggagaagaagctgatcgagctcaagtccatcgagcagctgatccagatcgcccggagcaaggagaccctgaagtacaagcagctccgcaaggagctgaacctggccaaggacatcagcttcaagtccatcagcgacgaggagaagacctggatcaacctcgtcggcaacgccaagttcaagaagatcctggggctgaactacgagaccttcctcaagaacacggagatctccgacgagatcgccaagatcctgacctacgacaagaccttcgagcagaaggagaccaagctgaagaacctcctggtgaacatcgactggatcgacaacaaccacatcgcggagctggccaagctcagcttctcccagttcaaccagctgagcctgaaggccatcaagatcatctccaagatcatgatcgagggctacgcccggtacgacgaggccgtgcagtacgcgttcgagaacaacctcctgcccaagcccagccacgagaagtccatcctgctcccgcccctgaaggagacgaacatcgccatcctgaaccccaccgtcatccgcgccttcgcccagttccgccaggtggccaacgcgctcgtgagcaagtacgggtccttcgacaaggtccacttcgagctggcccgggaggtgaacaccaaggaggaccgcaagcggtgggagaaggaccgcgacaagaacgagaagatgcaccggcagatcaccgagaagctggtggaggagggcgtcaagcccagctacaagaacatcctgaagtccaagctccgcagcgagcagaaggacacgtgcccgtactgccagaagaacctgcactaccccatgatcttcgaggacgggtacgccgagatcgaccacatcctgcccctctcccagagccaggacgactcctacgtgaacaaggtcctggtgcacagcgcctgcaaccagaacaagaagaaccggacccccttcgagtggttccaggacgagaagaaggactgggacaccttcaagtcctacatcctgatggagagcaccctcggcgagaagaagcgcaactacctgatcaaggagaacttcagcgacccgcagtcccggaaggagttcatcagccgcaacctgaacgacacgcggtacatgtccaaggcgatcaagacctactgcgagaaccactggaagctcagccacgacgacgacaagctgcgcatccaggtgcggtccggcaagctgaccagcaccctccgccaccagtgggggctggacaacaagaaccgggagacgcacacccaccacgccatggacgccatcatgatcgccttctccacccagggcatggtcaagaagctgagcgactacttcgccaagaaggaggcgaaggtggagaaggacaagcccgtgctcatcacccccatcaagcagttcaaggaggccgtcgagcaggccacgaccctggagcgccaggagtccatccagaccaaggccggggacaccatcacgctgaaccggctcctgatcagccggcccccgcgcgcctccgtgaccggcgcggcccacgagcagaccgccaagccctacccccgcatcaagcccatcaagaacaagtacaagcgccggcgcatcccgatcgacgaggacaagttcgagctgttccggaacgacaaggtggccagcgggaacgacaagaacttctacaactccagcaccatcccccgcgtcgacatctacaagaaggacgacaagtaccacgtggtgcccatctacctctccgacatgaccaaggccgaggtccccaacaagagcctgggcacgaacccggagggcatggacgagaagtacttctgcttctccgtgttcaagaacgacctgatcgagctcgagaccaaggcgacccccaagaagcccagcaagaagctgctggggtacttcaagcagctcaacggcgccaacttcatcctgaacagcatccacaacgggatcatcgacggcttcgtgtgctccccgatcaccctgttcaagcagcagaaggacatgtgcaagaagtgcctccccgaggaccgggccatcgggaactgcagccaggagacgctggagttctgggaggccgagaacatcaaggtccccaagaaggacttcgagtgcgaccagggcatcaagttcgcgatcgccgtgcgcaagtacaccatcgaccccctgggctactaccacgaggtgaagggggagaagctcctgggcaccatcccgcagggggccaagaagcaccccaagcggcagaagtga

SEQ ID NO: 1469 - RNA, 3150 nt, synthetic construct
  misc_feature 1..3150: note = Cas9 variant
  source 1..3150: mol_type = other RNA
atgatcaacgagcgcctgaccttcggcatcgacctcgggatcggcagctgcgggtgggccgtgctgcggcacgccgacgcggccggcgagcccggggtcatcgagggcctgggctcctggtgcttcgacgtgccggagaccagcaaggagcgcatccccacgaaccaggtgcggcgctccaaccggctcctgcgccgggtcatccgccggcgccggaaccgcatggccgagatccggcgcctgttccacgcccaggggctcctgcccagcgccgacgaggacgcgctgaagcggccccgcctcgacccgtgggagctgcgggcccgcggcctggaccagtgcctctccgccgaggagttcgccgtggcgctggggcacatcgcccggcaccgcggcttccggagctccgccaagcgcaaggccgccaacaccagcggggaggactccaagatgctgagcgcgctcctggtgacccgcgagcggaccgcccgctaccggacggtcggcgagatgttcgcccgcgaccccgagtactccgcccggcgccggaaccgcgacggcatcttcgaccggaccgtggcccgcgacgacctgatccacgaggtggggaagctgttcgaggcgcagcgggcccgcggcagcgccttcgcctcccccgacctggaggccgacttcaacgcgatcgccttccggcaggccgagatgcaggacagcgagcgcctggtcgggaactgccccttcgagcgggacgagaagcgcgccgcccggtgggcgccgtccttcgagcgcttccggctcctgacccgcctgatcaacctccgcatcgccaccgccgagggcgagcggcgcttcacgcccgaggacctggcccgggtgagcgcggagctgggcgccaccgccaagctccccgtgtcccgcgtccgggccctgatcgggctgctccccgacgagcgcttcaccaccatccgggtggaggacgaggaccgcgacatcgtggcccggacgggcgaggcggccccggggacctggcgcctgcggaagaccctgggcgaggccctctgggccgagatgcaggcccgccccgaccagctggacgcgatcgcccacgtcctgagcttcttcgaggccaccgccaagatccggtccgagctcgaccgcctggggctgcccgccgcggtgatcgaggccctcgaccggggcctggaggacggcgccttcgccaagttcaagggggcgggccacatcagcgccaaggcctgccgcaacctgctcccccacctccagcaggggcaccggtacgaccaggcctgccgcctggccggctacgaccacgcggccagcacgctctcccacaccgcccaggtggtcagcaaggccgggttcaacgccctggtgaccgagctgggcgagtccatcgcgaacccgatcgcccggaaggccctcaccgagggcctgaagcagatccgcgccatgtgcgcccggtgggggctgcccggcgcgatccacatcgagctggcccgcgaggtggggaacagcatcgagaagcgccgggagctcgagtcccagcgcgagacgaccaccaagcggcgccagaccgagcgggacgagatccgcggcctgctggccctcgaggacgtcgacgacgacacgctgctgcggtaccgcctctggaaggagcagggcgggaagtgcctgtacaccggcaaggacatccacgtgcggcagctgatcgccaccgacaacagcgtgcaggtcgaccacatcctcccctggtcccgcttcggggacgacagcttcaacaacaagaccctgtgcctggcgtccgccaaccagcggaagcgcggccagacgccctgggagtggttcagcctcaccgggaccccggaggcctgggaggtgttcgcctcccgggtcgagaccagcaaggacctgcgcggcttcaagaagcggaacctgctcctgaagaacgccgacgaggtggcgcagcgcttccggtcccgcaacctgaacgacacgcggtacgccgcccgcctcctggccgaggccgcgaagctgttctaccccgccggcgaccgccaggagaaggacgggcggcgccgggtgctcacccgccccggccccctgaccgccgccctgcggcacgcctgggggctcgagagcctgaagaaggcggacggcaagcgcgtctccgacgaccggcaccacgccctggacgccctcgccgtggccgcgatcagcgagcgcgaggtgcagcggctgacccgctccttccaggagtgggagcagcaggggctggcccggccgctccgccacgtcgccccgccctggcccggcttccggggcgacgtgctggccgcgtacgcccaggccttcgtggcccgccccgagcggcgccgggcccgcgggaagggccacgacgcgagcatccggcaggtcgtgggggagggccccgaggcccaggtgttcgagcgccgggggctggccgacctcaaggaggccgacctggaccgcgtcaaggaccccgagcgcaaccaggccatcatcgaggcggtgcgggcctggatcctggccggccgcccggccgacgccccgccccggagcccccgcggcgacgtgatcgtcaagctccggacggcgcccgccaagaagatcaagcccgccgtgcccgtgcgcgggggcaccgccgaccgcggggacatggtccggatcgacgtgttcacccggcccaaccgcaagggccgggacgagtggtacctggtgccgatctacccccaccaggtcatgaaccgcaaggcgtggccccacccgcccatgcggagcgtggtggcctacaaggacgaggccgggtggaccgagatcggcgccgagcacagcttccgcttctccctgtacccccggagctacgtccagctcgtgaagtccaacggcgacgtgatcgaggggtacctggtcagcatggaccgctccaccggcgccttccgggtgttcgtgcacaacaaccccgcggagatggccaaggggatcggcgccaagacgctgctcaacctgcgcaagttcaacgtcgaccggttcggggtgcgcaccgaggtgaagtccgaggtccgcacctggcacggcgaggtgtgcacctcccccgtgccgcccgactga

SEQ ID NO: 1470 - RNA, 3150 nt, synthetic construct
  misc_feature 1..3150: note = Cas9 variant
  source 1..3150: mol_type = other RNA
atgcagctgagcaagctcaactacatcctgggcctggacctcgggatcgcctccgtgggctggagcgtcatcgagatcgacgagaccgagatgcccatccgcctgatcgacgtgggggtgcggaccttcgagcgcgccgaggtcccgaagacgggcgagtccctggcgctcgcccggcgcctggcccggagcacccgccggctgatccgccggcgcgccttccggctcctgaaggccaagcgcctgctcaagaaccaccagatcgtgtccgcggacgagctgagcaccctgcccaaccactgctgggagctccgggtgaaggggctggacgagcgcctgacctgccaggagtgggccgccgtcctcctgcacctcctcaagcaccggggctacctgtcccagcgcaagagcgaggcccagaacgcggacaaggagatgggcgccctgctctccggggtggccaacaaccacaagctgctgagcgagaaccactaccggacgcccgccgagatcgccgtgaagaagttcgcgctcgaggagggccacatgcgcaaccagcgcggggcctacacccacaccttcaaccggctggacctgctcgccgagatgcggctgctgttccagacccagcgcgagctcggctccccctacgccagcggggagctggagcaggagttctgcaagctgctcatgtggcagaagccggccctgtccggcgacgcgatcctgaagatgctcggcaagtgcacgctggagcccaccgagtacaaggccgccaagaacacctacaccgccgagcgcttcgtctggctgacgaagctcaacaacctgcggatcctggagaacgggagcgagcgcgccctcaacgcggacgagcgggccctgctgctcaaccagccctacgagaaggccaagttcacctacgagcaggcccgcaagctgctgcagctgaacgaggccgcgcggttcaactccgtgcgctacggcaaggagaacgccgagaagtccaccctcatggagatgaaggcctaccacgccatccggaaggcggtggagaccgccgacagcagcgcctgggccacgctgaagacccagcccctgctcctggacgagatcgggaccgccttctccatctacaagaccgacgaggacatcaagacgcagctgcagggcaagctcgcggacaacgtcatcgacgtgctgctggagaacctcaacttcgacaagttcatccagctgagcctgaaggccctctacaagatcctgccgctgatggagcagggcctccgctacgacgaggcctgcagccagatctacggggaccacttcggcaagaaggagcagaagaacgaccggctgctgccccagatccccgccgacgagatccgcaaccccgtggtcctccggaccctgtcccaggcccgcaaggtgatcaacgcggtgatccggctgtacgggagcccggcccgcatccacatcgagaccgcccgggagctcggcaagtcctacaaggaccgcaaggagatcgagaagcggcaggagcagaaccgcgccgagcgggagaaggccgtcgacaagttcaaggagctgttccccaacttcatcggggagcccaaggcgaaggacatcctgaccatgcgcctctacgagcagcagaacggccagtgcctgtacagcggcaagtccctggacctccaccgcctgctggagaaggggtacgtggagatcgaccacgccctccccttcagccggacgtgggacgactccttcaacaacaaggtgctggtcctggccggcgagaaccagaacaagagcaaccagaccccgttcgagtggctcgggaaggacgagcagaagtgggccctgttcaccgcgcgcgtgaactcctgccggttcccctacagcaagaagcagcgcatcctgaccaagaagctcgacgacgagggcttcatccagcggaacctgaacgacacgcgctacatcgcccggttcctggtgaacttcgtcaacgacaacctccacctgaccgggaagggcaagcgccgggtgttcgcctccaacggccagatcaccgccttcctgcgcgggcggtggggcctcaccaaggtccgcgaggagagcgaccggcaccacgccctggacgcggtggtggtcgcctgctccacggtgagcatccagcagaagatcacccgcttcgtgaagtaccaggaggggaacctgcagaccgccgagcggatcgaccgcgagaccggcgagatcatccccctccacttccccgacccgtgggccttcttccgggaggaggtcatgatccgcatcttctccgagatgccccaggaggacctggtgatcaagctgcccgaccggccccaggccaaccacgagttcgtgcagccgctgttcgtcagccgcatgcccacgcggaagatgtccgggcagggccacatggagaccatcaagagcgcgaagcgcctggacgagggcatctccgtgagcaaggtgcccctgacccagctcaagctgaaggacctggagaacatggtcaaccgcgaccgggagatcgccctctacgaggccctgaaggcccgcctgaccgagttcaaggacgaccccgccaaggcgttcgccgagccgttctacaagaagggcggggtgcaggtcaagagcgtgcgggtggagcaggtccagaagtccggggtggtggtgcgcaacggcaacggcgtcgccgacaacgccagcatggtgcgggtggacgtcttcatcaagggcgggaagtacttcctcgtgcccatctacacctggcaggtcgcgaaggggatcctgcccgaccgcgccgtgatcgcctacacgccggagaacgagtgggagctgatggacgactccgcccagttccagttcagcatctaccccaacgacctcatcaagctgaccaccaagaaggccatcttcttcggctactactccgggttcaaccggctgaccggcgcgatcaacatcaaggagcacgacctccagatcagcaagggcgacaagggggtgcacctgggcctgggggtgaagctcgccctgtccctggagaagtaccaggtcgacgagctcggcaagaacatccgcccctgccggcccacgcagcgccagaacgtgcggtga

SEQ ID NO: 1471 - RNA, 3153 nt, synthetic construct
  misc_feature 1..3153: note = Cas9 variant
  source 1..3153: mol_type = other RNA
atgagctcctaccgcttcagcttcgacctgggcaccaactccatcgggtgggccgtgttcgagctcgaccccaagacccggccggtcgccctggcggactgcggcgtgcgcatcttccccgacgggcggaaccccaaggacaagcagagcctggccgtggcccgccgggaggcccgcgccgtccggcgccggcgcgaccggtacctcaagcgccggtccgagctgatggagcgcctggtggcgaagggcctcatgcccgagagccgggacgaccagaaggccctggaggggctggacccgtacgccctccgcgccgcgggcctggacgacgccctgccgccccaccacttcggccgggccctcttccacctgaaccagcgccgggggttcaagtccaaccgcaagaccgaccggggcgagaacagcgagaccgggatcaccaagatcggcatgaagaagctgcacgaggccctcctgtccgaggggtgccgcaccctgggcgagctccagcaccgccaccacgaggccaaccagacgcccgcgatggacaccaaccccaagagcgtgcggtccaagctgcgcggcgagggggccaaggccgtctacgacttctaccccagccgggacgccgtggaggacgagttcaacaagctgtgggactcccagaagcgcttccaccccgacctcctgaccgacagcgcccgggacgcgatccgcgacgccatcttctaccagcggaagctgaagacccccgacgccggccgctgctccttcaacccggccgaggagcgggtggcccgcgcgatgcccatcgcccagcacttccggatcctccagttcgtcggggacctgcgcctgatcgacaacgacctcgtgcggcaccccctgaacaacgaccagaagaaggccctgtaccgcgacctcctggccaagggcaagctgacgttcaaggccatgcggaagaccatcggcatcgggagcgagtacgcgttctcccacgagagcgagaagcagtccgagttccgcggcgacgagaccgccgcccggctcgccgggcccaagtacttcggcccgaagtggcgcgagctgagcttcaacgaccagagcgagatcgtggaccggctgctccacgaggagaacgaggagaccctgatccagtacctgcaggaccgcttcgggttcgaccacgaccgctgcgaggtcatcgcggacgcgcccctccccgacggccacacgcggctgggcaagaccgccctggagaccctcgtggagatcatgcgcgacgaccacctcccctacgaccaggcctgcaccaaggccgggtacgagcacgccctgccgcccgacggcgtgatcctggacgacctgccctactacgggatcgccctggagcggcacgtcgccttcggcgacgggaagtccgagaaccccgagaagcgctacggcaagatcgccaacccgacggtgcacatcgccctcaaccagctgcggaaggtgatcaacgcgctgatcgcccgctacggccaccccgaccaggtcgtgatggagatcgcccgggacctgaagcagagcaaggccaagcgcgacgacatctccaaggagcagaagaagaaccaggaccggaacgaccagcgccggaagaagctccaggaggcccacatcgcggtgaacgccgagaacatgctgcgcatgcggctgtgggaggagctcgacgaggacaacgccgccgcgcgcgcctgccccttcaccggggagaccatcagcatggcccggctgttctcccccgaggtcgagatcgagcacatcctgccgttcagccgctccctcgacaacagccccgccaacaagaccctgtgcatggtgtgggccaaccgggcgaagggcaaccgcacgccctgggaggccttcgggcgggaccgcgagccgggcttcgactggcccgagatcgccgcccgggccgcgcgcctgcccaagaacaagtcctggcgcttcgggcccgacgccatggagcggctcgagcgcgagggcgacttcctggaccggcagctgaccgacacccagtacctcagccgcatcgcccgggagtacgtgaccaagatctgcgacccgaaccaggtctgggtgacgcccggccgcctgaccgcctggctgcggcgcaactgggggctcaacggcatcctgcccaccgggaacgccaccaagaaccgggacgaccaccgccaccacgcgatcgacgccatcgtcgtgggcctgacggaccggggcatcctcaaccgcgtgtcccggagcgccgccctggcggaggccgaggacctggaccgctccatcgccgagatgcccgacccgttcgacgggttccgggacaacatccgccacatcctcgagcagatcatcgtcagccacaagcccgacgccggcttcgtgcccgggcaccccaagggcaacaccaccccgggggccctgcacaacgacaccgcgtacggcatcatcaagacggacgccaagggcatgtccgaggtggtcacccggaaggacgtgctgagcttcaaggggaccaaggagatcgagtccatccgcgacgccgccacccggcagagcctcctggacgccgtggcgggcgtcccctccgggctggccttcaaggaggccctccgcgactggagcgtgcgcacgggcaccaagcgggtgcgcgtcaccttcaacatgagcgtgatccccatccaggaccgggacgggaaggcctacaagggctacaagggcgacgggaacctgtgcgccgagatctacgagcgccccgacggcaagtggggcgacgagatcatctcccggttcgacgcggtgcagccggggttcacgccccagtggcagcgcgaccaccccgccgcccaccgggtcatgcgcctgttccgggacgacatgatcatggccgagatcgacggggtgatgaccgtgtgccgcatcgtcaagatgagccccggcaaggtggtgttcaccccgcaccacgaggccaacaccgactcccggaaccgcgacaaggacgaccccttcagcttccacacgtgctccggcgagagcctccggaagcgcaaggcgcagaagctgttcgtcgaccccctggggaagatccggggctaccgcgccaaggaggggtga

SEQ ID NO: 1472 - RNA, 3153 nt, synthetic construct
  misc_feature 1..3153: note = Cas9 variant
  source 1..3153: mol_type = other RNA
atgggcgagaacatgatcgacgagagcctgaccttcgggatcgacctcggcatcgggtcctgcggctgggccgtgctgcgccggcccagcgccttcgggcgcaagggcgtcatcgagggcatggggtcctggtgcttcgacgtgcccgagaccagcaaggagcggacgcccaccaaccagatccgccggtccaaccgcctgctccggcgcgtgatccggcgccggcgcaaccggatggcggccatccgccggctgctgcacgccgccggcctcctgcccagcaccgactccgacgccctgaagcgccccgggcacgacccgtgggagctccgggcgcgcggcctggacaagcccctgaagcccgtcgagttcgccgtggtgctcgggcacatcgccaagcggcgcggcttcaagagcgccgcgaagcggaaggccaccaacatctccagcgacgacaagaagatgctgacggccctggaggccacccgcgagcgcctcggccggtaccgcaccgtcggggagatgttcgcccgggaccccgacttcgcgtcccgccggcgcaaccgggagggcaagtacgaccgcaccacggcccgggacgacctggagcacgaggtgcacgccctgttcgccgcccagcgccggctcgggcagggcttcgcgagcccggagctggaggaggccttcaccgcctccgccttccaccagcgccccatgcaggacagcgagcggctggtgggcttctgccccttcgagcgcaccgagaagcgggccgcgaagctcaccccctccttcgagcgcttccggctgctggcccgcctcctgaacctgcggatcacgaccccggacggggagcgccccctcaccgtcgacgagatcgccctggtgacccgcgacctgggcaagacggccaagctcagcatcaagcgggtgcgcaccctgatcgggctggaggacaaccagcggttcaccaccatccgccccgaggacgaggaccgggacatcgtcgcccgcacgggcggggcgatgaccggcaccgccaccctccggaaggccctgggcgaggccctgtggacggacatgcaggagcgccccgagcagctcgacgcgatcgtccaggtgctgtccttcttcgaggccaacgagaccatcaccgagaagctgcgggagatcgggctcaccctggccgtgctggacgtgctcctgacggccctggacgccggcgtgttcgcgaagttcaagggggccgcccacatcagcaccaaggccgcccgcaacctcctgccgcacctggagcagggccggcgctacgacgaggcgtgcaccatggccgggtacgaccacgccgcctcccggctcagccaccacggccagatcgtcgccaagacccagttcaacgcgctggtgacggagatcggcgagagcatcgccaaccccatcgcccgcaaggccctgatcgaggggctgaagcagatctgggcgatgcggaaccactggggcctccccgggtccatccacgtggagctggcccgcgacgtcggcaacagcatcgagaagcggcgcgagatcgagaagcacatcgagaagaacaccgccctgcgggcccgcgagcggcgcgaggtgcacgacctcctggacctggaggacgtgaacggggacaccctcctgcgctaccggctgtggaaggagcagggcggcaagtgcctctacaccgggaaggccatccacatccgccagatcgcggccacggacaactccgtccaggtggaccacatcctgccctggagccggttcggcgacgactccttcaacaacaagaccctgtgcctcgccagcgccaaccagcagaagaagcgctccaccccgtacgagtggctgagcgggcagaccggcgacgcctggaacgcgttcgtccagcggatcgagaccaacaaggagctgcgcggcttcaagaagcggaactacctcctgaagaacgccaaggaggccgaggagaagttccgctcccggaacctgaacgacacgcgctacgccgcccgcctcttcgcggaggccgtgaagctgctgtacgccttcggggagcggcaggagaagggcgggaaccggcgcgtgttcacccggcccggcgccctcaccgcggccctgcgccaggcctggggcgtcgagagcctgaagaagcaggacgggaagcggatcaacgacgaccgccaccacgccctcgacgccctgaccgtggcggccgtggacgaggccgagatccagcggctgacgaagtccttccacgagtgggagcagcagggcctcgggcgccccctgcgccgggtcgagcccccgtgggagagcttccgcgccgacgtggaggccacctaccccgaggtgttcgtcgcgcggcccgagcgccggcgcgcccggggcgaggggcacgccgccaccatccgccaggtgaaggagcgggagtgcacccccatcgtgttcgagcgcaaggccgtctccagcctgaaggaggcggacctcgagcggatcaaggacggcgagcgcaacgaggccatcgtggaggccatccggtcctggatcgccacggggcgcccggccgacgcgccgccccggagcccccgcggcgacatcatcaccaagatccggctggccaccaccatcaaggccgccgtgcccgtccgcggcgggacggcgggccgcggggagatggtgcgggccgacgtgttctccaagcccaaccggcgcggcaaggacgagtggtacctggtccccgtgtacccgcaccagatcatgaaccgcaaggcctggcccaagccgcccatgcggagcatcgtggccaacaaggacgaggacgagtggaccgaggtcgggcccgagcaccagttccgcttctccctctacccccggagcaacatcgagatcatccgccccagcggcgaggtgatcgagggctacttcgtggggctgcaccggaacaccggcgccctgaccatctccgcgcacaacgaccccaagagcatccactccgggatcggcacgaagaccctcctggccatcagcaagtaccaggtcgaccgcttcgggcggaagtccccggtgcgcaaggaggtgcggacctggcacggcgaggcctgcatcagccccaccccgcccggctga

SEQ ID NO: 1473 - RNA, 3153 nt, synthetic construct
  misc_feature 1..3153: note = Cas9 variant
  source 1..3153: mol_type = other RNA
atgaagatcctgggcttcgacatcgggatcgccagcatcggctgggccttcgtggagaacggggagctcaaggactgcggcgtccgcatcttcaccaaggcggagaaccccaagaccggggactccctggccatgccgcggcgcgaggcccggagcgtgcgccggcgcctggcccggcgcaagggccggctcgagacgctgaagcgcctgctcgccaaggagtgggacctgtgctacgaggactacatcgcggccgacggcgagctgcccaaggccttcatggggaagaacctcaacaacccctacgtgctgcggtacgaggccctgcagcgcctcctgtccaaggaggagctggtccgggtggtgctccacatcgcgaagcaccgcggctacgggaacaagaacgccaagatcaccaagagcgaggagtccaagcgggagcagggcaagatcctgagcgccctggccaccaacgcctccgcgatcgcccgctaccggaccgtcggggagtacttctacaaggagttctgcgaggtgatcaagaacccccagggcctcagcacgaacgagcactacacccagtccaaggtgcgcgtcctgaagccgatccggaacaagggcggggagtacaccaactgcatcctgcaggaggacctccagcgcgagctgcggtgcatcttcgagtaccagaagggcttcgggttccccatcacccaggagttccaggacaagatcctgaagatcgccttctaccagcgccccctcaaggacttcagccacctggtgggcaagtgcacgttctaccccgacgagttccgcgccctgaagtgctccctcagcgccgtggagttcatcaccctgtccaagaccatcaacgtcctgacctacatcagcaaggagtccggcgaggtgtacagcaaggggcagtacgagcagatgctcgactccgtgttcaaggcggtctgcgagaagggcagcctgtccttcgcccagctgcggaagatcctccacatcgacgagcgcatccggttcaaggaggtggactacatggcccgcaagagcaagaacacgagcggggactccacccacaagcagaagaccagcaacccggagaccaagaagttcatcgagcacaagaacctgaagaagttctgcgagatcctgtccgagatcgccgaggaccgggccctcgcggacagcatcgcccgcgacatgacgctgatcaaggacgaggagaagctggcccagaagctccacggctacgggaagttctcccaggagcagatcacccagctgagcgccctgaacttctcccaccacatcaacctcagcctgaaggccctgtccgagatcctccccttcatgcgggagggcatgcgctacgacgaggcgtgcaagctggccggcctgaaggcccggcacaacgacaagaagtccaagttcctcccgcccttctgcgagagcatctacgccgacgagctgaccaaccccgtggtccaccgcgcgatcgccgagtaccggaagatcctgaacgccctgatcgccaagtacgggagcgtgcacaagatccacatcgagctcacccgcgacgtgggcaagaacttccaggagcgggagaagtacaagaaggagatcgagtccaactacaaggcccgcgtccaggcgatgcaggagtgcgagaagctggggctgacgctcagcgagggcaacatcctgaagctgcgcctcttccgggagcagaacgagatctgcgtgtactccgggcggaagatcaccctggccaacctgaaggagcagggcgccctcgagatcgaccacatcctgccctacagccgctccagcgacgactcctacatgaacaaggtgctggtcttcaccaacgagaaccagaacaagggcaacaagaccccctacgaggccttcgggggcgacagccagaagtggggcgagatcgagagcctcgccctgcggtccgggtaccccaagaagaaggcgaagcgcatcctggacaaggggttcggcgaccgcgaggccggcttcaagagccggaacatcgtggactccgggtacatcgcccgcctcatcgccaactacacgaaggagtacctgaagttcctgccgctcgacagccacgagaacaccgccctgatcgcgggcgagaaggactccaagatccacgtcgaggccgtgaaggggatgctgaccgccaccatgcggcacttctggggcctcggcagcaagaaccgctacgagcacacgcaccacgccgtggacgcgatcatcatcgcctacatcaacgccgccatgatccagcggttctcccagttccgccagaaccaggagagcctgaaggcccggttctacgcgaaggagctggccaaggaggagttcaagacccagcgcgccttcttcgagcccttccgggggttccgcgagcaggtcctcgccaaggtgggccagatcttcgtgtcccggccgccccgcaagcgggcccgcggggcgctgcacgaggagaccttctacagcatcgacgacaagaagctgtccgagacctacggcgggaaggagggcgtccagcgggccctcagcctgggcaagatccgccagatcgggacgaagatcgtggccaacggccccatggtgcgggtcgacatcttcaagcacaagcagtcccgccggttctacgccgtgcccatctacaccatggacttcgccctggggatcctccccaacaaggcggtggtcagcggcaaggacaccaagtccaaggtgatcaaggactggctggagatggacagctgctacgagttctgcttctccctgttcaaggacgacctcatcgaggtgcagaagtccgacatggagaagcccgagctggcctacttcgtcagcctggacgccagcgacgggcgcatcaaggtgcggcaccactgcaacgacatcaccaagatcaacgagaaccagaagaagctgttcagcgaggccatcgagaaggaggtggtcggccgcggctccatccagaacctcaaggtgttcaagaagtacaaggtgagcccgctgggggagatcaaggaggcgaagtacgagccccgccagcccatcgccctcaagacgtcccccaagaagcaccggaagcagaacaacgcccagtga

SEQ ID NO: 1474 - RNA, 3156 nt, synthetic construct
  misc_feature 1..3156: note = Cas9 variant
  source 1..3156: mol_type = other RNA
atgaacaactacatcctgggcctcgacatcgggatcaccagcgtgggctacgggatcgtcgactccgacacccgcgagatcaaggacgccggcgtgcggctgttccccgaggccaacgtggacaacaacgaggggcgccggagcaagcgcggcgcccggcgcctgaagcggcgccggatccaccgcctcgaccgggtcaagcacctcctggccgagtacgacctcctggacctgacgaacatcccgaagtccaccaacccctaccagacccgcgtgaagggcctcaacgagaagctgagcaaggacgagctggtgatcgccctcctgcacatcgccaagcggcgcgggatccacaacgtcaacgtgatgatggacgacaacgactccggcaacgagctgagcaccaaggaccagctcaagaagaacgccaaggcgctgtccgacaagtacgtgtgcgagctgcagctcgagcggttcgagcaggactacaaggtccgcggggagaagaaccggttcaagacggaggacttcgtgcgcgaggcccggaagctgctggagacccagagcaagttcttcgagatcgaccagaccttcatcatgcgctacatcgagctcatcgagacccggcgcgagtacttcgagggccccgggaagggctcccccttcggctgggaggggaacatcaagaagtggttcgagcagatgatgggccactgcacgtacttcccggaggagctgcgcagcgtgaagtactcctacagcgccgagctgttcaacgccctcaacgacctgaacaacctggtcatcacccgggacgaggacgcgaagctcaactacggggagaagttccagatcatcgagaacgtgttcaagcagaagaagacccccaacctgaagcagatcgccatcgagatcggcgtgcacgagaccgagatcaagggctaccgcgtcaacaagtccgggaagcccgagttcacgcagttcaagctgtaccacgacctcaagaacatcttcaaggaccccaagtacctgaacgacatccagctgatggacaacatcgccgagatcatcaccatctaccaggacgccgagagcatcatcaaggagctcaaccagctgccggagctgctctccgagcgggagaaggagaagatcagcgccctgtccggctacagcgggacccaccgcctgtccctcaagtgcatcaacctgctgctcgacgacctgtgggagagcagcctgaaccagatggagctgttcaccaagctgaacctgaagcccaagaagatcgacctctcccagcagcacaagatccccagcaagctggtggacgacttcatcctgtcccccgtggtcaagcgggcgttcatccagagcatccaggtggtgaacgccatcatcgacaagtacggcctgccggaggacatcatcatcgagctcgcccgcgagaacaactccgacgaccggcgcaagttcctgaaccagctgcagaagcagaacgaggagacgcggaagcaggtcgagaaggtgctccgcgagtacgggaacgacaacgccaagcggatcgtgcagaagatcaagctgcacaacatgcaggagggcaagtgcctgtacagcctcaaggacatccccctggaggacctgctccgcaacccccaccactacgaggtcgaccacatcatcccccggtccgtggccttcgacaacagcatgcacaacaaggtcctggtgcgcgcggacgagaactccaagaagggcaaccggaccccgtaccagtacctgaacagctccgagagctccctcagctacaacgagttcaagcagcacatcctgaacctgtccaagaccaaggaccgcatcaccaagaagaagcgggagtacctcctggaggagcgcgacatcaacaagttcgacgtgcagaaggagttcatcaaccggaacctggtcgacacgcgctacgccacccgcgagctcaccagcctgctgaaggcctacttctccgccaacaacctcgacgtgaaggtgaagaccatcaacgggagcttcacgaactacctgcggaaggtctggaagttcgacaaggaccgcaacaagggctacaagcaccacgccgaggacgcgctgatcatcgccaacgccgacttcctcttcaagcacaacaagaagctgcggaacatcaacaaggtgctggacgccccctccaaggaggtggacaagaagcgcgtcaccgtgcagagcgaggacgagtacaaccagatcttcgaggacacccagaaggcccaggcgatcaagaagttcgagatccggaagttcagccaccgcgtggacaagaagcccaaccggcagctcatcaacgacaccctgtactccacgcgcaacatcgacgggatcgagtacgtcgtggagagcatcaaggacatctactccgtgaacaacgacaaggtcaagaccaagttcaagaaggacccccaccggctgctcatgtaccgcaacgacccgcagaccttcgagaagttcgagaaggtgttcaagcagtacgagagcgagaagaaccccttcgccaagtactacgaggagaccggcgagaagatccggaagttctccaagacggggcagggcccctacatcaacaagatcaagtacctgcgcgagcggctgggccgccactgcgacgtgaccaacaagtacatcaacagccggaacaagatcgtccagctcaagatctactcctaccgcttcgacatctaccagtacgggaacaactacaagatgatcaccatcagctacatcgacctggagcagaagtccaactactactacatcagccgggagaagtacgagcagaagaagaaggacaagcagatcgacgactcctacaagttcatcggcagcttctacaagaacgacatcatcaactacaacggggagatgtaccgcgtgatcggcgtgaacgactccgagaagaacaagatccagctggacatgatcgacatcagcatcaaggactacatggagctcaacaacatcaagaagaccggggtcatctacaagacgatcggcaagtccaccacccacatcgagaagtacaccaccgacatcctgggcaacctgtacaaggccgcgcccccgaagaagccccagctcatcttcaagtga

SEQ ID NO: 1475 - RNA, 3159 nt, synthetic construct
  misc_feature 1..3159: note = Cas9 variant
  source 1..3159: mol_type = other RNA
atggagaacaagaacctgcactacatcctcggcctggacctggggatcgccagcgtgggctgggccgtcgtggagatcgacgagaaggagaaccccctccgcctgatcgacgtgggggtccggaccttcgagcgcgcggagacccagaagggcgagtccctggccctcagccggcgctccgcccggagcgcccgccggctgacgcagcgccgggtggcccgcctgaagaaggcgaagcggctcctgaagtccgagaacatcctgctcagcaccgacgagcgcctgccgcaccaggtgtggcagctgcgggtcgaggggctcgaccgcaagctggagcggcaggagtgggccgccgtgctgctccacctgatcaagcaccgcggctacctgtcccagcggaagaacgagagcaagtccgagaacaaggagctcggcgccctgctgagcggggtggcgtccaaccacgagctcctgcagcaggccacctaccgcacccccgccgagctggccgtcaagaagttcgaggtggaggagggccacatccggaaccagcagggggcctacacgcacaccttcagccgcctcgacctgctggcggagatggagctcctgttctcccggcagcagcacttcggcaaccccttcgccagcgagaagctgctcgagaacctgaccgccctgctcatgtggcagaagcccgccctgtccggggaggacatcctgaagatgctcggcaagtgcaccttcgaggacgagtacaaggccgcgaagaacacgtacaccgccgagcgcttcgtgtggatcaccaagctgaacaacctgcgcatccaggagaacggcctcgagcgggccctgagcgacaacgagcgcctgatgctcatcgagcagccgtacgagaaggccaagctgacctacgcccaggtccggtccatcctgaacctcagcgacgacgcgatcttcaagggggtgcgctactccggcgaggacaagaaggccatcgagacgaagaccaccctgatggagatgaaggcctaccaccagatccggaaggtgctggaggggaacaacctgaaggccgagtgggtcgccctcaaggcgaaccccaccctgctggacgagatcggcacggccttcagcctctacaagaccgacgaggacatcagcgcctacctggccggcaagctgtcccagcccgtgctcaacgcgctgctggagaacctcagcttcgacaagttcatccagctgtccctgaaggccctctacaagctgctgcccctcatgcagcaggggctgcgctacgacgaggcctgccgggagatctacggcgaccactacgggaagaagaccgaggagacccaccacttcctgccgcagatccccgccgacgagatccgcaaccccgtggtcctccggacgctgacccaggcccgcaaggtgatcaacggcgtggtccggctgtacgggagccccgcgcgcatccacatcgagaccggccgggaggtgggcaagtcctacaaggaccgccacgagctcaagaagcggcaggaggagaaccgcaagcagcgggagaagaccatcagcgagatcaagacgctgttcccgaacttctccggggagcccaagggcaaggacatcctgaagatgcgcctctactaccagcagaacgccaagtgcctgtacagcgggaagcccctggagctccaccggctgttcgagcagaagtacgtggaggtcgaccacgccctgcccctctcccgcacctgggacgacagcttcaacaacaaggtgctggtcctggccaacgagaaccagaacaagggcaacctcaccccgttcgagtggctggacgggaagaacaactccgagcgctggcggaccttcaaggccctggtggagacgagcgcgttcccctacgccaagaagcagcgcatcctctcccagaagctggacgagaagggcttcatcgagcggaacctgaacgacacccgctacgtggcccggttcctctgcaacttcatcgccgacaacatgcacctgaccggcgaggggaagcgcaaggtcttcgccagcaacggccagatcaccgcgctgctccggcgccggtgggggctggccaagtcccgcgaggacaacgaccggcaccacgccctggacgccgtgctcgtggcgtgcagcacggtcgccatgcagcagaagatcacccgcttcgtgcggttcaaggccggcgacgtgttcaccggggagcgcatcgaccgggagaccggcgagatcatccccctgcacttccccacgccgtggcagttcttcaagcaggaggtcgagatccgcatcttctccgacaaccccaagctggagctcgagaaccggctgcccgaccgcccccaggccaaccacgagttcgtgcagccgctgttcgtgagccggatgcccacccgcaagatgaccggccaggggcacatggagaccgtcaagtccgccaagcggctcaacgagggcatcagcatgatcaagatgcccctgaccaagctgaagctcaaggacctggagctgatggtgaaccgcgagcgcgagaaggacctctacgacgcgctgaagacgcggctggaggccttcaacgacgaccccgccaaggccttcgccgagccgttcatgaagaagggcggggcgatcgtcaagagcgtgcgcgtggagcaggtccagaagtccggcgtgctcgtgcggcaggggaacggcgtggccgacaacgccagcatggtccgcgtggacgtgttcaccaaggacgggaagtacttcctggtccccatctacacctggcaggtcgccaagggcatcctgcccaacaaggccgtgatccaggggaaggacgaggaggactgggaggacatcgacgacgcgaccttccagttctccctccacccgaacgacctgatcagcgtgaagacgaagaaggacgagttcctgggctacttcaacggcctcaaccggcacaccgggggcatcaacatccgcacccacgacctggagaagtccaaggggaagcagggcatcttcgaggggatcggcgtgaagatcgccctgagcttcgagaagtaccagatcgacgagctcggcaagaacatccggctgtgcaagccctccaagcgccagcccgtgcggtga

SEQ ID NO: 1476 - RNA, 3159 nt, synthetic construct
  misc_feature 1..3159: note = Cas9 variant
  source 1..3159: mol_type = other RNA
atgaagaacaccagcctgaactacgtgctcggcctggacctggggatctccagcgtcggctgggccgtggtggagatcgacgagaaggagaaccccctctccctgatcgacgtcggggtgcgcaccttcgagcgggccgagacgcagaagggcgagagcctggcgctcgcccgccggctggcccgctccgcccggcgcctgacccagcggcgcgtggcccggctcaagaaggcgaagcgcctgctcaagagcgagaacatcctgctgtccaccgacgagtgcctgccgcaccaggtctggcagctccgggtggaggggctggagcgcaagctggagcggcaggagtgggccgccgtgctcctgcacctgatcaagcaccgcggctacctcagccagcggaagaacgagtccaagagcgagaacaaggagctgggcgccctgctctccggggtcgcgaacaaccacaagctgctgcagcagaccacgtaccgcacccccgccgagctcgccgtgaagaagttcgaggtggaggagggccacatccggaaccagcaggggagctacacccacaccttctcccgcctggacctgctcagcgagatggagctgctgttctcccggcagcagcacttcggcaaccccttcacgagcgagaagctcctggagaacctgaccgccctcctgatgtggcagaagcccgccctgtccggggacgcgatcctcaagatgctgggcaagtgcaccttcgagaacgagtacaaggccgccaagcacacctacagcgccgagcgcttcatctggatcacgaagctgaacaacctccggatccaggagaacggcctggagcgcgccctgaacgacaacgagcgcctcgcgctgatgaagcagccgtacgagaaggccaagctgacctacgcccaggtccggtccatcctcaacctgagcgacgaggccatcttcaaggggctgcgctacagcggcgaggacaagaagacctccgagaccaagacggtgctgatggagatgaaggcctaccaccagatccggctcgcgctggagaagaacgacctgaagaccgagtgggccgagctcaaggtgaacagctccctgctggacgagatcgggaccgccttcagcctctacaagaccgacgaggacatctccacgtgcctggccggcaagctgagccagcccgtcctcaacgccctgctggagaacctcaacttcgacaagttcatccagctgtccctgaaggcgctccacaagatcctgcccctgatgcagcagggcctccgctacgacgaggcctgcgccgagatctacggggaccactacggcaagaagaccgaggagaaccacctcctgctgccccagatcccggccgacgagatccggaaccccgtggtgctgcgcaccctgacccaggcgcggaaggtcatcaacggggtggtgcgcctctacagctcccccgcccggatccacatcgagacgggccgcgaggtcggcaagagctaccaggaccggcgcgagctggagaagcggcaggaggagaaccgcaagcagcgggagaaggccatctccgagatcaagaccctgttccccaacttcagcggggagccgaaggccaaggacatcctcaagatgcgcctgtactaccagcagaacgccaagtgcctgtactccggcaagcccctcgagctgcaccggctgctcgagcaggggtacgtggagatcgaccacgcgctgcccttcagccgcacctgggacgactccttcaacaacaaggtgctggtcctcgccaacgagaaccagaacaagggcaacctgacccccttcgagtggctggacgggaagaacaacagcgagcggtggaaggccttcaaggccctcgtggagacgtccgccttcccgtacaccaagaagcagcgcatcctgagccagaagctggacgagaagggcttcatcgagcgcaacctcaacgacacccggtacgtcgcgcgcttcctgtgcaacttcatcgccgacaacatgcacctgaccggggagggcaagcggaaggtgttcgcctccaacggccagatcacggccctcctgcgcgggcggtggggcctggccaagagccgcgaggacaacgaccggcaccacgcgctcgacgccgtggtcgtggcctgcagcaccgtgtccatgcagcagaagatcacccgcttcgtccggttcgaggaggggaacgtgttcaccggcgagcgcatcgaccgggagacgggggagatcatccccctgcacttccccgccccctggaagttcttccgcgaggaggtggagatccggatcttcagcgacaacccgaagctggagctcgagaaccgcctgatcgcgcggccccaggccaaccacgagttcgtccagcccctgttcgtgtcccgcatgcccacccggaagatgaccggccagggccacatggagaccatcaagagcgccaagcgcctcaacgaggggctgtccgtgatcaagatgctgctcaccaagctgcggctgaaggacctcgagagcatggtcaaccgcgagcgggagaaggagctgtacgaggccctgaaggcccgcctcgaggcgttcaacgacgagccggccaaggccttcgccgagcccttcatgaagaagggcggggccatcgtgaagtccgtgcgcgtcgagcaggtccagaagtccggcgtgctggtgcgggacggcaacggggtggcggacaacgccagcatggtgcgcgtcgacgtgttcacgaagggcgggaagtacttcctggtgcccatctacacctggcaggtcgccaagggcatcctccccaacaaggccgtgatccaggggaagaacgaggaggactgggaggtgatggacgacgccaccttccggttcagcctgcaccagaacgacctggtcaagctcgtgaccaagaagaagacgatcttcggctacttcaacggcctgaaccgcgcgaccgggaacatcgacatcaaggagcacgacctggagaagtccaaggtgaaggacggcatccaccagagcatcgggatcaagctcgccctgtccttcgagaagtaccaggtcgacgagctgggcaagaacatccggctctgcaagagctccaagcgccaggccgtgcggtga

SEQ ID NO: 1477 - RNA, 3159 nt, synthetic construct
  misc_feature 1..3159: note = Cas9 variant
  source 1..3159: mol_type = other RNA
atgatcggcgagcacgtgcgcgggggctgcctgttcgacgaccactggacccccaactggggcgccttccggctccccaacaccgtccgcacgttcaccaaggccgagaaccccaaggacgggagctccctggcggagccccggcgccaggcccgggggctgcgccggcgcctccggcgcaagacccagcggctggaggacctgcgccggctcctggccaaggagggcgtgctgagcctctccgacctggagaccctgttccgcgagacgcccgccaaggacccgtaccagctccgggccgagggcctggaccgccccctgagcttccccgagtgggtgcgggtcctctaccacatcaccaagcaccgcgggttccagtccaaccggcgcaaccccgtggaggacggccaggagcggagccgccaggaggaggaggggaagctgctgtccggcgtgggggagaacgagcgcctcctgcgggagggcggctaccgcaccgcgggggagatgctggcccgggacccgaagttccaggaccaccgccggaaccgcgccggcgactacagccacaccctctcccggagcctgctgctcgaggaggcccgccggctgttccagtcccagcgcacgctggggaacccccacgcgagctccaacctcgaggaggccttcctgcacctggtcgccttccagaaccccttcgccagcggcgaggacatccggaacaaggccggccactgctccctcgagcccgaccagatccgcgcgccgcggcgcagcgcctccgccgagaccttcatgctgctgcagaagaccgggaacctccggctgatccaccgccggaccggcgaggagcgccccctgacggacaaggagcgggagcagatccacctcctggcctggaagcaggagaaggtgacccacaagaccctgcgccgccacctcgagatccccgaggagtggctgttcaccgggctgccctaccaccggagcggcgacaaggccgaggagaagctgttcgtgcacctcgcggggatccacgagatccgcaaggccctggacaagggcccggaccccgccgtctgggacacgctccggtcccgccgggacctgctggacagcatcgccgacaccctcaccttctacaagaacgaggacgagatcctgccccgcctggagagcctgggcctctcccccgagaacgcccgggcgctggccccgctgagcttctccgggaccgcccacctcagcctgtccgccctgggcaagctcctgccccacctggaggagggcaagagctacacgcaggcccgcgcggacgccgggtacgccgccccgccgcccgaccggcaccccaagctcccgcccctggaggaggcggactggcgcaaccccgtggtgttccgggccctgacccagacccgcaaggtcgtgaacgccctcgtgcggcgctacgggccgccctggtgcatccacctggagaccgcccgggagctgtcccagcccgccaaggtccgccggcgcatcgagacggagcagcaggcgaacgagaagaagaagcagcaggccgagcgggagttcctcgacatcgtgggcaccgcccccggccccggggacctgctgaagatgcgcctctggcgggagcagggcgggttctgcccctactgcgaggagtacctgaaccccacccgcctggccgagcccggctacgccgagatggaccacatcctcccctacagccgctccctggacaacgggtggcacaaccgggtgctggtccacggcaaggacaaccgcgacaagggcaaccggacccccttcgaggcgttcgggggcgacacggcccgctgggaccggctcgtggcctgggtgcaggccagccacctgtccgccccgaagaagcgcaacctgctccgggaggacttcggggaggaggcggagcgcgagctgaaggaccggaacctgaccgacacccgcttcatcaccaagacggccgccaccctcctgcgggaccgcctgaccttccaccccgaggcccccaaggaccccgtcatgaccctcaacggccggctgacggcgttcctgcgcaagcagtggggcctccacaagaaccggaagaacggggacctgcaccacgccctggacgccgccgtgctcgccgtggcgagccgctccttcgtctaccggctgagctcccacaacgccgcctggggcgagctgccgcgcgggcgggaggccgagaacggcttcagcctcccctaccccgccttccgctccgaggtgctggcgcgcctgtgccccacccgggaggagatcctcctgcgcctggaccagggcggggtcggctacgacgaggccttccggaacgggctccgcccggtgttcgtgagccgggccccctcccgccggctgcgcggcaaggcccacatggagaccctgcggagccccaagtggaaggaccaccccgaggggccgcgcaccgccagccggatccccctcaaggacctgaacctggagaagctcgagcgcatggtcggcaaggaccgggaccgcaagctgtacgaggcgctgcgggagcgcctcgccgccttcgggggcaacggcaagaaggccttcgtggcgcccttccggaagccctgccgctccggggagggcccgctggtgcggagcctgcgcatcttcgactccgggtacagcggcgtcgagctccgggacgggggcgaggtgtacgccgtggccgaccacgagtccatggtccgcgtggacgtgtacgccaagaagaaccgcttctacctggtccccgtgtacgtggccgacgtcgcgcggggcatcgtgaagaaccgcgccatcgtggcccacaagagcgaggaggagtgggacctggtcgacgggtccttcgacttccggttcagcctcttccccggcgacctggtggagatcgagaagaaggacggggcctacctgggctactacaagtcctgccaccgcggggacggccggctcctgctggaccgccacgaccggatgccgcgcgagagcgactgcggcaccttctacgtgtccacgcggaaggacgtcctcagcatgtccaagtaccaggtggaccccctgggggagatccgcctggtgggcagcgagaagccgcccttcgtcctctga

SEQ ID NO: 1478 - RNA, 3162 nt, synthetic construct; identical to SEQ ID NO: 1382
  misc_feature 1..3162: note = Cas9 variant
  source 1..3162: mol_type = other RNA

SEQ ID NO: 1479 - RNA, 3162 nt, synthetic construct
  misc_feature 1..3162: note = Cas9 variant
  source 1..3162: mol_type = other RNA
atgaagcgcaactacatcctgggcctcgacatcgggatcaccagcgtgggctacgggatcatcgactacgagacccggaacgtcatcgacgcgggcgtgcgcctgttcaaggaggccaacgtggagaacaacgaggggcggcgctccaagcggggcacgcgccggctgaagcgccggcgccggcaccgcctccagcgggtcaagaagctgctgttcgaccacaacttcctcaccgacaacagcgagctgtccggcatcagcccctacgaggcgcgcgtgaaggggctgaaccagaagatctccgaggaggagttcagcgtggccctcctgcacctggccaagcggcgcggcgtccacaacgtgaacgaggtggaggaggacaccgggaacgagctctccaccaaggagcagatcagccggaactccaaggccctggaggagaagtacgtcgccgagctgcagctcgagcgcctgaaggtggacggcgaggtgcgcggggcggtcaaccggttcaagacgagcgactacgtgaaggaggcccagcagatcctgaaggtgcagaaggcctaccaccagttcgaccagtccttcatcgacacctacatcgacctcctggagacccggcgcacctactacgagggcccgggcgaggggagccccttcggctggaaggacatcaaggagtggtacgagatgctgatggggcagtgcacgtacttccccgaggagctccgctccgtcaagtacgcctacaacgcggacctgtacaacgccctgaacgacctcaacaacctggtgatcgcccgggacgagaacgagaagctggagtactacgagaagttccagatcatcgagaacgtgttcaagcagaagaagaagcccaccctcaagcagatcgccaaggagatcctggtcaacgaggaggacatcaagggctaccgcgtgaccagcaccggcaagccggagttcacgaacttcaaggtgtaccacgacatcaagtccatcaccagccggaaggagatcctggagaacgccgagctcctgaaccagatcgcgaagatcctgaccatctaccagtccagcgaggacatccagggggagctcgcccgcctgtactccgagctgacccaggaggagatcgagcagatcagcaagctcgccggctacacggggacccaccggctgagcctgaaggccatcaacctcatcatcgacgagctgtggcacacctccgacaaccagatggagatcttcaaccgcctgaagctcgtccccaagaaggtggacctgagccagcagaaggagatccccaccacgctggtggacgacttcatcctctcccccgtcgtgaagcggagcttcatccagtccatcaaggtcatcaacgccatcatcaagaagtacggcttcccgaacgacatcatcatcgagctggcgcgcgagaagaacagcaaggacgcccagaagttcatcaacgagatgcagaagcggaaccgccagaccaacgagcggatcgaggagatcatccgcaccaccgggaaggagaacgccaagtacctgatcgagaagatcaagctccacgacatgcaggagggcaagtgcctgtactccctggaggccatccccctggaggacctcctgaacaaccccttcaactacgaggtggaccacatcatcccccggagcgtgtccttcgacaacagcttcaacaacaaggtcctggtgaagcaggaggagaactccaagaagggcaaccgcacgccgttccagtacttcagctccagcgactccaagatcagctacgagatcttcaagaagcacatcctcaacctggccaaggggaagggccggatctccaagaagaagaaggagtacctgctcgaggagcgcgacatcaaccggttcagcgtgcagaagtacttcatcaaccgcaacctggtcgacacccggtacgcgacccgcgagctgatgaacctcctgcgctcctacttccgggtgaacgacctggacatcaaggtcaagagcatcaacgggggcttcaccagcttcctccgcaagaagtggaagttcaagaaggagcggaacaaggggtacaagcaccacgccgaggacgccctgatcatcgccaacgccgacttcatcttcaaggagtggaagaagctggacaagacgaacaaggtgatggaggaccagatcgtggaggagcagcaggcggagtccatgcccgagatcgagaccgagcaggagtacaaggagatcttcatcacgccccaccagatccaggacatcaaggacttcaaggactacaagtacagccaccgcgtggacaagaagcccaaccgggagctcgtcaacgacaccctgtactccacccgcaaggacgacaagggcaacaccctgatcgtgaacaacctcaagggcctgtacgacaaggacaacgacaagctgaagaagctcatcaacaagagcccggagaagctgctgatgtaccaccacgacccccagacctaccagaagctcaaggtgatcatggagcagtactccaacgagaagaaccccctgtacaagtaccacgaggagaccgggaactacctgacgaagtacagcaagaaggacaacggccccgtcatcaagaagatcaagtactacgggaacaagctcaacgtgtacctggacatcacccgggactacctgaagtcccgcaacaagatcgtgaagctcagcctgaagccgtaccggttcgacgtctacctggacaacggcgtgtacaagttcgtgaccgtcaagaacctcgacatcatcaagaaggaggactactacgaggtggactccgacagctacgaggaggccaagatcgtgaagaaggtctccgagcaggcccagttcgtggccagcttctacaacaacgacctgatcaaggtggacggggagctgttccgcgtcatcggcgtgaacaacgacctcctgaaccggatcgaggtgaacatggtcgacatcacctacaaggagtacctggagaacatcaacgacaagaagtccagccgcatcatcaagaccatctccagcaagacgcagtccatcaagaagtacagcaccgacatcctcggcaacctgtacgaggccaagagcaagcagcggccccagatgaccatgaaggggtga

SEQ ID NO: 1480 - RNA, 3162 nt, synthetic construct
  misc_feature 1..3162: note = Cas9 variant
  source 1..3162: mol_type = other RNA
atgaagcgcaactacatcctgggcctcgacatcgggatcaccagcgtgggctacgggatcatcgactacgagacccgggacgtcatcgacgccggcgtgcgcctgttcaaggaggccaacgtggagaacaacgaggggcggcgctccaagcggggcgcgggccgcctgaagcggcgccggcgccaccggctccagcgcgtcaagaagctgctgttcgactacaacctcctgacggaccacagcgagctgtccgggatcaacccctacgaggcccgggtgaagggcctcagccagaagctgtccgaggaggagttcagcgccgccctgctccacctggccaagcgccgcggggtgcacaacgtcaacgaggtggaggaggacaccggcaacgagctgtccaccaaggagcagatcagccggaactccaaggcgctcgaggagaagtacgtggccgagctgcagctggagcggctcaagaccgacggggaggtccgcggcagcatcaaccggttcaagacgtccgactacgtgaaggaggccaagcagctgctgaaggtgcagaaggagtaccaccagctcgaccagagcttcatcgacacctacatcgacctgctggagacccgccggacctactacgagggcccgggggagggctcccccttcgggtggaaggacatcaaggagtggtacgagatgctcatgggccactgcacgtacttccccgaggagctgcgcagcgtcaagtacgcctacaacgcggacctgtacaacgccctcaacgacctgaacaacctggtgatcgcccgcgacgagaacgagaagctcgagtactacgagaagttccagatcatcgagaacgtgttcaagcagaagaagaagcccaccctgaagcagatcgagaaggagatcctggtcaacgaggaggacatcaagggctaccgggtgacctccaccgggaagccggagttcagcaacctcaaggtgtaccacgacatcaaggacatcacggcccgcaaggagatcatcgagaacgccgagctgctggaccagatcgcggagatcctcaccatctaccagtccagcgaggacatccaggaggagctggtcaagctgaactccgagctcacccaggaggagatcgagcagatcagcaacctgaagggctacaccgggacgcacaacctgagcctcaaggccatcaacctgatcctggacgagctctggcacaccaacgacaaccagatggccatcttcaaccggctgaagctggtgcccaagaaggtggacctctcccagcagaaggagatccccaccaccctggtcgacgacttcatcctgagccccgtggtgaagcgctccttcatccagagcatcaaggtcatcaacgccatcatcaagaagtacggcctgccgaacgacatcatcatcgagctcgcccgggagaagaactccaaggacgcgcagaagatgatcaacgagatgcagaagcgcaaccggcagacgaacgagcgcatcgaggagatcatccggaccaccgggaaggagaacgccaagtacctgatcgagaagatcaagctgcacgacatgcaggagggcaagtgcctctacagcctggaggccatccccctggaggacctcctgaacaaccccttcaactacgaggtggaccacatcatcccccgctccgtcagcttcgacaactccttcaacaacaaggtgctggtgaagcaggaggagaacagcaagaagggcaaccggaccccgttccagtacctctccagctccgacagcaagatctcctacgagacgttcaagaagcacatcctgaacctggccaaggggaagggccgcatcagcaagaccaagaaggagtacctcctggaggagcgggacatcaaccgcttctccgtccagaaggacttcatcaaccggaacctggtggacacccgctacgccacccgggagctcatgaacctgctgcgcagctacttccgggtgaacaacctcgacgtcaaggtgaagtccatcaacgggggcttcacgagcttcctgcgccgcaagtggaagttcaagaaggagcggaacaaggggtacaagcaccacgcggaggacgccctgatcatcgccaacgccgacttcatcttcaaggagtggaagaagctcgacaaggccaagaaggtgatggagaaccagaccgtcgaggagaagcaggcggagagcatgtccgagatcgagaccgagcaggagtacaaggagatcttcatcacgccccaccagatccagcacatcaaggacttcaaggactacaagtacagccaccgcgtggacaagaagcccaaccgggagctgatcaacgacaccctgtactccacccgcaaggacgacaagggcaacaccctcatcgtgaacaacctgaacggcctgtaccacaaggacaacgacaagctcaagaagctgatgaacaagagccccgagaagctgctcatgtaccaccacgacccgcagacctaccagaagctgaagctgatcatggagcagtacggggacgagaagaaccccctctacaagtactacgaggagacgggcaactacctgaccaagtactccaagaaggacaacgggcccgtcatcaagaagatcaagtactacggcaacaagctgaacgcccacctcgacatcaccgacgactaccccaacagccggaacaaggtggtgaagctgtccctgaagccgtaccgcttcgacgtctacctcgacaacggggtgtacaagttcgtgaccgtcaagaacctgaacgtgatcaagaaggagaactactacgaggtgaacagcaagtgctacgagaaggccaagaagctgaagaagatctccgaccaggccgagttcatcgcgagcttctacaacaacgacctcatcaagatcgacggcgagctgtaccgggtcatcggcgtgaacaccgacctgatcaaccgcatcgaggtgaacatggtcgacatcacgtaccgggagtacctcgagaacatgaacgacaagcgcagcccccggatcttcaagaccatcgcctccaagacccagtccatcaagaagtacagcaccgacatcctggggacgctgtacgaggtgaactccaagaagcacccccagatgatcatgaagggctga

SEQ ID NO: 1481 - RNA, 3162 nt, synthetic construct
  misc_feature 1..3162: note = Cas9 variant
  source 1..3162: mol_type = other RNA
atgagcggcatggtgttcgggatcgacctgggcatcgcctcctgcgggtgggccgtcctccgccagccccagcgggacggcgacccgggggagatcgtggacctgggcagctggatgttcgacgtgcccgagaccgacaaggagcgcacccccacgaaccaggtccggcgcggcaaccggctgctccgccgggtgatccgccggcgcgcgcagcggatggtggagatccgccggctgttccacgaccacgggctgctcgccggccacgcccccgaggccctgaagcgcgccgggctggacccgtgggacctccgggcgcgctccctggacaaggtcctggagcccgccgccctcgccgtggcgctgggccacatcgccaagcggcgcgggttcaagagcgccgcccggcgcaaggaggccaacaccgcgggcgacgaccagaagatgctgaaggccctcgaggccacccacgagcggctgggccgctaccgcaccatcggggagatgttcgcccgggaccccgacttcgagtcccgcaagcggaaccgcgacggcatgttcgaccggacgcaggggcgcgacgacctgctccacgaggtgggcgagatcttcaaggcccagcggcgcctgggcagcgcgctggccaccgccgagctcgagcaggccttcaccgccatcgcgttccggcagctgcccatccaggactccgagcgcctggtcgggctctgccagttcgagccgaaggagaagcgggccgcccgcttcgcccccagcttcgagcggttccgcctgctgcagcggctcaccaacctgcgcgtggtgacggtcgagggcgagcggcccctgaccgccgacgagatcgcggccgccgccgcggacctcgggcgcaccgccaagctgtccgtgaaggaggtgcggaagcgcatcggcctggccgccgaccaccgcttcgccgcgttcaaggccgacgaggaggaccgggacatcatcgcccgcaccggggaggccctccacggcacgtaccggctgcgcaaggccctgggcgaggggctctgggcggagatgctgcccggccagctggacgccatcgcccacgccctcagcttcttcgagacccaggacgtcatcctgaaggagctggacaagctcgacctgccggccggggtgcgggacgcgatcgccaccggcctggacgccggggccttcgcgcgcttcaagggcaccggccacatctccgcccgggccgcccgcgccctcctgccccacctggaggcggggctccggtacgaccaggcctgcacgaaggccggctacgaccacgccgccagccgctgggcgaagcgggagcaggtcgccgacaaggccgccttcaaccgcctggtgaccgacatgggggccgagatcgcgaaccccatcgcccggaagtccctgaccgaggccctgaagcagctctgggccatgcgcaaccggtggggcctgcccgacgcgatccacatcgagctggcccgcgacgtggggaacagcctcgagaagcggcgcgagatcgagcgggccatcgagaagaacaccgccgcccgcgagcgggagcgcggcgaggcgcgcgacctgctgggcatcgacgacgtgtccggggacacgctcctgcggtaccgcctgtggaaggagcaggccggccggtgcccgtacaccgacgcccccatcccgcccggggccatcatcgccaccgacaacagcttccaggtcgaccacatcctcccgtggtcccgcttcggcgacgacagcttcgcgaacaaggtgctgtgcgccaccgccgccaaccagcggaagaagggccagacgccctgcgagtggatcaccgccgcgcagggggaggagggctgggccaccttcgtggcccgcatcgaggggaacgccgccttccggggccccaagaagcgcaactacgtcctgaagaacgcgaaggaggccgaggagcggttccgcgcccggaacctcaacgacacccgctacgccgcgcggctgctggccgaggccgtgaagctgttctaccccgagggggagcgccaggacaagggcggcgtccggcgcgtgttcacgcggcccgggggcctcaccgccgccctgcgccacgcgtggggcgtggaggccctcaagaagcgggacgggaagcgcgtcgacgacgcccgccaccacgccctggacgccctggtggtggcggccatcggggagggcgaggtccagcggctcacccgctcctaccaggagtgggagcagcagggcctggcccggcccctgcgccgggtggacccgccctggggcgacttccacagcttccgccgggaggtgaaggacgcctacgacgggatcttcgtcgcccgccccgagcggcgccgggcgcgcggggagggccacgccgccaccatccgccaggtgcgggagcgggacggggccgcggtggtcttcgagcgcaaggccatcgccgacctcagcgagaagcggctggccgacatcaaggaccccgagcgcaaccaggccatcgtggaggcgatccggcagtggatcgtggacggccgccccgccgaccggctgccgcgctcccccgccggcgacgagatccgcaaggtccggctccgcacgaaggggaagcccgccgtccaggtgcggggcggggccgcggaccgcggcgagatcgtgcgggtggacgtgttcaccaagcccaacaagaaggggaagaacgagttctacctggtcccgatctacccccaccaggtgatgaacaaggccgagtggcccacgcccccgatgcgcgccgtggtcgcctacaaggacgagagcgagtggaccctgctcgacgagaacttcggcttcctgttctccctgttcccccggagctacgtggaggtgaccaagcccggcggggaggtcctctccggctacttccaggggatggaccgcagcaccggcgccatctccctgttcaaccaccgggacagccgctccctgaccgacgacagcggcaactccacccgggggatcggcgcgaagaccctcctgacgatgaagaagtacagcgtggaccgcttcgggaagcgggccgaggtgaagtccgaggtccgcacctggcacggcgtggcctgcacctaccccaccccgcccgggtga

SEQ ID NO: 1482 - RNA, 3165 nt, synthetic construct
  misc_feature 1..3165: note = Cas9 variant
  source 1..3165: mol_type = other RNA
atgaagctgacgcccctcaactacatcctgggcctggacctcgggatcgccagcgtgggctgggccgtcgtggagatcgacgagcaggagaacccgctggggctgatcgacgtgggcgtccgcaccttcgaccgggcggaggtggccaagaccggggagtccctcgccctggcccgccggctggcccgcagctcccggcgcctcgtgaagcggcgcgcggaccggatcaagaaggtcaagcgcctgctcaagagcgagaacatcctcctgtccgccgacgagcagctgcccaacgacgtgtggcagctccgggtgaagggcctggaccagaagctggagcgccaggagtgggccgccgtcctcctgcacctcctgaagcaccggggctacctgagccagcgcaagaacgagtccaagagcgagaacaaggagctgggggcgctccggtccggcgtggccgccaaccaccagatcctgcagagcgccgagtaccgcacccccgccgagatcgcggtgaagaagttccacgtcgaggaggggcacatccggaaccagcgcggcgcctacacccacaccttctcccggctggacctcctggccgagatcgagctgctgttcacgcgccagaccgagctggggaacccccacaccagcgccaagctgctcgagaacctgaccgccctgctcatgtggcagaagccggcgctggccggcgaggccatcctgaagatgctcggcaagtgcacgttcgagcccaccgagtacaaggccgccaagaactcctacagcgcggagcggttcgtgtggctgaccaagctgaacaacctccgcatcctggagcagggggccgagcgcgccctgaccgacaacgagcggttcgccctcctggaccagccctacgagaaggccaagttcacgtacgcgcaggcccgcaccatgctggccctccccgacgaggccatcttcaagggcgtgcggtaccagggggaggacaagaaggcggtcgagaccaagaccatcctgatggagatgaaggcctaccaccagatccgcaaggccctggagaacgccgacctgaaggccgagtggaacgagctcaagaacaactccgagctgctggacgacatcggcacggcgttcagcctccacaagaccgacgaggacatctgccggtacctggacggcaagctgtccgagagcatcctcaacgccctgctggagaacctcaacttcgacaagttcatccagctgtccctgaaggccctccagcagatcctgccgctgatgctccaggggcagcgctacgacgaggccgtgagcgccatctacggcgaccactacgggaagaagtccgcggagatcaaccggctgctgcccaccatccccgccgacgagatccgcaaccccgtggtcctccggaccctgacgcaggcccgcaaggtgatcaacgccgtggtccggctgtacggcagcccggcccgcatccacatcgagaccgggcgggaggtgggcaagagctaccaggaccgcaagaagctcgagaagcagcaggaggacaaccggaagcaccgcgagtccgcggtgcagaagttcaaggagtacttccccaacttcgtcggcgagcccaaggggaaggacatcctgaagatgcggctgtacgagctccagcaggccaagtgcctgtacagcggcaagtccctggagctccaccgcctgctggagaaggggtacgtggaggtcgaccacgccctccccttcagccggacctgggacgactccttcaacaacaaggtgctggtgctggccaacgagaaccagaacaagggcaacctcaccccgtacgagtggctggacgggaagaacaacagcgagccctggcagaacttcgtcgcgcgcgtgcagacgtccggcttcagccacaccaagaagcagcgcatcctgtcccacaagctcgacgagaagggcttcatcgagcggaacctgaacgacacccgctacgtggtccggttcctgtgcaacttcatcgccgacaacatgctcctgaccgggaagggcaagcgcaaggtgttcgccagcaacgggcagatcacggccctgctccggggccgctgggggctgcagaaggtgcgggacgacaacgaccgccaccacgccctggacgcggtcgtggtggcctgctccaccgtcgccatgcagcagaagatcacccggttcgtgcgctacgaggagggcaacgtgttcagcggcgagcggatcgaccgcgagaccggggagatcatccccctccacttcccctccccgtgggccttcttccgggagaacgtcgagatccgcatcttcagcgagaaccccaagctggagctggagaaccggctccccgactacccccagtacaaccacgagttcgtgcagccgctgttcgtgtcccgcatgcccacgcggaagatgaccggccaggggcacatggagaccgtcaagagcgccaagcgcctggacgagggcctctccgtgctgaaggtgcccctgacccagctcaagctgaacgacctggagcggatggtcaaccgcgagcgggagatggcgctctacgagagcctgaaggtgcgcctggagcagttcgacaacgaccccgccaaggccttcgccgagccgttctacaagaagggcggggccctcgtgaaggcggtccgcgtggagcagacgcagaagtccggcgtgctggtccgggacgggaacggcgtggccgacaacgccagcatggtgcgcgtcgacgtgttcaccaaggccgggaagtacttcctggtgcccatctacacctggcaggtcgcgaagggcatcctccccaacaaggccgtgaccgccaacgtggacgagatcgactggctggagatggacgagagctaccagttcatcttcaccatgtacccgaacgacctggtcaaggtgaagctcaagaaggaggagttcttcggctactacgggggcctggaccgggccacgggggccatcgtgatcaaggagcacgacctggagaagtccaagggccgccaggggatctaccggatcggcgtcaagctcgcgctgagcttcgagaagtaccaggtggacgagctgggcaagaacatccgcccctgccggcccaccaagcgccagcacgtgcggtga

SEQ ID NO: 1483 - RNA, 3165 nt, synthetic construct
  misc_feature 1..3165: note = Cas9 variant
  source 1..3165: mol_type = other RNA
atgcgcatcctgggcgtggacctcggggtcgccagcgtgggctgggccctggtgaacgacaagaacaacaagatcatcgactccggggtccggatcttcacccagagcaccaaccgcgagggcaagacgctggcggccgtgcggcgctccttccgcgggggccggcgggtgctcagccgccggaagcagcgcctgaaccagctgaagaagctgttcatcgcccacaagctgctgtccaagagcgagttcaagcacctcttcaactccaagaaccggctggacatctggcagctgcgcgccaagggcctcgagcagcagctgaacaacaaggagtgggcccgggtcctgtaccacatcgcgaagcgccgggcctaccagagcaaccgcaagtccgaggagagcgggaacaccgacaagaagaaggtgctctccggcatcagcaagaacgagaagaagatgaacgagctggggtacaagaccatcggcgagatgctgtacaccgagaaccggtaccccgacaaccgcatccggcgcaacaagaaggaccagtacaagcactccatcagccgggacctcctgcgcaaggagatcgacgtgctgttcgagtcccagcgcgacttcgggaaccagttcgccacggacggcctcaaggagcactacaaggacatcgccttcacccagcggccgatcaagttcaaggcggacctggtcggcaagtgcaccttcgagacccaggagtaccgcggggccaagaactgcttcagcgtggagaagtccacgctgctcagcaagatcaacaacaccgacctgatcgacaagtccaccggcgagatcaagcggctgttcgagatcagcgagttcgacaagctcctggacatcttctacagcatcaaggaggtgaagtacaccacgctgcgcaagcagctcaagatcaccgacgccttcaagttcaagcagctggactaccaccagaacttcgagtacaagaccaacatcaaggccaagatcgaggacttctacaagctggaggactggctcacccccgagcagaaggtcctgctggagaagcaggtcctcgacgacaagaaggagaagttcaagtgctacaagtactccagcatccggtccatcctgagcctgtccgagagccagaagttcaacggggtgaagtacgacacgaaggtggagaacaccgtgttcggcaagctcaacggctaccactccatcaagaaggagctgaacaaggaggtgttcgacctcctcttcatcgacaaggacaagttcaacaagatcgccgagatcctgagctaccagaaggacgacaagtccgcgacccaggacctgaagaagcaggtcttcaacgacttcaacatggacaagaccatcgtgaacgaggccatcaacagcctcctgaacatctccttcagcgggttcaactccctgagcctcaaggccatcaacaagctgctgccctacctgtgccagggcctcaagtaccacgacgccgtggcccactccgagtacaagcaccacagccagttcaaggcggccaacccccagcagtacctgcgcccgctgaacaaggaggagaactaccagatcacgtcccccaccgtcaagcgggtgttcagccagttccgcaaggtgctcaacgccgtcatccggaagcacgggtccttcgacgccatgcacatcgagatggcccgcgagctgaagaacagcaagaagatcaagttcgagatccagaccggccagaaggagtacgcgcaggagaaggaggccatccgggtgaagttcctggagatcttcaagtacgaggggagcggccgcgacctcctgaagctgcggctctacgagcagcagcacggcaagtgcatctactccaagaaggagatcgagatcaacaagctgctggaggacgggtacgtcgagatcgaccacatcctcccctggagccgcaccttcgacaactccctgaacaacaaggccctgtgcctcagcgccgagaaccagaacaaggccaaccagacgcccttcgagtacctgaccaactccgacaagaacagcaaggactccaaggagtggcaggagtacaagaactacgtgagctccttcgcgggcatcaagcaggccaagaagcacaagctgctcaacaccaccctgccgccccggcgcgggaacgacttcagcgacgacatcaagaaccccgagtccggcttcctggcccggaacctcaacgacacggcctacgcgagccgcttcatcaagaacttcgtgcagaaccacctccagttctcccagaacgacaccatcaagcagaaggtcaaggtgcggagcggggccctgaccaaccagctgcgctacaactggggcatcgaggagaagaaccgcgacaacaacctgcaccacgccgaggacgccatcatcctggccttcgcgacccagggcgaggtgcagcggatgtccacgatcagcgccaagcgcgaggacttcaagtaccagaccgccaaggagcggaagatcaagttcacgcccccgttctccgacttcaagagcgtcctcgacgagagcgtgggggacatcttcgtgtccttcgcgccccgccggaagatcagcggcgccgcccacaaggccaccatcaagcccaaggacaccgggggcaagtacaagttccccgtcaacaacgggatggccgagaacggcgtgatccagcgcgtggacgtcttcaagaacgccaagaacaagtaccagttcatcgtgttctacccggccgacttctacaaggacgacttccccgagctggacctgaagggcaacgagatcgacaagaacgtgcagttcctcttctccctgttcaaggacgacctgatcgagttcaagaccaagaagaccaagaccaaggacagcaagcacctcctggcgtacttcaagtacatccggtccgacgggaagatcgccttccagcagaactacaaggccgagatcgagcgcaaggagagcgacaacaagaagggctacaaggacatcctgctcgccaccgggtccggcctggcgagcctgaagaagtaccaggtctccgtgctcggcgacatcgccgaggtgaagaacgagaagcggctgcccctgatcaagcagatgtacaagagcaagcccaagaagaagtga

SEQ ID NO: 1484 - RNA, 3165 nt, synthetic construct
  misc_feature 1..3165: note = Cas9 variant
  source 1..3165: mol_type = other RNA
atgaaccagaagttcatcctgggcctcgacatcgggatcaccagcgtgggctacgggctgatcgactacgagaccaagaacatcatcgacgccggcgtccgcctgttccccgaggccaacgtggagaacaacgaggggcggcgctccaagcggggcagccgccggctcaagcgccggcgcatccaccggctggagcgcgtgaagaagctgctcgaggactacaacctgctggaccagtcccagatcccgcagagcacgaacccctacgcgatccgggtcaagggcctctccgaggccctgagcaaggacgagctggtgatcgccctcctgcacatcgccaagcgccgggggatccacaagatcgacgtgatcgactccaacgacgacgtcggcaacgagctgagcaccaaggagcagctcaacaagaactccaagctgctgaaggacaagttcgtgtgccagatccagctcgagcgcatgaacgaggggcaggtccggggcgagaagaaccgcttcaagaccgccgacatcatcaaggagatcatccagctgctgaacgtgcagaagaacttccaccagctcgacgagaacttcatcaacaagtacatcgagctggtggagatgcggcgcgagtacttcgaggggcccggcaagggcagcccctacgggtgggagggcgacccgaaggcgtggtacgagaccctgatggggcactgcacgtacttccccgacgagctccggtccgtgaagtacgcctacagcgccgacctgttcaacgccctgaacgacctcaacaacctggtcatccagcgcgacggcctgtccaagctcgagtaccacgagaagtaccacatcatcgagaacgtgttcaagcagaagaagaagcccaccctgaagcagatcgcgaacgagatcaacgtgaaccccgaggacatcaagggctaccggatcaccaagagcgggaagccgcagttcaccgagttcaagctgtaccacgacctcaagtccgtcctgttcgaccagagcatcctggagaacgaggacgtgctcgaccagatcgccgagatcctgacgatctaccaggacaaggactccatcaagagcaagctgaccgagctcgacatcctgctgaacgaggaggacaaggagaacatcgcccagctcaccggctacaccgggacgcaccgcctgtccctgaagtgcatccgcctcgtgctggaggagcagtggtacagcagccggaaccagatggagatcttcacccacctgaacatcaagcccaagaagatcaacctcaccgccgccaacaagatccccaaggcgatgatcgacgagttcatcctgtcccccgtcgtgaagcgcaccttcggccaggccatcaacctgatcaacaagatcatcgagaagtacggggtgccggaggacatcatcatcgagctggcccgggagaacaacagcaaggacaagcagaagttcatcaacgagatgcagaagaagaacgagaacacgcgcaagcggatcaacgagatcatcggcaagtacggcaaccagaacgccaagcgcctcgtcgagaagatccggctgcacgacgagcaggaggggaagtgcctgtactccctcgagagcatccccctggaggacctgctcaacaaccccaaccactacgaggtggaccacatcatcccccgctccgtgagcttcgacaactcctaccacaacaaggtcctggtgaagcagagcgagaactccaagaagtccaacctgaccccgtaccagtacttcaacagcggcaagagcaagctctcctacaaccagttcaagcagcacatcctgaacctgagcaagtcccaggaccggatcagcaagaagaagaaggagtacctcctggaggagcgcgacatcaacaagttcgaggtccagaaggagttcatcaaccggaacctggtggacacccgctacgccacccgggagctcacgaactacctgaaggcgtacttctccgccaacaacatgaacgtgaaggtcaagaccatcaacgggagcttcaccgactacctgcgcaaggtgtggaagttcaagaaggagcggaaccacggctacaagcaccacgccgaggacgccctcatcatcgccaacgcggacttcctgttcaaggagaacaagaagctgaaggccgtgaactccgtcctcgagaagcccgagatcgagagcaagcagctggacatccaggtggacagcgaggacaactactccgagatgttcatcatccccaagcaggtccaggacatcaaggacttccgcaacttcaagtacagccaccgggtggacaagaagcccaaccgccagctgatcaacgacaccctctactccacgcggaagaaggacaacagcacctacatcgtgcagaccatcaaggacatctacgccaaggacaacaccacgctgaagaagcagttcgacaagtccccggagaagttcctgatgtaccagcacgacccccgcaccttcgagaagctcgaggtgatcatgaagcagtacgccaacgagaagaaccccctggccaagtaccacgaggagaccggggagtacctgaccaagtacagcaagaagaacaacggccccatcgtcaagtccctcaagtacatcggcaacaagctggggagccacctggacgtgacgcaccagttcaagtccagcaccaagaagctcgtgaagctgtccatcaagccgtaccgcttcgacgtctacctgaccgacaagggctacaagttcatcaccatcagctacctcgacgtgctgaagaaggacaactactactacatccccgagcagaagtacgacaagctgaagctcgggaaggcgatcgacaagaacgccaagttcatcgcctccttctacaagaacgacctgatcaagctggacggcgagatctacaagatcatcggggtgaacagcgacacgcggaacatgatcgagctcgacctgcccgacatccgctacaaggagtactgcgagctgaacaacatcaagggcgagccccggatcaagaagaccatcggcaagaaggtcaactccatcgagaagctcaccaccgacgtgctggggaacgtgttcaccaacacgcagtacaccaagccgcagctcctgttcaagcgcggcaactga

SEQ ID NO: 1485 - RNA, 3165 nt, synthetic construct
  misc_feature 1..3165: note = Cas9 variant
  source 1..3165: mol_type = other RNA
atgaagctgacgcccctcaactacatcctgggcctggacctcgggatcgccagcgtgggctgggccgtcgtggagatcgacgagcaggagaacccgctggggctgatcgacgtgggcgtccgcaccttcgaccgggcggaggtgcccaagaccggggagtccctcgccctggcccgccggctggcccgcagcgcccggcgcctcgtgaagcggcgcgcggaccggatcaagaaggccaagcgcctgctgaaggccgagaacatcctcctgtccgccgacgagcacctccccaacgacgtctggcagctgcgggtgaagggcctggaccagaagctggagcgccaggagtgggcggccgtgctcctgcacctcctgaagcaccggggctacctgagccagcgcaagaacgagtccaagagcgagaacaaggagctgggggccctcctgtccggcgtcgagaccaaccaccagatcctgcagagcgccgagtaccggacccccgccgagatcgcggtgaagaagttccacgtggaggacgggcacatccgcaaccagcggggcgcctacacccacacgttctcccgcctcgacctgctggccgagatggagctcctgttccagcggcagaccgacctggggaacccgcacaccagcgccaagctcctggagaacctgaccgccctcctgatgtggcagaagcccgcgctggccggcgaggccatcctcaagatgctgggcaagtgcacgttcgagcccaccgagtacaaggccgccaagaactcctacagcgcggagcgcttcgtctggctgaccaagctcaacaacctgcggatcctggagcagggggccgagcgcgccctcaccgacaacgagcgcttcgccctgctggaccagccctacgagaaggccaagttcacgtacgcgcaggcccggaccatgctcgccctgccggacgaggccatcttcaagggcgtgcgctaccagggggaggacaagaaggcggtggagaccaagaccatcctgatggagatgaaggcctaccaccagatccggaaggccctggagaacgccgacctcaaggccgagtggaacgagctgaagaacaactccgagctgctcgacgacatcggcacggcgttcagcctgcacaagaccgacgaggacatctgccgctacctggacggcaagctctccgagagcatcctgaacgccctgctcgagaacctgaacttcgacaagttcatccagctgtccctcaaggccctgcagcagatcctgcccctcatgctgcaggggcagcggtacgacgaggccgtcagcgccatctacggcgaccactacgggaagaagtccgcggagatcaaccgcctgctccccaccatccccgccgacgagatccggaacccggtggtgctgcgcaccctgacgcaggcccggaaggtcatcaacgccgtggtgcgcctctacggcagccccgcccggatccacatcgagaccgggcgcgaggtcggcaagagctaccaggaccggaagaagctggagaagcagcaggaggacaaccgcaagcagcgggagtccgcggtgaagaagttcaaggagtacttccccaacttcgtgggcgagcccaaggggaaggacatcctgaagatgcgcctctacgagctgcagcaggccaagtgcctgtacagcggcaagtccctcgagctgcaccggctgctcgagaaggggtacgtcgaggtggaccacgccctgccgttcagccgcacctgggacgactccttcaacaacaaggtcctggtgctcgccaacgagaaccagaacaagggcaacctgaccccctacgagtggctggacgggaagaacaacagcgagcactggcagaacttcgtggcgcgggtccagacgtccggcttcagccacaccaagaagcagcgcatcctctcccacaagctggacgagaagggcttcatcgagcgcaacctgaacgacacccggtacgtggcccgcttcctctgcaacttcatcgccgacaacatgctgctgaccgggaagggcaagcggaaggtgttcgccagcaacgggcagatcacggccctcctgcgcggccggtgggggctgcagaaggtccgcgacgacaacgaccggcaccacgcgctcgacgccgtggtggtcgcctgctccaccgtggtgatgcagcagaagatcacccgcttcgtccggtacgaggagggcaacgtgttcagcggcgagcgcatcgaccgggagaccggggagatcatccccctgcacttcccctccccgtgggccttcttccgcgagaacgtggagatccggatcttcagcgagaaccccaagctggagctcgagaaccgcctgcccgactacccccagtacaaccacgagttcgtccagccgctgttcgtgtcccggatgcccacgcgcaagatgaccggccaggggcacatggagaccgtcaagagcgccaagcggctcgacgagggcctgtccgtgctgaaggtgcccctcacccagctgaagctgagcgacctcgagcgcatggtgaaccgggagcgcgaggtcacgctgtacgagtccctgaaggcgcggctcgagcagttcggcaacgaccccgccaaggccttcgccgagccgttccacaagaagggcggggccgtggtgaaggcggtccgcgtggagcagacccagaagtccggggtgctggtccgcgacggcaacggggtggccgacaacgccagcatggtgcgggtcgacgtgttcaccaagggcggcaagtacttcctggtgcccatctacacctggcaggtcgccaaggggatcctccccaacaaggcggtgaccgccaacgtggacgagatcgactggctggagatggacgagagctaccagttcatcttcacgatgtacccgaacgacctggtcaaggtgaagctcaagaaggaggagttcttcggctactacgggggcctggaccgcgccaccggggccatcgtgatcaaggagcacgacctggagaagtccaagggcaagcagggcatctaccggatcggggtcaagctcgccctgagcttcgagaagtaccaggtggacgagctgggcaagaacatccgcccctgccggcccaccaagcgccagcacgtgcggtga

SEQ ID NO: 1486 - RNA, 3165 nt, synthetic construct
  misc_feature 1..3165: note = Cas9 variant
  source 1..3165: mol_type = other RNA
atgaaggagaagtacatcctgggcctcgacctggggatcaccagcgtgggctacgggatcatcaacttcgagaccaagaagatcatcgacgccggcgtccgcctgttccccgaggccaacgtggacaacaacgaggggcggcgctccaagcggggcagccgccggctcaagcgccggcgcatccaccggctggagcgcgtgaagctgctcctgacggagtacgacctgatcaacaaggagcagatcccgacctccaacaacccctaccagatccgggtcaagggcctcagcgagatcctgtccaaggacgagctggccatcgccctcctgcacctggccaagcgccgggggatccacaacatcaacgtgagctccgaggacgaggacgccagcaacgagctctccaccaaggagcagatcaaccgcaacaacaagctgctgaaggacaagtacgtgtgcgaggtccagctccagcggctgaaggagggccagatccgcggggagaagaaccggttcaagaccacggacatcctgaaggagatcgaccagctcctgaaggtgcagaaggactaccacaacctggacatcgacttcatcaaccagtacaaggagatcgtggagacccgccgggagtacttcgagggccccgggcagggcagccccttcggctggaacggggacctcaagaagtggtacgagatgctgatgggccactgcacctacttcccgcaggagctgcgctccgtcaagtacgcctacagcgcggacctcttcaacgccctgaacgacctgaacaacctcatcatccagcgggacaactccgagaagctggagtaccacgagaagtaccacatcatcgagaacgtgttcaagcagaagaagaagcccaccctgaagcagatcgccaaggagatcggggtgaaccccgaggacatcaagggctaccgcatcaccaagagcggcacgccccagttcaccgagttcaagctctaccacgacctgaagtccatcgtcttcgacaagagcatcctggagaacgaggccatcctcgaccagatcgcggagatcctgaccatctaccaggacgagcagtccatcaaggaggagctgaacaagctcccggagatcctgaacgagcaggacaaggccgagatcgccaagctgatcgggtacaacggcacgcaccgcctcagcctgaagtgcatccacctgatcaacgaggagctctggcagacctcccggaaccagatggagatcttcaactacctgaacatcaagcccaacaaggtggacctgagcgagcagaacaagatccccaaggacatggtgaacgacttcatcctcagccccgtcgtgaagcgcaccttcatccagtccatcaacgtgatcaacaaggtcatcgagaagtacgggatcccggaggacatcatcatcgagctggcccgggagaacaacagcgacgaccgcaagaagttcatcaacaacctgcagaagaagaacgaggccacccggaagcgcatcaacgagatcatcggccagacggggaaccagaacgcgaagcggatcgtggagaagatccgcctgcacgaccagcaggagggcaagtgcctctactccctggagagcatcgccctgatggacctcctgaacaacccccagaactacgaggtggaccacatcatcccccggtccgtcgccttcgacaacagcatccacaacaaggtgctggtgaagcagatcgagaactccaagaagggcaaccgcaccccctaccagtacctcaacagctccgacgccaagctgagctacaaccagttcaagcagcacatcctgaacctctccaagagcaaggaccggatctccaagaagaagaaggactacctgctggaggagcgcgacatcaacaagttcgaggtccagaaggagttcatcaaccggaacctcgtggacacccgctacgccacccgggagctgacgagctacctgaaggcgtacttctccgccaacaacatggacgtcaaggtgaagaccatcaacgggagcttcaccaaccacctccgcaaggtgtggcggttcgacaagtaccgcaaccacggctacaagcaccacgccgaggacgccctgatcatcgccaacgcggacttcctgttcaaggagaacaagaagctccagaacaccaacaagatcctggagaagccgacgatcgagaacaacaccaagaaggtcaccgtggagaaggaggaggactacaacaacgtgttcgagacccccaagctggtcgaggacatcaagcagtaccgggactacaagttctcccaccgcgtggacaagaagcccaaccgccagctcatcaacgacacgctgtacagcacccggatgaaggacgagcacgactacatcgtgcagaccatcaccgacatctacgggaaggacaacacgaacctgaagaagcagttcaacaagaaccccgagaagttcctcatgtaccagaacgacccgaagaccttcgagaagctgtccatcatcatgaagcagtacagcgacgagaagaaccccctggccaagtactacgaggagaccggcgagtacctcaccaagtacagcaagaagaacaacgggcccatcgtcaagaagatcaagctgctgggcaacaaggtgggcaaccacctcgacgtgacgaacaagtacgagaactccaccaagaagctggtcaagctgagcatcaagaactaccgcttcgacgtgtacctcaccgagaaggggtacaagttcgtgaccatcgcctacctgaacgtcttcaagaaggacaactactactacatccccaaggacaagtaccaggagctgaaggagaagaagaagatcaaggacaccgaccagttcatcgcctccttctacaagaacgacctcatcaagctgaacggcgacctgtacaagatcatcggggtgaacagcgacgaccggaacatcatcgagctcgactactacgacatcaagtacaaggactactgcgagatcaacaacatcaagggcgagccgcgcatcaagaagacgatcgggaagaagaccgagtccatcgagaagttcaccaccgacgtgctgggcaacctgtacctccacagcacggagaaggcgccccagctgatcttcaagcggggcctgtga

SEQ ID NO: 1487 - RNA, 3165 nt, synthetic construct
  misc_feature 1..3165: note = Cas9 variant
  source 1..3165: mol_type = other RNA
atggagaacaagaacctgaactacatcctcggcctggacctggggatcgccagcgtgggctgggccgtcgtggagatcgacgagaaggagaaccccctccgcctgatcgacgtgggggtccggaccttcgagcgcgcggaggtgccgaagaccggcgagtccctggccctcagccggcgcctggcccggtccgcccgccggctgacgcagcgccgggtggcccgcctcaagaaggcgaagcggctgctcaagagcgagaacatcctgctgtccaccgacgagcgcctgccccaccaggtctggcagctccgggtggaggggctggaccacaagctggagcgccaggagtgggccgccgtgctcctgcacctgatcaagcaccggggctacctcagccagcgcaagaacgagtccaagagcgagaacaaggagctgggcgccctgctctccggggtcgacaacaaccacaagctgctgcagcaggcgacctaccggagccccgccgagctcgccgtgaagaagttcgaggtggaggagggccacatccgcaaccagcagggggcctacacccacacgttctcccggctggacctgctcgccgagatggagctgctgttcagccgccagcagcacttcggcaaccccttcgcgtccgagaagctcctggagaacctgaccgccctcctgatgtggcagaagccggccctgagcggggaggccatcctcaagatgctgggcaagtgcaccttcgaggacgagtacaaggccgcgaagaacacctactccgccgagcggttcgtctggatcacgaagctgaacaacctccgcatccaggagaacggcctggagcgcgccctgaacgacaacgagcggctcgccctgatggagcagccctacgacaagaaccgcctgttctacagccaggtgcggtccatcctcaagctgagcgacgaggccatcttcaaggggctgcgctactccggcgaggacaagaaggcgatcgagaccaaggccgtgctgatggagatgaaggcctaccaccagatccggaaggtcctcgaggggaacaacctgaaggccgagtgggccgagctgaaggcgaaccccaccctcctggacgagatcggcaccgccttcagcctgtacaagacggacgaggacatcagcgcctacctcgccggcaagctgtcccagcccgtgctgaacgcgctcctggagaacctgagcttcgacaagttcatccagctctccctgaaggccctgtacaagctcctgccgctgatgcagcaggggctccgctacgacgaggcctgccgggagatctacggcgaccactacgggaagaagaccgaggagaaccaccacttcctgccccagatccccgccgacgagatccgcaaccccgtggtcctgcggaccctcacccaggcccgcaaggtgatcaacggcgtggtccggctgtacgggagcccggcgcgcatccacatcgagacgggccgggaggtgggcaagtcctacaaggaccgccgggagctggagaagcgccaggaggagaaccggaagcagcgcgagaacgccatcaaggagttcaaggagtacttcccccacttcgccggggagcccaaggccaaggacatcctcaagatgcggctgtacaagcagcagaacgccaagtgcctgtacagcggcaagcccatcgagctccaccgcctgctggagaaggggtacgtggaggtcgaccacgcgctcccgttctcccgcacctgggacgacagcttcaacaacaaggtgctggtcctggccaacgagaaccagaacaagggcaacctcacccccttcgagtggctggacgggaagcacaactccgagcggtggcgcgccttcaaggccctggtggagaccagcgccttcccctacgcgaagaagcagcggatcctctcccagaagctggacgagaagggcttcatcgagcgcaacctgaacgacacgcggtacgtggcccgcttcctctgcaacttcatcgccgacaacatgcacctgaccggcgaggggaagcggaaggtcttcgccagcaacggccagatcaccgcgctgctccgctcccggtgggggctggccaagagccgcgaggacaacgaccggcaccacgccctggacgccgtggtggtcgcctgctccaccgtggcgatgcagcagaagatcacgcgcttcgtgcggttcgaggccggcgacgtcttcaccggggagcgcatcgaccgggagaccggcgagatcatccccctccacttcccgaccccctggcagttcttcaagcaggaggtggagatccgcatcttcagcgacaaccccaagctggagctggagaaccggctccccgaccgcccgcaggccaaccacgagttcgtgcagcccctgttcgtctcccggatgcccacgcgcaagatgaccggccaggggcacatggagaccgtcaagagcgccaagcggctgaacgagggcatctccgtgatcaagatgcccctcaccaagctgaagctgaaggacctcgagctgatggtgaaccgcgagcgcgagaaggacctgtacgacacgctcaaggcccggctggaggcgttcaacgacgacccggccaaggccttcgccgagcccttcatcaagaagggcggggccatcgtcaagagcgtgcgcgtggagcagatccagaagtccggcgtgctggtgcgggaggggaacggcgtcgcggacaacgccagcatggtgcgcgtggacgtcttcaccaagggcgggaagtacttcctcgtgcccatctacacctggcaggtcgccaaggggatcctgccgaacaaggccgcgacccagtacaaggacgaggaggactgggaggtgatggacaacagcgccacgttcaagttctccctgcaccccaacgacctcgtgaagctggtgaccaagaagaagaccatcctgggctacttcaacggcctcaaccgggccaccgggaacatcgacatcaaggagcacgacctggacaagagcaagggcaagcaggggatcttcgagggcgtcgggatcaagctggccctctccttcgagaagtaccaggtggacgagctgggcaagaacatccgcctgtgcaagcccagcaagcggcagcccgtgcgctga

SEQ ID NO: 1488 - RNA, 3168 nt, synthetic construct
  misc_feature 1..3168: note = Cas9 variant
  source 1..3168: mol_type = other RNA
atgaacaactacatcctgggcctcgacatcgggatcaccagcgtgggctacgggatcgtcgactccgacacccgcgagatcaaggacgccggcgtgcggctgttccccgaggccaacgtggacaacaacgaggggcgccggagcaagcgcggcgcccggcgcctgaagcggcgccggatccaccgcctcgaccgggtcaagcacctcctggccgagtacaacctgctggacctgacgaacatcccgaagtccaccaacccctaccagatccgcgtgaagggcctcaacgagaagctgagcaaggacgagctggtgatcgccctcctgcacatcgccaagcggcgcgggatccacaacgtcaacgtgatgatggacgacaacgactccggcaacgagctgagcaccaaggaccagctcaagaagaacgccaaggcgctgtccgacaagtacgtgtgcgagctgcagctcgagcggttcgagcaggactacaaggtccgcggggagaagaaccggttcaagaccgaggacttcgtgcgcgaggcccggaagctgctggagacgcagagcaagttcttcgagatcgaccagaccttcatcatgcgctacatcgacctcgtggagacccggcgcgagtacttcgagggccccgggaagggctcccccttcggctgggaggggaacatcaagaagtggttcgagcagatgatgggccactgcacctacttcccggaggagctgcgcagcgtcaagtacgcctactccgccgagctgttcaacgcgctcaacgacctgaacaacctggtgatcacgcgggacgaggaggccaagctcaactacggggagaagttccagatcatcgagaacgtgttcaagcagaagaagacccccaacctgaagcagatcgccaaggagatcggcgtcagcgagaccgacatcaagggctaccgcgtgaacaagtccgggaagcccgagttcacccagttcaagctgtaccacgacctcaagaacatcttcgaggacagcaagtacctgaacgacgtgcagctgatggacaacatcgccgagatcatcacgatctaccaggaccccgagtccatcatcaaggagctcaacctgctgccggagctcctgagcgagaaggagaaggagaagatctccgccctgagcggctacgcggggacccaccggctctccctgaagtgcatcaacctgctcctggacgacctgtgggagagcagcctcaaccagatggagctgttcaccaagctgaacctcaagcccaagaagatcgacctgtcccagcagcacaagatccccatcaagctggtcgacgacttcatcctgagccccgtggtgaagcgcgccttcatccagtccatccaggtcgtgaacgccatcatcgacaagtacggcctcccggaggacatcatcatcgagctggcccgggagaacaacagcgacgaccgccggaagttcctgaaccagctccagaagcagaacgccgagacccgcaagcaggtcgagaaggtgctgcgggagtacgggaacgacaacgcgaagcgcatcgtgcagaagatcaagctgcacaacatgcaggagggcaagtgcctctactccctgaaggacatccccctggaggacctcctgaagaaccccaaccactacgaggtcgaccacatcatcccccggagcgtggccttcgacaactccatgcacaacaaggtgctggtccgcgccgaggagaacagcaagaagggcaaccggacgccgtaccagtacctcaactccagcgagtccagcctgtcctacaacgagttcaagcagcacatcctgaacctcagcaagaccaaggaccgcatcaccaagaagaagcgggagtacctgctggaggagcgcgacatcaacaagtacgacgtgcagaaggagttcatcaaccggaacctcgtggacacccgctacgccacgcgggagctgacctccctgctcaaggcctacttcagcgcgaacaacctggacgtcaaggtgaagaccatcaacgggtccttcaccaactacctgcgcaaggtgtggaagttcgacaaggaccgcaacaagggctacaagcaccacgccgaggacgccctcatcatcgccaacgccgacttcctgttcaagcacaacaagaagctgcggaacatcaacaaggtcctcgacgcgcccagcaaggagatcgacaagaagcgcgtgacggtgcagtccgaggacgagtacaaccagatgttcgaggacacccagaaggcccaggccatcaagaagttcgagatccggaagttcagccaccgcgtcgacaagaagcccaaccggcagctgatcaaggacaccctgtacagcacccgcaacatcgacgggatcgagtacgtggtggagtccatcaaggacatctacagcgtcaacaacgacaaggtgaagacgaagttcaagaaggacccccaccggctcctgatgtaccgcaacgacccgcagaccttcgagaagttcgagaaggtgttcaagcagtacgagtccgagaagaaccccttcgccaagtactacgaggagaccggcgagaagatccggaagttcagcaagaccgggcagggcccctacatcaacaagatcaagtacctgcgcgagcggctcggccgccactgcgacgtcacgaacaagtacatcaactcccggaacaagatcgtgcagctgaagatctacagctaccgcttcgacatctaccagtacgggaacaactacaagatgatcaccatctcctacatcgacctggagcagaagtccaactactactacatcagccgggagaagtacgagcagaagaagaaggacaagcagatcgacgacagctacaagttcatcggctccttctacaagaacgacatcatcaactacaacggggagatgtaccgcgtgatcggcgtcaacgacagcgagaagaacaagatccagctcgacatgatcgacatctccatcaaggactacatggagctgaacaacatcaagaagaccggggtgatctacaagaccatcggcaagagcacgacccacatcgagaagtacaccaccgacatcctgggcaacctctacaaggcggcgcccccgaagaagccccagctgatcttcaagcgggggatggagtga

SEQ ID NO: 1489 - RNA, 3168 nt, synthetic construct
  misc_feature 1..3168: note = Cas9 variant
  source 1..3168: mol_type = other RNA
atgacccccatcagcgagtccctcctgttcggcctggacgtggggatcagctcctgcggctgggccgtcctgaagcacagcgacaccacggggcacatcgaggccctcggctcctggtgcttcaacgccccggagaccaagaccgagcgcacccccacgaaccagatccggcgcagctcccggctgctgcgccgggtggtgcgccggcgccggaaccgcatgaccgagatccggcgcctcttcgcccggcacgggctgatcgacaacgaccgccccgacgccctgcggcagcccgccatcgacccgtgggagatgcgcggccagggcctcgaccggcagctgacccccgaggagttcgccgtcgcgctggcccacatcgccaagcaccgcgggttcaagagctccgccaagcgggtcaagagcaacgcgtcccccgacgacagcaagatgctcgccgccctggagaagaccaaggagctgtccgcccagtaccgcacgatcggcgagatgttcgcccgggacagcgcgtacgtgcagcgccgccggaaccgcgacggcctcttcgaccggaccatctcccgcgacgacctgatcgacgaggccaagatcctgttcgaccggcagcgcaagctcgggaaccccgtggccagcaccgagatcgaggaggccttcacccggatcgccttctggcagaacccgatgcaggactccggggtgctggtggcgagctgccccttcgagcccaaggagaagcgctccagccggttcagcccctccttcgagcgcttccggctgctctgccgcctgatcaacctgcgggtcacggacggcccggaggagcgccccctcaccgaggaggagctgcggctggcctacgagcacgccggcaagacccgcaagctcaccgccgccgcgatccggaagctgatcgggctgcgcgacgaccagcacttcacgaccatcccgcccgagcaggagaagcaggacatcaccagccggaccggcgagacgttcgccgggaccgccaccttccgctccgtgctcggcgagagcctgtggcgccagctgctcccccaccccgagtggctggacaacgccgcctggatcatctccttccacgagctgaccgagacgatcatcaagaagctcggcgagatcgggctgcccgtggaggcgtacgagctgatctgcgacgccctcaagagcgacaagtcccccttcgccaagttcaagggcgccagctccctgagcgacaaggcggtccgggccctgatcccgtacctccagcaggggctgacctacgacaaggcctgccagaaggccggctacgaccacgccgcgtcccgcttcagcgggcgggccaccatcgacaccaaggccaagttcaacgccctgatggccgaggtgcgcgactccatcgcgaaccccatcgcccggaaggccctcagcgagggcatgaagcagctgtgggccatgcgcaaccggtggggcctgcccggggccatctgcatcgagctcgcgcgcgacgtgggcaactccctggagaagcggaaggagatcgagcgcaacctgaagacgaccgccaagcagcgggcccgcgagcgggaggaggcctgcgagctgctcaacctgaaggaggtcagctccgacatcctgctccgctaccggctgtggaaggagcagggcgggcgctgctgctacagcgggaagtccatcacccccgacatgctgatggcgcaggacaaccggatccagatcgaccacatcctcccgtggagccgcttcggcgacgacagctactccaacaagggcctgtgcctggccaaggagaaccaggccaagaagaaccagaccccctacgagtggatccacgggcagggcacgaccgcccagaaggagcagtgggacaagttcgtggccgacgtggagagccggaagaacaccaaggggctcaagaagcgcaacttcctgctgaagggctccaaggagatcgaggagcggttccgcagccgcaacctcaacgacacccggtacgcggcccgcctgatggtcgaggccgcccggctgctctaccccgccgggcagcgcggcgagaagggcgggacgcggcgcgtgttcacccggcccggcgcgctgaccgccgccctgcgccacgcctggggcgtggagtccctcaagaagatcgacggggagcggctgcacgacaaccgccaccacgccctggacgcggccatcgtcgccgccgtgagcgaggcggagatccagaagctcaccaagtccttccaggagtgcgagcagaagggcctgagccggccgatgcgcgacgtggccccgccctgggacgggttccgggaccagctgaaggagaagtacgagaccatcttcgtcgcccgccccgagcggcagcgcgcccggggccaggggcacgaggccacgatccgccaggtgcgggaggaggagaccggccccgtcatctacgagcgcaaggcggtgtccgccctcaccctggccgacctggccaagatcaaggaccccgaccgcaacgccgggctcatcgcgagcctgcggcagtggatcgaggccggcaagcccgccgacaagccgccccgcaccccctgccaccagtccgccgccggccacgagatccggaaggtgcgcctggcgacgatcatcacccccgccgtcccggtgcggggcgggatggccaagcgcggggagatgacccgggtggacatcttcaaggtcatcggcaagaaggggaagcccgagtggtacatgatccccatctacccccaccagatcatgaaccgcagccagtggccggccccgcccaacaaggccgtggtggcgggcaagtccgaggccgactggcccatcatgggcgccgaggcccagttccagttcagcctctacccctgctcctacgtccggctgttcaaggaggggaccgtgatcgagggctacttctgcgggtgccaccgcagccgggcgtacatcacgctggccctctccaccggcgccgcgcccctgcagaaggggatcggcatcaagacccaggagcacatccagaagttcagcgtgaaccgcttcggcgagctgagccccgtcaagcaggagacccggacgtggcacggggtggcctgcacctcccccgaccagcacgactga

SEQ ID NO: 1490 - RNA, 3171 nt, synthetic construct
  misc_feature 1..3171: note = Cas9 variant
  source 1..3171: mol_type = other RNA
atgaaggccctgaactacatcctcggcctggacctggggatcgccagcgtgggctgggcggtcgtggagatcgaccagaacgagctccccatccgcctgatcgacctgggggtgcggaccttcgagcgcgccgaggtcccgaagaccggcgactccctcgccctggcccggcgcctggcccggagctcccgccggctcgtgcgccggcgcgcggtgcggctgctgaaggccaagcgcctcctgaagcaggaggggatcctgcaggccgacgacttccacagctcccacctcaagcccctgcccaacaacccctgggagctgcgggtcaagggcctcaaccacctcctggaccgcaaggagtgggccgcggtgctcctgcacctcctgaagcaccggggctacctgagccagcgcaagaacgagtccaagacggacaacaaggagctgggggccctcctgaagggcgtgagcgagaaccggcagctgctccaggcccaggccttctccaccccggccgagatcgcgatcaagaagttccagcaggaggaggggcacatccgcaaccagcggggcgcctacagccacaccttcgaccgcaacgacctgctggccgagctccggctgctgttccagaagcagcgcgagttcaacaacccctacacctcccagagcctcgagcaggccatcgccgagctgctgatgtggcagaagcccgcgctctccggggaggccatcctgaagatgctgggcaagtgcacgttcgagcccagcgagtacaaggccccgaagaactcctacagcgccgagtacttcgtctggctcaccaagctgaacaacctgcgcatcctcgagaacggcgccgaccgggggctgaccgcggaggagcgccagctgctcatcaaccagcccttcgagaaggccaagttcacctacgcccaggcccggaagctgctggagctgtccgacctcgccatcttcaagggcgtgcgctacgggaaggacaacgcggagagcgccacgctgatggagatgaaggcctggcacgccatccggaaggcgctggagtccaacggcctcaagaccgagtggaacggcctgaagaccaagcccgagctgctcgacaagatcgggaccgccttcagcatctacaagacggacgaggacatcagccagtacctgaacggcgagctgtcccccgccgtgctcaacgccctgctggagaacctcagcttcgacaagttcatccgcctgtccctgcagagcctcgccaagatcctgccgctgatggagcaggggctccggtacgacgaggcgtgcaagcaggtctacggcgaccactacgggaagaaggagcagctggagctgcgcttcctccccaagatccccgtggaggacatccggaaccccgtggtcctgcgcaccctgtcccaggcccggaaggtgatcaacggcgtggtccgcctctacggcagcccggcccggatccacatcgagaccgggcgcgaggtgggcaagtccttcagcgagcggcgcgacatctccaagcggcaggaggagaaccgcaacgagcggcagcgcgccgtggagaagttcaaggagttcttcccccacttcgtcggggagcccaaggccaaggacatcctgaagatgcgcctgtacgagcagcagcacggcaagtgcctctacagcgggaaggagctggacctgaaccggctcctggagaagggctacgtggagatcgaccacgcgctgcccttctcccgcacctgggacgacagcttcaacaacaaggtgctcgtcctggcctccgagaaccagaacaagggcaaccagacgccgtacgagtggctgaacgggaaggagaacgccgagcggtggaagctgttccaggccctggtgaacggcagccgcttcccctactccaagaagcagcggatcctgaccaagtacctcgacgaggacgggttccgcgagcggaacctgaacgacacccgctacgtcgcccggttcctgtgcaacttcatcgaggacaacatgcagctcgtgggccaggggaagaagcgcgtgttcgcgagcaacggccagatcaccgccctgctgcggcgctcctggggcatccagaaggtccgggaggacaacgaccgccaccacgccgtggacgccgtggtcgtggcgtgcagcacgcgggccctccagaagaagatcaccgactacgtgcgctacaaggagatgaacgtcttcaccggggagaagatcgaccaggagaccggcgagatcatcaagttccacttccccgagccctggaagttcttccggcaggaggtggagatccgcgtgttctccgagacgccggccgaggacgtcgtgatcgccctgcccgaccggccccaggccaaccacgagttcatccagcccctgttcgtgagccgcgcgccgacccggaagatgaccgggcagggccacatggagaccatcaagagcgccaagcgcctcgccgagggcctgtccgtcagccgcgtgcccctgacgcagctcaagctgaaggacctggagaacatggtgaaccgggagcgcgagaaggccctctacgaggccctgaaggtccggctggagaagttcaacaacgaccccgcgaaggccttcgccgacccgttctacaagaagggcgggcagcaggtcaaggccgtgcgcgtggagcaggtccagaagtccggggtgctcgtgcggcaggagaacggcgtggccgacaacgcgagcatggtgcgcgtcgacgtgttcatcaagggcgggaagtacttcctggtgcccatctacacctggcaggtcgccaagggcatcctgcccaaccgggccgccacccaggggaaggaggaggagtactgggacatcatggacgagaccgcgatcttccagttctccctctaccagaacgacctgatcaagctggtgacgaagaagaagaccatcttcggctacttcaacgggctcaaccgcgccaccagcaacatcaacatcaaggagcacgacctggacaagtccaagggcaaggacgggatctacctggaggtgggcgtcaagctcgccctgagcctggagaagtaccaggtggacgagctcggcaagaacatccagccctgccggtccatgaagaagcgcccgcccgtgcggtga

SEQ ID NO: 1491 - RNA, 3171 nt, synthetic construct
  misc_feature 1..3171: note = Cas9 variant
  source 1..3171: mol_type = other RNA
atgcccaagcagaagtccacccgctaccggctggccctcgacctgggcagcaccagcctggggtgggccgtgctccgcctgaacgagcagcacgagccgaacgcgatcatccgggccggcgtccgcatcttctccaacgggcggaaccccaaggacggcagctccctggccgtgacgcgccgggccgcccgcgcgatgcggcgccggcgcgaccggctcctgaagcgcaaggcccggatgatgaacaagctggtggagtacgggttcttccccgccgacgtcgccgagcgcaagaagctcgagcggatcaacccctacgagctgcgcgcgaagggcctggacgccccgctcacccccggcgagttcgcccgggccctgttccacatcaaccagcgccgggggttcaagagcaaccgcaagaccgacaagaaggagaacgactccggcgccctgaaggcggccatcagccacctccgccagcagctgcacgagcggaaggcccgcaccgtgggggagtggctgtggcagcggctccaggccggcctggggacgcgcgcccggtaccgcgagtcccgggtggcgcaggccaacggcaagacccgcatcgagaagtcctacgacctgtacgtcgaccggcagatgatcgccgaggagttcgacgccctctgggccgcgcaggccgccttcaacccccagcagttcagcgagcaggcccgcggcgagctgcgggacgtgctgctgttccagcgcgacctgcggcccgtgcgcccggggcggtgcaccctgctccccgacgaggagcgcgcgcccctggccctgcccagcgtccagcggttccgcatcctccaggaggccaaccacctccggctgctccacccggacctgcgcgaggagcccctgtccctcgcccagcgcgacgccgtggtggacgcgctggagcacaacagcaagcggaccttcgagcagctgcgcaagctcctgaagctgaacggcacggtcaagttcaacctcgaggacgagaagcggaaggagctgaaggggaacgccacctccgccaccctgagcaaggacggcctcttcggcgagaactggtggaacctggacgaggccctgcaggacgccatcgtgtggcagctcgtgtccgagcagagcgaggagaagctgcagaactggctgcaggcgaacaccggggtcaacgccacgcaggccgagaccatcgccaacgccggcctgcccgaggggtacggctccctcagctacaaggcgctggcccgcatcatccccgccctgcgggggaccgaggtggccaacggcatcgacgtgccgcgcacctacgaccaggccgtccaggcggccggcttcgcccaccacagcgacctcgactccgggttcgacttcgagcacagccacgacgaggtggagcggatcggcgagcgcgtgatcgcctccacgggggaggtcaagcccgtgttcgcgttcaagcagctgccctactacggcaaggccctgcggcgccacgtggccttcgccaaggagcacccccggaacgaggaggagcgctacgggaagatcgccaacccgaccgtccacatcggcctcaaccagctgcgggtggtcgtgaacgcgctgatccgccggtacggccgccccaccgaggtggtcgtggagctcgcccgggacctgaagcagagccgcgagcagcggcaggaggagcagaagcgccaggccgactaccagaagcggaacgagcacatccgccgcgagatcgcctccatgcacgggtgcgccgaggagcgggtgagccacgcggacgtccagaagtggatcctgtgggaggagctctccttcgacgtggccgaccgccggtgcccctacagcggcgtgcagatctccgcccagatgctgctgagcaaccaggtcgagatcgagcacatcctccccttctcccagaccctggacaacagcctgaacaaccgcacggtggccatgcggcaggccaaccgcatcaaggggaaccggaccccgtggcaggcgcgcgaggacttcgagcggcagggctggtcctacgacagcatcctccagcgcgccgagcggatgcccaaggccaagcgctaccggttctcccgcgacgggtacgagcggtggctgaaggaggacaaggacttcctggcccgcgcgctcaacgacacccggtacctgagccgcgtggccaagacctacatggagctggtctgccccctcggcacgcgggtgatccccggccagatgaccgccctgctgcgcgccaagttcgggctcaacgacgtgctgggcctgaacggggagaagaaccgcgacgaccaccggcaccacgccgtcgacgcgtgcgtgatcggcgtgaccgaccagggcctcctgcagcgcttcgcccaggcctccgccgacgcccgggggaacggcctggagaagctcgtcgagaacatgccggtgccctgggcgacctaccgcgaccacgtgaagcgggccatccagtgcatctgggtcagccacaagcccgaccacgggtacgagggcccgatgatggaggagacggcctacgggatccgcaaggacggctccatccggcagaagaccaaggccgacggcagcaccgggcgcgagatcacccacctgatccggatcacggagcccacccagaacctgcgccacggcgtggacgcccaggggcagcccctcgcgtacaagggctacgtcgggggcagcaacgactgcatcgagatcacccagaacgagcagggcaagtgggaggggaacgtgatcaccacgttccaggcctacgacatcgtgcggcgcctgggctccaagcaggggccccggcgcctgcggcacccgaccctcgcccagaccctggacgtgtacggcaagcccaagaagctggtcatgcgcctcatgatcgacgactgcgtgcggctggagctggacgggaacaagaagaccctccgcgtggtcaagatcaccggcaacggccaggtgttcatggcccccgtgcacgaggccaacgtcgacaagcggaacagcgacaagacggaccccttcgcgtacgtgtccaagtacgccgggagcttccagaaggccaaggcccgccggatcaccatctccccgatcggcgagctgcacgaccccgggttctga

SEQ ID NO: 1492 - RNA, 3174 nt, synthetic construct
  misc_feature 1..3174: note = Cas9 variant
  source 1..3174: mol_type = other RNA
atgagcgacaagtccaagatcctgggcttcgacatcgggatcaccagcatcggctgggcctacgtggagggggaggagctcatcgactgcggcgtccgcatcttcaccaaggccgagaaccccaagacgaaggagtccctggcgctgccgcggcgcgaggcccgcggggtgcggcggcgcctcgcccggcgcaagggccggctgaacgccatcaagcagctgatctgcaaggagttcggcctcaactaccaggactacatcgcccaggacggggagctgcccaaggcgtacgccggcaagctgatcaacccctacgagctccgcagcaaggccctgcgggagaagctggagaaggaggagctcgcccgcgtgatcctgcacatcgcgaagcaccgggggtacggcaacaagcacgccaaggagaccgacgacgccgagtccgggaagatcaagaaggccatcagcaacaacgagaagatcctgaacgagaagggctaccagtccgccggcgagtacctctaccaggagttcttccagaaggagcgcctgcaggaggagaagaaggggaacaacaccaccaaggagttcaagaacgtccggaacaaggcgggcgactacgagcactgcatcgcccagacgcagatgcagaacgagctgcgcctcatcttcgagaagcagcgggagttcgggctgaacttcagcgaggagttcaagaagaaggtgctggagaccgccttcttccagcgccccctcaaggacttctccgacaagatcggcgactgcaccttcatcgagggcgccaagcgggccccgaaggacagcctgtccgcgatcgagttcgtggccctggggcgcatcatcaacaccctcaagaacctgcagaacacgagcggcgaggtctactcccgggacaagatcaacgagatcctgcagatcgtgctcgacaagggggagatcagctacaagaagctgcgcgagatcctggacatcgagtccagcgtgcgcttcaaggactccaagctcgactacaccaaggagctgaaggaggccgagaagaccaagctgttcgagagcaagaacctccagaagttcaagaaggccctgggctccttcgaggggatcagccgggagatcctggacagcatcgccaaggagatcatgatcaccaaggacaaggagaagctcgcgaaggagctgaagaagttccccctggacgagacgcagatccagaacctctccaacctgagcttctcccagaccatcaacctgagcctcgaggccctgtcccagatcctgcccttcatgcgcggcgagcgggaggacaagtgcctccgctacgacgaggccgtcgagaaggccggcctgaaggaggtggccaagaacaagagcaaggacgacttcctgcccccgctcgagaactacgagccctacctggcgaaccccgtggtcgcccgggccctgtccgagtaccgcaaggtgctgaacgccctcctgcggaagtacgggaagatgcacaagatccacatcgagttcacccgcgaggtgggcaagagcaaggaggagcggaacaagatcgagaaggagcagaaggagaacttcgcgaagaaccaggaggcccagaagcagtgcgagatcctggggctccccatcaacggcgccaacatcctgaagatgaagctgtggcgcgagcagcaggagtcctgcgtctacagcgggaaggagatcgccatcgacgacctcaagaacccggccatcctccaggtggaccacatctacccctactcccggagcttcgacgactcctacaacaacaaggtgctggtcttcagcaaggagaaccagaacaagctgaacaagacccccttcgaggcgttcggcgagaacaaggacaagtgggagaagatcctgtccctggccagcaagctccccaagccgaagcgccagcggatctacaacatgcagttcaaggacaaggagcagggcttcctgacgcgcaacatcaacgacaccgggtacatcgcccggctggtgtcccagtggaccaagaactgcctcagcttcgagaagctgtccgaggacgaggtgagcatcgccggcgagaaggggagcaaggtccacgtggaggtgatctccggcagcctgaccgccatgctccgccactactgggggctgggcgacaagaaccgggacaaccacctccaccacgcggtcgacgccatcatcatcgcctactccaacgagaaggtgatcaaggccttcagcgactacaagaagcaccgcgagcagaacaaggccaagttctacgcgaaggagatcgccgagtccgagtacaagaagcagaaggtcttcttcgagcccacgaaccacttccggcagaaggtgctggagaagatcgacagcatcttcgtgtccaagccgccccgcaagcgcgcccggggcgccctgcacgaggagaccttctacagcttcgagcgcctgtgcaacgacaaggagtacgcgaagaaggagaagatggactacgggggcaaggccgggatccagaaggccatcgccctcggcaagatccggcaggtcggcaccaagatcgtgtccaacgggaccatggtgcgcgtcgacatcttccagcacaagagcaacggcaagttctacggggtgcccatctacacgatggacttcgccctgggcgtgctgcccaacaaggcggtcgtgtccgggaaggacaagcagggcgtgatcaaggactggctcgagatggacagcaactacgagttctgcttctccctgttcaaggacgacctgatcctcgtccagaagaaggagatggagaaggccgagctgtgctactacaccgacttcaacagcaacaccgccggcatcaagttcgagaagcacaacaacctgtacgtgaacctcaacgagaacgagcggaagctgttcacctccaaggaggtggtcaagggcgggaagaagaacgtgtggaaggacaagacgcccaaggagatcgagcagctggagaagaaccgcaagatcatcgggggcttcgtgaccatcgaggacctcaagaccttcgagaagtaccaggtcagccccctgggggaggtgcagaaggccgacttcgccccgcggcaggcgatcaccctgaagtccagccccaagcaccgcatcaacaagtga

SEQ ID NO: 1493 - RNA, 3174 nt, synthetic construct
  misc_feature 1..3174: note = Cas9 variant
  source 1..3174: mol_type = other RNA
atgagcaaccgcgtgccctaccggctggccctcgacctgggcaccaactccatcgggtggtgcctgctcgacctgaacggcaacggggacccgtgcggcgtccgccggatgggggtgcgcatcttccccgacggccgggaccccaagagcaaggagtccctggccgcggaccgccggctcgcccgcagcatgcggcgccggcgcgaccggtacctgcgccggcgctccgccctgatgaacgccctcgtggccgcgggcctgatgcccgccgaccgggccacccgcaaggccctggagagcgaggacccgtgcgagctccgggcgcgcgccctgttcgagcccctgacggccgggcaggtcggccgggccctcttccacctgaaccagcgccgcgggttcaagtccaaccggaaggccgcgggcgaggagaacgaggccgggaagatcaaggccggcatcagcgccctgaaggccgagatcgaggcgtccggcgagaccaccctcggggcctggctggccgcccgccaccggaagcgcgagaccgtgcgggcccgcctggacggcgcgggggccaaggccagctacgagttctaccccgagcggggcctcgtgcacgacgagttccaggccatccgcacggcccaggcgctgcaccaccccgccgtcaccgccgagcagtgggaccgggtggagtccgtgatcttccgccagcggccgctgcgccccgtccggcccggcaagtgcaccctcttccccgaccaggagcgcgccccgtgggcgctgcccgtggcccaggagttccggatcctgaccgagatcgggaacctcaagctgtaccgccccggcgaggagccccgggagctgagcgccgaccagcacgcccagctgttcgccaagctctgccgctccgcggacctgacgttcgagaagatccggaaggagctcaagctggacccggggctgaaggtgaacctcgagggcgagaagcgcgaccgcctgaagggggacgccgtcaccagcgccctgtccgccaagaagcggttcggccccaagtggaacgccctcacccccgacgaccgccgggacatcgtgggccgcctgatcgaggcggaggacgaggccgagctggccgggtggctcgagagcgtgcacggcctgccctccgagaacgccgcccacaccgcggccagcccggggctgcccgacggctactgccggctctccgagaaggccctggtcaagctggtgcccctcatgcgcgagcagcggctgcgctacgacgaggccgtgctggcgctgaacctccaccacagcgacttccggcccgaggggctgctggacgagctcccgtactacggcgagcccctggagcgcttcatcgccttcggcagcggggagccctccgacccgcccgagcagcacctgggccggttccccaaccccacggtccacatcgggctcaacgagctgcgcaagctggtgaaccggatcgtggagcgctggggcaagccggccgacatcgtcgtggagctcgcccgggacctgaagcgcagccgggacgagcgcgacaccatccagcgggagcaggcccagaaccagcgcaagaacgaggaccggttcgcgaagatcaaggagctggggatcgacccccgccccgactccatgctccgcctgcggctgtgggaggagctccccaaggtgggcgtcggccacgtgtgcgtctacaccggggagccgatcggcatccgccggctgctggagggggacgtggacatcgaccacatcctccccttcagccgcaccctgtccgacggcgccgacaacaagatcgtgtgcgtccggcgcgccaaccggttcaagcgcgaccggagcccctgggaggccttcggcgtgacggccgtggacgggtacgactgggcggccatcgcccagcgcgccgaggagctgcccaagaacaagcggtggcgcttcctcccggacgccatggaccggttcgagggcgagcgcgggttcctggaccggcagctggtcgagacccgccacctctcccgggtggcgcgccagtacctggccagcatcgtggacctgaacaaggtccgggtggcccccggcaagctcaccgccatgctgcgcgcgcgctgggggctgaacaagatcctctccgacggcaacctgaagaaccggagcgaccaccgccaccacgccatcgacgccgccgtgctgggcatgatcgaccagcggctcgtccagctggtggcccaggcggccgcccgcgccgaggccaacgagctggagcgcctcttcgacgggctgcccgaccccttcgacggcctggcggccacctccttcggggaccaggtgcgggagaagatccggggcatcacggtcagccaccgcgccgagcacgggtggcagggccggatgcacaacgacaccgcctacggcccggtggaggccgtgaacggggtccacaccgtggtgacccgcaagcccctctccggcctgacggcgaaggacttccccaacatccgggaccgcgtcctggccaaggccctcgaggaccacgtggccgccgaggcggccgccgggcggagcttcggcgacgccctggggtccttcaagtggggcggccagcccgtgcgccgggtccgcatgctggacgtgctcgggaacccgatccccatccaggaccccagcggcaccgtgttcaaggtctacaagggggactccaacgcgtggtacgagatcctgcgggacccccgcggccggtggaccgggaagatcgtgagcaccttcgaggcctaccgcctgcaccgggagtggctcgccgagacgggcggcgactccgggcgcggcagcggggtgttcctggactgggccgccaagcgcgtcgtgggcgaggcgggcaccccgctgttccgcctcttcaagggggacctgctggccctcggcgaggcccccgaccggcggatcgtgcgcgtcgtgaagttcagcgagggccaggtggccctggccctgcacctcgaggcggggaacctgaaggcccgggacgccgacaagggggaccccttcaagtaccagtactgctcccccgacagcctgcgcaagcaggccgcccggccggcgggcgtcgacctcctgggctacgtgcacgacaaggggcccctggagtga

SEQ ID NO: 1494 - RNA, 3174 nt, synthetic construct
  misc_feature 1..3174: note = Cas9 variant
  source 1..3174: mol_type = other RNA
atgcgccggctgggcctcgacatcgggaccaacagcatcggctggtgcctgatcgaggacgacaagaagatcgtggacatcggggtccgcatcttctccgacggccgggaccccaagagcggggcctccctggccgtggaccgccgggacgcgcgcgccatgcggcgccggcgcgaccggtacctcggccgccggagcgccttcctgcaggccctggtggtccacggcctcatgccggccgacgcggacgaggccaagctggtggccgaccgcgacccctaccagctgcgggccaaggcgctccacgtggccctggagcccttcgagatcgggcgcgccctgttccacctcaaccagcggcgcggcttcaagtccaaccggaaggccgaccgcaaggccaacgcgggggaggacggcaagatcgccgagggggccaaggccctggaccaggccatgagcgaggcgggcgtcgacaccctgggccagttcctcgccctgaaggagacgaagcgggtgcgcctggggtccgacggccaggcctacgacttctacccccagcgccggcacatcgagtacgagttcgaccgcatctggaaggtgcagagcgagtaccacccggccctcctgaccgaggccgcgcgggccgccctgcaccgcatcctcttcttccagcggcccctgaaggcccaggaggtcgggttctgcaccttcgccggcgtgaacggcatcgcggccaacgagcgccggctgcccaaggcccaccccctcttccagcagcgccggctgtacgaggaggtgaaccagctgcgcatcgtctccgccggggcggccgaccggccgctcaccctggacgagcgcgaccggctgatcctccgcctgcaggaccggaagaaggtgagcttcgacacgctggccaagaaggacctccgcctggccgacggcgagcggttcaacaaggagtccgagaaccgcaaggagctgatcggggacgaggtgcgggccgagatgagcgacaagaagcgcttcggcacccgctgggtccacttcgggctcgacgagcagctgcggatcctggcgaagctccaggacgaggagaaccccgaggccctgctggactggctccgctccgagtacggcctggacgaggccgccgccgagagcgtggcgaacgcccggctgcccgagggctacgggcgcttcggcgagaccgccacccggctcctgctggacgccctcaaggccgaggtgatcacgtacgacaaggcggccctgcgcgccttcgggcaccactccgacttccggaccggcgaggtcctggaccgcctgccctactacggggagctcctgacccgggagatcgccccgggcaagcccgagtacggcgaccccctggagcgccagtacgggaagatcaccaaccccacggtgcacatcggcctccggcagctggagaagctggtgaacgcggtcatcgccgtgcacgggcgcccggaccagatcgtggtcgagctcgcccgggagctgaagctgaacgagaaggagaaggacgagcacaagcgccggatcaagcgcgacaccgacgccgccatcgcgcggggccgcaagctcgccagcgaggggttcatcgacaacggcgccaaccggatgctgatgcgcatctgggaggagctgaaccccgccaaccccctcgaccggcgctgcccctactgcgccgagccgatcggcatccgcgcgctgttctccggggaggccgacatcgaccacatcatcccctacagccggtccctggacgacaacgtgggcaacaaggtcgtggcccaccgcagctgcaaccgggccaaggggaacaagaccccctacgagaagtggggcccccacatcgacccggagcgctgggagcggatcagcgaccaggtggcccgcctccacaagtccaagcagtggcggttcggccccgacgcgatggagcgcatcgaccgggacgggggcttcctggcccgccagctgaccgacacgcagtacctcagccgggtcgccgggaagtacctgcgctccctgtaccccaccgcccagagcggccgggtggacgtgatccccgggcgcatgaccgcgatgctccggcgcaagtggggcctgaactccctgctcccggaccacaactacgtcgagaacgagcacagcaacgcccccaagaaccggctggaccaccgccaccacgccatcgacgccgccgtggcggccgtgaccacgctgtccctcatgcagcagatcgccgacgccgccggccgggcggaggacaagaacctggaccgcctgttcgaggacatcccccagccgtggcccgggttccgcgaggagctcggcgaggccctgcggagcaccaccgtctcccacaaggccgaccacgggcgcaagcggcgccccagccgggaccgcgacgtgaccgccgcccggctgcacaacgacacggcgtacggcctcaccggggacgtggccgccgacggcaagacccccatcgtcgtgcaccgcgtgccgctggcctccctgaagcccgccgacctcatcgaccccctgcggatccccgacccggtcctgcgcgacgcgctctacgccgccacccgggaccgcacgggcaaggagttcgagcaggccctgacccagttcgcgcggcaccaccccctgttcaaggggatccgccgggtgcgcgtgcgggagcccctcaacgtcatccccatccgcgacgccgccggccgggcctacaaggcctacaagggggacgcgaacgcccgcttcgacgtgtggcggctgccgaacggcaagtgggtgagcgacatcgtctccatgttcgacgcccactgcatggccgacaagagcgaccgccgcccccaccccgccgcgaagaaggtgctgtccctccggcagaacgacatggtggccatcgagcgcagcggggtcacccagatcgcccgggtggtgaagttctccaccaacggcagcatcgccctggccgcggacaacgaggccggcgccctgaaggcccgcgacgcggcccccaacgacgtcgacccgttcaagtacatcttctccagcgggggcgggctcaagaacctgaaggcccgccaggtgcgggtggaccccctgggccgggtcttcgaccccgggccccgcgagtga

SEQ ID NO: 1495 - RNA, 3177 nt, synthetic construct
  misc_feature 1..3177: note = Cas9 variant
  source 1..3177: mol_type = other RNA
atgaagaacagctacatcctgggcctcgacgtggggatcgcctccgtcggctacgggctgatccacagcgactccaagagcgtgatcgacgccggcgtgcgcctgttccccgaggcgaacgtcgagaacaacgaggggcggcgcgccaagcggggctcccgccggctcaagcgccggcgcatccaccggctggaccgcgtgaagtacctgctcgcccagtaccacctgatcatcgacgacaagatccccaagagcaccaacccctacgccatccgggtgaagggcctgtccagcgccctctccaagagcgagctggtcatcgcgctgctccacctggccaagcgccgggggatccacaacgtgaacgtggtcatggacgagaacgagtccaccaacgagctgagcacgaaggagcagctcaaggagaacgccaagcagctggagaaccgctacgtgtgcgagctgcagctcgaccggctgaacgagcagtacaaggtgcgcggcgagcggaaccgcttcaagaccgaggacttcgtccgggaggcccgccagatcctgaccacccagcagaagtaccacgacatcgacgagcacttcatcgagcagtacacgcacctcctggagacccggcgcgagtactacgaggggcccggcaaggggtcccagtacggctgggagggcgacctgaagcagtggtacgagatgctcatggggcgctgcacctacttccccgaggagctgcggagcgtgaagtacgcgtacaccgccgacctgttcaacgccctcaacgacctgaacaacctggtgatcgcccgcgacgagaacgagaagctcgagtacttcgagaagtaccacatcatcgagaacgtcttcaagcagaagaagtccccgacgctgaagcagatcgccaaggagatcgacgtgaaggagagcgacatcaagggctaccggatcaccaagaacgggaagccccagttcacctccttcaagctgtaccacgacctcaacaagatcttcctggacaagaagaacctggagaacatcgagctcctggacgagatcgcgttcatcctgaccctctaccaggaccccctgagcatcaaggaggccctggaccagctccaggacctgctgacggagtccgagaaggaggccatcgcccacctcaacggctacaccggcacccaccgcctgagcctgaagtgcctccacctcctgatcgacgagatgtggcagaccagccggaaccagatggaggtgttcacggccctgaacctcaagccccagaagtaccagctgtccaagcagaagcagatcccgaagaagatggtcgaggagttcatcctgagccccgtggtgaagcgctccttcatccagagcatcgagatcgtcaacaccatcatcaagaagtacgggctccccgaggagatcatcatcgagctggcgcgggagaagaactccgaggaccgccggaagttcctgaaccgcatccagaaggagaacgagaacacccggaagcaggtcgaggaggtgatccgcgagtacggcaaccggaacgccaaggggctcgtggagaagatcaagctgcaccagatgcaggagggcaagtgcctgtacagcctccagaacatccccctggacgacctgctccgcaacccgtcccactacgagatcgaccacatcatcccccggagcgtgtccttcgacaacagcttcaacaacaaggtcctggtgaagcaggaggagaactccaagaaggggaaccgcaccccctaccagtacctgaacagcaacgagtccgtgctcagctacgtccagttcaagcagcacatcctgaacctgtccaagagcaaggagcggatctccaagaagaagcgcgagtacctcctggaggagcgggacatcaacaagttcgaggtgcagaaggagttcatcaaccgcaacctggtggacacgcgctacgccacccgggagctcgtccagctgctcaagagctacttctccgccaacgacctggacgtgaaggtgaagaccatcaacggcagcttcaccaactacctgcgcaaggcctggaagttcgacaagagccggaacaagggcttcaagcaccacgcggaggacgccctgatcatcgccaacgtctcctacctcttcaagcagagcaaggagctgaaggaggccaacgccatcctggagaacaacaacctctccctgaacaagaacaaggacagcaagaacctgctcacggagcaggactaccgcaagatgttcgagatccccaagcaggtccaggacatcaaggactacaaggacttcaagtactcccaccgggtggacaagaagccgaaccgccagctgatcaacgacagcctgtactccacccgggaggtgaacgagaaccactacatcgtgcagaccgtgaaggacatctacgcgaaggacaacaccaagatcaaggacctcttcctgaagacgcccgagaagctgctcatgtaccagcacgacccccagaccttcgagaagctgatgctggtcatcaagcagtacggggaggagaagaaccccttcgccaagtactacgaggagaacggcgagtacctcaccaagtacgccaagaacgagaaggggccgaccatcaagcgcctgaagtacatcggcaagaaggtggggacgcacctggacatcagcaccaacttctccggcgccaagcggaaggtggtccagctcagcatcaagcccttccgcttcgacgtgttccactccaaggcgggctaccacatgctgaccctgacctacatggacatcaagaagaaggagaagcactaccagatcctcaagaacgagtaccaggccctgaaggagcggtacaaggtgcccagcgacgcccagttcatcgggtccttctactacaacgacctgatcagcatcaacgacgagctgttccgcgtcatcggcgtgaacaactccacgcggaacgtggtcgagctgaacatggtggacatcaactacaaggactactgcgacctgatggggatcaagaagaccccgcgcatcttcaagaccatcaccaagaagaccggcaagatcgagaagtacagcacggacatcctcgggaaccagttcaaggtgaagccgtccaagagcccccagctgatcttcaagcggggcgtcctgtga

SEQ ID NO: 1496 - RNA, 3180 nt, synthetic construct
  misc_feature 1..3180: note = Cas9 variant
  source 1..3180: mol_type = other RNA
atgcgccggctgggcctcgacatcgggaccaacagcatcggctggtgcctgacccaggggcccggcgacgaggccgacgggatcgtggacatcggcgtccgcatcttctccgacggccgggacccgcagagcgggacgtccctggccgtggaccgccgggacgcgcgcgccgcccggcgccggcgcgaccggtacatcggccgccggagcgccttcctcgacaccctggtggcccacgggctgatgcccgcggacgccgacgaggccaagctcgtcgccgcgctggacccctacaccctgcgcgcccgggccctcgaggcgcccctgaccccgcacgagatcggccgcgccctgttccacctcaaccagcggcgcgggttcaagtccaaccggaaggcggagcgcaagacgaacgacgccgacgacggcaagatcgccaccgccgcctacgcgctggaccgggccatgctggacggcgggttcgacaccctcggccagttcctgaacgcccaggagaccaagcgcgtgcgcatggacggggaggcccagggctacgacttctacccccagcggcgccacgtggagtacgagttcgaccggatctggacggagcaggccaagcaccaccccgcgctgctcaccgagaccgcccgctacgccctgcaccggatcctgttctaccagcgccccctcaaggcccaggtcgtgggcaagtgcaccttcgtgcacagcgaggaccggctggccaaggcgcacccgctgttccagcagcgccggctctacgaggaggtcaaccagctggaggtgacgacccccggggaggccaaccgcaagctgaccctcgacgagcgggaccgcctggtgcgggagctgtcccacaagaaggccatcgccttcaccagcctcgcggccaagatcaagctggagcccggccagtccttcaacaaggccagcgagacgcgcacccagctggccggggacgaggtccgggccgtgctcggcgacaagaagcgcttcgggcccgcgtgggagcacttcgaccgggaccgccagtggaccatcgtggagcggctgctggaggaggaggacccggacgccctccacgccttcctgacccaggactgcggcctggacgacgagcacgccgccgcgacggccaagacctccctccccgagggctacgggcgcctgggcgccaccgccaccgcccgcatcctggcggagctccaggccgaggtcatcacgtacgacgaggccgtgcggcgctgcgggtggcaccacagcgaccaccggaccggcgagatcctgccccagctgccctactacggggagctcctgacccgcgacatcccgcccggcacccaggaccccaacgacccgcccgagaagcggtggggccgcatcacgaaccccaccgtgcacatcgggctgaaccaggtccggcagctcgtgaacgccatcgtggcggtccacggccgccccgaccagatcgtggtggagctggcccgggagctgaagctgaacgagaaggacaaggaggagcacaaccgccggatccgccgggacaccgccgccgccatcaagcgctccgagaagctcacccaggaggggttccccgacacgggcgcgaaccggatgctgctgcgcctctgggaggacctgaacccggccaaccccctggaccggcgctgcccctactgcggggcccccatcggcatgcgggccctcttcgccggcgaggcggacgtcgaccacatcatcccgtacagccgctccctggacgacagcgccgggaacaaggtggtcgcccaccggtcctgcaaccgcgccaagggcaaccgcaccccctacgagaagtggagcgacgaccccgaccggtgggacgccatcaccgcccaggtggcccgcctgcaccggtccaagcagtggcgcttcgggccggacgccatggcccgggtggagaaggacggcggcttcctcagccgccagctgaccgacacgcagtacctgagccggctcgcggggcgctacctgtccagcctgtaccccaccaaggaggagggctccgtctacgtgatccccgggcggatgaccgccatgctccgccggctgtggggcctgaacgacatcctcagcgaccacaacatcgtggagaacaagcactccaacgcccccaagaaccgcctggaccaccggcaccacgccatcgacgccgcggtcgtggccgtgagcacccgctccctgatgcagcggatcgcccgcaccgccgggcaggccgaggaccggaacctcgaccgcctgttcgagggcctggacccgccctggcccggcttccgggaccagctccgcgaccgcctgctggcggtcacggtgagccacaaggccgaccacgggcggaccggcacccccgtgccggggaaggacgccaccgccggccgcctccacaacgacacggcctacgggctgaccggcgagacctccgcgaagggcctgcccatcgtcgtgcaccgggtgcccctcaccagcctgaagcccgccgacatcacggacccggaccgcatccccgaccccgtcctgcgggacgccatcgagcgcgccaccgccgggaagatgggcaaggacttcaccgacgcgctcgccaagttcgggcggtccggcgcccaggagaccgaccgcaagggggagcggctgttccgcggcacgcggcgcgtgcgggtgcgcgagcccctgggcgtcatcccgatcgccgacgcgagcgggcgggtgtacaaggcctacaagggcgactccaacgcccgcttcgacgtgtggcggctccccgacgggaagtgggtcagcgacatcgtgtccatgttcgacgcccaccgccccgaccagggcgaccggcgcccccacccggccgcgaagaaggtgctgagcctgcggcagaacgacatgatcgccatcgagcgcgacggggcgccccgcgagatcgtccgggtggtgaagttctccaccatcggcagcgtccagctcgccgccaccaccgaggccggccccctgaaggcccgcgacgcctccccgcccgacgtggaccccttccggtacatcaacagcagcgccgggggcctgaagaagatcaaggcccgccaggtgcggatcgaccccctcgggcgcatcttcgacccgggcccccggtga

SEQ ID NO: 1497 - RNA, 3180 nt, synthetic construct
  misc_feature 1..3180: note = Cas9 variant
  source 1..3180: mol_type = other RNA
atgatcgagcgcatcctgggcgtggacctcgggatcagctccctgggctgggccatcgtcgagtacgacaaggacgacgaggccgcgaaccggatcatcgactgcggggtgcgcctgttcaccgccgccgagacccccaagaagaaggagagcccgaacaaggcccggcgcgaggcccggggcatccgccgggtgctcaaccgccggcgcgtccggatgaacatgatcaagaagctgttcctgcgcgcggggctcatccaggacgtggacctggacggcgagggcgggatgttctactccaaggccaaccgggccgacgtgtgggagctgcgccacgacggcctctaccggctgctgaagggggacgagctcgcccgcgtcctgatccacatcgcgaagcaccggggctacaagttcatcggggacgacgaggccgacgaggagagcggcaaggtgaagaaggccggcgtggtcctgcgccagaacttcgaggccgccgggtgccggacggtgggcgagtggctctggcgcgagcgcggggcgaacggcaagaagcggaacaagcacggcgactacgagatctccatccaccgcgacctgctggtggaggaggtcgaggccatcttcgtggcccagcaggagatgcggagcaccatcgccaccgacgccctcaaggcggcctaccgcgagatcgccttcttcgtgcggcccatgcagcgcatcgagaagatggtcgggcactgcacctacttccccgaggagcggcgcgcccccaagtccgccccgacggcggagaagttcatcgccatcagcaagttcttctccaccgtgatcatcgacaacgagggctgggagcagaagatcatcgagcggaagaccctggaggagctgctcgacttcgccgtgagccgcgagaaggtcgagttccggcacctccgcaagttcctggacctctccgacaacgagatcttcaaggggctgcactacaagggcaagcccaagaccgccaagaagcgggaggccacgctgttcgaccccaacgagcccaccgagctcgagttcgacaaggtggaggcggagaagaaggcctggatcagcctgcgcggggccgccaagctgcgggaggcgctcggcaacgagttctacggccgcttcgtggccctggggaagcacgccgacgaggccaccaagatcctgacctactacaaggacgagggccagaagcggcgcgagctcacgaagctgccgctggaggccgagatggtcgagcggctcgtgaagatcgggttctccgacttcctgaagctgagcctcaaggcgatccgcgacatcctgcccgccatggagtccggcgcccggtacgacgaggccgtgctgatgctcggggtcccccacaaggagaagtccgccatcctgcccccgctgaacaagaccgacatcgacatcctcaaccccaccgtgatccgcgcgttcgcccagttccgcaaggtcgccaacgccctggtgcggaagtacggcgccttcgaccgcgtgcacttcgagctggcgcgggagatcaacaccaagggcgagatcgaggacatcaaggagagccagcgcaagaacgagaaggagcggaaggaggccgccgactggatcgccgagacgagcttccaggtccccctcacccgcaagaacatcctgaagaagcggctgtacatccagcaggacgggcgctgcgcgtacaccggcgacgtgatcgagctggagcggctgttcgacgaggggtactgcgagatcgaccacatcctgccccgctcccggagcgccgacgacagcttcgccaacaaggtgctgtgcctcgcccgcgccaaccagcagaagaccgaccggacgccgtacgagtggttcggccacgacgcggcccgctggaacgccttcgagacccggacctccgcccccagcaaccgcgtccggaccgggaagggcaagatcgaccgcctgctgaagaagaacttcgacgagaactccgagatggccttcaaggaccggaacctcaacgacacgcgctacatggcgcgggccatcaagacctactgcgagcagtactgggtgttcaagaacagccacaccaaggcccccgtgcaggtccgctccggcaagctgaccagcgtgctgcgctaccagtgggggctcgagtccaaggaccgggagagccacacgcaccacgccgtggacgccatcatcatcgcgttctccacccagggcatggtccagaagctgagcgagtactaccgcttcaaggagacccaccgggagaaggagcgccccaagctggccgtgccgctcgccaacttccgggacgccgtggaggaggcgacccgcatcgagaacacggagaccgtcaaggagggggtggaggtgaagcggctgctgatctcccgcccgccccgggcccgcgtcaccggccaggcccacgagcagaccgccaagccctacccccggatcaagcaggtcaagaacaagaagaagtggcgcctcgcccccatcgacgaggagaagttcgagagcttcaaggcggaccgggtggcctccgccaaccagaagaacttctacgagacgagcaccatcccccgcgtggacgtgtaccacaagaagggcaagttccacctggtgcccatctacctgcacgagatggtcctcaacgagctgccgaacctgtccctcgggaccaaccccgaggccatggacgagaacttcttcaagttcagcatcttcaaggacgacctgatctccatccagacccagggcacccccaagaagccggccaagatcatcatggggtacttcaagaacatgcacggcgcgaacatggtgctgagctccatcaacaacagcccctgcgaggggttcacgtgcacccccgtgagcatggacaagaagcacaaggacaagtgcaagctctgccccgaggagaaccggatcgccggccgctgcctgcagggcttcctggactactggtcccaggaggggctccggccgccccgcaaggagttcgagtgcgaccagggcgtcaagttcgccctggacgtgaagaagtaccagatcgaccccctggggtactactacgaggtgaagcaggagaagcggctcggcaccatcccccagatgcgcagcgccaagaagctggtcaagaagtga

SEQ ID NO: 1498 - RNA, 3180 nt, synthetic construct
  misc_feature 1..3180: note = Cas9 variant
  source 1..3180: mol_type = other RNA
atgagcaagcgcctgcggtaccgcctcgccctggacctgggcaccaactccatcgggttctgcctcctggacctgaacggcgacgggcggccctgcggcgtgcgccggatgggggtccgcatcttcccggacttcagcaagctccagcagtccctggccgcggaccggcgcctggcccggagcatgcgccggcgccgggaccgctacctccggcgccggaaggccctgatgaacgccctggtggccgcggccctcatgcccgccgaccccaaggcccgcaaggcgctggaggccctggacccctacgagctccgggccgccgccgtggcgggcccgctgcccgcccaccagctgggccgcgccctcttccacctgaaccagcggcgcgggttcaagtccaaccgcaaggccgccggcgacgagaacgaggcggggaaggtcaagagcggcatctccgccctgaaggccgagctcgccgccagcggggcgggcaccctgggccagtggctggccgcccggcacgccaaccgccagcccgtgcgggcccgcctcacggggaccggcgcgaaggccacctactccttctaccccgagcgggccctggtgcacgaggagttccaggccatccgcgcggcccaggccccgcaccaccccggggtcaccgccgagcagtgggaccggatcgagagcgtgatcttccaccagcgccccctgaagcccgtgaagccgggcaagtgcacgctctaccccgaggaggagcgggccccctgggcgctgcccatcgcccagcgcttccggatcctgcacgagctccacaacctgcgcatcgtccggccgggccagggggaggagggcctgtcccccgccgacttcgaccgcttcttcgaccggctctgccgcaagggggacctgaccttcaagaccctggccaaggagctcaagctgccgcccgacgcccggatcaacctggaggacgacaagcgcgaccggctcaagggcgacgcgaccgccgacgccctgagcgccgagaaggggaagcgccgccggatcggcgccgcgtggcactccttccccgccgaccgccagcgggagatcgtgggccgcctgatcgacgccgaggacgagggggagctcgccgcgtggctggtggaggagctgggcctcccctgggaggtcgccatcctgacggccgagcggcccgggctgcccgacggctactgccgcctcagcgagaaggccctggagcaggtcgtgccgctgatgcacgaggagcacctcccctacgacgaggccgtgcgggcgctcgggctgcaccactccgaccaccgcaccggcgagttcctggacgagctcccctactacggcctgcccctggagcggttcatcgccttcgggaccggcgaggccgacgacccgcccgagctccgcatcgggcggttccccaacccgaccgtgcacgtggccctgaacgagctgcgccgggtcgtgaaccgcatcatccggcgctggggcaagcccgaggagatcgtggtcgagctcgcccgggacctgaagcagagccgcgcggaccgggacaagacgcagcgcgagcaggccgacaaccagaagaagaactggacccggacccagcagctgcgcgagctcgggatggagcccaccggcgaggccctgctgcgcctccggctgtgggaggagctgccccgcatcggctccgcccacgtgtgcgtgtacacggggcagccgatcagcatgacccagctcctgcagggcgacgtcgacgtggaccacatcctgcccttctcccggaccctcgccaacggggcggacaacaagatcgtctgccaccgccgggccaaccgcatcaagcggaaccgcaccccctgggaggccttcggcgtggtgagcgccgacggctacgactgggcggccatcgccgagcgggccgagagcctgcccaagaacaagcgctggcggttcctgccgaacgccatggagcgcttcgagacggagcgggggttcatcgaccgccagctcgtcgagacccggcacctgtcccgcgtggcgcgggagtacctgggctgcatcgtgcccctcgagaaggtccgcgccgcccccgggcggctgaccgccatgctgcgcggccgctgggggctcaacagcatcctgtccgacgccaacctgaagaaccggagcgaccaccgccaccacgcggtggacgccgccgtgctcggcgtcatcgaccagcggctggtgcagcgcgtggccgacgccgcgaagcgggccgaggagaaggagctggagaagctgttcgacggcctgcccgacccgttcgaggggctgcccggcccctccttccgcgaccaggtccaggagcgggcccaggggatcatcgtgagccacaagcccgagcacggctggcaggggcgcatgcacaacgacaccgcctacggcccggtggagcggctccccgacggcacgcaccgcgtcgtgacccggaagcccctggggtccctggccgagaaggacttcggcaacatccgcgaccgggcgctcgccgccgccctggagcgccacgtggcggagcaggccgcccaggggcggagcctgggcgaggccctctcctgcttcacctggaccgggggcgaggtccgccgggtgcgcatgctggacaagctgggcagccccgtggccgtccaggacgacgacgggcacacgttcaagctctacaagggcgactccaacgcgtggtacgagatcctgcgggacgggcgcggccggtggaccgggcgcatcgtgagcacctacgaggcctaccgcctgcacgccgagtggctcgccgagcggggcgacggcgggcgctccgacgccgcgttcccggactgggccgcccggcgcctgtgcgccggcatcgggaagcccctgttccgcctcttcaagggcgacatgctggccttcggcaccgcgcccaaccgggagatcatgaaggtggtcaagttcagcgaggggcggatcgtgttcgccggccaccgcgaggccgggaacctgaaggagcgggacgccgacaaggacgaccccttcaagtaccgcacgtgctccccggaggcgctccggaaggcccaggcccgccccgtgggcgtcgaccccgccgggttcgtgcacgaccggggcccgctggagtga

SEQ ID NO: 1499 - RNA, 3180 nt, synthetic construct
  misc_feature 1..3180: note = Cas9 variant
  source 1..3180: mol_type = other RNA
atgggcatccgcttcgccttcgacctggggaccaacagcatcggctgggccgtgtggcggaccgggcccggcgtcttcggggaggacacggcggcctccctcgacggcagcggcgtgctgatcttcaaggacgggcgcaacccgaaggacggccagtccctggccaccatgcggcgcgtgccccggcagagccgcaagcggcgcgaccggttcgtcctccgccggcgcgacctgctggccgccctccggaaggcggggctgttccccgtggacgtggaggagggccgccggctggccgccaccgacccctaccacctccgcgccaaggcgctggacgagtccctgaccccgcacgagatggggcgggtcatcttccacctcaaccagcgccggggcttccgcagcaaccggaaggccgaccgccaggaccgcgagaagggcaagatcgccgaggggtccaagcggctggccgagacgctggccgcgaccaactgccgcaccctcggcgagttcctgtggagccggcaccgcgggacgccccggacccgctcccccacccggatccgcatggagggcgagggcgccaaggccctgtacgccttctaccccacccgggagatggtgcgcgccgagttcgagcggctctggaccgcgcagagccgcttcgccccggacctgctgacgcccgagcggcacgaggagatcgccgggatcctcttccgccagcgggacctggccccgcccaagatcggctgctgcaccttcgagccctccgagcgccggctgccccgcgccctccccagcgtggaggcgcgggggatctacgagcgcctggcccacctccgcatcaccaccggccccgtctccgaccgggggctcacgcgcccggagcgggacgtgctggccagcgccctgctcgccggcaagtccctgaccttcaaggcggtgcgcaagaccctgaagatcctcccccacgccctggtcaacttcgaggaggccggcgagaaggggctggacggcgccctcaccgcgaagctgctgagcaagcccgaccactacggggccgcctggcacggcctctccttcgccgagaaggacacgttcgtggggaagctgctggacgaggccgacgaggagcggctcatccgccggctggtgaccgagaaccgcctgagcgaggacgcggcccggcgctgcgcctccatccccctcgccgacggctacggccggctggggcgcaccgccaacaccgagatcctggcggccctcgtcgaggagacggacgagaccggcaccgtggtgacctacgccgaggccgtccggcgcgccggggagcggacgggccgcaactggcaccacagcgacgagcgggacggggtgatcctggaccgcctgccgtactacggcgagatcctgcagcggcacgtggtccccggcagcggggagcccgaggagaagaacgaggcggcccgctggggccggctcgccaaccccaccgtgcacatcgggctgaaccagctgcgcaaggtggtcaaccgcctcatcgccgcgcacggccggccggaccagatcgtggtcgagctggcccgcgagctgaagctcaaccgggagcagaaggagcgcctggaccgggagaaccgcaagaaccgggaggagaacgagcgccggaccgccatcctggccgagcacggccagcgcgacaccgccgagaacaagatccggctccgcctgttcgaggagcaggcgcgggccaacgccgggatcgccctgtgcccctacacgggccgcgccatcgggatcgcggagctgttcacctccgaggtggagatcgaccacatcctgcccgtgagcctgaccctcgacgactccctggccaaccgggtcctgtgccgccgggaggccaaccgcgagaagcggcgccagacccccttccaggccttcggcgccacgccggcgtggaacgacatcgtggcccgcgccgccaagctcccgcccaacaagcggtggcgcttcgaccccgcggccctggagcggttcgagcgcgagggcgggttcctgggccggcagctcaacgagaccaagtacctgagccgcctggccaagatctacctcgggaagatctgcgaccccgaccgggtgtacgtcacccccggcaccctgaccgggctgctccgcgcccggtggggcctgaactccatcctgagcgactccaacttcaagaaccgcagcgaccaccggcaccacgccgtggacgcggtggtcatcggggtgctcacgcgcggcatgatccagcggatcgcccacgacgccgcccgcgccgaggaccaggacctggaccgggtgttccgcgacgtccccgtgccgttcgaggacttccgggaccacgtgcgcgagcgggtctccaccatcaccgtggcggtgaagcccgagcacggcaagggcggggccctgcacgaggacaccagctacgggctcgtccccgacacggaccccaacgccgccctgggcaacctggtggtgcgcaagccgatccggtccctcaccgccggggaggtcgaccgcgtgcgcgaccgggcgctgcgcgcccggctgggcgccctcgccgcccccttccgcgacgagagcggccgggtgcgcgacgcgaaggggctggcccaggccctggaggccttcggcgcggagaacgggatccggcgcgtccggatcctcaagcccgacgcctccgtggtgaccatcgccgaccgccggaccggcgtcccctaccgcgccgtggccccgggggagaaccaccacgtggacatcgtccagatgcgggacggcagctggcgcggcttcgcggcctccgtgttcgaggtgaaccggcccgggtggcgccccgagtgggaggtcaagaagctgggcgggaagctggtgatgcggctccacaagggcgacatggtggagctgagcgacaaggacggccagcgccgggtcaaggtggtgcagcagatcgagatctccgccaaccgcgtccgcctgagcccccacaacgacgggggcaagctccaggaccggcacgccgacgccgacgacccgttccgctgggacctggcgacgatccccctgctcaaggaccgggggtgcgtggccgtgcgcgtcgaccccatcggcgtggtgaccctgcggcgctccaacgtctga

SEQ ID NO: 1500 - RNA, 3183 nt, synthetic construct
  misc_feature 1..3183: note = Cas9 variant
  source 1..3183: mol_type = other RNA
atggccgtcaagagcctgaactacatcctcggcctggacctggggatcgcctcctgcggctgggcggtggtggagatggacgagcaggagaaccccctccgcctgatcgacgtgggggtccggaccttcgaggaggccgagaacccgaaggacggcagctccctggccgagacccgccggctcgcccgcgcccagcggcgcctgatcagccggcgcgcgaaccggatgaacaagctgcgccggctcctgaagcaggagaacgtgctgcaggccaacgactacgacgagaaggggctcatcatcggcctgcccaaccaggcctgggagctgcgcgcccagggcctcgaccggaagctggagcccaaggagtgggcggccgtgctgatccacctcgtcaagcaccgcgggtacctgtcccagcggaagaacgagagccagacggccgacaaggagctgggcgccctcctgtccgggatgaaccacaaccaccagctgctccagagccagtccaaccagtaccgcacccccgccgagctggcgatcaagcagttcgccacccaggacggccacatccggaaccagcgcggggcctacacccacacgttcaaccggctggacctccagaacgagctgaaccagctgttcgacgcccagacccgcctcggcaacccgcacgtgagcggctccctgaagaccgccatcaacgacctgctcatgaaccagaaggcggccctgagcggggacgccatcctggagatgctcggccggtgcaccttcgagccctccgagtacaaggccgccaagaacacgtacagcgcggagcgcttcgtgtggctggggaagctgaccaacctccgcatccaggacaacggcctggagtccgccctgagccgggagcagcgcgagctcctgctgaacgagccctacaacaagaccaagctcacctaccagcaggtccggaagctgctgcgcctccccgagacggccttcttcaagggcctgcggtacgggaaggacaacgccgagtccgccaccctgatggagatgaagtcctaccacgcgatccgcaagagcctggagaacaagagcctcaagagcgagtgggagaagctgaagacccagccgaagctgctcgacctgatcggcaccgccttctccatctacaagacggacgacgagatcgccgggtgcctgaagaaccagctccccgagaacgtgatcatcgccctgcaggagcagctgaacttcagcaacttcatggagctctccctgaaggcgctggagaagctcctgcccctgatggagcagggcctccggtacgacgaggcctgcacccagatctacgggaaccgccacgagaagatcgccgacaagaccgagaagttcctgcccaacatcccggccgacaagctgcggaaccccgtggtcctccgcaccctgacgcaggcccggaaggtgatcaacgcgatcatccgccggtacggcagccccgcccgcgtgcacatcgagaccggccgggaggtcgggaagtccttcagcgaccgcgacaagctgaagaagcagcaggaggagaaccaggagcagcggcgccgggccatcgacgagtggaagcagttcttccccaacgccgcccacgagccgaaggcggtggacatcctcaagctgcgcctgtaccagctccagcagggcaagtgcctgtactccgggctgcccatcgacgtgcgccggctccccgagaagggctacgtcgagatcgaccacgccctgcccttcagccgcacctgggacgactccttcaacaacaagatcctggtgctcgccagcgagaaccagaacaaggggaaccagaccccgtacgagtacctgcggggcgccgacaactccgagagctggcgcctgttcgtggagaacgtccagaactgccagttctcccccaacaagaagcagaagatcatggccaagcagctcgacgagaagggcttcctggagcggaacctgaacgacacgcgctacgtgagccggttcctctgccagttcatctccgagtacctgcacctgaccgggaagggcaagaagcgcgtgttcgcgagcaacgggcagatcaccgccctcctgcggggccgctgggggctgtccaagaaccgggaggagaacgaccgccaccacgccgtcgacgccgtggtcgtggcgtgcagcaccgtggccatgcagcagaagatcacgcagttcgtccggtaccagaagggcaacgtgttcaccggcgagcgcatcgacaaggagaccggggaggtgatctccatccacttccccaccccctgggagcacttccgggaggaggtcatgatccgcgtgttcgacgacaacccgctccggacgctgcccgagaagctgcccaaccgccccgaggccctccacgagtacgtgatgccgctgttcgtcagccggatgcccacccgcaagatgaccggccaggggcacaaggagaccatcaagagcgccaagcggctggacgagaagatctccgtgctccgcgtgcccctgacgcagctgaagctcaacgacctggagaacatggtcaaccgcgagcgggagccggccctgtacgaggcgctcaaggcccgcctggagcagttcaagaacgaccccgccaaggccttcgccgagcccttcttcaagcagggcggccagcaggtcaaggcggtgcgggtggagatcgtgcagaagtccgggatgctgctccgcaagatcaacggcgtggccgacaacgggagcatggtccgggtggacgtgttcgagaagtccggcaagttctacctggtccccatctacgcctggcaggtcgccgaggggatcctgccgaaccacgccgtggtgcacagcaaggacgagagcgactggatcctcatggacgagtcctaccacttcaagttcgcgctgtacaagaacgacctgctcgaggtgcagaccaagaagggctgcatcatgggctacttcgccagcctggaccgcgccaccggggccatcaccatccgggagcacgaccgcgacaagaagaagtgcaaggacggcgagcaccggtccatcggggtgaagatggcgagctccttcaagaagctgcaggtcgacgagctcggcaagaacatccacgagacccgcagccggaagcgccccaacatcgggtga

SEQ ID NO: 1501 - RNA, 3186 nt, synthetic construct
  misc_feature 1..3186: note = Cas9 variant
  source 1..3186: mol_type = other RNA
atgcacaccctgccctacaccctcggcctggacatcgggatcgccagcgtgggcgccgcgctgctctccgacgagagcatcctggggatgcacgtccgcacgttctccgccgccgagaccgacaaggagggcgacccgctgaacaagatccggcgcgaggcccggagcgcccgccggcgcatccggcgccgggcgcaccgcctcctgcggctgcgccggctcctgaagcgcaccgggctgatctccgacaccagcctcgaggtgctgaagacgtccaagaccccctggcagctgcggagcgagggcctcgaccgcctgctgtcccccagcgagctcgccgccgccctgtaccacatcgtgaagcaccggggcttccagtccaaccgcaaggcggagctgaagaccgacgccaaggccgggcagatgctcagcggcgtctccgccaaccagcagctgatgcgggacaagagctaccgcaccatcgccgagatggtgtgcaaggacgacgcgttcaaggaccacaagcggaacaagggcgggtcctaccgcaacacgttcgcccgcagcgacctggccgacgagctcaagaccctgctgaagaagcagcgggagtacgacaaccccctcgccaccccggagctggaggaggccgtgcacaccctgctcatggcgcgccggcccgtcttcaaggacgacgacatcgagaagctggtggggttctgcacgttcgagcacggcgagaagcgcgcccccaaggccgccttctccagcgagcggttcatctggctgggcaagctcaacaacctgcgcctgatctaccccggggagcagcggtccctcaccccggaggagcgcagccagatcatcaacctgcccttcacccaggccagcgtgaagttctcccagatccggaagaagctggacctccccgagtacgtccgcttcaacctggtgcggtacaagcccggcgaggagaccagcaagtccgagacggcgaccttcttcgaggccaaggccttccacgagctgcgcaagacctaccgggagagcgggatctccgagctctgggagcgcgaccagcacgacccgcagcggctggaccagatcgccaccgccatcgcggtgtaccgcgacgacgagcggatccgcaacgagctgagcccccacacgatcgagaacgaggtcgtggaggccgtgctcaactgcgacttcacccagttcatcaacctgtccctgaaggccctcaacaagatcctgccctacatggagcagggccagcggtacgacgaggcctgcaccagcgcgggctaccagcaccacagcccccagcagaacgaggagaagtccgggcgcatcccgccgcccgacaagaacgtcatccgcaaccccgtggtgtaccggtccctgaaccaggcccgcaagctgatcaacgccatcaccaagcggtacggcgcccccgccgcgatccacctcgagatggcccgcgacctgagcaagcccttctccgagcgcaagagcatcgagcgggagcaggagaagtaccggaagcagaaggtccagctgcgcaacgagtacatcgagcacttcgggacggagcccaacggcctcaacctgctgaagttccggctctacaaggagcaggacgcccagtgcgcctacacccagaaggccctggacctgtcccgcctcaacgaggcggggtacgtggaggtggaccacatcctgccctacagccggtcctacgacgacagcctgctcaacaagaccctggtcctgaccgaggccaaccgcgacaagggcaaccggacgccgttcgagttcatgggcggggacgaccagtcccagcactggcagaagttcgtgcgctgggtgcagatgaaccccaagatccggcaggccaagcgcaaccggtacctccgcaaggacttcagcgagaaggccgcccgggagttccgcgaccggcacctgaacgacacccgctacatcggccgcgagctgaaggcgatgatcgagagccacgtccagtggcaccccgactccaagagcaaggactgctgcgtggtcctctccgggcagctgaccgccctgctccggggccgctgggggttcaacaaggaccgggccgccggcgacctgcaccacgcggtggacgccgccgtggtcgccgccgcgacccgcggcatgatccagcggatggcccgccacagcaagttccacgagctgaagaacgtgcggacgtcctacgccgaccccgacaccggggaggtggtcaacctcgccgccgcgcgcgacctggagaagcacttcccgctgccctgggacaacttccggaacgacaccctcgcctacctgaaccccagcgccatctccgccgacgagagcgcccaggagggccaccgcggggtgcgggtgtcccgcgcgccgacccggcgcaagctgggcgccgcccaccaggagacgatccggagcaaggggaaggacaacatcctcctggagcagggcctgtccgccgtcaagacgcccctcagcaagctgaccctgaagaacatcgagaacatggtgggctacgaggacccccgcaacgcggccctcgtgaaggtcctgcgggagcgcctggaggccttcgggggcgacggggccaaggccttcgcgcccaaccagccgcccgtgtacaagccctccaagcccggcaagcaggccccggagatccggagcgtgaagatggcctccaagagcaagggcgccctccacgtccgcgaggggctggccgactccggccgcatgatccggatcgacatctacgagaccaagaacgggtacgtgggcgtgcccatctacgtcagcgacaaggcgcgcagcaagctgcccaaggcctaccccaagaagggggaggaccgggccaactggccggaggtggacaccaacgacaacttcctcttctccctgtacagcaccgactggatcgaggccaagaccaagaaggagaccatcgccggctacgtgaagtcctacgacatcttcgacggccgcctgctcgtctacgcgcacgacaacaagaaggtggtgcggaagctgaccctgagcgccctcgccgacctgcagaagctgcacgtctccatcctcggggacctgtacaagggcgggacgcccaagtgcagccccctgcgcaagggccaggagctctga

SEQ ID NO: 1502 - RNA, 3186 nt, synthetic construct
  misc_feature 1..3186: note = Cas9 variant
  source 1..3186: mol_type = other RNA
atgctgcgcctcggcctggacatcgggagcacctccatcggctggttcctgtaccggatcaccaacgggatgatcgccgagatcatcgactgcggcgtgcgcctcttcagcgacgggcgggacgccaagacgggcgtctccagcgcggtggagcgccggaacgcccgcgccctgcggcgccggcgcgaccggtacctgcgccggcgcgccgccctcatgcggcgcctggcggccgccggcctgatgcccgaggacccgtcccaggccaagcccctcgagctgctggacccctaccggctccgcgcggacgccctggaccggcgcctggagctcaccgagctggggcgggccctgttccacctcaaccagcgccgcggcttcaagagcaaccggcagaccgaccgcgggaacaacgagggcgggaagatcatcgacggctccgcccggctggaccaggccatgatggcggtgggcgcccgcacctacggggagttcctgcacctccggcgcagccaggccgaggacctgcggcgcgtcccctccgtgcggacgcgcctgaccctccggagcgtggacggcgggaaggccgagaccggctacgacttctacccggaccgccggcacctggaggaggagttcaacaaggtctgggccgcgcaggccgcccaccaccccgtgctgaccgactccctccgccacgaggtgttcgagacgatcttcttccagcggcccctgaaggcccccgccgtcggccgctgcctgttcttcccggagccccggctcccccgcgcgcaccccctgacccagcggcgcgtgctgtacgagaccgtgaacgccctccgcatccggaccgagagcggggccgccgtcccgctgggcaaggagcagcgcgacaaggtgatcatgctgctcgacgggaaggcccccgtgaaggcgatcgcctccgccaagctgagcctgaaggccatcgcgaagcacctcaagctgcgggacggccagacgttcaccctggagaaggggcgcgactacatcgcctgcgaccccgtccgggcctccctcagccaccccgaccgcttcggcccgcggtggtccgtgctggaggccgaggtgcaggccgagatcgtcggccgcatccgggacgacgacgacaccatggcgctggtggagtggctcaagcaggtccacgggctggacgacgcccacgcccgcgccaccgccgacgcgcccctgcccgagggctacgggcggctcggcgagacggccacccgcaagctgctggactgcctgaaggccgaggtgctcacctacagcgaggccgtggggaaggccctggaccagcaccactccgaccggcgcaccggcgagatcctggagagcctcccctactacggcgaggtgctgcaggcgcacgtcatcccggggacgggcgagccccaccacgacgacatcacccggttcgggcgcatcaccaaccccaccgtgcacatcggcctgaaccagctccggcgcctggtcaaccggatcatcgcccgctacgggaagcccgccgagatcgtggtggagctggcccgggacctcaagcagagcacgggccagaagaaggcggccatcgccctgaacctgaagaaccgcaaggccgccgaggcgcgctccgccctcctgaccgagtggggcgtcccggacaccggggccaaccggatgtacgtgcgcctgtggcaggagctccacgaggaccccatgatgcggcgctgcccctacaccggcacgatcatcagcccctccctgctgttcagcggggccatcgacatcgaccacatcctcccgtactcccggaccctggacgacagcaccgccaaccgcaccctgtgcatgaaggaggcgaaccggcagaagcgcaacaagtcccccagcgaggcccggcgcgacggcatgcggatctgggccctcgaggacgacaacctgcgccacatccccgagttcaagcggtggcgcttcgccgaggacgccatggcgcggttcgagggcgagcgcgacttcgaggcccgggccctggtggacacgcagtacctctcccgcatcagcaaggcctacctggagaccctgtacgacggggcggacggcaagtcccacgtctgggtggtgccggggcggctcaccgagatgctgcgccgccactggggcctgaacgggatcctcaccgaccccctgcgggacgtcacgaaggagaagaaccgcatggaccaccggcaccacgccatcgacgccgccgtggtggccgcgaccgaccgcggcctgatcaaggccatggccgagcaggcccggaccgacgtcgaccagggccgcgaggccctcgcgagctccatcatgccgccctggcccgggttccgggaggccgtggccgcccaggtggaccgcatcatcgtcagccaccggcccgaccacggccgcatcgacctgaccacccggatgaaggggcgcgaccagacgaccggccccctgcaccgggacaccgcctacgggctcaccggccagtccgagaagggcgtgcccctggtggtcacgcgcgagccgttcgacaacctgacccccaccatgatcgggaagatccgggacgagcccctcaaggcggccctggccgccgtgaccgccggcaagaaggacgacgcgttcgccgaggccctggcccacttccgcgaccggcccgggccgtaccacggcatccgccgggtgcgcctcatcgagcccatcagcgtcgtggagatccgggacgcgtccgggcgcgcctacaagggctacaagggcaacagcaaccactgcttcgaggtgtggcgcctgcccgggggcgccatcacggagcacatcgtctccaccttcgacgcccaccagcccgggccggagccccggccccaccccgccgcgaagcgcctgctccggctgttcaagagcgacatggtgaagctggacgacagcaagttcggcccggtgatcgccaccgtcgtgatgttcgaccgcaacgggaagatctccctcgtgccccacaccgccagcaacgcccggaagcgctgcgagaagtacaaggaggacctgtacctgcggttcacggcccgcaccctcatcgaggcgggcgcccggcgcatcatcgtcgacgagaccggccacttccgggaccccgggcgcaagggctga

SEQ ID NO: 1503 - RNA, 3189 nt, synthetic construct
  misc_feature 1..3189: note = Cas9 variant
  source 1..3189: mol_type = other RNA
atggccgagaagcagcaccgctggggcctggacatcgggaccaacagcatcggctgggccgtgatcgcgctcatcgaggggcggcccgccggcctggtcgccaccgggtcccgcatcttcagcgacggccggaacccgaaggacggctccagcctggccgtggagcgccgggggccccgccagatgcggcgccggcgcgaccggtacctccgccggcgcgaccggttcatgcaggccctgatcaacgtgggcctgatgcccggggacgcggccgcccgcaaggccctcgtcacggagaacccctacgtgctgcggcagcgcggcctggaccaggcgctcaccctgccggagttcgggcgggccctgttccacctcaaccagcgccggggcttccagtccaaccgcaagaccgaccgcgccaccgccaaggagagcggcaaggtgaagaacgccatcgcggccttccgggccgggatgggcaacgcccgcacggtcggggaggccctggcgcggcgcctggaggacggccggcccgtgcgcgcccggatggtgggccaggggaaggacgagcactacgagctctacatcgcccgcgagtggatcgcccaggagttcgacgccctgtgggcgtcccagcagcggttccacgccgaggtcctggccgacgccgcccgcgaccggctccgcgcgatcctgctgttccagcggaagctcctgcccgtgcccgtgggcaagtgcttcctggagccgaaccagccccgcgtcgccgccgccctccccagcgcgcagcggttccgcctgatgcaggagctgaaccacctccgggtgatgaccctggccgacaagcgcgagcggcccctgtccttccaggagcgcaacgacctcctggcccagctggtggcccgcccgaagtgcgggttcgacatgctccggaagatcgtcttcggcgccaacaaggaggcgtaccgcttcaccatcgagagcgagcggcgcaaggagctgaaggggtgcgacaccgccgccaagctggccaaggtgaacgccctcggcacgcggtggcaggcgctgtccctggacgagcaggaccgcctcgtgtgcctgctgctcgacggcgagaacgacgccgtcctggccgacgccctgcgggagcactacgggctcaccgacgcccagatcgacaccctgctgggcctcagcttcgaggacgggcacatgcgcctgggccggtccgcgctgctgcgcgtgctcgacgccctggagagcgggcgggacgagcagggcctgcccctctcctacgacaaggccgtggtcgccgcgggctaccccgcccacaccgccgacctggagaacggggagcgcgacgccctgccctactacggcgagctcctgtggcggtacacgcaggacgccccgaccgcgaagaacgacgccgagcgcaagttcgggaagatcgccaaccccaccgtgcacatcggcctgaaccagctccggaagctggtgaacgccctgatccagcgctacgggaagcccgcccagatcgtcgtggagctcgcgcggaacctgaaggccggcctggaggagaaggagcgcatcaagaagcagcagaccgccaacctcgagcggaacgagcgcatccggcagaagctgcaggacgccggcgtccccgacaaccgcgagaaccgcctgcggatgcgcctcttcgaggagctggggcagggcaacgggctgggcacgccgtgcatctacagcggccggcagatctccctccagcgcctgttcagcaacgacgtccaggtggaccacatcctgcccttctccaagaccctcgacgacagcttcgccaacaaggtgctggcgcagcacgacgccaaccggtacaaggggaaccgcggccccttcgaggccttcggggccaaccgggacggctacgcgtgggacgacatccgcgcccgggccgccgtgctgccccgcaacaagcggaaccgcttcgccgagaccgcgatgcaggactggctccacaacgagaccgacttcctggcccggcagctgacggacaccgcctacctcagccgcgtggcccggcagtacctgaccgccatctgctccaaggacgacgtctacgtgagcccggggcgcctgaccgcgatgctccgggccaagtggggcctgaaccgcgtgctggacggcgtcatggaggagcaggggcggcccgccgtgaagaaccgcgacgaccaccgccaccacgccatcgacgccgtggtcatcggcgcgacggaccgggccatgctccagcaggtcgccaccctggccgcccgcgcgcgggagcaggacgccgagcgcctgatcggggacatgcccaccccctggccgaacttcctcgaggacgtgcgggccgccgtggcgcgctgcgtggtgtcccacaagcccgaccacggccccgagggcgggctgcacaacgacaccgcctacggcatcgtcgccgggccgttcgaggacggccggtaccgcgtgcggcaccgcgtgagcctgttcgacctcaagcccggggacctgtccaacgtccggtgcgacgcgcccctgcaggccgagctcgagcccatcttcgagcaggacgacgcccgcgcccgggaggtggccctgacggccctggccgagcgctaccggcagcgcaaggtgtggctcgaggagctgatgagcgtcctgccgatccggccccgcggcgaggacgggaagaccctccccgactccgcgccctacaaggcctacaagggcgacagcaactactgctacgagctgttcatcaacgagcggggccgctgggacggggagctgatctccaccttccgggccaaccaggccgcctaccgccgcttccggaacgacccggcgcgcttccggcgctacaccgccggcgggcggcccctcctgatgcgcctgtgcatcaacgactacatcgccgtgggcacggccgcggagcggaccatcttccgcgtggtcaagatgagcgagaacaagatcaccctcgccgagcacttcgagggcgggaccctgaagcagcgggacgccgacaaggacgaccccttcaagtacctgacgaagtcccccggcgccctccgcgacctgggggcccggcgcatcttcgtggacctgatcggccgggtgctcgacccggggatcaagggcgactga

SEQ ID NO: 1504 - RNA, 3189 nt, synthetic construct
  misc_feature 1..3189: note = Cas9 variant
  source 1..3189: mol_type = other RNA
atgaacctgaactacatcctcggcctggacctggggatcgccagcgtgggctgggccgtcgtggagatcgacgagcaggagaacccccagcgcctcatcgacgtgggggtccggaccttcgaccgcgcggaggtgctgaagaccggcgagtccctggccctcgcccggcgcctggcccggagctcccgccggctggtgaagcgccgggccgagcgcatcaagaaggcgaagcggctcctgaaggccgagaacctgctcctgagcgccgacgagatcctgccgaacgaggcctggcagctccgcgtcaaggggctggaccagaagctggagcggcaggagtgggcggccgtgctcctgcacctcctgaagcaccgcggctacctgtcccagcggaagaacgagagcaagtccgagaacaaggagctgggcgccctcctgagcggggtggccatcaaccaccagatcctgcagtccgccgagtaccgcacgcccgcggagatcgccgtcaacaagttccaggccgaggagggccacatccggaaccagcgcggggcctacacccacaccttcagccggctcgacctgctggccgagatggagctcctgttccagcgccaggcgaccctgggcaacccccacacgtccaccaagctcctggagaacctgaccgccctcctgatgtggcagaagcccgccctggccggggaggccatcctcaagatgctgggcaagtgcaccttcgagccgacggagtacaaggcggccaagaacagctactccgccgagcggttcgtgtggctgaccaagctcaacaacctgcgcatcctggagcagggcgccgagcgcgccctcaccgacaacgagcggttcgcgctgctggaccagccctacgagaaggccaagctcacctacgcccaggtgcgcacgctgctggggctgagcgacgaggccatcttcaagggcctccggtaccagggggaggacaagaaggcggtcgagaccaagaccaccctgatggaggtgaaggcctaccaccagatccgcaaggccctggagggcctcgacctgaaggccgagtggaacgagctgaagaacaaccccgccctcctggacgagatcggcacggcgttctccctgtacaagaccgacgacgacatccaccggtacctcgacgggaagctgagcgagtccgtgctgaacgccctcctggagaacctgaacttcgacaagttcatccagctcagcctgaaggccctgcagcagatcctccccctgatgctgcagggccagcgctacgacgaggccgtctccgccatctacggggaccactacggcaagaagtccgacgagatcgaccggctcctgccgaacatccccaccgacgagatccgcaaccccgtggtgctgcggaccctcacgcaggcgcgcaaggtcatcaacgccgtggtgcggctgtacgggagccccgcccgcatccacatcgagaccggccgggaggtcggcaagagctaccaggaccgcaagaagctggagaagcagcaggaggagaaccggaagcagcgcgagaacgccgtgaagaagttcaaggagtacttcccgaacttcgtgggggagcccaagggcaaggacatcctcaagatgcggctgtacgagctgcagcaggccaagtgcctctacagcgggaagtccctggagctgtaccgcctcctggagaagggctacgtcgaggtggaccacgcgctgcccttcagccggacctgggacgactccttcaacaacaaggtcctcgtgctggccaacgagaaccagaacaaggggaacgccaccccctacgagtggctggacggcaagaacaacagcgagggctggcagcacttcgtggcccgcgtccagacgtccgggttcagctacgcgaagaagcagcgcgtgctcatccaggagctggacgagaagtccttcatcgagcggaacctgaacgacacccgctacgtggcccggttcctctgcaaccacatcgccgacaacatgctgctgaccggcaaggggaagcgcaaggtcttcgccagcaacggccagatcaccgccctcctgcgggggtgctggggcctgcagaaggtgcgcgagaacaacgaccggcaccacgcgctcgacgccgtggtcgtggcctgctccaccaagagcatgcaggacaagatcacgaagttcgtgaagtacaaggagggccgcctgttcaaggacaagaaggacggggtctacaagggcgagcggatcaaccgcgagaccggggagatcatctccctgcacttcccgaccccctggaagttcttcaaggagaacgtggagatccggatcttcagcgagaaccccaagctcgagctggagaaccgcctgcccgactacccgcagtacaaccacgagttcgtgcagcccctcttcgtctcccggatgcccacgcgcaagatgaccggccagggccacatggagaccgtcaagagcgccaagcggctggacaaggggctgtccgtgctcaaggtgcccctgacccagctgaagctcagcgacctggagcgcatggtgaaccgggagcgcgagatggccctgtacgaggcgctcaaggagtgcctggagcagttcggcaacgacccggccaaggccttcgccgagcccttctacaagaagggcggggccctggtgaaggcggtccgggtggagcagacgcagaagtccggggtgctcgtccgcaacggcaacggcgtggccgacaacgccaccgggagcatcgtgcgggtcgacgtgttcaccaagggcgggaagtacttcctggtgcccatctacacctggcaggtcgccaagggcatcctgcccaacaaggcggtgatccaggggaaggacgagagcgagtgggaggagatggacgagaacgccgtgttccagttctccatgcacaagaacgacctcatcaaggtcaagaccaagaagggcgagatcttcggctacttcaacgggctggaccgcgccacgggcagcatcgagatcgaggagcacgacctggagaagtccaaggggaagaacggcagccaccgcgggctcggcgtgaagaccgccttcttcctggagaagtaccaggtggacgagctgggcaagaacatccggccgtgccgccccaccaagcggcagcacgtccgctga

SEQ ID NO: 1505 - RNA, 3192 nt, synthetic construct
  misc_feature 1..3192: note = Cas9 variant
  source 1..3192: mol_type = other RNA
atggagaaccacatcaactaccgcctgggcctcgacatcgggatcgccagcgtgggctggtccgtcatcaacctggacaagaagcggatcgaggacctgggggtgcgcatcttcaacgccgcggagcaccccaaggacggcagctccctcgccctgccgcggcgcatcgcccgggggcgccggcgcctgctccggcgcaaggcctaccgggtgaagcgcgtccggaagctgatcgtggactacaacatcctgaccaaggaccagctcaacgacctgttcaagcagaagtgccagaacagcgtgtgggagatccgcgtcaaggccctggacaacaaggtgaccaacgaggagtgggcgcggctcctgatcaacctgtgcaagcgccggggcttcaagtccaaccgcaagaacgaggccgacgacaaggagacgaagaaggtgatcaacagcatcaagtccaacatcaagggcatgaaggagagcgggtcccggaccatcggcgagtacatctacacccagaccctcagctccggggacatcagcaagtccttccgcaacaaggacggccagtacaacaactgcgtcagccggaagatgatcgaggaggagatcaagatcctgttcaagaagcagcgcgagctggggtgcgagttcgcctccgaggagatcgaggagaagtacctcgccatcttcaacagccagcgccccttctccaagttcgaggacctggagaagatggtgggcttctgcacgttcgagaaggcgagcaaggagcggcgcgcccccaagtgctccatcagcgccgaggagttcgtgctgtacgacaacatgaacaagctcagcatcctgaacaagggcgacacccggaagctgaccaacgaggagcgcaagatcatcgtcgagaacgccttcaagaacaaggagatcaagtactccaagctccggaagatcctgaacctgagcaacgacgagcgcttctccaccctcagctactccaacaagacggagctgagcaagaccgagaactccaagttcgtggccctgaaggggtaccacgagatcaagagcgcgatcgagaagtccttcggcaaggacacctggaaccgggtgaagaacaaccgcaccatgctcaacgacatcgcctacgtcctgagcatcgccaagacggacgaggacatcatcaagcagctgtccctccggaacatcccccgcgagatcatcgacgccgtgctggggctgagcttctccaagttcagcaacctctccatcaaggccatcgagaagatcctgccgtacctgaaggacggccagcagtacaacgaggcgtgcaagagcgccggctacgacttcaaggccacctacaacggggagaagtcctacaagctccccctgatcgacatcgacgagatcgtgaaccccgtcgtgaaccgggccctgagccagacccgcaaggtgatcaacgccgtcatcgaccggtacggctcccccatcgggatcaacatcgagctcgcgcgcgacctggccaagaacttcaaggaccggagcaagatcaagaaggagcaggaggagaaccgcgccaacaaggagaagatcaagaacgagctgaagatgctcatgaacaaggagccgaccagctccgagatcctgaagtaccggctgtggaaggagcagcgcgaggagtgcgcctacagccaggagcggatctacatcgaggacctcttcaaggtgggccagtacgagatcgaccacatcatccccttctcccgcagcttcgacgactccctgaacaacaaggtgctggtcaaggccgcggagaaccagcgcaaggccaaccggatcccctacgagtacttcgggagcgacgaggaccgctggtaccggttcgaggtgtgggtcgagcagtccagcctgtccttcaagaagaagaacaacctcctgaagaagcgcttcagccgggaggactccatcgagttcaaggaccgcaacctggtggacacgcagtacatcagccggtacatctccaacttcatcaagagccgcctcatcttcaaggagtccgacagcaagcagaaggtgatcaccatcaacggccgggccacctcctacctgcgcgccaagtggggcctgctcaaggtccgggagaacggggacaagcaccacgcgctggacgccaccgtgatcgccgtggccacgcagggcatggtccaggagatcagcaagtacagcaaggcccacgagctgaagtacatccgccagggggacgagttcatcgacatcgagaccggcgagatcgtgaaggtgaaggaccacaagcacctctccaaggaccggctgcccgagccgtggctggggttcagctccgagctccgcctgcggctgagcgagaaccccatcgaggagctcaagaagtcccccatcagcacctacgacgaggagttcatccgcaagaccgtccggcccatcttcgtgtcccgcgtgccgtaccggaaggtcacgggccgcctgttcgaggagaccgtgtacagccccaaggcgttcatcgacgagggcttcatcgccaagaagaagctgcaggacctcaccctgaaggacttcgagaacatctacaactacaactccgacaagaagctgtacgacgccctccgggagcgcctggaggagtacgggggcaacgccaagaaggccttcgcggaggagttccgcaagcccaccaagacggggaagctgggccccatcgtcaagagcatcaaggtgaagaccaagatcccgttcaaggacgggatcgacctcaacggcggcaaggtgaagaaggacgggctggtgcggatcgacatctacgagaaggagggcaagtactacgtcgtgcccgtgtaccgcctggacatccagcaggggaacatccccaagaaggccgccgtcgccaacaaggaggagaaggactggatcctcatggacgagtcctacaacttcaagttcagcctgtacaagaacgacctgatctacatcaagtacgactccaagggcgagtacttcggctactacgacgggttcgaccggcacaccggcgccatcaccctcgagcgccacgacaacagcgagcggtaccgcgggatcggcatcaagacgggggtgaaggagatcttcaagtacaacgtggacgtcctgggccggtactacaaggtggcgaagtga

SEQ ID NO: 1506 - RNA, 3192 nt, synthetic construct
  misc_feature 1..3192: note = Cas9 variant
  source 1..3192: mol_type = other RNA
atggagaagttccactacgtgctgggcctcgacctggggatcgccagcgtcggctgggccgcgatcgagatcgacaaggagaccgagacctccatcgggctgctcgactgcggcgtgcgcacgttcgagcgggccgaggtgcccaagaccggggacagcctggccaaggcccgccgggaggcccgctccacccggcgcctgatccggcgccggagccaccgcctcctgcggctgaagcgcctcctgaagcgggagatcttccgccagccggagaccttcaaggacctgcccatcaacgcgtggcagctccgggtcaagggcctggactcccgcctgaacgagtacgagtgggccgccgtgctcctgcacctggtgaagcaccggggctacctcagccagcgcaagtccgagatgagcgagacggactccaagagcgagatggggcggctgctggccggcgtcgcggagaaccaccagctcctgcagcaggagcagtaccgcacccccgccgagctggccctcaagaagttcgtgaagcacttccggaacaagggcggggactacgcccacaccttcaaccgcctggacctgcaggccgagctccacctcctgttccagaagcagcgcgagctggggaaccccttcacctccccggagctggagcgccaggtggacgacctgctcatgacgcagcggagcgcgctgcagggcgacgccatcctgaagatgctcggccactgcgggttcgagcccgagcagttcaaggccgccaagaacaccttctccgccgagcggttcatctggctgaccaagctgaacaacctccgcatccaggaccagggcaaggagcgggcgctgaccgccgacgagcgcacgaagctgctcgacgagccctacaagaagtccaagctgacctacgcccaggtccggaagctgctcagcctgccccagaccgccatcttcaaggggctgcgctacgacctcgagcacgacaagaaggccgagaacagcaccctgatggagatgaagtcctaccacaacatccggcagacgctggagaagtccggcctgaagaccgagtggcagagcatcgcgacccagccggagatcctcgacgccatcggcaccgccttcagcatctacaagacggacgaggacatcagccacgagctgaagacctgccgcctgcccgagaacgtgctcaacgagctgctgaagaacatcaacttcgacgggttcatccagctctccctgaccgccctgcggaagatcctccccctgatggagcagggctaccgctacgacgaggcctgcacccagatctacgggaaccaccacagcggctccctgcagcaggagagcaagcagttcctcccccacatcccgatcgacgacgtgcggaaccccgtcgtgttccgcacgctgacccaggcgcggaaggtggtcaacgccatcatccgccggtacgggtcccccgcccgcgtgcacatcgagatggcccgggagctgggcaagagcaagtccgaccgcgaccgcatcgagaagcagcagcagaagaacaagaaggagcgggagaacgcggtggccaagttcaaggaggacttccccgacttcgtcggcgagccgcgcgggaaggacatcctcaagatgcggctgtacgagcagcagcacggcaagtgcctgtacagcgggcacgacatcgacatcaaccgcctcaacgagaagggctacgtggagatcgaccacgccctgcccttctcccggacctgggacgacagccagaacaacaaggtgctggtcctcgggtccgagaaccagaacaagcgcaaccagacccccgacgagtacctggacggcgccaacaacagccagcggtggctggagttccaggcccgcgtgcagacgtgccacttctcctacggcaagaagcagcggatccagctcgcgaagctggacgacgagaccgagaaggggttcctggagcgcaacctcaacgacacccggtacatcgcccgcttcatgtgccagttcgtgcaggagaacctgtacctgaccggcaaggggaagcggctcgtcttcgccagcaacggcgggatgacggccaccctgcgcaacctgtggggcctccggaaggtgcgcgaggacaacgaccggcaccacgccctggacgcgatcgtcgtggcctgctccaccgccagcatgcagcagaagatcaccaaggccttccagcgccacgagtccatcgagtacgtggacacggagaccggcgaggtcaagttccggatcccccagccgtgggacttcttccgccaggaggtgatgatccgggtgttcagcgaccagccctgcgaggacctggtcgagaagctctccgcccgccccgaggcgctgcacgacaacgtgacgcccctgttcgtgagccgcgccccgaaccggaagatgagcgggcagggccacctcgagaccatcaagtccgccaagcgcctgagcgaggagaactccatggtcaagaagcccctgaccaccctcaagctgaaggacatccccgagatcgtggggtaccccagccgggagccgcagctgtacgccgcgctcaagacccgcctggagacccacgacgacgaccccatcaaggccttcgccaagcccttctacaagccgaacaagaacggcgagctgggcgccctcgtgcggtccgtccgcgtgaagggggtgcagaacaccggcgtcatggtgcacgacgggaagggcatcgccgacaacgcgacgatggtgcgggtcgacgtgtacaccaaggccgggaagaactacctggtgcccgtctacgtgtggcaggtcgcccagggcatcctgcccaaccgcgccgtgaccagcggcaagtccgaggccgactgggacctcatcgacgagagcttcgagttcaagttctccctgagccgcggggacctggtggagatgatctccaacaagggccggatcttcgggtactacaacggcctcgaccgggcgaacgggagcatcggcatccgcgagcacgacctggagaagtccaagggcaaggacggggtgcaccgggtcggcgtgaagaccgccacggccttcaacaagtaccacgtggaccccctggggaaggagatccaccgctgcagctccgagccgcggcccaccctcaagatcaagagcaagaagtga

SEQ ID NO: 1507 - RNA, 3192 nt, synthetic construct
  misc_feature 1..3192: note = Cas9 variant
  source 1..3192: mol_type = other RNA
atggagaaggactacatcctgggcctcgacatcgggatcggcagcgtggggtacggcctgatcgactacgacaccaagtccatcatcgacgccggggtccgcctgttccccgaggccaacgcggacaacaacctcggccggcgcgccaagcggggcgcccgccggctgaagcgccggcgcatccaccggctggagcgcgtcaagagcctcctgtccgagtacaagatcatcagcgggctggccccgaccaacaaccagccctacaacatccgggtgaagggcctcacggagcagctgaccaaggacgagctggccgtggcgctcctgcacatcgccaagcgccgggggatccacaacgtggacgtggccgccgacaaggaggagaccgcgtccgacagcctgtccaccaaggaccagatcaacaagaacgccaagttcctcgagagccgctacgtctgcgagctgcagaaggagcggctggagaacgagggccacgtgcgcggggtggagaaccggttcctcacgaaggacatcgtccgcgaggccaagaagatcatcgacacccagatgcagtactaccccgagatcgacgagaccttcaaggagaagtacatctccctggtggagacccggcgcgagtactacgagggccccggcaaggggagcccgtacggctgggacgccgacgtgaagaagtggtaccagctgatgatggggcactgcacgtacttccccgtcgagttccggtccgtgaagtacgcctacaccgcggacctctacaacgccctgaacgacctgaacaacctcaccatcgcccgcgacgacaaccccaagctggagtaccacgagaagtaccacatcatcgagaacgtgttcaagcagaagcgcaaccccaccctgaagcagatcgccaaggagatcggcgtcaacgacatcaacatcagcggctaccgggtgacgaagtccgggaagccgcagttcaccagcttcaagctgttccacgacctcaagaaggtggtcaaggaccacgccatcctggacgacatcgacctcctgaaccagatcgcggagatcctgaccatctaccaggacaaggactccatcgtggccgagctcggccagctggagtacctgatgagcgaggccgacaagcagtccatcagcgagctcaccgggtacacgggcacccactccctgagcctgaagtgcatgaacatgatcatcgacgagctctggcacagctccatgaaccagatggaggtgttcacctacctgaacatgcgccccaagaagtacgagctgaaggggtaccagcggatccccaccgacatgatcgacgacgccatcctcagccccgtcgtgaagcgctccttcaagcaggccatcggcgtggtcaacgcgatcatcaagaagtacggcctgccgaaggacatcatcatcgagctggcccgggagagcaactccgccgagaagtcccgctacctccgggccatccagaagaagaacgagaagacgcgcgagcggatcgaggccatcatcaaggagtacgggaacgagaacgcgaagggcctggtgcagaagatcaagctgcacgacgcccaggaggggaagtgcctctacagcctgaaggacatccccctggaggacctgctccgcaaccccaacaactacgacatcgaccacatcatcccccggagcgtctccttcgacgacagcatgcacaacaaggtgctggtgcgccgggagcagaacgccaagaagaacaaccagaccccgtaccagtacctgacctccggctacgccgacatcaagtacagcgtcttcaagcagcacgtgctcaacctggcggagaacaaggaccgcatgaccaagaagaagcgggagtacctgctcgaggagcgcaacatcaacaagtacgacgtgcagaaggagttcatcaaccggaacctggtcgacacgcgctacaccacccgggagctgaccacgctcctgaagacctacttcaccatcaacaacctggacgtgaaggtgaagaccatcaacgggtccttcacggacttcctccgcaagcgctggggcttcaagaagaaccgggacgagggctacaagcaccacgccgaggacgccctgatcatcgccaacgccgactacctgttcaaggagcacaagctcctgaaggagatcaaggacgtcagcgacctggcgggggacgagcgcaactccaacgtgaaggacgaggaccagtacgaggaggtgttcggcgggtacttcaagatcgaggacatcaagaagtacaagatcaagaagttcagccaccgggtcgacaagaagcccaaccgccagctcatcaacgacaccatctactccacccgggtgaaggacgacaagcgctacctgatcaacaccctgaagaacctctacgacaagagcaacggcgacctgaaggagcggatgcagaaggaccccgagtccctgctcatgtaccaccacgacccccagacgttcgagaagctgaagatcgtgatgagccagtacgagaacgagaagaacccgctggccaagtacttcgaggagaccgggcagtacctcaccaagtacgccaagcacgacaacggccccgccatccacaagatcaagtactacggcaacaagctggtcgagcacctggacatcaccaagaactaccacaacccccagaacaaggtggtgcagctcagccagaagtccttccgcttcgacgtctaccagaccgacaaggggtacaagttcatcagcatcgcctacctgacgctgaagaacgagaagaactactacgcgatctcccaggagaagtacgaccagctcaagagcgagaagaagatctccaacaacgccgtgttcatcggcagcttctacacctccgacatcatcgagatcaacaacgagaagttccgggtgatcggggtcaacagcgacaagaacaacctgatcgaggtggaccgcatcgacatccggcagaaggagttcatcgagctggaggaggagaagcaggtcaactacatgaactccgacagctacctcaagaacaaccgcatcaaggtgaccatcggccggaagaccacgaacatcgagaagttccacaccgacatcctgggcaacatgtacaagtccaagcgccccaaggccccgcagctggtgttcaagaaggggtga

SEQ ID NO: 1508 - RNA, 3195 nt, synthetic construct
  misc_feature 1..3195: note = Cas9 variant
  source 1..3195: mol_type = other RNA
atgagcgagtgcgtgacccgccggatcctgggcatcgacctcgggatcgcctcctgcggctggggcgtcatcgaggtgggggaggccagcgggtccatcatcgcgagcggcgtgcgctgcttcgacgcgcccctgatcgacaagaccggcgagccgaagtccgccacgcggcgcaccgcccgggggcagcgccggatcatccgccggcgccggcagcgcatgaacgccgtccggcgcctgctcgccgagttcggcgtgctgaccgggcggagccccgacgccctgcaccaggccctcctgcgcctgtcccagagcgtggccggctcccaggtcaccccctggacgctccgggcggccgcccacgagcgcaagctgaccaacgacgagctggccgtggtgctcgggcacatcgcccggcaccgcggcttccggagcaactccaagaacgacggcggggcgaacgccgccgacgagaccagcaagatgaagaaggccatggagaccacgcgcgagggcctggcccgctaccactccttcggggcgatgatcgccagcgaccccaagttcgccgaccggaagcgcaaccgggacaaggactactcccacaccgccaagcgcagcgacctggaggacgaggtccggaccatcttccgctcccagacccggttcggcagcctcgtggcctccgagaagctgagccaggcgttcgccgacgccgccttcttccagcgcccgctgcaggacagcgaggacatggtgggctcctgccccttcgagcccgggcagaagcggacggcccgccgggcgcccagcttcgagctgttccgcttcctctcccggctggccaacctcaagctgaccgtcggccgcgccccggagcggcgcctgacccccgacgagatcgccctcgcggccaaggggttcggcgagaccaagaagtccatcacgttcaagagcctgcgggaggccctggacctcgaccccaacgcccgcttcagcggggtggccaaggagaaggagtccaccctggacgtggcggcccggaccggcggcgccgcctacgggaccaagacgctgaaggacgccctcggcgacgcgccctggcgcagcctgtcccgcatgccggagaagctggaccggatcgccgagatcctcagcttccgcgaggacatgaaggccatccggaacgggctggaggaggtcggcctggacgggctcgtggtggacgccctgatgcaggccaccgcgaacggcgacttcaaggacttcacccgcgccgcccacatctccgccctggcggcccggaacatcatccccggcctccgcgaggggctggtctacagcgacgcctgcacccgggtgggctacgaccacgccgcccgccccgcggtgcccctgtcccagatcgggagcccggtcacgcggaaggccctctccgaggccctgaagcaggtccgcgccgtggcccgggagtacggccccatcgactacttccacatcgagctggcgcgcagcatcgggaagtccgccgaggagcggaagaagctcaccgacggcatcgaggcccgcaacgtggagaaggagaagcggcgcaaggaggccgccgagcacctgggccgggcgcccagcgacgacgagctgctccgctacgagctggccaaggagcagaacttcaagtgcatctactccggggaccccatcgacccggccggcatcagcgccaacgacacccggtaccaggtggaccacatcctgccctggagccgcttcggggacgactcctacgtcaacaagaccctgtgcacggcgcggagcaaccagaacaagcgcggccgcacccccttcgagtggttcgacgccgacaagaccgaggccgagtggatggagtactccgcccgggtggaggacctcaaggaggtgaagggccgcaagaagcggaactacagcatcaaggacgccgcgtccgtcgaggacaagttcaaggcccgcaacctgaccgacacgcagtgggccacccggctgctcgccgacgagctgaagcgcatgttcccgccccgggagtgcgagcgcgtggtgaccgtccgggccgacgggggcaacgacgggctgagcatcgtggaggagcgccgggtgttcacccgccccggcgcgatcacgtccaagctccggcgcgcctgggggctggagggcctgaagaagcaggacggcaagcgggtcgaggacgaccgccaccacgccgtggacgccctcgtgctggccgcgaccaccgagagcctgctcaaccggctgaccgtcgaggtgcagcagcgcgagcgggaggggcgccaggacgacatcttccactgctcccagccctggcccggcttccgcgtggacgtccagcggaccgtgtacgggagcgagacgatgccgggcatcttcgtgtcccgcgccgagcggcgccgggcccgcgggaaggcccacgacgccaccgtcaagcagatccgggacatcgacggcgagcgcatcgtgttcgagcggaagcccatcgagaagctgaccgacaaggacctcgagcgcatccccgtgccggagccctacggcaaggcggccgaccccaagaagctgcgggacgagctggtcgagaacctccgcgcctggatcgccgcggggaagcccaaggacaagccgccccggagccccaagggcgacatcatccgcaaggtgcggatcgagaccaaggacaaggtggccgtcgagatcaacgggggcacggtggaccgcggggacatggcccgggtggacgtcttccgcaagaagaacaagaagggcgtgtgggagttctacgtgatccccatctacccgcaccagatcgtcgcctccgccctgccgcccaaccgggcggtgatcgcctacaaggccgagagcgagtggaccgccatcgacggctgcttcgagttcgcctggtccctgaaccccatgagctacctcgagctggtgaagtccaacggggagctgatcgagggctacttccgcagcatggaccggaccaccggggcgatcaacctcagccccatgtccacgaacagcgagaccatccgctccatcggcgtcaagaccctgagctccttccgcaagttcaccgtggaccggctggggcgcaagttcgagatcccccgggaggtgcgcacgtggcggggcgaggcctgcacctga

SEQ ID NO: 1509 - RNA, 3195 nt, synthetic construct
  misc_feature 1..3195: note = Cas9 variant
  source 1..3195: mol_type = other RNA
atgaagcgcaccagcctgcgggcctaccgcctcggcgtggacctgggggccaactccctgggctggttcgtcgtgtggctcgacgaccacgggcagcccgagggcctggggccgggcggcgtgcggatcttccccgacgggcgcaacccccagagcaagcagtccaacgcggccggccggcgcctggcccggagcgcccgccggcgccgggaccgctacctccagcggcgcgggaagctgatgggcctgctcgtcaagcacgggctgatgcccgccgacgagccggcgcggaagcgcctggagtgcctcgacccctacggcctgcgggccaaggccctggacgaggtgctccccctgcaccacgtgggccgcgccctgttccacctcaaccagcggcgcgggctgttcgcgaaccgggccatcgagcagggcgacaaggacgcctccgccatcaaggccgcggccgggcgcctgcagaccagcatgcaggcctgcggcgcccgcacgctcggcgagttcctgaaccggcgccaccagctgcgggccaccgtccgcgcgcggtcccccgtcgggggcgacgtgcaggcccgctacgagttctacccgacccgggccatggtggacgccgagttcgaggccatctgggcggcccaggcgccccaccaccccaccatgacggccgaggcccacgacaccatccgcgaggccatcttcagccagcgggccatgaagcgcccctccatcgggaagtgcagcctcgacccggccacctcccaggacgacgtggacggcttccggtgcgcctggagccaccccctggcgcagcgcttccggatctggcaggacgtgcgcaacctggccgtcgtggagaccgggcccacgtccagccggctcggcaaggaggaccaggacaaggtggcccgcgccctgctgcagaccgaccagctctccttcgacgagatccggggcctgctggggctccccagcgacgcccgcttcaacctggagtccgaccggcgcgaccacctgaagggcgacgcgaccggggccatcctcagcgcccgccggcacttcggcccggcctggcacgaccgctccctggaccggcagatcgacatcgtcgccctgctcgagagcgcgctggacgaggccgccatcatcgccagcctggggaccacgcactccctcgacgaggccgcggcccagcgcgccctgagcgccctgctccccgacggctactgccggctgggcctgcgcgcgatcaagcgggtgctccccctgatggaggccgggcgcacctacgccgaggccgcctccgcggccggctacgaccacgccctgctgcccgggggcaagctcagcccgaccgggtacctgccctactacggccagtggctgcagaacgacgtggtcggctccgacgacgagcgggacaccaacgagcgccggtgggggcgcctccccaaccccacggtgcacatcggcatcgggcagctgcggcgcgtggtcaacgagctgatccggtggcacggcccgcccgccgagatcaccgtggagctcacccgcgacctgaagctgagcccccggcgcctcgccgagctggagcgggagcaggcggagaaccagcgcaagaacgacaagcggacctccctgctccgcaagctgggcctgcccgccagcacgcacaacctcctgaagctgcgcctctgggacgagcagggggacgtggcctccgagtgcccgtacaccggcgaggccatcgggctggagcggctggtcagcgacgacgtggacatcgaccacctcatccccttctccatcagctgggacgactccgccgcgaacaaggtcgtgtgcatgcgctacgccaaccgggagaagggcaaccgcacccccttcgaggccttcgggcaccggcagggccgcccgtacgactgggccgacatcgcggagcgggccgcccgcctgccccggggcaagcgctggcggttcgggcccggcgcccgcgcccagttcgaggagctgggggacttccaggcgcggctcctgaacgagaccagctggctggcccgcgtggccaagcagtacctcgccgccgtcacgcacccccaccggatccacgtgctgccgggccgcctgaccgcgctcctgcgggccacctgggagctgaacgacctcctgcccgggtccgacgaccgcgccgccaagagccggaaggaccaccgccaccacgccatcgacgcgctggtggccgccctcaccgaccaggccctgctgcgccggatggccaacgcgcacgacgacacgcgccggaagatcgaggtcctcctgccctggcccaccttccgcatcgacctggagacccggctcaaggccatgctggtgtcccacaagccggaccacggcctgcaggcccgcctccacgaggacaccgcctacggcacggtggagcaccccgagaccgaggacggggcgaacctggtctaccggaagaccttcgtggacatcagcgagaaggagatcgaccgcatccgggaccgccggctgcgcgacctcgtgcgggcccacgtcgccggcgagcgccagcaggggaagaccctgaaggccgccgtgctgtccttcgcgcagcggcgcgacatcgccggccaccccaacgggatccggcacgtgcgcctcaccaagagcatcaagcccgactacctggtcccgatccgggacaaggccggccgcatctacaagagctacaacgccggcgagaacgccttcgtggacatcctgcaggcggagtccgggcggtggatcgcccgcgccacgaccgtgttccaggccaaccaggccaacgagagccacgacgcgcccgccgcccagcccatcatgcgcgtcttcaagggcgacatgctccggatcgaccacgccggggcggagaagttcgtgaagatcgtgcgcctgtcccccagcaacaacctgctctacctggtcgagcaccaccaggccggcgtgttccagacccggcacgacgacccggaggactccttccgctggctgttcgccagcttcgacaagctccgggagtggaacgccgagctggtgcgcatcgacaccctggggcagccctggcggcgcaagcggggcctcgagacgggctccgaggacgccacccgcatcgggtggacccggcccaagaagtggccctga

SEQ ID NO: 1510 - RNA, 3198 nt, synthetic construct
  misc_feature 1..3198: note = Cas9 variant
  source 1..3198: mol_type = other RNA
atgaacaaggacatcaactacgccctgggcctcgacatcgggatcaccagcgtgggctgggccgtcatcaacctggacctgaaccgcatcgaggacctcggggtgcggatcttcaacgcggccgagaacctgaaggacggctccagcctggccctcccccgccggctggcccgcgggcggcgccggctgctccgccggaaggcctaccgcgtggagcgggtccgcaagctgatcctgaagaacaacatcctcaccaaggaggagctggagggcctgttcaagaacaaggaggtgatcgacgtgtgggaggcgcgggtcaagggcctcgactacaagctgtcccgcgaggagtgggccaagatcctgatcaacttctgcaagcggcgcgggttcaagagcaaccggaagaacgaggccaaggacaaggaggccggccagatcctctccagcatctcctacaacatcgagaagatgaaggagacgaacagccgcaccatcggggagtacatctacaacgaggtgaagaactccgaggacagctacgcgccgctgcggaacaagttcggcgagtacaagatgtgcgtgtcccgcgacgtcatccgggaggagatccacaccctgttcgagaagcagcgcgagctcgggaacaacttcgccagcgacgagatcgaggacaagtacttcgagatcttcaactcccagcgccccttcagcaacttcgaggacctggagaagctggtgggcttctgcaccttcgagcggaagaagcacaagcgcgcccccaagcactgcatctccagcgaggagttcacgctctacgagggcatcaacaagctgtccatcatcaaggacggggagaagcggaagctgagcgaggaggagcgcaccctcgtggtcaacgaggccttcaacaagaaggagatcaagtacaccaccctgcggaagctgctcggcctgtccgaggaggagctgttcagcacgctcacctacagcatcgacaaggacatctccaagaccgagaacaccaagttcgtgagcctgaaggggtaccacgagatcaagcgcgccatcgagaagggcgtgtccaagaaggcgtggcaggacatcgagaacaaccggaacctgctcaacgacatcgcctacgtcctgacgctgggcaagaccgacgacgagatcgagaagcagctccgcctgcggaacgtgcccgaggagctgttcgagagcctcctggacatgtccttcaacaagttcaacaacctgagcatctacgccctcgagaagatcctgccgttcatgaaggaggggtaccagtacaacgaggcctgcgagaaggccggctacaacttcaaggcgatctacgagggggtgcgcaccaagaagctgcccgtcatcgagatcgacgagatcgtgaaccccgtggtcaaccgggccctcgcccagacccgcaaggtgatcaactccgtgatcgacaagtacggcagccccgtccggatcaacatcgagctggcccgcgacctggccaagaacttcaaggaccggaagctgatcgagaaggagcagaaggagaaccgcgcgaacctcgacaagatccgggagaacctgcgcgagctgatggacaaggagccgacggtggtcgaggtgctcaagtaccggctgtgggagcagcagcgcggggagtgcgcctacacccagtcccagatccccctggagcgcctcttcagccccggctactgcgagatcgaccacatcatccccttctcccggagcttcgacgactccctgagcaacaagatcctggtgctcggctccgagaaccagcgcaaggggaaccggaccccgtacgagtacttcggcgaggacagcgagcgctggaactccttcgagatctgggtcaaggggagctacctgaactacaagaagaaggccaacctgctcaagaagaagttctccgaggaggagcagcgggactggaaggcccgcaacctgcaggacaccaagtacatctgccggtacatcagcaacttcgtgaacaaccgcctggagttcaaggagagcgagaacaagcagaaggtgatcacggtcaacggccgggccaccgcgtacctccgctcccggtgggggctgaacaaggtgcgcgaggacggcgacaagcaccacgccctggacgccgccgtggtcggcgtgaccacccaggggatggtgcagaagatcagcaagtactccaaggcgcacgagctctacacggtccggaagaacgacgagttcgtggacgtggagaccggcgagtgcgtcgacgtggacgagtacaaggagatccgcaaggacatcctgccccggccctggcgcgggttcagcgaggagctgaagctccggctgtccgacaaccccctggaggagctcaagaagtccccgatcgagacctacaacgaggagttcatcaaggagaacgtgaagcccatcttcgtcagccgcgtgcccttccggaagatcagcggcaagctgttcaaggagaccatctactccgagcgcgccttcaaggacgggtacttcgtgagcaagaagtccctggtcgacctcaagcggggcgacctggacaacttctacaactacgagtgcgacaagaagctgtacgacgccatcagcgagcgcatgaaggagttcaactacaacggcaagaaggccttcgagtcccccttccgcaagccgaccaagagcgggaaggagggccccgtggtgcggtccgtcaagatcaagagcgccgtgcccttcaaggacgggatccccatgaacgagggcctcgtggcgaaggagggcatggtccgcatcgacatctacgagaaggaggggaagtacttcgtggtgccggtctaccggtaccagctggccaagggcatcgtgcccaagcgcgccgccatcgccaagaaggacgagctgaagtggcccatcatggaccagacgtacaacttcaagttctccatctacaagaacgacctcatcgaggtgaagtacgacaagaagggggtctacttcggctactacgacgggttcgaccggaacagcgcgagcctgaccatcgagaagcacgacaactccgagcgctaccggagcatcggcctgaaggtgggcgtgctcgagatcaacaagtacgaggtcgacgtgctggggaactaccacaaggtgaagctgggcgggaactga

SEQ ID NO: 1511 - RNA, 3198 nt, synthetic construct
  misc_feature 1..3198: note = Cas9 variant
  source 1..3198: mol_type = other RNA
atgaacaaggacatcaactacgccctgggcctcgacatcgggatcaccagcgtgggctgggccgtcatcaacctggacctgaaccgcatcgaggacctcggggtgcggatcttcaacgcggccgagaaccccaaggacggctccagcctggccctgccgcgccggctcgcccgcgggcggcgccggctgctgcgccggaaggcctaccgcgtggagcgggtccgcaagctcatcgtgaagaacaacatcctgaccaaggaggagctggagggcctcttcaagaacaaggaggtgatcgacgtctgggaggcgcgggtgaagggcctggactacaagctgtcccgcgaggagtgggccaagatcctcatcaacttctgcaagcggcgcgggttcaagagcaaccggaagaacgagacgaaggacaaggaggccggccagatcctgtccagcatctcctacaacatcgagaagatgaaggagaccaacagccgcaccatcggggagtacatctacaacgaggtgaagaactccgacgacagctacgcgcccctgcggaacaagttcggcgagtacaagatgtgcgtctcccgcgacgtgctccgggaggagatccacaccctgttcgagaagcagcgcgagctggggaacaacttcgccagcgacgagatcgaggacaagtacttcgagatcttcaactcccagcgccccttcagcaacttcgaggacctcgagaagctggtgggcttctgcacgttcgagcggaagaagcacaagcgcgcccccaagcactgcatctccagcgaggagttcaccctgtacgagggcatcaacaagctctccatcatcaaggacggggagaagcggaagctgagcgaggaggagcgcaccctggtcgtgaacgaggccttcaacaagaaggagatcaagtacaccacgctccggaagctgctgggcctctccgaggacgagctgttcagcaccctgacctacagcatcgacaaggacatctccaagaccgagaacacgaagttcgtgagcctcaaggggtaccacgagatcaagcgcgccatcgagaagggcgtctccaagaaggcctggcaggacatcgagaacaaccggaacctgctgaacgacatcgcgtacgtgctcaccctgggcaagaccgacgacgagatcgagaagcagctgcgcctccggaacgtgccggaggagctgttcgagagcctgctcgacatgtccttcagcaagttcaacaacctgtccatctacgccctggagaagatcctccccttcatgaaggaggggtaccagtacaacgaggcctgcgagaaggccggctacaacttcaaggccatctacgagggggtccgcaccaagaagctgcccgtgatcgagatcgacgagatcgtgaaccccgtcgtgaaccgggcgctggcccagacgcgcaaggtgatcaacagcgtcatcgacaagtacggctccccggtgcggatcaacatcgagctcgcccgcgacctggccaagaacttcaaggaccggaagctgatcgagaaggagcagaaggagaaccgcgccaacctggacaagatccgggagaacctccgcgagctgatggacaaggagcccaccgcggtcgaggtgctgaagtaccggctctgggagcagcagcgcggggagtgcgcctacacccagagccagatcgccctggagcgcctgttctcccccggctactgcgagatcgaccacatcatccccttcagccggtccttcgacgacagcctctccaacaagatcctggtgctgggcagcgagaaccagcgcaaggggaacaagatcccgtacgagtacttcggcgaggactccgagcggtggaacagcttcgagatctgggtcaaggggtcctacctcaactacaagaagaaggccaacctgctgaagaagaagttcaccgaggaggagcagcgcgactggaaggcccggaacctccaggacacgaagtacatctgccgctacatcagcaacttcgtgaacaaccggctggagttcaaggagagcgagaacaagcagaaggtgatcaccgtcaacggccgcgcgaccgcctacctgcggtcccgctgggggctcaacaaggtgcgggaggacggcgacaagcaccacgccctggacgccgcggtggtcggcgtgaccacgcaggggatggtgcagaagatcagcaagtactccaaggcccacgagctgtacaccgtccgcaagaacgacgagttcgtggacgtggagaccggcgagtgcgtcgacgtggacgagtacaaggagatccggaaggacatcctcccccgcccctggcgggggttcagcgaggagctgaagctgcgcctctccgacaaccccctggaggagctgaagaagctcccgatcgagacctacaacgaggagttcatcaaggagaacgtgaagcccatcttcgtcagccgggtgcccttccgcaagatctccggcaagctgttcaaggagacgatctacagcgagcgggccttcaaggacgggtacttcgtgtccaagaagtccctggtcgacctcaagcgcggcgacctggacaacttctacaactacgagtgcgacaagaagctgtacgacgccatcagcgagcggatgaaggagttcaactacaacggcaagaaggccttcgagagccccttccgcaagccgaccaagtccgggaaggagggccccgtggtgcgcagcgtcaagatcaagtccgcggcccccttcaaggacgggatccccatgaacgagggcctcgtggccaaggagggcatggtgcggatcgacatctacgagaaggaggggaagtacttcgtcgtgccggtgtaccgctaccagctggccaagggcatcgtccccaagcgggccgcgatcgccggcaagagcgagctgaagtggcccatcatggaccagacctacaacttcaagttctccatcttcaagaacgacctcatcgagatcaagtacgccaagaaggacgggtacttcgggtactacgacggcttcgaccgccacaccgccagcctggtgatcgagaaccacgacaacagcgaccggtaccgcggcatcggggtgaagacgggcgtcgtggagttcaacaagtacgaggtggacgtcctggggaactaccacaaggtgaacctcggcgggaactga

SEQ ID NO: 1512 - RNA, 3201 nt, synthetic construct
  misc_feature 1..3201: note = Cas9 variant
  source 1..3201: mol_type = other RNA
atgagcgagcgcgtggtccggcgcatcctgggcatcgacctcgggatcgcctcctgcggctggggcgtggtggacatcagcggggccgggggcggcatcatcgcgaccggggtccggtgcttcgacgcgcccctgatcgacaagaccggcgagccgaagtccgccacgcgccggaccgcccgcgggcagcggcgcatcgtgcggcgccggcgccagcggatgaacggcgtgcgccggctgctctgcgagttcgggctgctgcccgacccccgccccgacgccctcaaccaggccatgcggcgcatcagcaccgcctccgccgccgcgcaggtcaccccgtggacgctgcgggccgccgcccaccagcgcctgctcagcaacgaggagctggccgtggtgctgggccacatcgcgcggcaccgcggcttccgctccaacgccaagaacgaggccggggccaacgccgcggacgagaccagcaagatgaagaaggccatggaggccacccgggagggcctcgccaagtaccacgccttcggggacatgatcgcgaacgaccccaagttcgccaaccgcaagcggaaccgcgacaaggactactcccacaccgccaagcggagcgacctggaggacgaggtccgcgccatcctgcgggcccagctccgcttcggctccgcggccgccacggagaccctggcccagaccttcgcggacgtggccttcttccagcggcccctgcaggacagcgaggaccgcgtgggcgactgccccttcgagccggggcagaagcgggccgcccgccgggccccctccttcgagctgttccgcttcctcagccggctggcgaacctcaagctggccgtcggccgctcccccgagcggcgcctgaccgccgaggagatcgccctcgccgcgaaggggttcggcgagacgaagaagaccatcaccttcaagagcctgcgggaggccctggacctcgaccccaacgcccgcttctccgggatcggcaaggacaaggaggccagcctggacgtggtggcccgcaccggcggggcggcctacggcacgaagaccctgaaggacgccctcggggacgccccgtggcggtccctgagccgcacccccgagaccctggaccggatcgcggagatcctcagcttccgcgaggacatcacgtccatccggaacggcctggaggacctggggctcgacagcctggtcgtggaggccctgatgcaggccgccgccaacggcgacttcaaggagttcacccgcgcgggccacatctccgcccgggccgcccgcaacatcatccccgggctccgggagggcctggtgtacagcgaggcctgcgcgcgcgtcgggtacgaccacgccgcccggctgtccgtgcccctcgaccaggtgggcagcccggtcacccgcaaggccctgtccgaggccctgaagcaggtccgggcggtggcccgcgagtacgggcccatcgactacttccacatcgagctcgcccggagcgtgggcaagtccgccgaggagcgcaagcagctgaccgacggcatcgaggcgcggaacgtggagaaggccaagcgccggaagcaggccgaggagcacctggggcgcgcccccagcgacgacgagctcctgcggtacgagctggccaaggagcagaacttcaagtgcatctactccggcgacgcgatcgaccccgccggggtcgccgccaacgacacgcgctaccaggtggaccacatcctgccgtggagccgcttcggcgacgactcctacctcaacaagaccctgtgcaccgcccggagcaaccagaacaagcgcggccggacccccttcgagtggttcgaggcggacaagacggacgtggagtggatggagtacgtcgcccgcgtggagaacctgcaggaggtgaaggggcggaagaagcgcaactactccatcaaggacgccgccgccatcgaggacaagttcaaggcgcggaacctcaccgacacccagtgggccacccgcctgctggccgacgagctcagccggatgttcccgccccgcgagtgcgagcgggccatctgcggccgcgccgacgggggcaacgacgggctgacgatcgtcgaggagcggcgcgtgttcacccggcccggcgcgatcacctccaagctgcgccgggcctggggcctcgaggggctgaagaagcaggacggcaagcgcgtggaggacgaccggcaccacgccgtcgacgccctggtgctcgcggccaccacggagagcctgctgcagcgcctcaccgtggaggtccagcgccgggagcgcgaggggcggcccgacgacatcttccactgcgccgagccctggcgcggcttccgggccgacgtgcgccggaccgtgtacgggtccgagaccatgcccggcatcttcgtcagccgcgccgagcggcgccgggcgcgcggcaaggcccacgacgccaccatcaagcagatccgggagatcgagggggagcgcctggtgttcgagcggaagccggtggagaagctgacggacaaggacctcgagaagatccccatccccaagccgtacggccaggtcagcgaccccaagcgcctgcgggacgagctggtggagtccctccgcgcctggatcgccgcggggaagcccaaggaccggcccccgctgagccccaagggcgacgtgatccgcaaggtccggatccagaccaacgacaaggtgtccgtggagatcaacgggggcaccgtcgaccgcggcgacatggcccgcgtggacgtgttccggaagaagaacaagaaggccgtctgggagtactacgtggtgcccatctacccccaccagatcgtcgccctgaacgacccgcccgaccgcgccgtgatcgcgtacgccgaggacaaggactggaaggagatcgacagctcctacgagttcctctggagcctgttcgggctgtcctacgtggagatcagcaaggccaacggcgagtgcatcgacgggtacttccggggcctccaccgcgggaccggcgccgcgtccgtctgcaagcacatcagcctgggcaaggacgccacggtgtccgggatcggcctgaagaccctcgccagcttcaagaagttcaccatcgaccggctggggcgcaagttcgagatcccccgggaggtgcgcacctggcggggcgaggcctgcacgtga

SEQ ID NO: 1513 - RNA, 3201 nt, synthetic construct
  misc_feature 1..3201: note = Cas9 variant
  source 1..3201: mol_type = other RNA
atgagccacctggtgctcggcctggacctggggcccaactccatcggctgggccctcgtcaacgacgacccggagcaccccgtggagagcaagctggtggacctgggggtccgcgtgttccccgagggcgtggacaacttcgacacctccaaggagctcagccggaacgaggaccgccgggtcgcccgcgggatgcggcgccagatccggcgccgggcgcgccggcgccagcagctgaagcaggccctgatcgactccaagctctggcccagcgacccgaacgacgaggtggtgctgtacaacaccaacccctacgagctgcgggcccgcgccctcaaggagcggctggagccccacgaggtcggccgcgtgctgctccacctgaaccagcggcgcggcttcctgtccaaccggaagaaggaccgcggggacaaggaggtgcagggcatgctcgccgagatcaacgagaacgagcagcagtgcaaggacgggggcttcgacacgatcggggcgtggctggccgacaagcaggccaacatcgaccacgccaaccgggaggagaacgaccacgtccgcaaccgccacctggcgcggagccagtacgtggacgagttcgaggccatctggtccgtgcaggccaagcaccaccccaagctcctgaccgaggagctgaaggtcggcaagctcggcaagcagacctacccggtgaagcccatcccccgctggcacgagcaccggcaggggctgagccccctggagtccttcggcatctacgggctcatcttcttccagcgcccgatgtactggcccaagagcgtggtcggcctgtgcgagctggagcccaaggagcggcgctgccagcggtccgaccgccggcagcagcgcttccggctcctgcaggaggtgaacaacctgaagtacgtggaccccgacacccacctcgagcagaagctggacgacaagcagcgccggctgctcctggacaagctgagccacacgaaggagatgaccttcgaccagatccgcaaggccctcgacttcctggagtccgtcaagttcaacctggagcggggcgagcgcagccggctcaagggggtgccgatcgacgccctgttcgcggccaaggacgtgctgggccaggagtggtacgaccgccccgagcagcagaagaccgagatcgtcgccgtgctcctggacaacgagcgggacgacgaccgcatcatcgcccgcgccgtcgcggagtgggggatgaccgccaaggaggccgaggccatgctgggcgtggacctccccgccgggtacgcgaacctgtcctgcaaggccatcgagaagctgctgccccacatggagcggggcctcctgtacatggacgacgacgagagcaactccgccatgcacgccgccggctacctgcgccgggaccagctccgccggcgcatcttcgacgtgctgccggaccccgcgcggacgcccaactgccccatcggggacatcccgaaccccgtcgtgaagcgcaccctgaccgagatccggaaggtggtcaacgccatcgtgcgcgagtacggcaagcccgacgccatccacctcgagctggcccggagcgtgcagatggggaaggagaagcgcagcgagtactccaagatgatccgggaccgcgaggcggagcgggacggcatcgtcgagaagctgcgcgagagcggggtgcgggtgacccgcgacaacatcctcaagtaccagctgtgggagcagcagaaccaggagtgcatctactccggcaagcccatcagcttcgagaagctgttcggcgagggcggcggggtcgaggtggaccacatcctcccgcggtcccgcagcctggacgactcccaggccaacaagatcgtgtgcctgcggacggccaacgccgggaagggggaccagaccccctacgagtggctcgccgacacccagcccaagcagtacgagcaggtctgccagcgcgcgggcatgctgatgcgcagcggccggatgccgtacgccaagtaccgccggttcatccagcgcgagctggagctcgacaagttcatcgcccggcagctggccgacaccgggtacatcacgaaggccaccatggagtacctgcgctacctcttcgacaaggaccacgacgtgctgggcctgaaggggcagctcaccgcggagctgcggtaccactggggcctggagaccatcctcgaggagctgcccgactcccccgcctggcacgaggccgacagcggcaagctgcgccccggggagaagaaccgggccgaccaccgccaccacgccatcgacgcggtggtcatcgccctcacgaaccggcgccggctggtgcagctgtccgacatcgtgaagcgcggcggggcccgggcccacggcgagatcctcgaggacccgtggcccaacttccgcgagaacgtcgtgcaggcgatcaagaagaccaacgtgagccaccgggtcgagcgcaaggtggccgggaagctgcacgaggagaccctgtacggccccacccggacgcccggcgagtgggtgctccgcaagccggtcatcgccctgtccgccaacgaggtggagcgcatccgggacgccaccatccgccagatcgtggtcagcgcgctggccgacgccgggatcgacgtgggccgggggaagaagcccgacgccaagaagatgaaggaggccctctccaagctgaagatgcccagcggcgtgcccatccgcaaggtccggctgaccaagccggagcagaccatccagcccgtgcgcgcggggcggcccgaccaggccttcgtgaagcccggctccacgcaccacctctgcatcttcgagttcaccgagaacggcaagaccaagcgcgacgccgtcttcgtgaccatgctggaggccatgaaccggctgaagcgccgggagccggtgatccagcgcacgcaccccgagcggcccgacagccgcttcgtcatgtccctcagcgcccgggagatgctgctggcgaactggaaggacggggagcgcctcctgaccttcaagaccgccagctccacccagggccagatctggttcgccgagcacacggacgcccgcaagagcgcggactacaagcagttcgtggccaacgccaacaccctggacgccaagaaggtgaccgtcgaccccctcgggcggatccggtgggccaacgactga

SEQ ID NO: 1514 - RNA, 3204 nt, synthetic construct
  misc_feature 1..3204: note = Cas9 variant
  source 1..3204: mol_type = other RNA
atgggcacccgcctggggctcgacatcggcaccaacagcatcgggtggtgcctgttcaacctggacggctccgggcggcccatcggcatccgcgacatcggcgtgcggatcttcagcgacgggcgcgacccgcggtccggcgccagcctcgccgtcgagcgccgggtggcgcgcgccatgcggcgccggcgcgaccggtacatccgccggcgctccgccctgctggaggccctcatcaacacggggctgatgcccgccgacgtgcaggagagcaaggcgctgaccggctgcgacccctacgtcctccgggcccaggccctggaccgcgccctggacgcgcacctcctggggcgggtgctgttccacctcaaccagcgccggggcttcaagtccaaccgcaaggccgagcgcaaggccggcgacgacaaggagggcgggaagatcgccgacggggccaaggcgctggacctggccatgcacgaggccggcgcccggacctacggcgagttcctcgccgggcgcgacagccggcgcgtgcggctgcgcgcggagggcgacgggtacgacttctaccccgagcggcgccacctggaggccgagttcgacgccatctgggacgcccaggccgcgtacaacccggccctcctgaccgacgtcgtgcgggaccgcctgcggcgcatcatcttcttccagcggcccctcaaggcccccaaggtgggcgggtgcacgttcttcaacgaggagccccgcctgccgaaggcccaccccctgttccaggagcggcgcctctacgaggaggtcaaccagctggagatcacccgggccggcgcgccctcccgcaagctgaccctcgaccagcgggacaagatcatccgcaagctcaagagcgccaagaccgcctccttcagcggcctggcccgcctgctgaagctggcggacggggagtccttcagccgggtgacggagaaccgcaccggcctcgccggggacgacatcttcacctccttcagcgacaagcggtgcttcggcgaccgctgggcccacttcgaccccggggtgcagtggtccatcatcgagaccgtcacggaggaggaggacccggtgcggctgcgcgactggctgatggccacccacggcgtgaccgtcgagcaggccgaggcgatcggccgggtgcgcctccccgaggggcacggccggctgggggagaccgccagccgcctgatcctcgcccagctgaagtccggcagcaaggacgggcaccccctgacgtacaacgaggccgtggaggccgcgctcggcaagagccactccgacttccggaccggcgagatcctggagcagctgccctactacggggagatcctcagccgcgagatcccgcccggctccctggaccccgacgacgacgacgagatccggtgggggaagatcaccaaccccaccgtccacatcggcctgaaccagctgcgccggctcctgaacgccctgatcaaggcccacggccgcccggacgagatcgtggtggagctcgcccgggagctgaagctgagcgagaaggacaaggccgagcacaaccgccggatcggggcgaacacgcgcgccgccgaggcccggtccaagaagctcctggagagcggccagcccgacaccggggcgaaccgctccctgctcaagctgtgggaggacctgaaccccaacaaccccctcgaccgctgctgcccgttctgcggccggcacatcgggcagatggccctgttcagcggcgagaccgagatcgagcacatcatcccctactcccgcagcctggacgactccgccgccaacaaggtcatcgcccaccggagctgcaaccgcgagaagggcaaccggaccccctgggaggcgtgggggcacacggagcgctgggccatcatcgccgagcaggtctcccggctccacaagagcaagcagtggcgcttcgcccccgacgccatcgagcggttcaaccaggagggcgggttcatcgcgcgccagctgtccgacacccagtacctgagccggatggcccgcacctacctctccagcctgtacccggacaccgccggcgtgtacgtgatccccgggcggatgacggccatgctgcgccggctctggggcctgaacgagctgctccccgaccacaactacgtggagaacccgcactccggcgcccccaagaaccgcctggaccaccggcaccacgcgatcgacgccgccgtcgtgggggtgaccacccgcggcctgctcaacgagatcagccgggccgcggggcgcgccgagcgccaggacctggaccggctgttcatcgacctccccaagccctgggagaccttccgcgaggacctgcacgagagcctggcccgggtcgtgggctcccacaaggccgaccacgggcgcaagggcgtgccggccaagggcaaggacgcgacggccgcccggctccacaacgagaccgcctacgggctgaccggcctgaccagcgagtccgggctccccatcgtcgtgcaccgcgtgcccctgctgagcctcaagcccgacgacctgtccaacccgatccggatccccgacgccgcgctgcagcgcgccctccgggaggccacggacggcaagagcgggaaggacttccaggaggccctggcccagttctccaagagcgaccccgtcttcaagggcatccgccacgtgcgggtgcgcgagaccctgaaggtcatccccatccgggacgcgtccggccacgccttcaaggcctacaagggggacgccaacgcccgctacgacgtgtggcggatgccggacggcaagtgggtgagctcctggcgcgaccgggacgggaaggcgcacagcggcatcatcaccatgttcgccgcccaccaggccggccagcccgtccagcgcccccaccccgcggccaagcgggtgctctccctgcgccagaacgacctggtggccgtcgagccgcaggggcagccccggaagatcatgcgcgtggtgaagttcagctccggcgggcagatcaccttcgccgagcaccaggaggccggccccctcaaggcgcgcgacgccaccagccccgacatcgacccgttcaagtacttctactccagcgccgggggcctgcagaaggcccgggcccgccagatccggatcgacgagctgggccgcatcttcgaccccgggccccggtga

SEQ ID NO: 1515 - RNA, 3207 nt, synthetic construct
  misc_feature 1..3207: note = Cas9 variant
  source 1..3207: mol_type = other RNA
atgaagtacgtgctgggcctcgacatcgggatcgccagctgcggctgggccgtcatcaaccaggagaagcaccgcatcgaggacctgggggtgcggatcttcgacaaggcggagaaccccaaggacggcaagtccctggccaccccgcgccgggacgcccgcagcacccggcgcacgctccggcgcaagaagcaccggatgcagcgcatcaagatcctgctggtgaagcacgggctcctgtccaagaccgagatcgaccacctgtacgagagcgccaccgagatcgacgtctggtacctccggctgaacgccctggagcgccggctcaaccccaaggagttcgcgcgcgtgctgatccacctgtccaagcggcgcggcttcaagagcaaccggaaggagaccacgctctccgagaacggccagatcctggagaacatcagcgagaacctgcagatcatggagcagaagaactaccgcaccgtgggggagatgatcctcaaggacaagcggttcgagaaccacaagcgcaacaaggacggcacctacatcgggaccgtcacgcggcagcagctgcaggaggagatccagatgatcttcaacgcccagcgcctgtacaagaacaaccacgccaccgagaagttcgagtccagctacctcgagatctgggcctcccagcgcccctacgcgagcaaggaccagatcgagaagatgatcggctactgcaccctggagcccaaggagaagcgggtgccgaaggcctcctggagcttccagtacttcgtggccctgcagaccatcaacaacctccgcctgatctccaaggaccggatcgaggagctgagcttcgaggagaagaagcgcatcatgaacctcgccctggagaagtccatcgtcaagtacatcgacatccggaagctgctcagcgtgcccaaggagttccagttcaactccctgagctacagcgccgacatcgtggacacgaccgtcgagaacaagaagtgcatcgagctgaaggagtaccactccatcaacaaggtgtacaagcagatctacgggcagaacgcgctcaacctgctgcccaaggactacgacaccatcgcctacggcctcaccatcttcaaggacgacaaggacatccaggagtacctgcagaacaagtacgtgaacgccaagggcaagcccatcagcaacctggccaacaagacgtacgacgacaccttcatccaggtcctcctgaccctgaacttctccaagatggggcacctcagcttcaaggccctgaagaacatcatcccgttcctggaggagggcctctcctacgacaaggcgtgcgagaaggccgggtacaacttcaagggcaccagctacacgaagaagaccaagtacctgcccgtgatcccccagaacaccaaccccgtggtccaccgcgccctgtcccagacccggaaggtgatcaacgccatcatcaagaagtacggcagcccgaacgccatccacatcgagacggcgcgcgagctctccaagaccttccaggagcggaaggagatcgacagcatgtaccaggacaactccaagaagaacgagcacgccatctgcaagctgaaggagctggggaacatcaaccccagcggcatcaacatcgtgaagttcaagctgtggaacgagcaggacgggcgctgcatgtacaccggcaagtacatcgagccccaccgcctcttcgaggaggggtacaccgaggtcgaccacatcctgccctactcccggagcctggacgactcctacaacaacaaggtgctcacgctgggcaccgagaaccagcggaagggcaacaagaccccgtacgagtacatgcgcaacaacagcatctgggacgagttcgagacccgggtgcagtccaacaagaagatcaacaagaagaagcagcagaagctgctcctgcagaacttcagccacgcccgcgagcaggagttcatcgagcggaacctgaacgacacgcgctacgccaccatctacctctccagcctgatccagcagcacctgatcttcagcgagtccagccgggagaagaaggtccacaccgtgtccgggatcatcaccagccacctccgctcccgctggggcttcaacaaggaccggaaggaggggcacatccaccacgccctggacgcggtcatcgtggccgtgacgagcgaccacatgatccagcgcgtcaccaagtactacaagctgaaggagctcaaccggaaccgccaggccaagcggatgcagttccccgagccctgggagggcttccgcctggagctggaggcccggatctcccccaacacccagcagtacctcaaggggatccgcttcaagaactacgcggacgtgaacctgagcgagatcaagccgatcttcgtgtcccggatgcccaagcgcagcatcaccggcgagctgcaccaggagaccatccggaagttcctcggctacaacgagaaggggaaggtcctgacggccaccaagaccaagctggaggacatccccttcgacgccaacggcgacttccccatgttcgggaaggagaccgacctctacacgtacaacgccatcaaggagcgctacctgtcccacaagaaggacaagagcaagtccttccaggagccgctgtacaagcccaccaagagcggcgggatcggccccctcatcaagtccatcaagatcatggacacccggaccatcgtgaaccccgtgaaccagggcaagggggtcgtgtacaacagcaagatcgcccgcacggacgtgttcaagaagggcgagaagtactacctgatcccgatctacaccatcgacctgatgaagaacaccctcccccagaaggcgatcaccgccgggaagggctacgaggactggacgaccatcgacccctccttcaccttcctgttcagcctgttcccgaacgacctcatccagatcgtccccagcaagaacaagaccatcaaggcccggacgaccgtgtccaagaaggaggtgctgctgcccagcctcaccggctacttcaagggggtccactccggcaccgccgggatcacggtggagacccacgacggcagcatcatcgccaacgtggggtccaagcagctgctgagcttcgagaagtaccaggtcgacgtgctcggccactacaccaagatcaagaaggagaagcgcatcggcatggcgatctga

SEQ ID NO: 1516 - RNA, 3207 nt, synthetic construct
  misc_feature 1..3207: note = Cas9 variant
  source 1..3207: mol_type = other RNA
atgaacaaggccgtggcctaccgcctggcgctcgacctgggcagcacctccctggggtgggccatcttccggctcaacgaggcccgcgagcccaccgccatcatccgggccggcgtccgcatcttcagcgacgggcggaacgcgaactccgagccgctggccgtgcaccgccgggtggcccgcgccatgcggcgccggcgcgaccggctgctcaagcgcaagaagcggatgcacgaccagctggtccagcacggcttcttccccgcggaggtggccgagcgcaaggagctggagcggctcaacccctaccagctgcgcgccaaggggctgcacgaggccctcacgcccggcgagttcgcccgggcgctgttccacatcaaccagcgccggggcttcaagagcaaccgcaagaccgaccgcaaggacaacgactccggggccctgaagcaggccatcagcgagctccggaagcgcatccaggactccgactgcgccaccgccggcgagtggttctggaaggagcggatgcagcagaagccggagggggtgcgcggccagtgggtccgggcgcgctaccggaagacccccagcacgaccgacgaggggaagaagcgcatcggctacgacctgtacgtggaccgggccatggtggagcaggagttcgacgccctgtgggccgcccaggcggccctccagcccggcctgttcaccgaggccgcccgcgccgagctgaaggacaccctcctgtaccagcgggacctgcgccccgtcaagccggggcggtgcacgctcctgcccgcggaggagcgcgcgcccctggccctcccctccacccagcggttccgcatcctgcaggaggtgaacaacctgcggctcctggacgaggccctgcgcgaggtgccgctcaacctggcccagcgggacgccgtcgtgagcgccctggagggcaagaaggagctctccttcgccgccatccgcaagctgctgaccctcagcgggaagttcaacctggaggacgagaagcgcgcggagctgaagggcaacgccacctccgtgatcctcgcccggaaggacctgttcggcgacgcctgggccgggttcgacgcggccgtccaggacgagatcgtgtggcgcctggtgagccaggagtccgagggcgccctcatcgcctggctgcagcagcacacgggggtcgacggcgtgtgcgccgaggcgatcgtgaacacccggctgcccgacgggtacggccgcctcagccggaaggccctggagcgcatcgtccccgccctgcagcgggaggtgtgcacctacgacaaggccgtgcaggcggccggcttcgcccaccactccgacctggggttcgacttcgactacgccgaggacgaggtccagcaggtcggcgagcacaccatcgccagcacgggggaggtgcaggcgcagtacgccttcaagcagctcccctactacggcaaggccctgcagcgccacgtggccttcgggtccggcgacgccaaggaccacgaggagaagtgctacggcaagatcgcgaacccgaccgtgcacatcgggctgaaccaggtccggaccgtggtgaacgccctcatccgccggtacggccaccccaccgaggtcgtggtggagctggcccgcgacctgaagcagagccgggagcagaagcagcagacgcagcgcgagcaggccgacaaccagaagcggaacgaggacatccgcaagcggatcgcccccatcctcgagaccagccccgagcgcgtccgggaccgcgacatcaagaagtggatcctgtgggaggagctgaacaagaaggacatcgcggaccggcactgcccgtactccggggagcgcatcagcgccaccatgctcctgtccgaggccgtggagatcgagcacatcctgcccttcagccgcaccctcgacgactccctgaacaaccggacggtggccatgcgccgggcgaaccgcatcaagggcgaccggaccccctgggaggcccgcgccgacttcgaggcccaggggtggcggtacgaggccatcctgcagcgcgcggagggcatgcccccgcggaagcgctaccggttcgccgaggacggctaccagcgctggctcgggaaggaccggaacttcctggcccgcgccctgaacgacaccagctacctctcccggctggccgcgaactacctgcgcctcgtctgcccccagggcgtgcgggtgatccccgggcagatgaccgacaagctgcgcggcaagttcggcctgaacagcgtcctcgggctggacggcaagaagaaccggaacgaccaccgccaccacgccgtggacgcctgcgtgatcggggtcacggaccagggcctgatgcagcgcttcgccaacgcctccaagcaggcgcgggagaacgggctcacccgcctggtgcaggacatgctgctcccctggtggccgagctactacgaccacgtggagcgggccgtccgccacatccgggtgtcccaccgccccgaccacggcttcgagggcgccatgatgaaggggaccgcccacggcatccgggaggacgggatccgcgaggacggccggatcaagcagcgccccaaggccaaggggagcgcggaccacaagaccatcacgctgatcccgatcgacgagccccggcagctggcccgccacggcgtggacgccgagggcaagcccctcccctacaaggggtacgcctccggcagcaactactgcatcgagatcaccaagaacgggaagggcaagtgggaggggcaggtcatctccaccttcgacgcgtaccggatcaaggccgccgccgacgccgcggcccgcgccggccaggtgatcagcaccgtggaggccgactccatcgtccgcaagagcggctgggagcggctgcgcggggcccagtcccagaacggccagccgctggtgatgcggctcgtgatcggggacagcgtccggatggaggtggacggccgcgacgaggtgatgcgggtcgtgaagatgagcgggaaggagatggtgttcgcgcccgtccgcgaggccaacgtggacaagcgcaacaacatgcccgacgagcaggaccccttcacgtacacctacaagcgggccgaccagctgcgcaaggccaaggcccgccaggtgaccatctccccgatcggcgagctgcgggaccccggcttcaaggggtga

SEQ ID NO: 1517 - RNA, 3207 nt, synthetic construct
  misc_feature 1..3207: note = Cas9 variant
  source 1..3207: mol_type = other RNA
atgcagtacgtgctgggcctcgacatcgggatcgccagctgcggctgggccgtcatcaaccaggagaaggagcgcatcgaggacctgggggtgcggatcttcgacaaggcggagaaccccaaggacggcaagtccctggccgccccgcgccgggacgcccgcagcacccggcgcaccctccggcgcaagaagcaccggatgctgcgcatcaagatcctgctcgtgaagcaggggctgctgtccaagaacgagctcaaccacctgtacgagagcacgaccgaggtcgacgtgtggaacctgcggctcgacgccctggagcgcaagctgaaccccaaggagttcacccgggtgctcatccacctggcgaagcgccggggcttcaagtccaaccgcaaggagaccacgctgagcgagaacggccagatcctcgagtccatcagcgagaaccagcagatcatggagcagcagaactaccggaccgtcggggagatgatcctgaaggacaagaagttcgagaaccacaagcgcaacaaggacggcacctacatcgggaccgtgacgcggcagcagctgcaggaggagatccagatgatcttcaccgcccagcgcctctacaagaacgactacgccaccgaggagttcgagatctcctacctggagatctgggccagccagcggccctacgcgtccaaggaccagatcgagaagatgatcggctactgcaccctggagcccaaggagaagcgcgtgccgaaggccagctggtccttccagtacttcgtcgccctccagacgatcaacaacctgcgcctgatcagcaaggaccggatcgaggagctctccttcaaggagaagaagcagatcatgaacctggccctggagaagtccatcgtgaagtacatcgacatccgcaagctcctgagcatccccaacgagttccagttcaacagcctgtcctacagcgccgacaccgtggacaccaccctcgagaacaagcggtgcatcgagctgaaggagtactacagcatcaacaaggtctacaagcagatctacgagaagaacgcgctgaacctcctgcccatcgactacgacacgatcgcctacgggctgaccatcttcaaggacgacaaggacatcctcgagtacctgcagaacaagtacgtgaacgccaagggcaagcccatcaacaacctggccaagaagacctacgactacaccttcatccaggccctcctgacgctgaacttcaccaagatgggccacctctccttcaaggcgctgaagaacatcatcccgttcctggaggaggggctcagctacgacaaggcctgcgagaaggccggctacaacttcaaggggacctcctacaccgagaagacgaagtacctgcccgtgatcccccagaacaccaaccccgtcgtgcaccgcgccctgagccagacccggaaggtgatcaacgccatcatcaagaagtacggctccccgaacgcgatccacatcgagaccgcccgcgagctgagcaagacgttccaggagcggaaggagatcgactccatgtaccaggacaacagcaagaagaacgagcacgccatccacaagctcaaggagctgggcaacatcaacccctccgggatcaacatcgtcaagttcaagctgtggaacgagcaggacggccgctgcatgtacagcgggaagtacatcgagccccaccgcctcttcgaggagggctacaccgaggtggaccacatcctgccctactcccggagcctggacgactcctacaacaacaagaccctcaccctggggacggagaaccagcggaagggcaacaagaccccgtacgagtacatgggcaacaccagcatctggaacgacttcgagacccgcgtgcactccaacaagaagatcaacaagaagaagcagcagaagctgctcctgcagcacttcagctacgcccgggagcaggagttcatcgagcgcaacctgaacgacacgcggtacgccaccatctacctctccagcctgatccagcagcacctgatcttctccgagagcagccgcaagaagaaggtccacaccgtgtccgggatcatcaccagccacctccggtcccgctggggcttcaacaaggaccggaaggaggggcacatccaccacgcgctggacgccgtgatcgtcgccgtgaccagcgaccacatgatccagcgcgtcacgaagtactacaagctgaaggagctcaaccgcaacctgcaggccaagcggatgcccttccccgagccctgggagggcttccgcctggagctcgaggcgcggatctccccgaacacccagcagtacctgaaggggttccgcttcaagaactacgccgacgtgaacctgagcgagatcaagcccatcttcgtgtcccggatgcccaagcgcagcatcaccggcgagctccaccaggagaccatccggaagttcatcggctacaacgagaaggggaaggtcctgacggccatcaagaccaagctggaggacatccccttcgacgccaacggcgacttcccgatgtacgggaaggagaccgacctctacacctacaacgccatcaaggagcgcttcctgtcccacaagaaggacaagcgcaagagcttccaggagcccctgtacaagcccacgaagtccggcgggatcggccccctcatcaagagcatcaagatcatcgacacccggaccatcgtgaacccggtgaaccagggcaagggggtcgtgtacaactccaagatcgcgcggaccgacgtgttcaagaaggacgagaagtactacctgatccccatctacacgatcgacctgatgaagaacatcctcccccagaaggccatcaccgccggcaaggggtacgaggactggaccaccatcgacccgagcttcacgttcctgttctccctgttccccaacgacctcatccagatcgtccccagcaagaacaagaccatcaaggcccgcaccaccgtgtccaagaaggaggtgctgctgcccagcctcacgggctacttcaagggcgtccacagcgggaccgccggcatcaccgtggagacccacgacgggtccgtgatcgcgaacgtcggcagcaagcagctgctgctcatcgagaagtaccaggtggacatcctggggcactacacgaagatcaaggaggagaagcggatcggcatggccatctga

SEQ ID NO: 1518 - RNA, 3207 nt, synthetic construct
  misc_feature 1..3207: note = Cas9 variant
  source 1..3207: mol_type = other RNA
atgcccaagagcgccaagccgcagcaggcctacaccctgggcctcgacatcgggatcgcgtccgtgggcgccgccctgctggggcagcagcacatcatcggcctccacgtccgcaccttcgaccgggccgagacggccaaggagggggagcccctgaacaagatccgccgggacgcgcgcctgacccggcgccggctccagcgccgggcccaccgcctgctgcggctccgccggctgttcaagcgccacaacctgatccccgacaccgacaccagcacgttcatctccggccagagcccctgggagctccgggcccagggcctggaccgccagctgacctccgccgagtggaccaccgtgctctaccacatcgtgaagcaccgggggttccacagcaaccgcaagtccgaggtcaagacggacgagaaggcgggccagatgctgagcggggtgaaccagaaccaggccctgctcaagcagtccggcctgcggaccatgggggagctggccgcccgccacgaggccttccgggaggcgaagcgcaacaagaagggcgcctacaaccacaccttcagccgccacgacctcgaggacgagctgcacctcctgttctcccggcagcgcgagctgggcaacccgtacgccacccccgagctggaggacgccgtgcacacgctcctgatgcagcggcgccccgccctgagcgggaccaacctcctgaagatggtcggccactgcaccctggagcccgacgagttccgggcgccgaaggcctcctacaccgccgagcgcttcatctggctcacgaagctgaacaacctgcgggtgagcgggtccggcgagacccgccccctcaacgagagcgagcggcaggccctgctgtccaagcccttcagccagtccaagctcacctacaagcaggtccgcaagatcctggagctgcccgacaacatccggttcgtgggcctccactaccacccggcccaggacaacggcaagagccccgagaaccgcgtgttcttcgaggcgaaggccttccacgccctgcggaacgtgtacaagaaggccgggctgaacctcgagtggcagcgcgacagccagaaccccgagaagctggacaacatcacctacgccctgacggtcttcaaggaggacaaggaggcgaagcagtggctcatcgagaagggggtggaggcctccgtgatcgaggccgtcctgaacgagagcttctccgagttcgtgcggctgagcatcaaggccctgcgcaagatcatcccccacatggagatcggccaccggtacgacgaggcggtgaagctcgccgggtactcccaccacagccacctcccgcagccctccaagaccccctacatcccccgcttcagcaagcagtccatcgccaacccggtcgtgagccgggccctgaaccaggcccgcaagctggtgaacgcgatcgtccgcgagtacggcccgcccgacgccgtgcacatcgagctggcccgggacctgaacaagcccttcgacgagcgccggaagatcgagaaggaccaggagaagtaccagaaggacaaggcccgcgacatcgagaccttccaggagaacttcggcttcacccccaaggggctccagctgacgaagtggcggctgtaccgcgagcagtccggcaagtgcgcctacagcctcaagcccctggacatcaaccggctgttcgaggacgggtacgtggagatcgaccacgcgctcccctactcccgcagcttcaacgacggcatgaacaacaaggtcctgaccctgaccaccgagaaccggaacaaggggaaccagacgccctacgagtacctcgacggcgcctccaacagcgcccagtggcgcaacttcgtggcctgggtcaactccaacaagagctaccgggcctccaagcagcgcaacctgctgcggaaggacttcgcggcccaggccgccaccgagttccgcgagcggcacctcaccgacacccgctacatcgcgcgggagttcaagcgcatggtggagacgcacctgaagctgaacaagccgaaccagcggtgcgtggtcgtgagcggccagctcaccgcctacctgcgcgcccggtgggggctgatcaaggtgcgcgagaacggcgacctccaccacgccctggacgccgcggtcgtggccgcctgcagccacgccatggtgaagcgcctggccgactactcccggcgcggggagctccagtacgcgcggggccaccacttcgaccccgagaccggggagatcatcgacatcaacgccctgcgcaagctggacgaccacttcccccagccgtggaccgacttccggcgcgagctcctggcctggctgagccccgaccccgcccagcagctcaagaacctggcctactacacggacgagcggctgaagcaggtcaagcccatccgcgtgtcccgggcgccgacccgccggggcctcggcgccgcccaccaggagaccatccgcagcgccaagtacctgggggagaaccggtccaccgtgaagacgcccctggagaagctcaagctgaaggacatccccaacatcgtcggctacgaggacccccgcaaccaccagctgatccaggcgatcagccagcggctcaccgagcacggggacgacggcaagaaggccttcaaggagccgctgtacaagcccggcaacaacaagtccaccgcccccgtggtgcgcagcgtcaagctgttcaccgtgcagaagtccgggatccccgtgcggggcgggatcgccaacaacggcaacatggtccgcgtggacatcttcaccaagaaggagcggtacttcgccgtgccggtctacgtgagcgacgcggcccgcaacgagctccccaacaaggccgtggcccgcgggaaggacggctggatcgacatcgacgactccttcagcttcctgttctccctgtaccccaacgactgggtcagcgtggtggtcaagccccacgaggccccgtgcgagggctactacgcggggctcgacatctccacgggcgccatccacatctgggcccacgaccggaaccgcagcgtggggaagaacggcctgatgcggtccatcgggatcaagaccgcccacagcgtggagaagtaccacgtcgacctgctcggcaacctgtaccgcgtggtgcacgagacccggaagcccctgcgcgccggcaagtga

SEQ ID NO: 1519 - RNA, 3207 nt, synthetic construct
  misc_feature 1..3207: note = Cas9 variant
  source 1..3207: mol_type = other RNA
atgcagtacgtgctgggcctcgacatcgggatcgccagctgcggctgggccgtcatcaaccaggagaaggagcgcatcgaggacctgggggtgcggatcttcgacaaggcggagaaccccaaggacggcaagtccatggccaccccgcgccgggacgcccgcagcacccggcgcacgctgcggcgcaagaagcaccggatgcagcgcatcaagatcatcctcgtgaagcaggggctgctgtccaagaccgagctcgaccacctgtacgagagcgccaccgaggtcgacgtgtggaacctgcggctcgacgccctggagcgcaagctgaaccccaaggagttcacccgggtgctcatccacctggcgaagcgccggggcttcaagtccaaccgcaaggagacgaccctgagcgagaacggccagatcctcgagtccatcagcgagaaccagcagatcatggggcagaagaactaccggaccgtcggcgagatgatcctgcaggacaagaagttcgagtcccacaagcgcaacaaggacgggacctacatcggcacggtgacccggcagcagctgcaggacgagatccagatgatcttcaacgcccagcgcctctacaagaacaactacgccaccgccgagttcgagaacagctacctggagatctgggcgtcccagcggccctacgccagcaaggaccagatcgagaagatgatcgggtactgcaccctggagcagaaggagaagcgcgcccccaaggcctcctggagcttccagtacttcgtggccctccagacgatcaacaacctgcgcctgatctccaaggaccggatcgaggagctcagcttcgaggagaagaagcagatcatgaacctggcgctggagaagtccatcgtcaagtacatcgacatccgcaagctcctgagcgtgccgaacgagttccagttcaactccctgagctacagcgccgacaccgtggacatcaccgtcgagtcccggaagtgcatcgagctcaaggagtaccacagcatcaacaaggtgtacaagcagatctacgagaagaacgccctgaacctgctccccaaggactacgacaccatcgcctacggcctgacgatcttcaaggacgacaaggacatcctggagtacctccagaacaagtacgtgaacgccaagggcaagcccatctccaacttcgcgaacaagacctacgacgacaccttcatccaggccctgctgaacctcaacttcaccaagatggggcacctgagcttcaaggccctgaagaacatcatccccttcctcgaggagggcctgtcctacgacaaggcctgcgagaaggccgggtacaacttcaagggcacgagctacaccgagaagaccaagtacctgccggtcatcccccagaacaccaaccccgtggtgcaccgcgcgctctcccagacgcggaaggtcatcaacgccatcatcaagaagtacggcagccccaacgccatccacatcgagaccgcccgcgagctgtccaagaccttccaggagcggaaggagatcgacagcatgtaccaggacaactccaagaagaacgagcacgccatctgcaagctgaaggagctcgggaacatcaacccgagcggcatcaacatcgtgaagttcaagctgtggaacgagcaggacgggcgctgcatgtactccggcaagtacatcgagccccaccggctgttcgaggaggggtacaccgaggtggaccacatcctgccctacagccgctccctcgacgacagctacaacaacaagacgctgaccctgggcaccgagaaccagcggaagggcaacaagaccccctacgagtacatggggaacacgtccatctggaacgacttcgagacccgcgtccagagcaacaagaagatcaccaagaagaagcagcagaagctcctgctgcagcacttctcctacgcgcgggagcaggagttcatcgagcgcaacctcaacgacacccggtacgccacgatctacctgagcagcctgatccagcagcacctcatcttctccgagagctcccgcaagaagaaggtgcacaccgtgagcggcatcatcacctcccacctccggagccgctgggggttcaacaaggaccggaaggagggccacatccaccacgccctggacgccgtcatcgtggcggtcacctccgaccacatgatccagcgcgtgaccaagtactacaagctgaaggagctgaaccgcaacctgcaggccaagcggatgccgttccccgagccctgggaggggttccgcctcgagctggaggcccggatcagccccaacacgcagcagtacctgaagggcttccgcttcaagaactacgccgacgtgaacctctccgagatcaagccgatcttcgtcagccggatgcccaagcgctccatcaccggcgagctgcaccaggagaccatccggaagttcatcgggtacaacgagaagggcaaggtgctgaccgccatcaagacgaagctcgaggacatccccttcgacgcgaacggggacttccccatgtacggcaaggagaccgacctgtacacctacaacgccatcaaggagcgcttcctgagccacaagaaggacaagcggaagtccttccaggagccgctctacaagcccaccaagagcgggggcatcggccccctgatcaagtccatcaagatcatcgacacgcgcaccatcgtgaaccccgtcaaccaggggaagggcgtggtgtacaacagcaagatcgcccggaccgacgtcttcaagaaggacgagaagtactacctgatcccgatctacaccatcgacctcatgaagaacatcctgccccagaaggccatcacggccgggaagggctacgaggactggaccaccatcgacccctccttcaccttcctgttcagcctcttcccgaacgacctgatccagatcgtgcccagcaagaacaagacgatcaaggcgcgcaccaccgtgtccaagaaggaggtcctgctccccagcctgaccggctacttcaagggggtgcactccggcacggccgggatcaccgtggagacccacgacggcagcgtcatcgccaacgtggggtccaagcagctgctcctgttcgagaagtaccaggtggacgtcctgggccactacaccaagatcaaggaggagaagcggatcggcatggccatctga

SEQ ID NO: 1520 - RNA, 3210 nt, synthetic construct
  misc_feature 1..3210: note = Cas9 variant
  source 1..3210: mol_type = other RNA
atgaagaagcagccccagcgctacatcctgggcctcgacctggggatcgccagcgtgggctgggccctgatcctcgtcgacggggcggagaacccggtgggcctgctggactgcggggtgcggaccttcgagcgcgccgaggtccccaagaccggcgactccctcgccctggcccggcgccaggcccggagcgtgcgccggctgatccgccggcgcgcgcaccggctcctgcgcctgcggcgcctcctgaagcgggagggcatcctgtccgccgccgacttcaacagcgacgggctccccaacctgcccatcgacgcctggcagctgcgcgtggcgggcctcgagcggaagctgacgaaccaggagtgggccgccgtcctgctccacctggtgaagcaccgcgggtacctgtcccagcgcaagagcgagacccagaccgagaacaaggagctcggccggctgctggccggggtggccgagaactccaagctcctgagcgagtccagcgagcagtaccggaccccggcggagctggccgtcaagctgttcgccgagcagtccggccgcctgcgcaacaagggcggggactacacgcacaccttcaaccggctggacctccagaaggagctgcacctcctcttcgagcgccagtgcgccctgggcaaccccttcgccagcgcggagctgcagtccaaggtggacgagctcctgatgacccagcggagcgccctgcagggggaggccgtgctcaagatgctgggcaagtgcaccttcgagccctccgagtacaaggccgccaagaacacgtacagcgcggagcgcttcatctggctgaccaagctcaacaacctgcggatcctgtacaacggcgaggaccgcgccctcgacgagggggagcggaagcagctgctggacgagccctacaagaaggccaagctgacctacaagcaggtccgctccatcctcaacctgccggagagcgccgtgttcaagggcctgcggtacgggaaggactccgacggcctcaaggccgagaacggggcgctgatggagatgaaggcctaccacaagatccgcaccgtgctggagaaggccggcctcaagggcgagtgggagaaccggatccgcaaccccgagatcctggaccagatcgggacggccttcagcgtctacaagaccgacgaggacatcaaggcggagctggccgccctccggctgcccgagaacgtgctggacgccctcctggccggcctgaacttcgacaagttcatccagctcagcctgaaggcgctgtccaacatcctccccctgatggagcgcgggatccggtacgacgaggcctgcaaggaggtgtacggcgaccaccgcgccctggccgagagcaagaaccagatgctcctgccgcagatccccgccaacgagatccggaaccccgtcgtgctgcgcaccctcacccaggcgcggaaggtgatcaacgccatcatccgccgctacgggagcccccagcgggtccacatcgagacggcccgcgagctgggcaagagcttcaaggaccggaaggagatcgagaagcgccaggaggagaaccggaaggagcgcgagcgggccgccgagcacttcaaggagctgttcccgcgcttcaccggcgagcccaagtccggggacatcctcaagctgcggctgtaccagcagcagcagggcaagtgcctctacagcgggatccccatcgacctgggccgcctgaacgagaaggggtacgtggagatcgaccacgcgctccccttctcccggacctgggacgacagcttcaacaacaaggtgctggtcctgggctccgagaaccagaagaagcgcaaccagaccccgtacgagtacctcgacggcgcccgggacagccagcgctggcgggagttccaggcccgcgtgcaggggtgccggttcccctacgccaagaagcagcgcatccagacggcgaagctggactccaagaccgagcagggcttcctggagcggaacctcaacgacacccgctacatcgcccggttcctgtgcgggttcatcgagaagtccctgcacctccagggcgccggcaagcgccgcgtcttcgcctccaacgggcagatcaccgccctgctgcggggcctctgggggctgaagaaggtgcgcgaggacaacgaccggcaccacgcgctggacgccatcgtggtcgcctgcagcacggtgtccatgcagcagaagatcaccaaggccatgcagcgccgggagaccctcgagaccatcaacacggagaccggcgaggtgaagacccgcatcccccagccctgggacttcttccggcaggaggtcatgatccgcgtgttcagcgacgccccgcgggaggagctggcggagaagctgaactcccgccccgaggccctccacgacttcgtgagccccctgttcgtctcccgggcccccaaccgcaagatgaccgggcagggccacctggagacggtcaagagcgccaagcggctcagcgagaacatctccgtggtgaagaagccgctgaccgccctgaagctcaaggacatcgagaacatcgtgggctaccccgaccgcgagcccgcgctgtaccgggccctgcaggagcgcctccaggcctacaaggacgacccggccaaggcgttcgccgagcccttctacaagcccgccaaggacgggggccaggggagcctggtgaaggccgtccggatcatcgagaacaccaagcacggcctgaaggtgcgcaacgggatcaccgacacgaacggcgacatggtgcgggccgacgtctaccagaaggcggacaagaagggcaagcgccagtacttcatcgtgcccgtgtacgcctggcaggtcgagaagaacgagctcccgaccgtggactgcaaggggtacgagatcgacgacacctacgagttctgcttctccctgtacaagtacgacatcatcgagatccagaaccccgacaacatgagcaaggagctgcgcgtgtactacatcaactgcgactccagcgacggccggttctggctcgcccaccacgacaagtccgccaaggagcagcagttccgcatcagcacccagaaccagcccatcatcaagaagtaccaggtcgaccccctggggaaggagatccggctgtgcaaggccgagaagcgcaccgagctcaacggcaagaagaagaagtga

SEQ ID NO: 1521 - RNA, 3210 nt, synthetic construct
  misc_feature 1..3210: note = Cas9 variant
  source 1..3210: mol_type = other RNA
atgaactacgacatcggcctgcgcatcgggatcaccagctgcggctggtccatcatcaacaaggacctcgagcggatcgaggacctgggggtgcgcgtcttcgagaaggccgagaaccccgacggcaccgccagcgcggccccgcggcgcgaggcccggaagtcccgccggaagcaccgccggaagaagcaccgcatcgagcggatcaagcgcctgatcgtgcagcacgacctcctgagcaagaaggagctggactccctctacctgagccccttcaacatcgacgtgtggaacctgcgggtcgaggccctcgagcgcaagctggacaaccgggagttcgcccgcgtgctgatccacctcgtgcagcggcgcgggttccagacgatccggaagtccgtcgagatccaggaggagggcaagctgctggagaacgtgagcgagaacgagcgcatcatgaaggtgaacggctacaagaccgtcggggagatgttctccaagcacgagaagttcacccaccacaagcggaacaaggacggcagctacacctccgtggtgacgcgcagcctcctgctgaaggagatcaagaccatcttcaactcccagcgcatcctcgggaacgtcttcagcacccagaagctggagtccgactacctgtacatctggggcagccagcggcccaccctcacgtacgagcagctgatgtccatggtggggaactgcatctacgagaagaaggagaagcgcgcgcccaagaccagctgggccttccagtacttctccctgctccagaagatcaacaagctgaaggtgagcgacgacaacaccctgcggaagctcagcaaggaggagcgcgacatcgtcatcgagctggccttcaagaagaagaacgtgtccttcgtggacatccggaaggccctgaagctcaacgacaacaccaagttcaaccacctgacgtacagccacgtcgtggagaccaagaaggtggagaaggcgaccttcatcgagctgaagggctaccacctcatcaagaagcagctgaaggaccgcaacgtcgagctgacccaggagctccagccgaaggactacgacgccatcgccgccgcctccacgttcttcaagaacgacatcgagttccgggactacctgcgcaaccagtacctggacagcaacggcaagcggaagtccaacatcgcgaacaaggtgttcgaggacaaggtgatcgccgccgtcttcgagctcaacttcagcaaggtgtgccacctgtccttcaagagcctgtacaagctcatcccccacctggagaaggggctggactacaaggaggccatcctctgcgccggctacaacttccgcgacgagaacaagcgggacaagaagctgttcctgcccgtcatccagcaggagaccaaccccgtggtgcaccgcgcgctcacccaggcccggaaggtcatcaacgccatcatccgcgagtacgggtccccgaacaccatccggttcgtggtggccaacgacctggccaagacgtacaagcagcgcaaggagctggagagcaccctgaagaagaaccgggcggagaacgagaagatcaagaccaagctcctgtccatgggcatcatcaaccccaccggcatggacatcgtcaagtacaagctgtggtacgagcagagcgggatctgcctctacacgggccgccagatggagctgtccagcctgttcaagcccgggtactccatcgtgaaccacatcatcccctacaaccggagcttcgacgacacctaccacaaccgcgtgctcaccctgaccgagacgaagtacgagaagggcaacaagatcccgttcgagtacttcggggccgaggagacctgctggaacgagtacgagaagcgcgtctccaccagcaagaagatccacgacaagaagcgggagaagctgctcatccgcaacttcgacatcgagtacgagaacgagatgatctccaacaacgtgttcgacacccactacatcggcagctacttcgagaagtacatcgacgagcacctccagttcaagaagtccacgaagaagcagaaggtgttctccatccacggcaacatggtcgcccacctccacagccggtgggggttcaacaagaactcccgcgagatctacctgaaccacgccgtggacgccgcgatcgtggccgtcctgaccgaccagctgatccggaacatcgccgactactaccgccgggacaacatcctggagcagaagggcagcctgaagttccccgagccctggaagtccttcagcatcgagctggaggcccgcatcagcccccaggtgcgggacctcatcaagaagctgaacctggacagctacctcgacgtggacatcctgcacatcaagccggtcttcatctccaagaagccccgccggaaggtgaacggggaggcgcacaagagcaccatccgctccctgatcggcatcaacgagatcgggaagaccgtgacgtgcatcaagacccggctcgaggacatccccttcgacgagaacggcgacttccccatgtacggcaaggacaccgacaagtacacctacaccgccatcaaggagcgctacctggagttcaacaaggacaaggagaaggccttcagcacgccgctgtacaagctcaagcggaacggggagcccggcaaccagatcaagtccgtcaagatcatcgacacccgcaacatcgtgaacaaggtgaaccaggggaagggcatcgcctacaacagcaacatcatccgggtcgacgtgttctcccgcgaccagaagtactacgtggtccccatctacctgcgggacttcatcaaggggagcctgcccaacaagatcatcaccgccgcgaagggcttcatgcagtggccggagaccgacaactcctacacgttcctcttcagcatcttccccaacgacctgatcaaggtggtgcccaaggagggcaagttcatcaaggccaagaacgagaacaaggagaacatcaacctgaccgagatcctcgggtacttcaagggcctggacagctccaccggggccttcaccctggagagccacgacggctccctcctggcccgcggcatcgggacgaagaacctgctcctgatcgagaagtaccaggtcgacgtgctgggccggtacaacaaggtggggaacgaggagcgccaggacatcaagatccagcagaactga

SEQ ID NO: 1522 - RNA, 3210 nt, synthetic construct
  misc_feature 1..3210: note = Cas9 variant
  source 1..3210: mol_type = other RNA
atgaactacgacatcggcctgcgcatcgggatcaccagctgcggctggtccatcatcaacaaggacctcgagcggatcgaggacctgggggtgcgcgtcttcgagaaggccgagaaccccgacggcaccgccagcgcggccccgcggcgcgaggcccggaagtcccgccggaagcaccgccggaagaagcaccgcatcgagcggatcaagcgcctgatcgtgcagcacgacctcctgagcaagaaggagctggactccctctacctgagccccttcaacatcgacgtgtggaacctgcaggtcgaggccctcgagcggaagctggacaaccgcgagttcgcccgggtgctgatccacctcgtgcagcgccgggggttccagacgatccgcaagtccgtcgagatccaggaggagggcaagctgctggagaacgtgagcgagaacgagcggatcatgaaggtgaacggctacaagaccgtcggggagatgttctccaagcacgagaagttcacccaccacaagcgcaacaaggacggcagctacacctccgtggtgacgcggagcctcctgctgaaggagatcaagaccatcttcaactcccagcgcatcctcgggaacgtcttcagcacccagaagctggagtccgactacctgtacatctggggcagccagcgccccaccctcacgtacgagcagctgatgtccatggtggggaactgcatctacgagaagaaggagaagcgggcgcccaagaccagctgggccttccagtacttctccctgctccagaagatcaacaagctgaaggtgagcgacgacaacaccctgcgcaagctcagcaaggaggagcgggacatcgtcatcgagctggccttcaagaagaagaacgtgtccttcgtggacatccgcaaggccctgaagctcaacgacaacaccaagttcaaccacctgacgtacagccacgtcgtggagaccaagaaggtggagaaggcgaccttcatcgagctgaagggctaccacctcatcaagaagcagctgaaggaccggaacgtcgagctgacccaggagctccagccgaaggactacgacgccatcgccgccgcctccacgttcttcaagaacgacatcgagttccgcgactacctgcggaaccagtacctggacagcaacggcaagcgcaagtccaacatcgcgaacaaggtgttcgaggacaaggtgatcgccgccgtcttcgagctcaacttcagcaaggtgtgccacctgtccttcaagagcctgtacaagctcatcccccacctggagaaggggctggactacaaggaggccatcctctgcgccggctacaacttccgggacgagaacaagcgcgacaagaagctgttcctgcccgtcatccagcaggagaccaaccccgtggtgcaccgggcgctcacccaggcccgcaaggtcatcaacgccatcatccgggagtacgggtccccgaacaccatccgcttcgtggtggccaacgacctggccaagacgtacaagcagcggaaggagctggagagcaccctgaagaagaaccgcgcggagaacgagaagatcaagaccaagctcctgtccatgggcatcatcaaccccaccggcatggacatcgtcaagtacaagctgtggtacgagcagagcgggatctgcctctacacgggccggcagatggagctgtccagcctgttcaagcccgggtactccatcgtgaaccacatcatcccctacaaccgcagcttcgacgacacctaccacaaccgggtgctcaccctgaccgagacgaagtacgagaagggcaacaagatcccgttcgagtacttcggggccgaggagacctgctggaacgagtacgagaagcgcgtctccaccagcaagaagatccacgacaagaagcgcgagaagctgctcatccggaacttcgacatcgagtacgagaacgagatgatctccaacaacgtgttcgacacccactacatcggcagctacttcgagaagtacatcgacgagcacctccagttcaagaagtccacgaagaagcagaaggtgttctccatccacggcaacatggtcgcccacctccacagccgctgggggttcaacaagaactcccgggagatctacctgaaccacgccgtggacgccgcgatcgtggccgtcctgaccgaccagctgatccgcaacatcgccgactactaccggcgcgacaacatcctggagcagaagggcagcctgaagttccccgagccctggaagtccttcagcatcgagctggaggcccggatcagcccccaggtgcgcgacctcatcaagaagctgaacctggacagctacctcgacgtggacatcctgcacatcaagccggtcttcatctccaagaagccccggcgcaaggtgaacggggaggcgcacaagagcaccatccggtccctgatcggcatcaacgagatcgggaagaccgtgacgtgcatcaagacccgcctcgaggacatccccttcgacgagaacggcgacttccccatgtacggcaaggacaccgacaagtacacctacaccgccatcaaggagcggtacctggagttcaacaaggacaaggagaaggccttcagcacgccgctgtacaagctcaagcgcaacggggagcccggcaaccagatcaagtccgtcaagatcatcgacacccggaacatcgtgaacaaggtgaaccaggggaagggcatcgcctacaacagcaacatcatccgcgtcgacgtgttctcccgggaccagaagtactacgtggtccccatctacctgcgcgacttcatcaaggggagcctgcccaacaagatcatcaccgccgcgaagggcttcatgcagtggccggagaccgacaactcctacacgttcctcttcagcatcttccccaacgacctgatcaaggtggtgcccaaggagggcaagttcatcaaggccaagaacgagaacaaggagaacatcaacctgaccgagatcctcgggtacttcaagggcctggacagctccaccggggccttcaccctggagagccacgacggctccctcctggcccggggcatcgggacgaagaacctgctcctgatcgagaagtaccaggtcgacgtgctgggccgctacaacaaggtggggaacgaggagcggcaggacatcaagatccagcagaactga

SEQ ID NO: 1523 - RNA, 3213 nt, synthetic construct
  misc_feature 1..3213: note = Cas9 variant
  source 1..3213: mol_type = other RNA
atggccacccgcctgggcctcgacatcgggaccaacagcatcggctggtgcctgtacgacggggactccatccgggacatcggcgtgcgcatcttcctggacgggcgggagcccagcaagctcacggtctccggcagcggcaccccgctggccgtgaagcgccgggacgcgcgcggggcccggcgccggcgcgaccggtacatcggccgccggtccgccatgctgcgcgagctccggaagcacgggctgctgcccgccgaccccaagcaggccaaggtgctcgagacccaggacccctacgcgctgcgcgtccgggccctggacgagaagctcgagccgcaccagatcggccgcgccctgttccacctgaaccagcggcgcgggttcaagagcaaccggaaggccgagcgcgcgtccaaggccggcgaggacggcaagatcgccaccgccacgaagctcctggacgaggagatgcagcgcctgggggcccggaccctcggcgagttcctggtgaagcgcgacagcgagttcgacggggaggcgggcaagcgggtgcgcatgcgggccgactccaaggcctacgacttctaccccgaccgccggcacgtcctggacgagttccgcgccatctggaacgcccagaaggtgtggcaccccgagctcctgaccgagcaggcgtggaacgacatcttccgggtgatcgagtaccagcgcgagctgaagccccaggtcgtgggccactgcaccttcgccgggatcaacggcgtgccggccgacgagaagcggctccccaaggcccaccccctgttccagcagcgccggctgtacgaggaggtcaaccagctcaaggtggtggcccccggggaggcgggccgcccgctgacgcgggacgagcgcgacgccctgatcctcaagctgcaggacaagaagtccgtcagcttcgagaccctggggaagaccctcaagctgaaggacggcgagcggttcaacaaggagagcgagaaccgcaaggccctggacggcgacgaggtgcgggccgccctctccgggaagaagctgttcggcacccgctggttccacttcagcgcggaggagcagtggatgatcatcgagcgcctgctcgaggaggaggactccgagacgctgctgacctggctcaagatcgggtaccggctggacgacgaggccgccctggccgtggcgaacgccaagctccccgagggccacgggcgcttcggcctgagcgccaccaccgccctgctcaaggagctgaaggccgacgtctgcacgtacgcggaggccgccaagcgggccggcttccaccactccgacttccgcaccggggaggtgttcgaccagctgccctactacggcgagatcctggcccgggagatcgcgcccgggaagccggagtacggcgacgagaacgagcgccggttcgggaagatcaccaaccccaccgtgcacatcggcctcaaccagctgacgaagctggtcaacgccatcatccgcctccacggcaagcccgactacatcttcgtggagctggcccgggagctgaagctcaacgagaaggagaagatcgcctacaaccgccagctgaaggagaacaccgacgccgcgcgggaccgcggggccaagctgggcaccatgggggtgcgggacaccggccgcaaccggctcatcctgcgcctgtggacggagctcaaccccggcgacgccctgaaccggcgctgcccgttctgcggggagcagatcagccagcggatgatccagaacggcgaggtcgagatcgagcacatcatcccctactcccagtgcttcgacgacgggatcggcaacaaggtgctgagccacgtccgctgcaaccggcagaagggggaccagaccccctgggagcgctggggccacgaccccgaccgctggagcatcatccaggagcaggtcgcccacctccaccggtccaagcagtggcgcttcggcccggacgcgcgggaccgctacgccgccgaggaggacagcttcctgccccggcagctgatcgacacccagtacctcacccgcatcgccgccaagtacctggcgtgcctgtaccccgagcgcggggagcggcacgtgttcgccgtgcacggcgggatgacggccatgctccggcgcctgtgggacctgaactccatcctcctggaccacaactgggtggagaacctgaacagcaacgcccccaagaaccggctcgaccaccgccaccacgccatcgacgcggccgtggtcggcatcatgaccccggggctgatcgccgagatcgccaaggccgcggcccgggccgagaagcagaacctggaccgcctcttcgaggagctgcccatgccctgggcccagcacccgaacgaccggcgcttccgggacgagctgcgcgagaagatcctcgcggccaccgtgtcccacaaggccgaccacggccggcagggcaagcccgagcgcgggcgcgacatcaccgccggcaagctgcacaacgacacggcctacgggttcaccggcctgaccagcgacaccgggctccccgtggtcgtgcaccgggtgcccctgacgtccctgaccccgaaggacatcgcggaccccgaccgcatccccgacaccaccctccggggcagcctgtggcaggccacccgcgacctgtccggcaaggagttcgagaaggccctcctggacttcagccggacgcacgcccagttcaaggggatccgccgggtccgcgtgcgggagggcctgaccctcatccccatccgcaaccacgccgggaagccgtacaagggctacctgggggactccaacgcgcggtacaacgtgtggcagatgcccgacggccgctgggtccaccaggtgatcagcaccttcgacctgcaccagcccggcttcatcgagcagcggccccacccggccgccaagaaggtgctctccctgcgccagaacgacctgatcgccatcgagcgggacggggccctccgccagatcatgcgggtccagaagtacggccagaacgggcagatcttcctgatcgagcacaacgaggcgggcaacatggccgagcgcaacaagaacaccgacgaccccttcaagttctacggccccggggccagcgccctgcggaacatgaaggcccgccaggtgcggatcgacgagctcggccgcatcttcgaccccgggccgcgctga

SEQ ID NO: 1524 - RNA, 3213 nt, synthetic construct
  misc_feature 1..3213: note = Cas9 variant
  source 1..3213: mol_type = other RNA
atggccaaggacttcgagtacatcctgggcctcgacctgggggagaccagcatcggctggtccgtggtccgcctgaacgagggggtgcccgagcacctcgagcggctgggcgtgcgcatctgcagcgacgggcgggacgcccagtcccacgagccgctgagcgtcgcgcgccggatcgcccgcggcctccggcgccggcgcgaccggtacatccaccgccggatccgcctgaccgacgtgctggtgaagtacggcctcatgcccgaggacatcaaggagcggaagaagctgcaggccctgaacccctaccgcctccggtccgaggccctggaccgcaagctggagccctacgagctcgggcgggtcctgttccacatcaaccagcgccggggcttcaagagcaacatgaagacggaccgcaaggactccgagagcggggccatgaagcaggcgatcctgaagacccgcgccaagatggaggcctccggcgcccggaccctcggggagttcctgtacttcctgaacaaggacaagaccagcacgcaggagtacgtgccggtgcgcatgcggtcccacagcgagaagaacaagaccgtctacgagatgtaccccgaccgcgcgatgtacgaggacgaggtgcacaagatcttcgagcagcaggagctctcccccgaggcccagaccgagatcttcaacaccatcttcttccagcggcccctgaagccggtggagctgggcttctgcgagttcgaggacggcgagcgccgggcctacacggccagcgtcgtgttccagaagttccgcgccctccagcagatcaaccagatctacgtgcaggacgactacgagcggcgccccctgaccaaggaggagaaggacatcctgaagcacttcctcctggaggacttctccgcgctggacaagaacgggctcctgacctgggccaaggtccggaccctgctcaagctgcagaagaagaagttcaacctggagagcgagcgccggaagggcctcaacgccgacgtgacgtcctggaagctgagcaacgccgcctgcttcgggcgcgagtggttctccttcagcgacgcgaagaaggaggagatcgtggccctgatcaccggcgccgagaaggaggaggagctcatcgccgagctgaagaccaagtacggcctgagcgacgagcgggccaagaacaccgcgaacgtctccctccccgacggggtggccagcctgtccgccaaggccatgaagaagctgatccccttcctcgaggagggcatgctgtacgacgacgccgtgaagcaggcggggtacgtcttcagctccagcttcaagggcgtgctgccggagaagtacgagacgttcatcgagcccgagtccggggagtgcttcgacgagctcccctactacggccaggtgctgcgccggtacgtcctgggcggggtgcccagcgaggagaacaagctgttcccggagaagtactacggcaagatcaacaaccccaccgtccacatcgtgctcaaccagctgcgcaagctgatcaactccctcgtggccaagtacgggcacccccggaagatcgtcgtggagatggcccgcgacctgaagctgagcaagaagcagaaggacgccatcgcgaaggagcaggccctcaacgagcgcgagaacaagcggatcggcgccgagctggagcgcctggacatccggaacaactacgacaaccgcatgaagtacaagctctgggaggacctgtccaccgaccccaccaagcggagctgcccgttctgcgggaagcagatctcccagcaggacatcttcagccccgagttcgagatcgagcacctgatccccttctcccgcagcttcatggacggccggtccaacaaggtgctcagctgccgccggtgcaaccgcgagaagggcaacaagacgcccttcgaggccttcgggaacgactccacccggtggaacgccatcatgggccgcgtcgagagcctgccggagaacaagcggtggaagttcgcgagcgacgccatgtcccgcttcgagcgggacggggacctgctcgcccgcatgatgaccgacacccagtacatggcccggatcgcccgccggtacctgtgctgcgcggccaaccccaaccaggtgtacggcatccccgggcagctgacggccaagctccgcgagcactggggcctgaacagcatcctgtccgaccagaaggagaaggaccggagcgaccaccgccaccacgccatcgacgccttcgtggtcgcgtgcaccgaccgcggcaccctccagaagtactccaccgagcggcgcgactacgccaagcccgagatgccgagcgagaaggcgccccacatccccttcgccgacttccggctgtccgacatcaagcgcgtgttcgacgagatcatcgtgagccacaagccggaccgggggaacgcccgcgccgccatcctgaagggcgggacggtcgccaagctccacgaggagacctactacggcatgggcggggagggctccaagaaggggacctggaagctgatccagcggatccccgtgagcgagatcaagaaggcctccgacctggactgcctcatcgaccagaagggcaccgcgaaccccctgcgcgtgctgctcgtcggggccagcgagtccgagcaggagcagatcatcgccagctacttcgcccggcgcggcacgcacaaggtgcggacctaccgcgagcggaacaaggacgtgatcctgcccttcaaggacaaggacggcaagctgtaccgctacgccgtctacgggtccaacgcgtacgccgagatctactgcccggaccggggcaagaacgccgggaagtggcaggtcgagatcatccccaactactgcgcccaccagaagggcttcatccccaagtggcgccacaccgacgcccacgcgaagctcatcatgcggctgtaccgcaacgacatggtggcctacgagaaggaggggaagaccgtgatcgcccgggtgaagaagatgggcggcaacggggtgatcgtcttccgcaaccacctgatcgccaaggaggagggcgaccgcctcagctggcaggcggtggtgtccgggatgcagagcgccaacctgcggaagatctacgtcgacgtgctgggccgcgtgatcgaccccaagcggccgatgacgcagaacgagaccgacgggcaggacaactga

SEQ ID NO: 1525 - RNA, 3213 nt, synthetic construct
  misc_feature 1..3213: note = Cas9 variant
  source 1..3213: mol_type = other RNA
atgagccacttccgcctgaagcagctcaactacatcctgggcctggacctcgggatcgcctccgtgggctgggccgtcgtggagatcgacaccgaggagaaccccacccggctgatcgacgtgggggtccgcacgttcgagcgggcggaggtgccgaagaccggcgacagcctggccgccgcccgccggcaggcccgctccgcgcggcgcctcatccggcgccggacccaccgcctgctgcgggcccgccggctcctgaagcgcgaggggatcctgcacgccgacgacctcaacgccgagggcctggtgaaggagctgcccaacaccccctggcagctccgggtcgacggcctggaccgcaagctgatgcccaaggagtgggcggccgtgctcctgcacctggtgaagcaccgggggtacctcagccagcgcaagaacgagtccgagggcgccgacaaggagctggggcggctgctcgccggcgtccacgagaaccaccaggccctgcagagctccgagtaccgcacgccggcggagctggccgtgaagaagttccaggcccagagcgggcacatccgcaaccagcggggcgactacacccacaccttcgaccgcaaggacctccagcaggagctgcaccagctgttcgccgcccagcagaagtacggcaaccccttcgtgtccgacgggctcaagcagggcatcgagaccctgctgatgcagcagcggcccgcgctcagcggggacgccgtccagaagatgctgggccgctgcacgttcgagaccgaggagttcaaggccgccaagcacacctactccgccgagcggttcatctggctgaccaagctcaacaacctgcgcatccaggagaacggcaacgagcggtgcctgacggcgcaggagcgcgggcagatcatcgacctcccctacaagaaggccaagctgacctacgcccaggtgcggaaggagctgagcctcccggagaacgccttcttcaagggcctgcgctacgggaaggagaacgccgagaccgcggccctgatggagatgaaggcctaccacgccatccggaaggcgctcgagaaggccggcctgaagaccgagtggcaggggctggcctgcaagcccgagctcctggacgccatcggcacggtgttctccctgtacaagaccgacgaggacatcagcacccgcctgcagggccagctctccgaggacgtcatcaacgccctgctggcggggctcaacttcgacaagttcatccagctgagcctgaaggccctctccaagatcctgcccctgatggagcagggccagcggtacgacgaggcccacgccgccctctacgtgcgcagcacgccccagccgcagcggctgctgccccagatcaccgcggacgagatctgcaaccccgtggtcctccgcaccctgtcccaggcccggaaggtgatcaacgccatcgtgcgccggtacgggagccccgcccgcatccacatcgagaccggccgcgaggtcggcaagagcttcaaggaccggcaggagatccagaagcgccaggaggacaaccacaaggagcggaagcaggccgcggagaagttcctggagtacttcccgaacttcgtggggcagcccaaggccaaggacatcctcaagctgcgcctgtaccagcaccagcacggccagtgcctctactccgggaagaccctggacatctgccggctgaacgagaagggctacgccgagatcgaccacgccctccccttcagccgcacgtgggacgactccttcaacaacaaggtgctggtcctggcgggggagaaccagaacaagggcaaccagaccccctacgagtggctcgggggcgccagcaactccccgcggtggcaggagttcgtggcccgcgtcggcagctcccggttccaccacagcaagaagcagcgcatcctgctgcggcagctcgacgaggaggggttcaaggagcgcaacctgaacgacacccggtacgtggcccgcttcctgtgcaagttcatcgaggagaacatgctcctgctgggccgggggaagcgccgggtgttcgcctccaacggccagatcaccagcttcctccgctcccggtggggcctgcgcaaggtccgggaggagaacgaccgccaccacgcgctggacgccgtggtggtcgcctgcagcacggtggccatccagcagcgcatcacctacttcgtgcggcagcgcgagatgaacatcttcgacggggagctcatcgacaaggagacctccgaggtcagccggccctacttcccccagccctgggacttcttccgccaggaggtgatgatgcgggtgttcggcaagccggacggggacccctccttccccgaggccgacaccaaggagacgctgtgcaccctgctcgagacccgcctgagctcccggccccaggcggtccacgagtacgtgaccccgctgttcgtgagccgcgcccccacgcggaagatgtccggccaggggcacaaggagaccgtcaagagcgccaagctcctgcacgagggcaagagcgtgctgcgcgtgcccctcacccagctgaagccgaacctgctcgagaagatggtcaaccgggaccgcgagccccagctgtacgaggccctgaaggagcggctcgccgcgtacggcaacgaccccgccaaggccttcgccaccgagttccgcaagaagggcgggcagctggtgaaggcggtgcgggtcgaggacacccagaagtccggggtgctgctccacaagggcacgggggtggccgacaacgccaccatggtccgcgtggacgtgttcgagaagtccggcaagtactacctggtccccatctacagctggcaggtcgcccagggcatcctgccgaacaaggccgtgatccaggggaaggacgagaagaactgggacgagatggacgagacctacaccttcaagttcagcatgtaccccaacgacctcgtggagatcaacacgggcaagcagcggctgttcgggtactacatcggcctggaccgcgcgaccggggccatctccatccgggagcacgacctcgacaacttcaagggcaagaacggcatctaccgcgtgggggtgaagaccgccatcagcttcaagaagtaccagaccgacgagctgggcaaggtcgtggtgccctgccgccccaagaagcggctgccggtccgctga

SEQ ID NO: 1526 - RNA, 3216 nt, synthetic construct
  misc_feature 1..3216: note = Cas9 variant
  source 1..3216: mol_type = other RNA
atgcgcctgggcctcgacatcgggaccaacagcatcggctggtggctgtaccagaccgacgacgggacgatcaccgacgtgctggacggcggggtccggatcttctccgacggccgcgacccccagagcaaggagtccctcgccgtggaccggcgcgtggcccgggcgcagcgccggcgccgggaccgctacctgcggcgcaaggccgccctgatgaagcggatggccggcgccgggctcatgccgaccgaccaggcgcacgccaagaagctggagagcctggacccctacgccctccgcgccgagggcctggactgcgagctgcccctcacccacctggggcgggcgctgttccacctcaaccagcgccggggcttcaagtccaaccgcaagacggaccgcggggacaacgagagcggcaagatcaaggacgccaccgcccggctggactgggccatgcgggacgccaaggcgcgcacctacggcgagttcctgcacacccgccagcagaaggccgacgaccccaagcggatgccgacggtccgcacccggctcaccgtggcccgccgggacaacgccgagaaggaggaggccgggtacgacttctaccccgaccgccggcacctgtccgaggagttcgacgcgctgtgggccgcccaggccgactaccacgaggccctcagcgacgacctgcgcgaccagatcaagaccatcatcttccaccagcggcccctgaagacgcccgaggtgggcctctgcctgttcaccgacgagcgccggatcccgtccgcgcaccccctgaaccagcgccggatcctcctggagaccgtcaacgccctgcgcatcgtggcccgcggggaggccgcccggcggctcaccctggaggagcgcgaccagatcgtgcacgcgctggacaacaagaaccacacgaagaccctcagcggcatggccatgaagctgaaggccctgggcaaggtcatccggctccgctccgaccagaccttcaccctggagacggccaaccgcgacgcgatcgcctgcgacctggtgcgggccagcctctcccaccccgaccgcatgggcggggtgtggaccaccctggacgagggggcccagtgggaggtcgtgcagcggatccgcgccgtgcagagcgactccgagttcgacgcgctggtcgtgtggctcgagcagaaccacggcctggacaacgcccacgcccaggccaccgccaacgcgcccctgccggaggggtacggccggatgggcctcatggccacgcgccggatcctggccgccctgcagagcgacgtgatgccctactccgacgccgtcgcggcctgcgggtggagccactccggcgggcccaccggcgaggtgctcgagaagctgccctactacgggaagatcctggaccgccacgtgatcccgggcacctacgacgagaacaacgaggacgtcaagcggtacggccgcatcaccaaccccacggtgcacatcgggctgaaccagatccggcgcctcgtgaaccggatcatctgcatccacggcaagcccgacgagatcgtcgtggagctggcccgcgacctgaagaacagcgaggaccagaagcgggagatccagaagatcatcaagaagaacaccgacgccgcgatcaagcgcggggagaagctcatcaacgagctgggccagaaggacaccggggccaaccggctggtcctccgcctgtgggaggacctgggccacgacgtgatgacccggaactgcccctacagcggcaagcgcatctccgccgggatgctgttcgacggcagctgcgacgtggaccacatcctcccgtactcccggacgctggacgacgggatcgccaacaagaccctctgcctgaaggaggccaaccgccagaagtccaacaacaccccctgggaggtctggggcgagaccgagcagtgggacacgatcgcggccaacctgaagaacctccccgacaacaaggcctggcgcttcgccagcgacgccatgcagcggttcgagggcgagaacgacttcagcgcgcgcgccctgaaggacacccagtacctgtcccggatcgcccgcgcctacctcgacgccctgtacgacgggggcgacgggaacagccacgtgtgggtggtccccggccggctgaccgagatgctccgccggcactgggggctgaacggcctggaggcgctcaccgactccgacgagaacaccgtgaaggccaagaaccgcatggaccaccggcaccacgccatcgacgccgcggtggtcgccgccacggaccgcggcctgatccagcggatcagcaagatcgccaagcgcgacgagcaggccggggcggaggaggtggcccggtccgtgagcccgccctgggacggcttccgcgacgacatcgccgcccagctgtcccggatcatcgtcagccaccgcgccgaccacgggcggatcgactcccaggcgaagcagcagggcgaggacgccaccgccgggcagctccacatggacaccgcctacggcgtggtggacgccggccgcgtcgtgagccggaagcccctgctgtccctcagcgagtccgacatcaagaagatccgcgaccccgacctgcagcgccacctgacccgggtgacgaaggggctcgacaagaaggagttcgagcacgcgctgagcgacttcgccaacgcccgcaagctgccggaccagagcgagaacccctacttcggcatgcggcgcgtccggctcatcgacgccctgcaggactccgcccgcgtgagcgtgcgggaccgcgacgggcacatctacaaggcgtacaaggccggctccaaccactgctacgaggtctggcggctgcccgacgggaagatcaagccgtgggccatcagcaccttcgaggcccaccagaccggcaccgagtccaagccccaccccgcggccaagcgcctcctgcgggtgttcaagcgcgacatggtggccatcgagcgggacggcgagacgctgatgtgctacgtccagaagatggacatcgccaacggcctcttcctggtgccccacaccgaggggaacgccgacgcgcgcaaccgggacaaggacgacagcttcaagttcatccagatgtccgccgtgagcctgatccgcgccaagatccggcgcatccacgtcgacgagatggggcggctccgcgaccagggcccgccccggtga

SEQ ID NO: 1527 - RNA, 3216 nt, synthetic construct
  misc_feature 1..3216: note = Cas9 variant
  source 1..3216: mol_type = other RNA
atgcgctacaccatcggcctggacatcgggatcgccagcgtgggctgggccgtcatcaacgaggacaagtcccggatcgaggacctcggggtgcgcgtgttcaagaaggcggaggagcccgacggcaagagcctgaacctggcccggcgcgaggcccgggggtcccgccggcgcatccggcgccgggccacccgcatgcagaaggtcaaggagctcctggtgaagtacaacctggtgagcgagaaggagctcgagacgctgtacatcatcaccgagaccaccccggacgtctacgagctgcgggccaagggcctcgaccgcctgctgtcccggcaggagttcgcgcgcgtgctcacgaacatcgccaagcggcgcggctacaagagcaaccggaagatcgacgaggaggacaaggaggtggggaagctgtccaagggcaccatcgagaacaagcgcatcctgcaggagaaggggtaccggaccatcggcgagatgttctacaaggacgagaagttcgagtacaacaagcgcaacaaggccggggagtacaacagcaccgtcctccgctccatgctgatcgacgaggtgcacacgctgttcgagatgcagcggaagttcaagagcgagttcgccaacgaggagttcgagaaggagtacgtggaggtcatgacctaccagaagccctacatcacccccgagctcctggagaagatgctgggcaagtgcaccttcgagaagggcgagccccgcgcgccgaagaactcctacacgttcgagcggttcatgctcctgcagaaggtgaacaacctgaacatctacatcaacggggagaaggtggagatcccccaggagaagaagaaggagatcatcgagctcgcctacaagcagagcgagatcaagtacacccagctgcgcaagaagctggagctccccatcgaggcccggttcgccgacctgaactaccagatcaagcgcaccgaggacgagtccgaggaggccctggtcaagaagatcgaggacaagaagttcgtgaagctcgagggctggcacaagatccggctggcgctgaaggagaacaaggacaagttcgagaagatcgagaagaaccccgagctccagaacatcatcgccgacgccctggtgcgcaacaagaccgacgagacgatcaagaactacctggagaagtccgacatcgacgaggagatcatcaacgccatcctcaacatcaacttcaccaagttcgggcacctgagctacaaggccatgaacaagatcatcccggagctggagaagggcctcacctacgacaaggcgtgcgagaacgtcggctacgagttcaaggggcggaagaacgagctgcagtacaagctgccgcccgtgaccgagctcgaggacgagatcctgaacagcgtggtcctgcgcgccgtgtcccagacgcggaaggtgatcaacgccatcatcgacaagtacggcagccccaccgccatctacatcgagaccgcccgcgagctctccaagccctacgacgagcggatgaagatcgagaagcgccagaaggagaacgcggccaacaacgaccagatcaaggagtacatcaaggagaccttcgggttcgaccccaagcccttcgacatcgtcaagatgaagctgtggcgggagcagaacggcaagtgcgcctacagcagcaagcccatcccggccgagcgcctgtacgaggagaacttcgtgcaggtcgaccacatcatccccttctcccggtgcttcgacgacagctaccagaacaaggtgctcgtgctgacggacgagaaccagaagaagaaggagcgcacccccttcgagtacttcggggaggacaaggagcggtggcaccagttcgaggagttcgtcaacctgacctacaagttcaacacccgcaagaaggagaacctgctcatcaagaacttcaacgaggagaagtccaaggagtggatccagcgcaacatcaacgacacgaagtacatcagcaagttcatgtacaactacatcgccaacaacctgaagttcgcggactccgagagcaagcggaaggtgtacaacatcaacggccaggccacctccatcctgcgccactactggggcctcaagaaggaccgggaggagagcgacaagcaccacgcccaggacgccgtgatcatcgcgtgcgccaccaacaagaacatcaagaaggtctccgactacagccgccggaagctgctgtacaagaacaacgagatcatcgacgaggagaccggggagatcatcgacaagaagtacaacatcgacatctccatcaaggagccctggccgaagttccgcgaggaggtggaggcccggatggaggacgccgacaacaacggccagctctacgccctgatcaacgggaacttcacgaactacgacgacgtggacatcacccacatcaagcccatcttcaccagccgcatgcccgagcggaagatcaccggccgcgcgcacaaggacacgatgcggtcccagaagttcatccagcaggggcagaacttcaccgtcgtgaagaagcccctgaaggccatcagcaagcaggagatcgagggcatcatcaacaacccggacttcaagaacctctacctgtccgacaagaagctgtacgacgacatctaccagaagatgaaggaggccgacttcaaggccgagaaggccttcgcgaacgagtaccgcaagtacagcaagaacggcaactcccccatcgtgcggagcatcaaggtcgcctccgccggggccaccggcgtgcagctcaagaacggggccatcgcggagaacgccaacatggtgcgcgtcgacgtgttcgagaaggacaacaagaactacctggtgcccatctacgtcagcgacttcgccaagaacgagctgcccaacaaggccatctgcgcgaacaaggacgagaaggagtggatcgagatgaccgagaagtacaagttcaagttcagcctctacccgaacgacctggtgaagatcaagcggaagaacgagaaggagttctacgcctactactgctccacccaccgcggcacggggaacatcaacctgctcctggtgaacggcgaggcccggaaggacggcgtcgggatcaagaacaccgagatcttcgagaagtaccaggtggacgtgctgggcaacatcagcaaggtcaacaaggagaagcgcgagggggtgaagtga

SEQ ID NO: 1528 - RNA, 3216 nt, synthetic construct
  misc_feature 1..3216: note = Cas9 variant
  source 1..3216: mol_type = other RNA
atggactaccgcatcggcctggacatcgggaccaacagcatcggctggtccatcatcgagctcaccacggtgcagagcaagctggacgggaagtaccggctgaaggccgtcggcctcatcgacgccggggtgcgcatgttcgaccgggcggaggtgcccaagaccggcgcctccctggccctgccgcgccggctcgcccgcagctcccggcgccggctgacccgccggagcgcccgcaagaaggcgatccggaacctgctcgtcaaggaggacatcctgaaccagatcgagctggaccacctctaccgcacctccgagctggtggacatctggcagatccgggtggagggcctggagcgccggctcgggcgccaggagtgggcccggctgctgatccacctcggccagaagcgcgggtaccggagcacgcgcaaggccgaggagggcgccgacaccgaggggcgcgcggtcctgtccagcatcaaggagaaccaggagaccctgaagcagtaccggaccgtgggcgagatgtgggccacggacgacaagttcaagggccgcgtgcggaactccaccaacgagttcatcttcaacgtcagccgcgacaacctcgaggaggagatccggttcctgttccagcagcagcgcgagctggggtccatgtacgccagcaagctcctggaggagtcctacatggaggtgtggggccaccagctgcccttcgccagcggggagtccatcctcaagaacgtggggacctgcagcctgtacgagaaggagaagcgggccgcgaaggccacctacacgttccagtacttcatggccctggacaagctcaacaacgtccgcatcctgccctccatgcggaccctgagcgaggaggagcgcggcctcgccctgaaggccatgttcgagcgggacaagctgcccaagaacccgcccaagttcacctacagccacctccgcaaggcgatcaagctggaggaggacgagaccttccagacgatctcctacgacgtggagaagaccctggccaccaacgagagcgccgtgttcgtcaacctcgccgcctactaccagatcaagaaggtgtgcgacgagcacaacgagaactacgactacgtggactacaacaccatcgggcacgcgctgacggtctacaagaccgacgaggacatcaacaagtacctggcctccaagaacaacatcgccaagcgggtgtacgccaacgacttcatcgacagcgtgctcaagcactcctacaccaccttcggccacctgagcctgaaggccctctcccgcatcatccccctgatggaggagggggaggtcttcgcgaaggccaaggagaaggccggcttcaaggaggagagctacctggagatcaagtccaagctcctgacgaacatccccgacgccatcaagaacccggtggtgatgcggagcctgacccaggcgcgcaaggtcatcaacgccatcatcaagcggatgggggagcagcccgcctccatccagatcgagctggcccgcgagctcagcaaggacgtgtccgagcggaagaagatcaccaacggcttcgccgagaaccgcagccgcaaccagttcgcgatcaagaccctggaggagaaccacatcacgaacatccggggccaggacatcgtcaagttcaagctgtggcaggagcagggcggccgctgcgcctactccctcaagcccatcaagctggaggagctgatcagcttcctcaagaaggagcggcgctacgagcacaacctggacgtggaccacatcatcccctactccaagaccttcgacgacagctacaccaacaaggtgctggtcttctccgacgagaaccggaagaagggggaccagatcccggccgagtacctcggcatcgggaccaagcgctgggagaagtacaaggagttcgtgatcacgagcaagttccccgccagcaagaagaagcggctgctgaaggagcagctcgtggagcgcgaggagctgttcatgaaggagcggcacctgaacgacacccgctacgcctcccggtacttcatgaacttcctccgcgagaacctgctgcggaaggagaccgtcctccacgagacccagtgggtgacggcggtggccggccgcgtcaccagccacatccggaagcgcctgggcttcgggaaggaccgggaggagacccacctccaccacgccctggacgccatcatcgtggcctgcaccgacaagtggatgatcgactgcgtgaccaactactacaagtcccgcgagggcgggagcatcaagcggaaggagatccgcttcccctccccctggaacggcttctggcacgacgtccagacgaagctggcgcagctgccgcagcccgaggtgatcaacgagagcatctccaaggggaaccccgacgccgtggactacatgctcgtcagccggatgccccgcaagtccatcaccggcgccgcccacaaggagaccatcagcaagtggggcgggtacgacgacaagggcaaggcgctgctggtgaagaaggtggccctctccgagctgaagttcaagaacgacgacttcccgatgtacaacaaggagaccgaccccctgctctacgaggccatcaagaaccgctacgtcgagagcgggcgggacgtgaagcgcgccttcgccacgcccctgtacaagccctccaagagcggcaagcggaacgaggtgaagcgcgtcaaggtgatcgcggagaagaaggccatggtgcgggaggtcaacggcgggatcgccgagaacggcgggctggtgcgctccgacatcttcctcaaggagaagaagtacgtgatggtcccggtgtacaccttcgacaccatcaagcagcagctgcccaacaagtacgtggtcagcggccgggggtacgagcagtggcccgagctgaccgccgagcacgtgttccagttctccgtgtacccctacgagctcgtccacgtgggcacgaacaagggcgacaacagcttctactacttcgccagcctgaacatctccagcaacgtgctgaagttctccgagtgcaaccgcccgaccaaggactacatcgagatcgggctcaacagcatcatcctgctggagaagtacgagatcgacgtcctcggccggatcaccgggcagtccaagaagggcatccgccagagcttcaagaacaacaagtcccagatgaaggagtga

SEQ ID NO: 1529 - RNA, 3219 nt, synthetic construct
  misc_feature 1..3219: note = Cas9 variant
  source 1..3219: mol_type = other RNA
atgcgcctgggcctcgacatcgggaccaacagcgtgggctggtggctgtacaagaccgacggggaggccgcctccgcgcggatcgtcgaggtgatcgacggcggggtgcgcatcttcagcgacggccgggaccccaagtccaagacgagcctggccgtcgaccgccgggtggcccgcgccgcccggcgccggcgcgaccggtacctccgccggcgcgcgtccctgatgaagctgctcgcccggaccggcctgatgccggccgaccccgtggaggccaagaagctggagcgcctcgacccctacgagctgcggagcaccgggctggacgacgcgctccccctgacccacttcggccgcgccctgttccacctcaaccagcggcgcgggttcaagtccaaccggaagacggaccgcggcgacaacgagaacgggaagatccgcgaggccaccgcccggctggacctggagatgatgaccagcggcgcccgctcctacggcgagttcctccacatgcggcgccagcgggcgagcgacccgcgccacgtcccctccgtgcggacccgcctgagcgtggccgcccgcgggggccccgacgccaaggccgaggcggggtacgacttctaccccgaccggcaccacctggaggaggagttccacgccctctgggccgcccaggccacgcaccaccaggcgctgaccgacgacctgcgggacctcgtcttcgagaagatcttctaccagcgcccgctgaaggagcccaagatcggcctgtgcctcttcaccgccgaggagcggatcgccaaggcccaccccctgacccagcgccgggtgctgttcgagacgatcaaccagctccgcgtgaccgccgacggccggtccacccgccccctgaccctggaggagcgggacacgctcgtccacgcgctggacaacaagaagccgaccaagagcatgacctccatgaacatgaccctgaaggccctcgccaagctgctgaagctccgcgacggggagcgcttcacgctggagaccggcgtgcgggagaacatcagctgcgaccccgtgcgcgcctgcatggcgcaccccgcccggttcgggccccagtggtccagcctggactgggaggcccagtgggacgtcatctcccgcgtgcgccaggtgcagagcgagggcgagttcatcgagctcaccgactggctgatccaggggcacggcctggacgccgaccacgccaaggcggtcggcaacgccccgctccccgaggggtacgcccggctgggcttcagcgccaccgagcggatcctggaccagctcaaggccgaggtgtgcacgtactccgacgcggtggccaagtgcgggtggcaccacagcgaccagcgcaccggcgcctgcctggaggtcctgccctactacggggaggtgctggaccggcacgtgatccccggcacctacgacgccaccgacgacgagatcacgcgctacggccggatcaccaacccgaccgtccacatcgggctcaaccagctgcgccggctggtgaacaagatcatcgaggtccacggcaagcccgaccagatcgtggtggagctcgcccgcgagctgaagcagtccgagccccagaagaaggacgcgatgaagcggctgcgcaacaccacggccgacgccatccggcgcagcgagcagctcgagcagctggggcagcccaacaccggccacaaccggatgctgctccgcctgtgggaggacctggggccggccatcggcccccggtgctgcccctacaccggcaagaccatctccgtcacgatggtgttcgacgggagctgcgacgtggaccacatcctccccttctcccgcaccctggacgacagcttcgcgaaccgcaccctgtgcctcaaggaggccaaccgggagaagtccgaccgcaccccgtgggaggcctggggcgggaccgaccagtgggacgacatcgccgccaacctgaagaacctgcccgagaagaagcggaagcgcttcggccccgacgcgatggagtggttcgagggcgagaacgacttcctcgaccgggccctggtcgacacgcagtacctggccaagatcagccgcatgtacctcgacaccctgttcaccaagggcgggcacgtgtgggtggtcccggggcggatgaccgagatgctgcgccggcactggggcctcaacgccctgctgaacgacaaggaccgcggggccgtgaaggcgaagaaccggacggaccaccgccaccacgccatcgacgccgccgtggtcgccgcgaccgactaccggctcatgcagaagatctcccgcgccgccggccagggcgagaacgccgggcagagcgcggagctgatcgcccgggacaccgacgccccctgggagcacttccgcgccgacatcgcctcccagctggagaagatcatcgtgagccaccgggcggaccacggccgcatcgacgtggaggggcggaagaccggccgcgactccacggccgggcgcctccacaacgacaccgcctacggcgtcatcgacgacctgaccgtggccagccggacgcccctgatgtccctcaagcccagcgacatcgccatcaccgagcgcggcaagaacatccgggacccgcagctgcagaacgcgctgtacgtggccaccaaggggaaggagggcaagatgttcgagcaggccctcgtcgacttcgcctccaaggaggggccctaccagggcatccgccgggtgcgcctggtggagaccctgcagaaggccgcgcgggtcgagatcgggaagaccgagagcggccagcccctcaaggcctacaagggcgacagcaaccactgctacgagctgtggaagctgcccgacgggaagatcgtgccccaggtggtcacgacctacgaggcccacgccggctccgcgccccgcccccaccccgccgccaagcggatcctccgcgtgttcaagaaggacatggtgaagctgaccaaggacggggaggagatcgtcggctacgtgcagagcatgcacatcaagaacgggctgttcgtggcccagcacctcgaggccaacgcggacgcccggaaccgcgacaagaccgacccgttcaagttcctgcagatgggcgccggcacgctggtcaagaccgggctccggcgcgtgctggtggacgagatcggccggctgcgcgaccccgggccgcccaagctctga

SEQ ID NO: 1530 - RNA, 3225 nt, synthetic construct
  misc_feature 1..3225: note = Cas9 variant
  source 1..3225: mol_type = other RNA
atgcagaccaagaacctgccctacaccctcggcctggacatcgggatggccagcgtgggcgccgcgctgctcctgccggaccaggagcgcatcctggccctccacgtccggacgttcgacaaggccgagaccgccaaggagggggagtccctgaacaagatccgccgggacagccgcctgacccggcgccggatccgccggcgcgcccaccggctcgtgcgcctggcgcggctgatgaagcgcgtgggcctcatcgccgacgccaaccccgaggccttcgcgctgcccggggtctccccctggcacctccgggccgacggcctcgaccgcctgctggagccgaaggagtgggccggcgtgctctaccacctggtgaagcaccgggggttccagagcaaccgcaagtccgaggccaaggccgacgagaaggcgggccagatgctgagcggggtcggccggaaccaggccctcctgaaggaggccgggtaccgcaccgtgggcgagctggccgcccggcacgaggacttcaaggaggcgaagcgcaacaagggcgggtcctacagccacacgttcgcccgcgccgacctcaacgccgagctgaacctgctgttcgagcggcagcgcgccctgggctcccggctggcgagcgccgacttccaggagaacgtgcgcgacctcctgatggcccggcgccccaccctgtccggggccaacctcctgaagatggtcggcaagtgcaccttcgagaagtccgaggaccgggcccccaaggcgggctaccgcgccgagcggttcgtgtggctggggaagctcaacaacctgaagatcgtgggcagcggggacgcccgccccctgaccgacgccgagcaccggatcgtcatcgacctcccgttcacgcaggcgaagctgaccttcaagcaggtccgcaaggccctggagctcgagacccaccagcggttcaacctgctgagctaccgccccgaccccaagggcaaggacaaggaccccgaggagtccaccttcttcgaggccaagagcttccacacgctccggaaggcctacgagggggccggcctgaagaaggagtggcagcgcgacgcgctggacccggaccggctcgacgccctggcctacgccctgacctgctacaaggacgacaccgagtcccgccagtggctggtggcccagggcatcgggacccccatcatcgaggcggtgctcgccgagagcttcgacaagttcatccacctgtcccagaaggccctgaaggccatcctcccccacatggaggccggccagcggtacgacgacgcggccaagagcgccgggtacgaccacagccagcccgacgccggcacggggaagcgcgcgaccctgccgccgcccgacaaggacaccatccgcaaccccgtggtgtaccgggccctgaaccaggcccgcaagctcgtcaacgccatcgtggccgagtacggcccgcccgcggccgtgcacatcgagctggcccgggacctgtccaagcccatcgacgagcgccgggacatcgagaagggccagaaggagttccaggccctcaaggagaagctggccgcggccttcgaggagaccttccaccgcaagcccagcgggctggacctcctgaagtaccggctgttccgcgagcagctcgaccagtgcccgtactgccagaaggccctggtcgtggaccggctgttcgagcccggctacgcccagatcgaccacgccctcccctactcccgcagcttcgacgacgggatgaacaacaaggtggtcgtgcacgtcgcgtgcaaccaggacaagggcaaccggacgccctacgagttcctggacggggccggcgactccgagcgctggcagcggttcgtggcctgggtgcagggcaacaaggccatccgccaggcgaagcggaaccgcctgctccgggtcaacttcgggaccgacgaggccaaggagttcagcaagcgcaacctgtccgacacccggtacatctgccgcgagttcaagcggaccatcgagacgcagttcgcctggcacagcgacgccgagggcaacgagcgctgcgtggtgctgtccgggcagctcaccagcctgctgcgcgcccggtggggcctcatcaaggtccgcgaggacggcgacctgcaccacgcgctggacgtggccgtgatcgccgccgcctcccggagcctcgtcaagcgcatggcggactactcccggcgcaacgagctggagatggtgcggaaccgctacgtggacccggccaccggggaggtcgtggacgtggccgccctgcggcagatcgaggaccacttccccaagccctggcccctcttccgcgaggagctgctggcccggctcgcgcccgagcccaagctgcagctgacctgcgtcagctcctacgacgagggcctccgcgagagcatccggcccatccgcgtgtcccgggccccgacgcgccgggggctgggcgccgcccaccaggagaccatccgcagcctgcgggacgggtcccagagcgccatcaagacgcccctccgcgacctgaacctgaaggacctcgagaacatcgtgggcttcgagcgcgacaccgcgctgatcgacgccatccggacccgcctggaggccttcggcggggagggcaagaaggccttcgacgacaagcagccgcccctccggaagcccagcaaggaccccgacaaggcgcccatcatccgctccgtcaagctgctggtgacccagaagtccgggatccccatccggggcgggatcgccaacaacggcgccatgctccgcagcgacatcttcaccaaggccggcaagttctacgccgtgccgatctacgtcgcggacgccgtgcgcggggagctgccccaccgggccgtggcccaggccaagcccgagctggagtggcccatgatggacgagagctaccagttcctcttctccctgcacccgaacgactggatgaccatccggctgaagaacgaggtccgcgagggctactacgcggggctcgaccgggccacgggcaacatcagcctgtggctgcacgaccgcaaccagaacgtggggcagaagggcctcctgaccggcaacgggatcaagaccgccctggccgtggagaagtaccacgtcgacctcctgggcaagctgcaccgggtgcacaaggaggagcgccagcccatccacatcaagcccgggaagcggtga

SEQ ID NO: 1531 - RNA, 3234 nt, synthetic construct
  misc_feature 1..3234: note = Cas9 variant
  source 1..3234: mol_type = other RNA
atgaagtacagcatcggcctggacatcgggatcgcctccgtgggctgggccgtcatcaacgaggacatcgagcgcatcgaggacctcggggtgcggatcttcgacgtggcggagcagcccaagaccggcgccagcctgtccaccccgcgccggctggcccgcagcacgcggaagcgcctccggcgccggcgccaccgggtcgagcgcgtgcggaagttcatgatccagaaggggctgctgacccaggtgcagatggagcagctctacgactggaaggacggcgacctggacatctggctggtccgcgtgaacgccctcgagcggaagctgtccgaccgcgagttcgcccggatcctggtgcacttcgcgaagaaccgcggcttccagagcaaccggaagtccgagctccaggaggaggacaacggggccgtcctgagcgccgtgcaggagaacaagcgcctgatggaggagaagggctaccagaccatctccgagatgctcctgtacgacgagaagttcgaggggaccaagcggaacaagggcggggagtacacgcacgtggtcgcccgcagcgacctgaagcgcgagatccagctcatcttcgagaagcagcgggcgtacggccacgccttcgccaccatggagaacgaggacaagttcctgcagatctggtccagccagcgccccttcgccaccaaggacgacatcgccaagaagatcggcaactgcaccttcgagcccaaggagaagcgggcgcccaagtccacgtacaccttcgagcgcttccgggccctggacaagctcaaccgcctgcggatcctgagcgggacctccccggcccgcagcctcacccaggaggagcgggacctgatcctgaactccctcttcagcaagaaggaggtgaagtacaaggagctgcgcaagctgctcaagctgaacgacgagcagcggttcaacgagatcttctacgaccccaacgagaagatcgagaagaacgagaaccgcacgttcctgtccctcgagagccagtacaagatccggaagatcctgcagaagatcgagggcaagagcctgaacgacacctaccgccccgtggacctcgacaccatcgcctacgccctgaccgtcttcaaggacgaccaggacatccgggactacctgcagaaccagtacgtggcgtccaacgggaagaaggagctcaacctggccaaccgcaagtacaacgacgagctgatcgaggagctcctgcacctgagcttcacgaagttcggccacctctccctgaaggccctgcggaacatcctccccttcatggagcagggcatcccgtaccaccaggcctgcgagaaggccgggtaccagttcaacaagaaggtgaaccgcgagaagcagaagctgctgccgcccgtccccgcgaaggacatcgtgaaccccgtggtcatccggagcctgtcccaggtgcgcaaggtgatcaacggcatcatcaagcgctacgggagcccctccagcatctacatcgagctcgcccgggagatgggccgcgggtacaaggagcggaaggacctggagaagcagtacaacaagaaccgccagatgaacgagggcgccaagaagcacatcctggagctccggcccgagttcggcgacccccgcgggcacgacatcctgaagtacaagctgtggcaggagcaggactgccggtgcgcctactccttcaagagcatcccgatcaagcagctgttcgagatcggctacgccgaggtcgaccacatcatcccctactcccgcagcttcgacgactccaacaacaacaaggtgctcgtcctggcggccgagaaccagaacaagcagaaccggaccccctacgagtggttcgggcacgacgagaccaagtggcaggagttcaccagcctcgtgacgaccatgaaggtgtccaagaagaagaagtccctgctgctcaagaagaacttcgacgaggagcaggccgaggagttccgcagccggcacctgaacgacacccgctacatcacccggtacatcaagacgttcatcgaggacaacctgcagttccgcatcgaggagggcaagaagacctacgtccacaccgtgaacggggcctacaccagcctcatgcggaagcgctggggcttcaacaagaaccggcaggagaacgcgctgcaccacgccctggacgccgtgatcgtcgccgtgtccctccccttcaagcacaaggtgcgcgcctacttcaagcggcgcgaggagtacgcgcacaaccagctgaagcgggagggcgagttcttcccggagccctggcccgggttcatccacgagctggagatccgcatgatgcaggacagcgagaacatcaagctcgccatggagagcctgaacctgaagacgtacgacgagtccttcatcaaggagctcaagcccatcttcgtcagccgcatgccgaagcgggccatgaagggccagatccacgaggagaccctgaagcgcgtgcgggggcgcaccgacgacggctacatccggaccgtgaagaaggtcaagctggaccagatccccttcgacaagaacggggacttccccatgttcggcaaggagacggacatgaagacctacgaggccatcaagtcccgctacctcgagagcggcaaggacaagaagaaggccttcaacacgcccctgtacaagccggcgaagaaccccgagaacgcccccatcatccggtccatcaagatcgaggagaaggccaaccgcgtggtgatgctggacgagaagaccgccgccgacaacgcgagcatcgtccggaccgaggtgttccgccacaaggagaccgggaactacttcctcaccccggtgtacgtcgccgacgtgctggccaagaaggtgcccgaccggctgatcaccaccaagaagccctactccgagtggcgcaagatcacggacgagtacgagttcctcttcagcctgtaccccaacgacctgatccgggtcaagatgccgaaggagaaggagaccaagacccacaccggcgagaagcacgtgtggcaggagaacttcatgtacttcaagggggtgcactccggcagcgccggcgtccgcatgatcgaccacatgaactccttcgaggacgagatcggggtgcggaagctcgtggtcttcgagaagtaccaggtggaccccctgggccgcatgaacaaggtgcacggggagaagcggcacggcatctga

SEQ ID NO: 1532 - RNA, 3234 nt, synthetic construct
  misc_feature 1..3234: note = Cas9 variant
  source 1..3234: mol_type = other RNA
atgaagtacagcatcggcctggacatcgggatcgcctccgtgggctgggccgtcatcaacgaggacatcgagcgcatcgaggacctcggggtgcggatcttcgacgtggcggagcagcccaagaccggcgccagcctgtccaccccgcgccggctggcccgcagcacgcggaagcgcctccggcgccggcgccaccgggtcgagcgcgtgcggaagttcatgatccagaaggggctgctgacccaggtgcagatggagcagctctacgactggaaggacggcgacctggacatctggctggtccgcgtgaacgccctcgagcggaagctgtccgaccgcgagttcgcccggatcctggtgcacttcgcgaagaaccgcggcttccagagcaaccggaagtccgagctccaggaggaggacaacggggccgtcctgagcgccgtgcaggagaacaagcgcctgatggaggagaagggctaccagaccatctccgagatgctcctgtacgacgagaagttcgaggggaccaagcggaacaagggcggggagtacacgcacgtggtcgcccgcagcgacctgaagcgcgagatccagctcatcttcgagaagcagcgggcgtacggccacgccttcgccaccatggagaacgaggacaagttcctgcagatctggtccagccagcgccccttcgccaccaaggacgacatcgccaagaagatcggcaactgcaccttcgagcccaaggagaagcgggcgcccaagtccacgtacaccttcgagcgcttccgggccctggacaagctcaaccgcctgcggatcctgagcgggacctccccggcccgcagcctcacccaggaggagcgggacctgatcctgaactccctcttcagcaagaaggaggtgaagtacaaggagctgcgcaagctgctcaagctgaacgacgagcagcggttcaacgagatcttctacgaccccaacgagaagatcgagaagaacgagaaccgcacgttcctgtccctcgagagccagtacaagatccggaagatcctgcagaagatcgagggcaagagcctgaacgacacctaccgccccgtggacctcgacaccatcgcctacgccctgaccgtcttcaaggacgaccaggacatccgggactacctgcagaaccagtacgtggcgtccaacgggaagaaggagctcaacctggccaaccgcaagtacaacgacgagctgatcgaggagctcctgcacctgagcttcacgaagttcggccacctctccctgaaggccctgcggaacatcctccccttcatggagcagggcatcccgtaccaccaggcctgcgagaaggccgggtaccagttcaacaagaaggtgaaccgcgagaagcagaagctgctgccgcccgtccccgcgaaggacatcgtgaaccccgtggtcatccggagcctgtcccaggtgcgcaaggtgatcaacggcatcatcaagcgctacgggagcccctccagcatctacatcgagctcgcccgggagatgggccgcgggtacaaggagcggaaggacctggagaagcagtacaacaagaaccgccagatgaacgagggcgccaagaagcacatcctggagctccggcccgagttcggcgacccccgcgggcacgacatcctgaagtacaagctgtggcaggagcaggactgccggtgcgcctactccttcaagagcatcccgatcaagcagctgttcgagatcggctacgccgaggtcgaccacatcatcccctactcccgcagcttcgacgactccaacaacaacaaggtgctcgtcctggcggccgagaaccagaacaagcagaaccggaccccctacgagtggttcgggcacgacgagaccaagtggcaggagttcaccagcctcgtgacgaccatgaaggtgtccaagaagaagaagtccctgctgctcaagaagaacttcgacgaggagcaggccgaggagttccgcagccggcacctgaacgacacccgctacatcacccggtacatcaagacgttcatcgaggacaacctgcagttccgcatggaggagggcaagaagcagtacgtccacaccgtgaacggggcctacaccagcctcatgcggaagcgctggggcttcaacaagaaccggcaggagaacgacctgcaccacgcgctggacgccgtgatcgtcgccgtgtccctccccttcaagcacaaggtgagcgcctacttcaagcgccgggaggagtacgcccacaaccagctgaagcgcgagggcgagttcttcccggagccctggcccgggttcatccacgagctggagatccggatgatgcaggacagcgagaacatcaagctcgcgatggagtccctgaacctgaagacctacgacgagagcttcatcaaggagctcaagcccatcttcgtctcccgcatgccgaagcgcgccatgcggggccagatccacgaggagacgctgaagcgcgtgcgggggcgcaccgacgacggctacatccggaccgtgaagaaggtcaagctggaccagatccccttcgacaagaacggggacttccccatgttcggcaaggagaccgacatgaagacgtacgaggccatcaagagccgctacctcgagtccggcaaggacaagaagaaggccttcaacacgcccctgtacaagccggccaagaaccccgagaacgcgcccatcatccggagcatcaagatcgaggagaaggccaaccgcgtggtgatgctggacgagaagaccgccgccgacaacgcctccatcgtccggaccgaggtgttccgccacaaggagaccgggaactacttcctcaccccggtgtacgtcgcggacgtgctggccaagaaggtgcccgaccggctgatcaccaccaagaagccctacagcgagtggcgcaagatcaccgacgagtacgagttcctcttctccctgtaccccaacgacctgatccgggtcaagatgccgaaggagaagggcacgaagacccacaccggggagaagcacgtgtggcaggagaacttcatgtacttcaagggcgtgcacagcggctccgccggggtccgcatgatcgaccacatgaacagcttcgaggacgagatcggcgtgcggaagctcgtggtcttcgagaagtaccaggtggaccccctggggcgcatgaacaaggtgcacggcgagaagcggcacgggatctga

SEQ ID NO: 1533 - RNA, 3234 nt, synthetic construct
  misc_feature 1..3234: note = Cas9 variant
  source 1..3234: mol_type = other RNA
atgcagcagaagccccagcgctacatcctgggcctcgacctggggatcgccagcgtgggctgggcctgcgtctgggcggacgagaacgagcacccgaccgggctgctcgactgcggcgtgcggaccttcgagcgcgccgaggtgcccaagacgggggactccctggccctggcccggcgccaggcccggagcgtccgccggctcatccgccggcgcgcgcaccggctgctgcgcctccggcgcctgctgaagcgggagggcgtgctcctgtccgccgacttcaacgagaacggcctggtgcgcgggctccccatcgacgcctgggccctgcgggtcgcgggcctggaccgcaagctcagcaacaaggagtgggccgccgtgctgctgcacctcgtgaagcaccgggggtacctgtcccagcgcaagaacgagacccagagcaaggacaaggagctgggccggctcctggccggggtcaacggcaaccgcgaggccctgcagaaccgctccgacgagtaccggaccgcggccgagctcgccgtgaagaagttcgccgccgagaacaacggcagcctgcgcaacaagggcggggactactcccacaccttcgaccggaaggacctgcagcgcgagctccacctcctgttcgagcggcagcgcgcgctggacaaccccttcacgagctccgagatggaggccgccgtggacgagctgctgatgaagcagcggagcgccctccagggggaggccgtcctgaagatgctgggccgctgcaccttcgagccgtccgagtacaaggcggccaagaacacctacagcgccgagcggttcgtgtggctcaccaagctgaacaacctgcgcatccagtacaacggcgaggagcgggccctctccgaggccgagcgccggctgctgctcgacgagccctaccagaaggcgaagctgacgtacaagcaggtccgcaccatcctggagctccccgagagcgccgtgttcaaggggctgcggtacggccacggggaggacggcctgaaggccgagtccgggaccctgatggagatgaaggcctaccacgcggtgcgcaaggccctcaaggacgccggcctggagggcgagtgggagaaccggatccgcaaccccgagctgctcgacgccatcgggaccgccttcagcctgtacaagacggacgaggacatccgggcgaacctggccgccttccgcctctccgagaacgtgctggaggccctgctcgccggcctgaacttcgacaagttcgtccacctgagcctcaaggcgctggccaagatcctgccgctcatggagcaggggatgcgctacgacgaggcctgcaaggaggcctacggcgaccactacggggccaaggagcaggaggaccaccggctgctgccgcccttcgtggcggacgacatccgcaaccccgtggtcttccggaccctcacccaggcccgcaagatcgtgaacgagatcgtgcggcgctacggcagccccctgcgggtccacatcgagaccggccgcgaggtggggaagtccttcagcgaccggaaggagatcgagaagcgccaggaggagaaccggaaggagcgcgagcgggccgccgcgcacttcaaggagctgttccccaacttcgccggcgagcccaaggcccaggacatcctcaagctgcgcctgtacgagcagcagcacgggaagtgcctctactccggcaaggagatcgacctgcggcgcctgcccgagaaggggtacgtcgagatcgaccacgccctcccgttcagccggacgtgggacgactccttcaacaacaaggtgctggtgctgggcaaggagaaccaggacaagcgcaaccggaccccctacgagtacctcgacggcaaggggaacagcggcgcctggcgcgcgttcgccgagcgggtctccgggtgccgcttcccctacgccaagaagcagcgcctgctgacccagaagctcgacgagaagaccgagcagggcttcctggagcggaacctgaacgacacgcgctacgtggcccggttcctctgccagttcatcgaggagaagatgcacctggagggcgccgggaagaagcgcgtgttcgcgagcaacggccagatcaccgccctgctccgggggttctggggcctgaagaaggtccgcgaggagaacgaccggcaccacgccctggacgccgtggtggtcgcctgctccagcgtgtccatgcagcagaagatcacccgccacttccggtaccgcgaggagctcgagcacatcgaccgggagaccggggaggtgatccacggcttcccccagccgtgggagttcttccgccaggaggtcatgacgcgggtgttcagcgacgaccccgtgtccgagctggcggagaagctggacagccgccccgaggccgtccacgagttcgtgacgcccctcttcgtgtcccgggccccgcaccgcaaggtcaccggccaggggcacctggagaccatccggagcgccaagcgcctggacgagaagatctccgtggtgaagctccccctgacccagctgaagaccaaggacatcgagcggatcgtcggctaccccaaccgcgagcccgcgctctacgacgccctggccgcccgcctggccgcgttcaaggacgacccggccaaggccttcagcgagcccttctacaagaccgggaaggacggcaagtgcggggtgctcgtgaaggccgtccgggtggagaacgtgcagaagtccggcctgctggtccgcaaggacgagagcggcaagatgcagggggtggccgacaacgcgaccatggtgcgggtcgacgtgttcggcaagaacgggaagaactacctcgtgcccgtctacgcctggcaggtcgagaagggcgagctgccgaaccgcgccgtggtggcctacgccgacgaggaggactgggacgagatggacgacagcttcgagttcaagttctccctgtaccccaacgacctcgtggaggtggtcacgaagaaggacaagttcttcgggtactacagcggcttcaaccgggcgaccggcgccatcaacatcaaggagcacgacctgtccaagagcaaggtgaagaacggggtgtacgagggcatcggggtcaagaccgcccagtccttccagaagtaccaggtggacaccctgggcaagacgatccgcctctgcaagcccgagaagcggatggggttcaagaagaagtga

SEQ ID NO: 1534 - RNA, 3237 nt, synthetic construct
  misc_feature 1..3237: note = Cas9 variant
  source 1..3237: mol_type = other RNA
atgcgctacgtgctgggcctcgacatcgggatcgccagctgcggctgggccgtcatcaaccaggagaaggagcggatcgaggacctgggggtgcgcatcttcgacaaggcggagaaccccaaggacggcaagtccctggccgccccgcggcgcgacgcccggagcacccgccggaccctccgccggaagaagcaccgcatgcagcggatcaaggtgctgctggtcaagcacgggctcctgtccaagacggagctggaccacctctacgagagcgccaccgaggtggacgtgtggaacctgcgcctggacgcgctcgagcggaagctgtaccccaaggagttcgcccgcatcctgatccacctcgccaagcggcgcggcttcaagtccaaccggaaggagaccaccctgagcgagaacggccagatcctggagtccatcagcgagaaccagcagatcatggagaagcagaactaccgcacggtcggggagatgatcctcaaggacaagaagttcgagaaccacaagcggaacaagaacggcacctacgtggggaccgtgacccgccagcagctgcaggacgagatccagatgatcttccacgcccagcggctgtacaagaacgactacgcgacggaggagttcgagtccagctacctcgagatctgggcctcccagcgcccctacgccagcaaggaccagatcgagaagatgatcggctactgcaccctggagcccaaggagaagcgcgccccgaaggcctcctggagcttccagtacttcgtcgcgctgcagaccatcaacaacctccggctgatctccaaggaccgcatcgaggagctgagcttcgaggagaagaagcagatcatgaacctcgccctggagaagtccatcgtgaagtacatcgacatccggaagctgctcagcgtgcccaacgagttccagttcaactccctgagctacagcgccgacaccgtcgacacggccgtggagtcccgcaagtgcatcgagctgaaggagtaccacagcatcaacaaggtgtacaagcagatctacggggagaacgccctcaacctgctgcccaagtactacgacaccatcgcgtacggcctcaccatcttcaaggacgacaaggacatcctggagtacctgcagaacaagtacgtcaacgccaagggcaagcccatctccaacttcgccaacaagacctacgacgacacgttcatccaggccctcctgaacctgaacttcaccaagatggggcacctcagcttcaaggccctgaagaacatcatcccgttcctggaggagggcctctcctacgacaaggcgtgcgagaaggccgggtacaacttcaagggcaccagctacaccgagcagacgaagtacctgcccgtgatcccccagaacaccaaccccgtggtccaccgggccctgtcccagacccgcaaggtgatcaacgccatcatcaagaagtacggcagcccgaacgccatccacatcgagaccgcgcgggagctctccaagacgttccaggagcgcaaggagatcgacagcatgtaccaggacaactccaagaagaacgagcacgccatccacaagctgaaggagctggggaacatcaaccccagcggcatcaacatcgtgaagttcaagctgtggaacgagcaggacgggcggtgcatgtactccggcaagtacatcgagccccaccgcctcttcgaggaggggtacaccgaggtcgaccacatcctgccctacagccggtccctggacgacagctacaacaacaagaccctcaccctgggcacggagaaccagcgcaagggcaacaagatcccgtacgagtacatggggaacacctccatctggaacgacttcgagacccgggtgcagagcaacaagaagatcaacaagaagaagcagcagaagctgctcctgcagcacttctcctacgcccgcgagcaggagttcatcgagcggaacctgaacgacacccgctacgccacgatctacctcagcagcctgatccagcagcacctgatcttctccgagagctcccggaagaagaaggtgcacaccgtcagcggcatcatcacctcccacctccgcagccggtgggggttcaacaaggaccgcaaggagggccacatccaccacgcgctggacgccgtgatcgtcgccgtgacctccgaccacatgatccagcgcgtgacgaagtactacaagctgaaggagctcaaccggaacctgcaggccaagcgcatgcccttccccgagccctgggaggggttccggctggagctcgaggcccgcatcagcccgaacacccagcagtacctgaagggcctgcggttcaagaactacgcggacgtcaacctctccgagatcaagagcatcttcgtgtcccgcatgcccaagcacagcatcaccggcgagctgcaccaggagaccatccggaagttcatcgggtacaacgagaagggcaaggtgctgaccgccatcaagacgaagctcgaggacatccccttcgacgccaacggggacttccccatgtacggcaaggagtccgacctgtacacctacaacgccatcaaggagcgctacctgagccacaagaaggacaagcggaagtccttccaggagccgctctacaagcccaccaagagcgggggcatcggccccctgatcaagtccatcaagatcatggacacccgcacgatcgtcaaccccgtgaaccaggggaagggcgtggtctacaacagcaagatcgcccggaccgacgtgttcaagaaggaggagaagtactacctgatcccgatctacaccatcgacctcatgaagaacatcctgccccagaaggcgatcaccgccgggaagggctacgaggactggacgaccatcgaccccagcttcaccttcctgttctccctcttcccgaacgacctgatccagatcgtgcccagcaagaacaagaccatcaaggcccgcacgaccgtctccaagaaggaggtgctgctccccagcctgaccggctacttcaagggggtgcactccggcaccgccgggatcacggtcgagacccacgacggcagcgtgatcgccaacgtggggtccaagcagctgctcctgatcgagaagtaccaggtcgacgtgctgggcaactacaccaagatcaaggaggagaagcggatcggcctcaccacgtacaacgacaacaagaagatcgcggcctgctga

SEQ ID NO: 1535 - RNA, 3237 nt, synthetic construct
  misc_feature 1..3237: note = Cas9 variant
  source 1..3237: mol_type = other RNA
atgaagcagcagccccagcgctacatcctgggcctcgacctggggatcgccagcgtgggctgggccctgatcctcgtcgacgaggaggggaacccgatcggcctgctggactgcggggtgcggaccttcgagcgcgcggaggtgcccaagaccggcgactccctcgccctggcccggcgccaggcccggagcgtccgccggctgatccgccggcgcgcccaccggctcctgcgcctgcggcgcctcctgaagcgggagggcgtgctgtccgcggccgacttcaacagcgacgggctccccaacctgcccatcgacacgtggcagctgcgcgtggccggcctcgagcggaagctgaccaaccaggagtgggccgcggtcctgctccacctggtgaagcaccgcgggtacctgtcccagcgcaagagcgagacccagaccgagaacaaggagctcggctgcctgctggcctccgtggccaagaacagcaagctcctgtccgagaacgccaaccagtaccggacgccggccgagctggcggtccggctgttcgccgagcagagcgggcacctccgcaacaagggcggcgactacacccacaccttcaaccgcctggacctccagaaggagctgcacctcctgttcgagcagcagcggaccttcgggaaccccttcgcctccgccgagctgcagagcaaggtggacggcctgctcatgatgcagcgctccgccctgcagggggaggcggtgctgaagatgctcggcaagtgcacgttcgagcccagcgagtacaaggccgccaagcacacctactccgccgagcggttcatctggctgaccaagctgaacaacctccgcatcctggagaacggcaccgagcgggccctgaacgaggcggagcgcaagctcctgctggacgagccctacaagaaggccaagctgacgtacagccaggcccggaagctcctggacatgtcccacgacgccaccttcaaggggctgcgctacggcaaggacagcgaggggctcaacgccgagaacggcgcgctgatggagatgaaggcctaccacaagatccggaccgtcctggacaaggccgggctcaagggcgagtgggagaaccgcatccggaacccggagatcctggacaagatcggcaccgccttctccctgtacaagacggacgaggacatccaggcggccctcgccgacctgcgcctgcccgagaacgtgctcaacgccctgctggccgggctcaacttcgacaagttcatccagctgagcctgaaggcgctcagcaacatcatgcccctgatggagcggggcatccgctacgacgaggcctgcaaggaggtgtacggggaccaccgggccctggccgagtccaagaaccagatgctcctgcccccgatccccgccaacgagatccgcaaccccgtcgtgctgcggaccctcacccagacccgcaaggtgatcaacgcgatcatccggcgctacggcagcccccagcgcgtccacatcgagacggcccgggagctggggaagtccttcaaggaccgcaaggagatcgagaagcggcaggaggagaaccgcaaggagcgggagcgcgccgccgagcacttcaaggagctgttcccgcacttcgccggcgagcccaagggcggggacatcctcaagctgcggctgtacgagcagcagcagggcaagtgcctctacagctccatccccatcgacctggggcgcctgaacgagaagggctacgtggagatcgaccacgcgctccccttcagccggacctgggacgactccttcaacaacaaggtgctggtcctggggagcgagaaccagaagaagcgcaaccagaccccgtacgagtacctcgacggcgcctccaacagccagcggtggcgcgagttccaggcccggctgcagggctgccgcttctcctacgccaagaagcagcggatccagaccgcgaagctggacagcaagacggagcaggggttcctcgagcgcaacctgaacgacacccggtacatcgcccgcttcctgtgcggcttcatcgaggagaacctccacctccagggggagggcaagcggcgcgtgttcgcctccaacggccagatcaccgccctgctgcgggggctgtggggcctgaagaaggtgcgcgaggagaacgaccgccaccacgccctcgacgcgatcgtcgtggcctgcagcaccgtctccatgcagcagaagatcacgaaggccatgcagcggcgcgagaccctggagaccgtggacaccgagacgggggaggtgaagacccggatcccccagccctgggacttcttccgccaggaggtcatgatgcgggtgttcagcgacacgccccacgaggagctggccgagaagctctccggccgcccggaggccctgcacgacttcgtgagccccctgttcgtctcccgggcgcccaaccgcaagatgaccgggcagggccacctcgagaccgtcaagagcgccaagcggctgagcgagaacatctccgtggtgcgcaagcccctgaccgccctcaagctgaaggacatcgagaacatcgtgggctacccggaccgggagcccgccctgtaccaggccctccgcgagcggctgcaggcgtacaaggacgaccccgtgaaggccttcgccgagccgttctacaagcccgccaagaacgggggccaggggagcctggtcaaggcggtgcgcgtgaaggacgtccagaagaccggcgtgatggtgcggaaggaccgcgggggcatcgcccggggcatcgccgacaacgccaccatggtccgcgtggacgtgttcgggaagaagggcaagaactacctcgtccccgtgtacgcctggcaggtcgcgaaggggatcctgcccaaccgggccgtggtggcctacgccgacgaggccgactgggacgagatggacgactcctacgagttcaagttcaccctgtacccgaacgacctcgtggagatcatcagcaagaagggccgcatcttcgggtactactccggcctgaaccgcgcgacgggcgccatcgacatcaaggagcacgacctgagcaaggagaaggccaagaacgggatccaccagtccgtcggcgtgaagaccgtgctcagcttccagaagtaccaggtcgaccccctggggaaggagatctgcctgtgcaaggtggagaagcaccccgagctcaactccaagaagaagaagtga

SEQ ID NO: 1536 - RNA, 3237 nt, synthetic construct
  misc_feature 1..3237: note = Cas9 variant
  source 1..3237: mol_type = other RNA
atgggctacctgatcgggctcgacatcggcatcaccagcgtggggtacgccgtcctgcagaccgacttcaagggcaacccctacaagatcctgctcatgaacacggtgatcttcccggtggccgaggcgcccaagaccggggagtccctggccgcccccgtccgccagaagcggagctcccgccggaccaaccgccggaccaagttccgcaagctgcgggtgcagaagctgttcgtgcgcttcggcctgctggagagcgccgacgtcgccacgttcctcaaccagaaggtgccccaccaggacatctggcagctgcggaaggacgcgctgaaccgcaagctctccaaccgggagctgttcgagatcctgtacttcttcgtgggccaccgcgggttcaagagcaaccggcgctccgaggtcaccggcaagcagccgaaggacaaccaggtggtgctcaccagcatccacgaccgggggaacaccctgaacgacttcgactccctgggcgagatgatgcaggagctccccgagttcaagacgatcaagcacaacaaggcctaccgccccgacaacaccatctaccccctgcgggcctggatcgagcacgagctgagcgccatcttctccgtccagcagaagaacaaccgccagatcaccgacaacttcatcacccagtacctcgacatcttccggagccagcgcgacttcgaccaggggccggcggccccctcccggttcggcggcaacatgatcgagcgcatggtggggcccgacagcctggacgcccacgagaagcgcgccgccaagctgacgaacaccttcttccggttcaacttcctctccaccctgaacaacctgaagatccagctcaccctgggcgcggagttccaccccctgacgaccccgcagcgcgagatcgtgctccaggccgccaccctcaagagcctgaactacaagcagatccggcacaagctccagctgcccgactccgcccgcttcaacctggtcccctaccagagcaacgaggaccccatcaagaccgagtccaagcactacctcttcaagcggaaggccctgacgcagatcgaggcggtgaccgacaacccgcagctgatcgacaagatcgggaccatcctcgcctacttcaagggcgacaagacccgccaggagaagctgagcgccctgaacctcagccgggccgagatcaagcagctgctgcccatcaaccagcccggcttcgggaacctctccctgaagacgatgcacaagatcctgccctacctcgagcagggccacctgtaccacgaggccgcgcagctggccgggtacgacttccagaacaacctggtggaccgccagtacctccgggacaacctgaagaacccggtcgtgaaccgcgccatcggcaagaccatcaaggtggtcaacgccatcatcaagaagtacggggaccccgacgccatccacatcgagctgacccgggagatcaagcacagccacgaggagcgccagaagatcgcgcggcagatgaacaccaacatggaccagaacgacaaggtggccgagcacctccgcgagaacggcatccccgtgaacggccagaacatcatcaagtccaagctgttctacgagcagaaggggatcgacctgtacagcggccagcagatcaacgagcaggacctctacacggaggaccactaccaggtcgaccacatcatcccctactccatcagcttcaacgactccttcaccaacaagaccgtgacccggacgagcaacaaccagaacaaggccaaccgcctgccgctggagtacctctccgaggagaagcaggacgccttccgggcgcgcgtcatgagcaacatctccaactaccggaagcgccagaacctgctgaaggaggggatcaccgaggacaaccgccagcagtggaagacccggaacatcaacgacaccggctacatcaaccgcctcctgagccagtacctgcggaacaacgtgcagttcacgaagaagtcccacaaccccgtgttcaccgtcaacggggccaccaccgcctacatccgcaagcggtacggcatcatcaagaaccgccaggccaccgacctccaccacgccgtggacgcggtgatcatcggctgcatcagcaacacgttcgtctcccggctggccaagtacagcgaggcccaggaggcccgctaccacaagcagctgtggcagatcacccagtaccggcaggagcacaaggacctctccaccatcgagtaccaggagctgatcaagcagttccccctgccctggccggacttccgccacgagctcatggcccggctgagcaccgaccccgcgaagatgatggcccaccacacgtgggagcactacaccgacgaggagatctcccagctgaagcccgccttcgtgatccgcagcgccaaccacaaggtgaccgggagcgcccacgacgacaccatctactccaagaagctctacgaccagcggggcgtcgggctgctgcgcacgagcctccagaacctgaagtacgactccaagaaggacggcatcaagaactacgagcggctgaaggacgggagcaactccctcgtgtacgacagcctgctgcgcgcgctcaaggagcacgacggcaacgccaagaaggccttcccggacaaccagctgctgatctccaccggcaaccaccagcagatcatcacccacgtgaagaccgtcaagaagatcacgcaccccatcgaggtgaaccgggacaccgccatcgcgatcgggggccgcatgatccgggtggacatcttcaagcaggccaaggcccagaagctcatcgggatccccgtctacgtgaacgacaccgtgaagcccaccctgccgaaccgcgcctgcacgagcggcaagcggtactccgactggtaccagctgacccgccaggaccagttcctctgcagcctggtctccaacgacctggtgctcgtggagaccgccagccccctgaaggtcaccaacaacatcacgaacgaggaggtgcagaccacccagctgctctgctacttctccagcttcaacatcgcgaacgcccagatcaacttccactccatcaacaacgacagctccatcaaccccatcgtgctgaacaaggtcacctacctgacgaagtaccagctcgactacctgggcaactacttccccgtgaagcacgagagccgcaagaccttcaaccggaagcgctga

SEQ ID NO: 1537 - RNA, 3237 nt, synthetic construct
  misc_feature 1..3237: note = Cas9 variant
  source 1..3237: mol_type = other RNA
atgcacacccgcctggccctcgacatcggcaccacgagcatcgggtggatcctgtacgagctggtgaacggccagcccgcctccatcctcgacgggggcacccggatcttcagcgacgggcgcgaggcgaagaccggccactccctggccgtcggccggcgcaccgcccgggggatgcgccggcgccgggaccgctacctgcggcgccgggccgccctcatgaagcgcctggcggccatcggcctgatgccggagagccccgaggccgccgcgcagctcgccacgctggacccctacgagctgcgggcccgcgggctcgaccaccccctgccgcccgagcacctgggccgggccctcttccacctgaaccagcgccgggggttcaagtccaaccgccggaccgacaagggcaacaacgagggcgggatgatcgccgacgcgagcgcccgcctggagcaggccatgatggccgccggcgcgcgctcctacggggagttcctccacaagcggcgcgccgaggccaccgcgccccgggccacccccgccgtgcgcacgcggatcaacccgcacctgaccggcgaggacggcaaggagcagcccgggtacgacttctaccccgaccgcaagcacctggaggacgagttccaccggctctgggaggcccaggcccgccacaaccccgacctgaccccggccatgggcgacctcctgttccagaccatcttccaccagcggcccctgaaggcccccgcggtggggcgctgcctgttcctcgacgagccccggctgccgaaggcccaccccctgacgcagcagcgcaccctctacgagaccgtcaacatgctgcggatcgccccgcccggccagcccaagcgccggctgagccgcgtgcagcgggaccagatcgtgcacgccctcaacaaccgcaagatcctggcgtcccccgggaagaacgtcctgaccctcgccgccatcggcaagctgctgaagctccggcccggcgaggccttcagcctggacacggccaaccgcgacgcgatcgcctgcgaccccgtgcgcatgtccctggcctacgaggggcggttcggcccgcagtggagcgccctctccgtggagagccagtgggagctgatccagcgcctgcgggacgaccaggacggggccgcgctcgtcgactggatcatggaccgctacggcttcgaccgggaccgcgcccgggccatcgccgacgcgcccctgcccgaggggttcggccgcctgggcgagaccgccacccgggccgtgctcgccgtgctgatcgggggcaccacggagcaggaggtcctgacctactccgaggccgtggcggcctgcgggtgggaccacagccgcctgggcaccggggaggtgctcgaccggctgccctactacggccaggtcctggaccgccacgtgctcccgggcaccgggcggcccgaggacgacgagatcacgcgcttcggccggatcaccaaccccaccgtgcacatcgggctgggccaggtcaagcgcctggtgaacaaggtgatcgacgcctggggccggccgcacgagatggtcgtggagctcgcccgcgacctgaagatgtccgaggaccagaagcggaacctggccaaggtgaacgcgcagaaccagcgcgccgccgagatgcggagcgccaagctcatcggggacctgaagatcgaggacaacggccgcaaccgcgggatcctgcgggtctgggaggagtccgccgcggacgtgctccaccgctgctgcccctacaccggcgcccagatcagcgccagcatgctgttcgacgggtcctgcgacatcgaccacatcctgccctacagccggacgctcgacgacggcttcaacaaccgcgtcatctgcctgaagtccgccaaccgggagaagcgcaacctgaccccctgggaggcctggggcaacaccccgaagtgggcggccatcgaggccaacctcaagaacctgccgcccgccaaggcgtggcggttcgcccccgacgccatgctgcgctacgagggggagcgggacttcaccgcccgcgccctcgtggacacgcagtacctgagccggctggcgcgcgagtacctcgagtgcctgtacgccgaggacatcgaccccggcccccactccgggaagaagccccggcgccccatctgggtggtcaccggcaagctgaccgagctcctgcggcgccactgggggctgaacagcctcctgccggacgcccaccggggcaccgccaaggccaagaaccgcctggaccaccggcaccacatgatcgacgcggccgtggtgggcgccacggaccacgccaccgtccagcgcatcgccaacatggcgaaggggaacgtggagaacggcctcgaggacctggccgggaccatcctgccgccctggcccggcctccgcgacgacctgaaggcccggctggagcgcaccatcgtgtcccaccgggggaaccacggcgccatcgaccccgccgcgcgcaagcagggccgggacaccacgagcgggcagctccacaacgacaccgcctacggcctgaccggggagaccctgaagggcgtccccctcgtggtgaaccgcaagcccatcgacatgctgacgcccgccatgatcgacaagatccgggacccgcacctgtcccgctggctcaccgccgtcaccaaggggaaggagggcaaggacttcaaggcggccgtggaggccttccgggcccaccccggcccctaccgcgggatccggcgcgtgcggctgatcgagcccgtcgaggtgatccgcatcaaggaccggaacggccgcccgtacaaggggtacaagggcgacagcaaccagtgctacgaggtgtggtgcctgcccgaccggaccctcacgcaccacgtcgtgtccaccttcgccgcgcaccagggccagaccgggaagccccacccggccgccaagcgcctggcccggctgtacaagggcgacatggtgcgcctcgaccggagcaagttcgggtccgtcatcgccaccgtggagaagttcgaccgcaacggccagctggagctggtgccccacaacgaggggaacgcggaccagcgctaccggaaggacaagagcgactccgtcttcatccgcctccgggccgccacgttcatcgccagcggcgcccgccgggtgatcgtggacgagatgggccgcatccgggaccccgggcccggcaagcactga

SEQ ID NO: 1538 - RNA, 3240 nt, synthetic construct
  misc_feature 1..3240: note = Cas9 variant
  source 1..3240: mol_type = other RNA
atgaagtacggcatcgggctggactgcggcatcaacagcgtggggtactgcatcatggagctcaactccgacgacgagcccaagcgcatcgtccggctgaacagccgcatcttcaccgaggccgagaacccgaaggacggctccagcctggccgcgccccggcgcgaggcccgggggctccgccggcgcatccggcgccacaagcaccggctggagcgcatccgggccctgctcgtgcgcgagaacatcgtgacccaggccgagctggacaacatgttctccggcacgctgagcgacatctacgagctccggaccgccgcgctggacgcgcccctgaacaacatcgagttcgcccgcgtcctcatcaacctggcccagcggcgcggcttcaagtccaaccgcaagagcgagaagtccagctccgacaaggagaccgggaagctgctcagcgcgatcaagaagaacaaggagtccatcgaggccggcgggtaccggaccgtgggcgagatgctgttcaaggacgagcggtacgccaagcacaagcgcaacaagggggaggcctacctgaacacggtgagccgcgacatgatcgaggccgagatccacgcggtcttcgcctcccagcggaacttcggcatgcccttcgccaacgagaagatcgagaacgagtacaccgacatcgccctcagccagcgcccgttcgacctgggccccggggagggccccgagaactgcaagtccccctacgccgggaagcagatcaagaacatgatcggccagtgcaccttcttcccggaggagaagcgggcggtgaaggccagctactccttccagctgttcagcctcctgcagggcatcaacaacatcaccctggtgagctccgacgggaacacgttccccctcagccaggagcagcgcaagaccctgaaggactactgcttcaagaccgccaacgtcacctacgcctccatccggaaggtgctgcagatcccccaggagtacacgttcaagaacatcacctacaccgacgacggcatcgagaagtccgagaagaagaccaagttccagcacctcaagccctaccacgagatgaagaaggtgctggggagcgccatccagacgctgaccccggaggagctcgacgagatcggcgagatcttcaccttctacaaggacgagaccatcatcatcaagcagctggaggagacggagatcgacaagagcctgtacgacctcctgctgcagctccccaccttcgagaaggcggggcacatctccaccaaggcctgcaagatgatcatccccttcctggaggagggcaagacctacgacaaggcctgcgagtgcgccggcctgaacttcaaggcccacacgaacatgcagaagcagatgctcctgcccgccaagagcgacgagctgaacgacgtcgtgaacccggtggtccgccgggccatctcccagaccatcaaggtggtgaacgccatcatccgcgagatggggaccagccccacctacatcaacatcgagctcgcccgggagctgtccaagagcaagaaggagcgcgacgagatcaacaagaagtacaagctgaaccaggcggagaacgagcggctcaagaacgagatcatcgacaacttcaagatcaagcccaacggccaggacatcatcaagctgaagctgtggcacgagcaggacgacgggatctgcccctacacgggcgtccgcatcaagtacgagaacctcttcgacgacgggtacgccgagatcgaccacatcatcccgtactccctgagcttcgacgactccttcaacaacaagatcctgaccaccgccacccagaaccggcagaagggcaaccgcatccccctggagtacctccccgagagcgagaaggacggcttccgggtgtgggtgaactccaacatccgcaaccaccggaagcgccagaacctgctgaaggagcacttcacggaggccgacaagaaggagttcaagagccggaacctcaacgacacccgctacctgaacaagctgctcctgaactacatcaacgacaacctcctgttcaccgacttctacaacgggaagaagaagcacgtcacctccgtgaacggcgccgtgacggcgtacatccgcaagcggtgggggatcaacaagaaccgcgaggacggcgacctgcaccacgccgtcgacgccgccgtgatcgcctgcgtcacccaggggatcatcaaccggatcaccgcgtacagcgcccgcaacgaggccccctacgacctgaacaccgagaccggcgagatcaaggagcggttcccgctcccctaccccaacttcaagaaggagctggacgcccgcacgaccatcgaggacgagaagcggctgaagcgcgtgctcatgagcttctccaactacagctacgacgacgtggagaaggccaagccctgcttcgtctcccggaccccgcaccgcaaggtgaccggcgcggcccacgaggagacgatccggagcgggaaggtggagggcttcaccgtctccaagaccgagctgaccaagctgaagctcacgaacggggagatcgagggctactacgagcccgagagcgacaccctgctgtacaacgccctcctgcagcgcctgaacgagttcggcggggacgccaaggcggccttcgccgacgagttccacaagcccaaggccgacggcaccccggggcccgtggtgaagaaggtcaagaccatcaagcggtccagctccaacgtgaaggcccgcaacaagaacggcctcggggtggcggacaacggcagcatgatccggatcgacgtcttctacgtggagaacgagggctactacttcgtgcccatctacgtcgccgacacggtgaaggagatgcccaacgaggcctgcccgttcgggaaggacaagaagaagatcatgaccgacgacgacttcctgttctccctgtaccccaacgacctcatcaagatcaccgccaagaaggacatgaagttcagcctggccaacaaggagtccggcctgcccaagaacaagtacgcgaacgaggtgctcgtctactacagcgccgccgacatctccaacgccagcatctccgtgatcatgcacgacaacgcctacaagttccgcgggtgcggcatcaagagcctggtgaagctggagaagtacaccgtcgaccccctcgggaacgtgagcaaggtgaaccgggagaagcgcatgtacttcaagtga

SEQ ID NO: 1539 - RNA, 3240 nt, synthetic construct
  misc_feature 1..3240: note = Cas9 variant
  source 1..3240: mol_type = other RNA
atgcgcctgggcctcgacatcgggaccagctccatcggctggtggctgtacgagaccgacggggccggcagcgacgcccggatcacgggggtggtcgacggcggcgtgcgcatcttctccgacgggcgggaccccaagagcggcgcgtccctggccgtggaccgccgggccgcccgcgccatgcggcgccggcgcgaccggtacctccgccggcgcgcgaccctgatgaaggtcctggccgagaccgggctcatgccggccgaccccgccgaggcgaaggccctggaggccctggaccccttcgccctccgggccgcgggcctggacgagcccctgccgctcccccacctggggcgcgccctgttccacctcaaccagcggcgcggcttcaagagcaaccggaagaccgaccgcggcgacaacgagtccgggaagatcaaggacgccacggcccggctggacatggagatgatggccaacggcgcgcgcacctacggggagttcctgcacaagcgccggcagaaggccaccgacccccgccacgtgcccagcgtgcggacccgcctctccatcgccaaccggggcggcccggacgggaaggaggaggccggctacgacttctaccccgaccgccggcacctggaggaggagttccacaagctgtgggccgcgcagggggcccaccaccccgagctcacggagaccctgcgcgacctcctgttcgagaagatcttcttccagcggcccctgaaggagccggaggtcggcctgtgcctcttcagcgggcaccacggcgtgccgcccaaggacccccgcctgcccaaggcccaccccctgacccagcggcgcgtgctctacgagaccgtcaaccagctgcgggtgacggccgacggccgcgaggcccggcccctgacccgcgaggagcgggaccaggtgatccacgcgctcgacaacaagaagcccaccaagtccctgagctccatggtcctgaagctcccggccctggccaaggtgctgaagctccgcgacggggagcggttcaccctggagacgggcgtgcgcgacgccatcgcgtgcgaccccctgcgcgccagccccgcccaccccgaccggttcgggccgcgctggtccatcctcgacgccgacgcccagtgggaggtcatcagccggatccgccgggtgcagtccgacgcggagcacgccgccctggtggactggctgaccgaggcccacggcctcgaccgcgcccacgcggaggccaccgcccacgcgcccctgcccgacgggtacggccggctgggcctcaccgccacgacccgcatcctgtaccagctgaccgccgacgtcgtgacctacgccgacgccgtgaaggcctgcgggtggcaccacagcgacggccggacgggggagtgcttcgaccgcctgccctactacggcgaggtcctcgagcggcacgtgatcccggggtcctaccaccccgacgacgacgacatcacccgcttcggccggatcaccaaccccaccgtgcacatcggcctgaaccagctgcgccggctcgtcaaccgcatcatcgagacgcacgggaagccgcaccagatcgtggtcgagctggcgcgggacctgaagaagtccgaggagcagaagcgcgccgacatcaagcggatccgcgacaccaccgaggccgccaagaagcggagcgagaagctcgaggagctggagatcgaggacaacggccgcaaccgcatgctgctccggctgtgggaggacctgaaccccgacgacgccatgcgccggttctgcccctacaccgggacgcgcatcagcgcggccatgatcttcgacggcagctgcgacgtggaccacatcctcccctactcccggaccctggacgacagcttcccgaaccgcaccctgtgcctccgggaggccaaccgccagaagcggaaccagaccccctggcaggcctggggcgacacgccccactggcacgccatcgcggccaacctgaagaacctgcccgagaacaagcgctggcggttcgccccggacgccatgacccgcttcgagggggagaacggcttcctcgaccgggccctgaaggacacccagtacctggcgcgcatctcccggagctacctcgacaccctgttcaccaagggcgggcacgtgtgggtcgtgcccgggcgcttcacggagatgctgcggcgccactggggcctcaactccctgctgagcgacgccggccgcggggccgtgaaggccaagaaccggaccgaccaccgccaccacgcgatcgacgccgccgtcatcgccgccaccgaccccggcctcctgaaccggatctcccgcgcggccgggcagggcgaggccgccgggcagagcgccgagctgatcgcgcgggacacgcccccgccctgggagggcttccgcgacgacctccgggtgcgcctggaccggatcatcgtgtcccaccgcgccgaccacggccggatcgaccacgccgcccgcaagcaggggcgggacagcaccgccggccagctgcaccaggagaccgcgtactccatcgtcgacgacatccacgtggccagccgcaccgacctcctgtccctgaagcccgcccagctcctggacgagcccgggcggagcggccaggtgcgcgacccgcagctgcggaaggccctccgcgtcgccaccgggggcaagacgggcaaggacttcgagaacgcgctgcggtacttcgcctccaagcccgggccctaccaggccatccgccgggtgcgcatcatcaagcccctgcaggcccaggcgcgggtgccggtccccgcccaggaccccatcaaggcctaccagggcgggagcaaccacctcttcgagatctggcgcctgcccgacggcgagatcgaggcccaggtgatcacctccttcgaggcccacaccctggagggggagaagcgcccgcaccccgcggccaagcggctcctgcgcgtgcacaagggcgacatggtcgccctggagcgggacggccgccgggtggtggggcacgtccagaagatggacatcgccaacggcctcttcatcgtgccccacaacgaggccaacgcggacacccgcaacaacgacaagagcgacccgttcaagtggatccagatcggggcccggcccgccatcgccagcggcatccgccgggtgtccgtcgacgagatcggccgcctgcgggacgggggcacgcgccccatctga

SEQ ID NO: 1540 - RNA, 3240 nt, synthetic construct
  misc_feature 1..3240: note = Cas9 variant
  source 1..3240: mol_type = other RNA
atggacgaggaggccaagatccagctgagcaaggagtcctacgaggaggagctcgagagcctgctggagaagtccggcgaggagttccgcgacgtgttcctccaggccaagaaggtctacgacgcgatcctgctgagcgacatcctctccaccaagaagcagaacagcaaggccaagctgtccctggggatgatcgagcggtacgacagccacaagaaggacctcgaggagctgaagcagttcgtgaaggccaacctgcccgagaagaccgccatcttcttcaaggactccagcaagaacggctacgccgggtacatcgacggcaagacgacccaggaggacttctacaagttcctcaagaaggagctgaacgggatcgcgggctccgagcgcttcatggagaaggtggaccaggagaacttcctgctcaagcagcggaccaccgccaacggcgtcatcccgcaccaggtgcacctgacggagctgaaggccatcatcgagcgccagaagccctactaccccttcctcgaggaggcccgggacaagatgatccgcctgctgaccttccggatcccctactacgtggggccgctcgcgcagggcgaggagaccagctccttcgcctggctggagcgcaagacccccgagaaggtcacgccctggaacgccaccgaggtgatcgactacagcgcctccgccatgaagttcatccagcggatgatcaactacgacacctacctgcccaccgagaaggtgctcccgaagcacagcatcctgtaccagaagtacacgatcttcaacgagctgaccaaggtcgcgtacaaggacgagcgcgggatcaagcaccagttctccagcaaggagaagcgggagatcttcaaggagctgttccagaagcagcgcaaggtgaccgtgaagaagctgcagcagttcctgtccgccaactacaacatcgaggacgccgagatcctcggcgtcgacaaggccttcaacagcagctacgccacctaccacgacttcctggacctggcgaagcccaacacggagcgggtggccgagctcctggagcagcccgagatgaacgccatgttcgaggacatcgtgaagatcctgaccatcttcgaggaccgcgagatgatccggacccagctcaagaagtaccagtccgtcctgggggacggcttcttcaagaagctggtgaagaagcactacaccggctgggggcgcctcagcgagcggctgatcaacggcatccgcgacaagaagacgaacaagaccatcctggactacctcatcgacgacgacgacttcccctacaaccggaaccgcaacttcatgcagctgatcaacgacgactccctgagcttcaaggaggagctcgccaacgagctggccctggcggggaaccagtccctcctggaggtggtcgaggccctgccgggcagccccgccatcaagaagggcatctggcagaccctgaagatcgtggaggagctcatcgagatcatcgggtacaaccccaagaacatcgtggtcgagatggcccgggagaaccagcgcaccaaccgctccaagccccggctgaaggccctggaggaggcgctcaagagcttcgactccccgctgctgaaggagcagcccgtggacaaccaggccctccagaaggaccgcctgtacctgtactacctccagaacggcaaggacatgtacacgggggaggccctggacatcgaccggctgagcgagtacgacatcgaccacatcatcccccgctccttcatcgtggacaacagcatcgacaacaaggtcctcgtgtccagcaaggagaaccggctgaagatggacgacgtccccgaccagaaggtggtgatccgcatgcggcgctactgggagaagctgctccgggccaacctgatctccgagcgcaagttcgcgtacctgaccaagctcgagctgaccccggaggacaaggcccggttcatccagcgccagctggtcgagacccggcagatcacgaagcacgtggccgccatcctcgaccagtacttcaaccagcccgaggagagcaagaacaagggcatccgcatcatcaccctgaagtccagcctggtgtcccagttccggaagaccttcgggatccacaaggtccgcgagatcaacaaccaccaccacgcccacgacgcgtacctcaacggcgtggtggccatcgccctgctgaagaagtaccccaagctcgagcccgagttcgtctacggcaactacaccaagttcaacctggccacggagaacaaggccaccgcgaagaaggagttctacagcaacatcctgcggttcttcgagaaggaggagtacagctacgacgagaacggggagatcttctgggacaaggcccgccacatcccgcagatcaagaaggtgatctccagccaccaggtgaacatcgtcaagaaggtggaggtgcagaccggcgggttctacaaggagaccgtcaaccccaagggcaagcccgacaagctcatccagcggaaggccgggtgggacgtgtccaagtacggcggcttcgggagccccgtggtcgcctacgccgtggcgttcatctacgagaagggcaaggcccgcaagaaggccaaggccatcgaggggatcacgatcatgaagcagtccctgttcgagcaggacccgatcggcttcctgagcaacaaggggtactccaacgtgaccaagttcatcaagctcagcaagtacaccctgtacgagctggagaacggccgccggcgcatggtcgcgtcccacaaggaggcccagaaggccaacagcttcatcctccccgagaagctggtgaccctcctcttctacgcccagcactacgacgagatcgcccacaaggagtccttcgactacgtgaacgaccacctgagcgagttccgggagatcctggaccaggtcatcgacttctccaaccgctacaccatcgcggccaagaacacggagaagatcgccgagctgttcgagcagaaccaggagagcaccgtgcagtccctcagccagtccttcatcaacctgatgcagctcaacgccatgggcgcccccgcggacttcaagttcttcgacgtgatcatcccgcggaagcgctaccccagcctgaccgagatctgggagagcaccatcatctaccagtccatcacggggctgcgggagacccgcacccggatggccaccctctgggacggcgagcagtga

SEQ ID NO: 1541 - RNA, 3240 nt, synthetic construct
  misc_feature 1..3240: note = Cas9 variant
  source 1..3240: mol_type = other RNA
atggacgaggaggccaagatccagctgagcaaggagtcctacgaggaggagctcgagagcctgctggagaagtccggcgaggagttccgcgacgtgttcctccaggccaagaaggtctacgacgcgatcctgctgagcgacatcctctccaccaagaagcagaacagcaaggccaagctgtccctggggatgatcgagcggtacgacagccacaagaaggacctcgaggagctgaagcagttcgtgaaggccaacctgcccgagaagaccgccatcttcttcaaggactccagcaagaacggctacgccgggtacatcgacggcaagacgacccaggaggacttctacaagttcctcaagaaggagctgaacgggatcgcgggctccgagcgcttcatggagaaggtggaccaggagaacttcctgctcaagcagcggaccaccgccaacggcgtcatcccgcaccaggtgcacctgacggagctgaaggccatcatcgagcgccagaagccctactaccccagcctcgaggaggcccgggacaagatgatccgcctgctgaccttccggatcccctactacgtggggccgctcgcgcagggcgaggagacctccagcttcgcctggctggagcgcaagacccccgagaaggtcacgccctggaacgccaccgaggtgatcgactactccgccagcgccatgaagttcatccagcggatgatcaactacgacacctacctgcccaccgagaaggtgctcccgaagcactccatcctgtaccagaagtacacgatcttcaacgagctgaccaaggtcgcgtacaaggacgagcgcgggatcaagcaccagttcagctccaaggagaagcgggagatcttcaaggagctgttccagaagcagcgcaaggtgaccgtgaagaagctgcagcagttcctgagcgccaactacaacatcgaggacgccgagatcctcggcgtcgacaaggccttcaacagctcctacgccacctaccacgacttcctggacctggcgaagcccaacacggagcgggtggccgagctcctggagcagcccgagatgaacgccatgttcgaggacatcgtgaagatcctgaccatcttcgaggaccgcgagatgatccggacccagctcaagaagtaccagagcgtcctgggggacggcttcttcaagaagctggtgaagaagcactacaccggctgggggcgcctctccgagcggctgatcaacggcatccgcgacaagaagacgaacaagaccatcctggactacctcatcgacgacgacgacttcccctacaaccggaaccgcaacttcatgcagctgatcaacgacgacagcctgtccttcaaggaggagctcgccaacgagctggccctggcggggaaccagagcctcctggaggtggtcgaggccctgctgggctccccggccatcaagaagggcatctggcagaccctcaagatcgtggaggagctgatcgagatcatcgggtacaaccccaagaacatcgtggtcgagatggcccgggagaaccagcgcaccaaccgcagcaagccccggctgaaggccctcgaggaggcgctgaagtccttcgacagccccctgctcaaggagcagccggtggacaaccaggccctgcagaaggaccgcctgtacctctactacctgcagaacggcaaggacatgtacacgggggaggccctggacatcgaccggctctccgagtacgacatcgaccacatcatcccccgcagcttcatcgtggacaactccatcgacaacaaggtcctggtgagctccaaggagaaccggctgaagatggacgacgtccccgaccagaaggtggtgatccgcatgcggcgctactgggagaagctcctgcgggccaacctgatcagcgagcgcaagttcgcgtacctcaccaagctggagctgacccccgaggacaaggcccggttcatccagcgccagctcgtcgagacccggcagatcacgaagcacgtggccgccatcctggaccagtacttcaaccagccggaggagtccaagaacaagggcatccgcatcatcaccctcaagagctccctcgtgagccagttccggaagaccttcgggatcaacaaggtccgcgagatcaacaaccaccaccacgcccacgacgcgtacctgaacggcgtggtggccatcgccctgctcaagaagtaccccaagctggagcccgagttcgtctacggcaactacaccaagttcaacctggccacggagaacaaggccaccgcgaagaaggagttctacagcaacatcctccggttcttcgagaaggaggagtactcctacgacgagaacggggagatcttctgggacaaggcccgccacatcccccagatcaagaaggtgatcagctcccaccaggtgaacatcgtcaagaaggtggaggtgcagaccggcgggttctacaaggagaccgtcaacccgaagggcaagcccgacaagctgatccagcggaaggccgggtgggacgtgagcaagtacggcggcttcgggtcccccgtggtcgcctacgccgtggcgttcatctacgagaagggcaaggcccgcaagaaggccaaggccatcgaggggatcacgatcatgaagcagagcctgttcgagcaggaccccatcggcttcctctccaacaaggggtacagcaacgtgaccaagttcatcaagctgtccaagtacaccctgtacgagctcgagaacggccgccggcgcatggtcgcgagccacaaggaggcccagaaggccaactccttcatcctgccggagaagctggtgaccctcctgtaccacgcccagcactacgacgagatcgcccacaaggagagcttcgactacgtgaacgaccacctgtccgagttccgggagatcctcgaccaggtcatcgacttcagcaaccgctacaccatcgcggccaagaacacggagaagatcgccgagctgttcgagcagaaccaggagtccaccgtgcagagcctgtcccagagcttcatcaacctcatgcagctgaacgccatgggcgcccccgcggacttcaagttcttcgacgtgatcatcccccggaagcgctacccgagcctgaccgagatctgggagtccaccatcatctaccagagcatcacggggctccgggagacccgcacccggatggccaccctgtgggacggcgagcagtga

SEQ ID NO: 1542 - RNA, 3243 nt, synthetic construct
  misc_feature 1..3243: note = Cas9 variant
  source 1..3243: mol_type = other RNA
atgaagaccagcttcgccttcgacatcggcaccaacagcatcgggtggtgcgtgctggccctcgacaacgcgaacctgccctaccgcatcctggacgccggcgtccggatcttcagcgacgggcgcgagccgaagtccggcacgagcctcgccgaggggcggcgcctggcccggggcatgtcccgccggcgcgaccggtacaagcgccggcgcaaggccgtgatccggaccctgatcgagtacggcctcatgcccgacgaccccgcggcccgccgggccctggtggccgagaccaacgacaaggcgcccgggaagatcgccagcgacgtctacgccctgcgcgcccgggccctcgacgacaagctgccgctgcaccacatcggccgcgccctcttccacatcaaccagcggcgcgggttcaagtccaaccggaagaccgacaagcgcgacaacgaccagggcaagatcgccagcgggatctcccgcctgcgggacaagctggccagcgagggcatgcgcacgctcggcgagtacctgaaccaccggcaccaggccgggaactgggtgcgcgtgcggccctcccgcgtccccggcaaggacgacaaggaggaggacgggtacggcttctaccccgagcgggccctgctccaggacgagttcaacgcgatctggaccgcccaggccgcccactacccggacgtgctgaccgaggagcgccggacccacctggagacgatcatcttcttccagcgccccctcaagcccgtgcaggtcggcaagtgcagcttcaaccccggggaggagcggctgccgcgcgcccaccccctgttccaggagttccggctctacaaggaggtgaacgagctggagctggtggaccgcaaccaggaccaccacaagctctccctggaccagcgggacgcgctgatcgcccagctcaagacccagcgcgaggccgcctacagcgccctgcggaagaccgcgcgcgcgcccctgggcacccggttcaacaaggagacggagtcccgcaccaagatgaagggggacgaggtcgccgccgagctcagcgcgaagacccgcttcggccaggcctggatctccatgcccctggaggagcggtggatcatcgtggacaccctgcgccgggtggaggacccgctcgagctgacggcctggctggagcagcactacgggctcgacggcgagcacatcgacgccatcctggccgcgcgcctgcccgagggctacgggcggctcggcgagaccgccctgaccgagatcctggtcgagctcaaggccgccgtgatcagcgaggccgaggcggcccgccgggccgggtacgaccacgccctgctgcagcgcggcgccgggctcgaggcgctgcccaagtaccaggaggtgatcgcccggcgcatcccgcccggcaccggcaaccccgacgacccctacgacgtcgagaaggggcggatcacgaaccccaccgtgcacatcggcctgaaccagctgcagaaggtgctcaacgccctgatccgccggtacgggaagccggagcagatcgccatcgagctggcgcgcgagctcaagctgaacgacgagcagaagcgggagaagaacatcgagatcgcccgcaacacccgggccgccgagcagcgctccgccaagctggtcgagctcggcgtgcccgacaccgggtacaaccgggtgctgctgaagctctgggaggagctgaacctgcgcgcgcccgagaaccgggtctgcatctactgcggcgagcccatcaacatcgagaccctcttcagcagcgccgtggacatcgaccacatcctgccgtggtccaagacgctggacgacagccaggccaaccgcctcgtctgccacgtggcctgcaaccgccagaaggccaactacgcgcccgccgaggtgccccagtggcagggccggtacgacgacatcctggcccgcgccaacaccctgccgctcaacaagcggtggcgcttcgggcgggacgccatgaagaagttcgcggacgaggagaccttcctggcccgccagctgacggacacccagtacctctcccggctggcccacgcctacatggcggccctgtaccccgacgaggagcccgacgcccagggcgtcctcgcccgcaagaaccacgtgcgggtgatcaccgggcgcatgaccgagatgctgcggcgccagtggggcctgaacagcctcctggccgaccacaaccagaagaaccggaacgaccaccgccaccacgcgatcgacgccgccgtcgtgggcgtgacgacccgggccctgctccagcgcatcgccaccgtcgccgggggccgggaggcccaggccctggaggagaccatcgggaagatcgagcccccgtggcccggcttccgcgacgagctgcaggccgtgatcaagcggatcgtggtctcccacaagcccgaccacgggacgctccccaagccgggccagggcgggcagaccgccggccagctgcacaacgacaccgcgtacgggctgaccggcgagaccgacagccgcgggacgcccatcgtggtgcgccggaagcccttcacctccctcaccgagaaggacctgcccagcatccgcgaccggcagctggcccaggccctcggctccgccatcgccggccgcagcgggaaggagctgcaggcggccctggagcagttccgggaccgcgacgactacaagtccatccggcacgtccgcgtggtggagccgctcaacgtcatccccatccgggacggcaccgggcgcgcctacaaggcctacaagggcgacgcgaactaccggtacgacgtgtgggagctgcccaacgggaagtggatgcacgaggtggtcagcatgttcgacgcccacgaccgctcctggacgagcgccgtgcacatccaccaccccgccgcccggcgcgtgctgtccctcaagcagaacgacatggtcgcgtacgaccacccgcaggacggccccaccatcggccgggtggtgaagttcagccagtccgggcagatgaccttcgcgccccacaaggaggccggcgccctgaaggcccgcgacgcggaccccgaggaccggttccgctacttctacaagagcgggtccgccatgaaggacatcggcctgcggcaggtccgcgtggacgagatcgggcgggtgttcgacccgggcccccgcgacaaggaggcccgcaacgcccggaagaagaagtccaccgactga

SEQ ID NO: 1543 - RNA, 3243 nt, synthetic construct
  misc_feature 1..3243: note = Cas9 variant
  source 1..3243: mol_type = other RNA
atggccaagagcttcgccttcgacatgggcaccaactccatcgggtgggcggtgctgggcctcgacagcgccggggaccccgactccatcgagggcgccggggtccgcatcttcagcgacggccgggagccgaagtccggcgccagcctggccgaggggcgccggatcgcgcgcggcatgtcccggcgccgggagcgctacaaggcccggcgcaaggccctgatccggaccctcggggactacggcctgatgcccctggagcgcgccgcgcggcgcgccctcgtggccgagacgaacgaccggagcttcgggctggtggcccaggacgtctacgccctgcgcgcgcgggccctcgtggagaagctgccgccctaccacctgggccgcgccctcttccacctgaaccagcggcgcggcttcaagtccaaccggaagaccgacgggcgcgacaacgagctgggcatgatcgccaccgggatcgccgcgctcgacgcccagctgaacggccgcaccctgggccagtacctccacgagatgcgcggggccgacccccggcagcggggccaggtgcgcgtccggccccacctggagatcaacgacaaggggcgcgagatcgccgcctacggcttctacccccagcgggcgatgctggagcgcgagttcaacgccatctgggccgcccaggcgccccaccacccggagctcctgagcgaggagcggcgcgcccacctgttccaggtgatcttctaccagcggcccctcaagcagcccgaccccgggcgctgctccttcaacccggccgagccccggctggccaaggcccaccccctgttccagcgcttccggctcgtgaaggagatcaacgagctgcgcatcgtcacgggcagcaactcccagggcgtgcccctgaccctcgagcagcgggacatcctgctgaccctcctgcgcgacaagaaggcgagctccttcaagaccctgctcgccaagatcatcaaggggcagccggaggcccggttcaacaaggccagcgactcccgcgacaagatgaagggcgacgagctggccgcgacgatgagcgacaagacccgcttcgggcaggcctggttcgccatgcccgaggccgagcagtggcggatcatcgccaagctgcgcgacatcgacgaccccctcgagctgaacgcgtggctggagtccgagtacggcctcgcccccgagcggcgcgacgccgtggccaacgccctgctgccgcaggggtacggccggctcggcgagaccgcgctgcgcaccatgctggactacctcgaggccgccgtcatcagcgaggccgaggcggccgcccaggccgggtacgaccacgccctggcgcggcgcggcgccgggctggaccagctgcccaagtaccaggaggtgctcggccggcgcatcccgcccgggagcggcgagcccaacgacccctacgacatccggatgggccgcatctccaaccccacggtgcacatcgccctgaaccagctgcggcgcgtcgtgaacgccctcatccggaagtacgggaagcccgccgagatcgcgatcgagctggcccgcgacctgaagctcagcgaggagcagaagcgggaggtgaacgccaccatcgccaagaacacccgcgacgccgagcggcgcgcggtccggctggccgacgagggcatcgacaacaccgggcacaaccgcgccctgctccgcttctgggaggagctggccgcggacccgctggaccgggtgtgcgtgtactgcggcggcgggatcggcgccgcctccctcttcaacgggagcgtcgacatcgaccacatcctgccctggtcccgcacgctggacgacagccgggccaaccgcatcctcgtgcacaactcctgcaaccggctgaagcgcaacttcgcccccttcgaggtgccggagtggcgggagatctaccaggacatcctggtccgcgcggccaagctccccgccaacaagagctggcggttcgcccccgacgccatggaccgcttcgagggcgagaaggacttcctggcgcggcagctgaccgacacccagtacctcgcccgcatggcccacgagtacctggccgccctgtaccccgacgaggagccggacgagtggggcgtgttcgcgcgggggaaccacgtccgcgtggtgcccggccggctcaccgagatgctgcgccgggcctgggggctgaacgccatcctctccgacgacaaccgcaagaaccggaacgaccaccgccaccacgccatcgacgccgtcgtggtgggcgtcacgacccgcgacatgctgaacaagatcagccaggcggccgggcggggcgccgacatgggggccgcggacgccctgcgccggttcgacccgccctggccctccttccaccaggccgtgcgcgccgccgtggagcggatcctcgtcagccaccgcgcggaccacggcaccctgcccggcaccgacgggcagggctccacggccgggcagctgcacaacgacaccgcctacggcctcaccggggagacccggaagggcctggccgtggtggtccgccggaagccctacctgagcctcgagccccgcgacatcgagacgatccgggacccgcagctgcgcgaccacctggccaccgagacctacggcctcgcgggggccgagttcaccgccgccctgaagcggctgcagcagacggacaagttctacgccggcatccgccgggtgcgcgtgaccgaggcgctctccgtcatccccatccgggacgccaccgggcacgcctacaaggcctacaagggcgacgcgaacttccgctacgacgtgtgggagctgcccaacgggaagtgggtgcccgaggtcatcagcatgttcgacgcccacgaccggggctgggtgtcccaggtgcacgccgccaacccggccgcgcgccgggtcctgagcctccgccagaacgacatggtggcctaccagcaccccgagcagggcctggtgtacgggcgcgtcgtgaagttcggccagtccgggcagatgaccttcgccgcccaccacgagggcggcagcctcaagagccgggacgccgaccgcgacgaccccttcaagtacttctacaagtccgcggggacgatgaaggacatcggcctgcggcagatccgcgtggacgagatcgggcgggtccaggaccccggcccgcaggaccgcgacagcaagcgggtgcgcaagtccgaccggtga

SEQ ID NO: 1544 - RNA, 3246 nt, synthetic construct
  misc_feature 1..3246: note = Cas9 variant
  source 1..3246: mol_type = other RNA
atggccgccttcaagcccaacccgatcaactacatcctgggcctcgacatcgggatcgcgagcgtgggctgggccatggtcgagatcgacgaggacgagaaccccatctgcctgatcgacctgggggtgcgcgtgttcgagcgggccgaggtccccaagaccggcgactccctcgccatggcccgccggctggcgcgcagcgtgcggcgcctgacccggcgccgggcccaccgcctcctgcgggcccgccggctgctcaagcgcgagggggtgctgcaggccgcggacttcgacgagaacggcctgatcaagtccctccccaacacgccgtggcagctgcgggccgccgccctggaccgcaagctcacgcccctggagtggagcgccgtcctgctccacctgatcaagcaccggggctacctgtcccagcgcaagaacgagggggagaccgcggacaaggagctcggcgccctgctgaagggggtggccgacaacgcccacgccctccagaccggcgacttccggacccccgcgaagctggccctgaacaagttcgagaaggagagcgggcacatccgcaaccagcggggcgactactcccacaccttcagccgcaaggacctccaggccgagctgaacctcctgttcgagaagcagaaggagttcggcaacccccacatctccgacgggctgaaggagggcatcgagaccctgctcatgacccagcgcccggccctgagcggggacgccgtgcagaagatgctgggccactgcacgttcgagcccaccgagcccaaggcggccaagaacacctacaccgccgagcggttcgtctggctcacgaagctgaacaacctgcgcatcctcgagcagggctccgagcagcccctgaccgacacccagcgggccaagctgatggacgagccgtaccgcaagagcaagctcacctacgcccaggcgcggaagctgctggggctcgaggacacggccttcttcaagggcctgcgctacgggaaggacaacgccgaggcctccaccctgatggagatgaaggcgtaccacgccatcagccgggccctcgagaaggagggcctgaaggacaagaagtccccgctgaacctgagccccgagctccaggacgagatcgggaccgccttctccctgttcaagaccgacgaggacatcacgggccgcctgaaggaccgggtgcagcccgagatcctcgaggccctgctgaagcacatcagcttcgacaagttcgtgcagatctccctcaaggcgctgcgccggatcgtccccctgatggagcagggcaagcgctacaacgaggcctgcgccgagatctacggggaccactacggcaagaagaacaccgaggagaagatctacctcccgcccatccccgccgacgagatccggaaccccgtggtgctgcgcgccctgagccaggcgcggaaggtcatcaacggggtggtgcgccggtacggcagccccgcccgcatccacatcgagaccgcccgggaggtcgggaagtccttcaaggaccgcaaggagatcgagaagcgccaggaggagaaccggaaggaccgcgagaaggccgccgcgaagttccaggagtacttccccaacttcgtgggcgagcccaagagcaaggacatcctcaagctgcggctgtacgagcagcagcacggcaagtgcctctactccgggaaggagatcaacctgggccgcctgaacgagaaggggtacgtggagatcgaccacgccctcccgttcagccggacctgggacgactccttcaacaacaaggtcctggtgctgggcagcgagaaccagaacaaggggaaccagacgccctacgagtacttcaacggcaaggacaactcccgcgagtggcaggagttcaaggcccgggtggagaccagccgcttcccccggtccaagaagcagcgcatcctcctgcagaagttcgacgaggacggcttcaaggagcggaacctgaacgacacccgctacgtcaaccggttcctctgccagttcgtggccgaccgcatgcggctgaccgggaagggcaagaagcgcgtcttcgcgagcaacgggcagatcacgaacctgctccggggcttctggggcctgcgcaaggtgcgggccgagaacgaccgccaccacgccctggacgccgtggtcgtggcctgctccaccgtggcgatgcagcagaagatcacccggttcgtccgctacaaggagatgaacgccttcgacgggaagaccatcgacaaggagacgggcgaggtgctccaccagaagacccacttcccccagccgtgggagttcttcgcccaggaggtgatgatccgcgtcttcgggaagcccgacggcaagcccgagttcgaggaggccgacaccccggagaagctgcggaccctgctcgccgagaagctgagctcccgccccgaggcggtgcacgagtacgtgacgcccctgttcgtcagccgggcccccaaccgcaagatgtccgggcagggccacatggagaccgtcaagagcgccaagcggctcgacgagggcgtgtccgtgctgcgcgtgccgctgacccagctcaagctgaaggacctggagaagatggtgaaccgggagcgcgagcccaagctctacgaggccctgaaggcccggctggaggcgcacaaggacgaccccgccaaggccttcgccgagcccttctacaagtacgacaaggcggggaaccgcacccagcaggtcaaggccgtgcgggtggagcaggtccagaagaccggcgtgtgggtgcgcaaccacaacgggatcgccgacaacgccacgatggtccgggtggacgtgttcgagaagggcgacaagtactacctcgtcccgatctacagctggcaggtcgccaaggggatcctgcccgaccgcgcggtggtggcctacgccgacgaggaggactggaccgtgatcgacgagtccttccggttcaagttcgtgctgtacagcaacgacctcatcaaggtccagctgaagaaggacagcttcctgggctacttctccggcctcgaccgcgccaccggggccatcagcctgcgggagcacgacctggagaagtccaagggcaaggacgggatgcaccgcatcggcgtgaagaccgcgctcagcttccagaagtaccagatcgacgagatggggaaggagatccggccctgccgcctgaagaagcggcccccggtgcgctga

SEQ ID NO: 1545 - RNA, 3246 nt, synthetic construct
  misc_feature 1..3246: note = Cas9 variant
  source 1..3246: mol_type = other RNA
atggccgccttcaagcccaaccccatcaactacatcctgggcctcgacatcgggatcgcgagcgtgggctgggccatggtcgagatcgacgaggacgagaaccccatctgcctgatcgacctgggggtgcgcgtgttcgagcgggccgaggtccccaagaccggcgactccctcgccgccgcgcgccggctggcccgcagcgtgcggcgcctgacccggcgccgggcccaccgcctcctgcgggcccgccggctgctcaagcgcgagggggtgctgcaggcggccgacttcgacgagaacggcctgatcaagtccctccccaacacgccgtggcagctgcggagcgccgccctggaccgcaagctcacgcccctggagtggtccgccgtcctgctccacctgatcaagcaccggggctacctgagccagcgcaagaacgagggggagaccgcggacaaggagctcggcgccctgctgaagggggtggccgacaacgcccacgccctccagaccggcgacttccggacccccgcggagctggccctgaacaagttcgagaaggagtccgggcacatccgcaaccggcgcggcgactacagccacaccttctcccgcaaggacctccaggccgagctggacctcctgttcgagaagcagaaggagttcggcaacccccacatcagcgacgacctgaaggaggggatcgagaccctgctcatgacccagcggccggccctgtccggcgacgccgtgcagaagatgctggggcactgcacgttcgagcccaccgagcccaaggcggccaagaacacctacaccgccgagcgcttcgtctggctcacgaagctgaacaacctgcggatcctcgagcagggcagcgagcgccccctgaccgacaccgagcgggccaccctgatggacgagccgtaccgcaagtccaagctcacgtacgcccaggcgcggaagctgctggagctcgacgacaccgccttcttcaagggcctgcgctacgggaaggacaacgccgaggccagcaccctgatggagatgaaggcgtaccacgccatctcccgggccctcgagaaggagggcctgaaggacaagaagtccccgctgaacctgagccccgagctccaggacgagatcgggaccgccttcagcctgttcaagacggacgaggacatcaccggccgcctgaaggaccgggtgcagcccgagatcctcgaggtgctgctgaagcacatctccttcgacaagttcgtccagatcagcctcaaggccctgcgccggatcgtgcccctgatggagcaggggaagcgctacgacgaggcgtgcgccgagatctacggcgaccacgacggcaagaagaacaccgaggagaagatctacctcccgcccatccccgccgacgagatccggaaccccgtggtcctgcgcgccctgagccaggcccggaaggtgatcaacgcggtggtccgccggtacgggtcccccgcccgcatccacatcgagaccgcccgcgaggtgggcaagagcttcaaggaccggaaggagatcgagaagcgccaggaggagaaccggaaggaccgcgagaaggccgccgcgaagttccgggagtacttccccaacttcgtgggggagcccaagtccaaggacatcctcaagctgcgcctgtacgagcagcagcacggcaagtgcctctacagcgggaaggagatcaacctgggccggctgaacgagaagggctacgtcgagatcgaccacgccctcccgttctcccgcacgtgggacgacagcttcaacaacaaggtgctggtgctggggtccgagaaccagaacaagggcaaccagaccccctacgagtacttcaacgggaaggacaacagccgggagtggcaggagttcaaggcccgcgtcgagacctcccggttcccccgcagcaagaagcagcggatcctcctgcagaagttcgacgaggagggcttcaaggagcgcaacctgaacgacacccggtacgtgaaccgcttcctctgccagttcgtcgccgaccacatgctgctgacggggaagggcaagcggcgcgtgttcgcgtccaacggccagatcaccaacctcctgcgggggttctggggcctgcgcaaggtgcgggccgagaacaaccgccaccacgccctcgacgccgtcgtggtggcctgcagcaccgtcgcgatgcagcagaagatcacccgcttcgtgcggtacaaggagatgaacgccttcgacgggaagacgatcgacaaggagaccggcgaggtgctgcaccagaagacccacttcccccagccgtgggagttcttcgcccaggaggtcatgatccgcgtgttcggcaagcccgacgggaagcccgagttcgaggaggccgacaccccggagaagctgcggacgctcctggccgagaagctgtccagccgccccgaggcggtgcacgagtacgtcacgcccctcttcgtgtcccgggcccccaaccgcaagatgagcggccaggggcacatggagaccgtgaagtccgccaagcggctggacgagggcgtcagcgtgctgcgcgtgccgctcacccagctgaagctgaaggacctcgagaagatggtcaaccgggagcgcgagcccaagctgtacgaggccctgaaggcccggctcgaggcgcacaaggacgaccccgccaaggccttcgccgagcccttctacaagtacgacaaggcggggaaccgcacccagcaggtcaaggccgtgcgggtggagcaggtccagaagaccggcgtgtgggtgcgcaaccacaacggcatcgccgacaacgccaccatggtgcgggtggacgtcttcgagaaggccgggaagtactacctggtgccgatctactcctggcaggtcgcgaagggcatcctgcccgaccgcgccgtggtggcctacgccgacgaggaggggtggaccgtgatcgacgagagcttccggttcaagttcgtcctctacagcaacgacctgatcaaggtgcagctgaagaaggactccttcctcggctacttcagcgggctggaccgcgccaccggcgcgatctccctgcgggagcacgacctcgagaagtccaagggcaaggacgggatgcaccgcatcggcgtgaagacggccctgagcttccagaagtaccagatcgacgagatggggaaggagatccgcctgtgccggctcaagaagcgcccgcccgtccggtga

SEQ ID NO: 1546 - RNA, 3246 nt, synthetic construct
  misc_feature 1..3246: note = Cas9 variant
  source 1..3246: mol_type = other RNA
atgaccgccttcaagcccaaccccatcaactacatcctgggcctcgacatcgggatcgccagcgtgggctgggcgatggtcgagatcgacgaggaggagaaccccatccgcctgatcgacctgggggtgcgggtgttcgagcgcgccgaggtccccaagaccggcgactccctcgccgccgcccggcgcctggcgcggagcgtgcgccggctgacgcgccggcgcgcccaccggctcctgcgcgcccggcgcctgctcaagcgggagggggtgctgcaggccgcggacttcgacgagaacggcctgatcaagtccctccccaacaccccgtggcagctgcgcgccgccgccctggaccggaagctcacgcccctggagtggagcgccgtcctgctccacctgatcaagcaccgcggctacctgtcccagcggaagaacgagggggagaccgcggacaaggagctcggcgccctgctgaagggggtggccgacaacgcccacgccctccagaccggcgacttccgcacccccgcggagctggccgtgaacaagttcgagaaggagagcgggcacatccggaaccagcgcggcgactactcccacaccttcagccgcaaggacctgcaggccgagctcgtcctgctgttcgagaagcagaaggagttcggcaacccccacatctccgacgggctcaaggagggcatcgagaccctgctgatggcccagcggccggccctcagcggggacgcggtgcagaagatgctgggctactgcacgttcgagcccaccgagcccaaggccgccaagaacacctacaccgccgagcgcttcatctggctgacgaagctcaacaacctgcggatcctggagcagggctccgagcgccccctcaccgacaccgagcgggccaccctgatcgacatgccgtacaagaacaagctgacgtacgcgaaggcccgcgagctcctggggctggacgacaccgccttcttcaagggcctccggtacgggaaggacaacgccgagagcgcgaccctgatggagatgaaggcctaccacgccatccgccgggccctggagaaggagggcctcaaggacaagaagtccccgctgagcctgtcccccgagctgcaggacgagatcgggaccgccttcagcctcttcaagacggacgaggacatcaccggccgcctgaagggctgcctgcagcccgagatcctcgacgcgctgctgaagcacatcaacttcgacaagttcgtgcagatctccctcaaggccctgcggcgcatcgtccccctgatggagcaggggaagcggtacgacgaggcctgcgccgagacctacggcgaccactacggggagaagaacagcgaggagatgctctacctgccgcccatccccgccgacgagatccgcaaccccgtggtgctgcgggcgctctcccaggcccgcaaggtcatcaacggcgtggtgcggcgctacgggagccccgcccggatccacatcgagaccgcccgcgaggtcggcaagagcttcaaggaccgcaaggagatcgagaagcggcaggaggagaaccgcaaggaccgggagaaggccgcggccaagttccgcgagtacttccccaacttcgtgggcgagcccaagtccaaggacatcctgaagctgcggctctacgagcagcagcacgggaagtgcctgtacagcggcaaggccatcgacatccgccggctgaacgggaagggctacgtggagatcgaccacgccctcccgttctcccgcacgtgggacgacagcttcaacaacaaggtcctggtgctggggtccgagaaccagaacaagggcaaccggaccccctacgagtacctcaacggcaaggacaacagccgcgagtggctggagttcaaggcgcgggtggagacctcccgcttcccccacagcaagaagcagcgggtcctgctccagaagttcgacgagaaggggttcaaggagcgcaacctgaacgacacccggtacgtgaaccgcttcctgtgccagttcgtcgccgaccacatgcagctcacgggcaaggggaagcggcgcgtgttcgcctccaacggccagatcaccaacctgctgcggggcttctgggggctccacaaggtgcgcgccgagaacgaccggcaccacgccctggacgcggtcgtggtggcctgcagcaccgtcgccatgcagcagaagatcacgtgcttcgtgcgctacaaggagatgaacgccttcgacggcaagaccgtggacaaggagaccggggaggtcctgcaccagaagacccacttcccccagccgtgggagttcttcgcccaggaggtgatgatccgcgtgttcggcaagcccgacgggaagcccgagttcgaggaggcggacaccccggagaagctccgggccctgctggccgagaagctctccagccgccccgaggccgtccacgagtacgtgacgcccctgttcgtgtcccgggcccccaaccgcaagatgagcggcgcgcacaaggacaccctgcggtccgccaagcgcttcgtcaagcacaacgagaagatcagcgtgaagcgggtgtggctcaccgagatcaagctggccgacctggagaacatggtcaactacaagaacggccgcgagatcgagctctacgaggccctgaaggcgcggctgggggcctacggcgggaacgccaagcaggccttcgacccgaaggacaaccccttctacaagaagggcgggcagctcgtgaaggccgtgcgcgtcgagaagacccaggagtccggcgtgctgctgaacaagaagaacgcgtacaccatcgccgacaacggcgacatggtgcgggtcgacgtgttctgcaaggtggacaagaaggggaagaaccagtacttcatcgtccccatctacgcctggcaggtcgccgagaacatcctccccgacatcgactgcaagggctaccgcatcgacgacagctacacgttctgcttctccctgcacaagtacgacctgatcgccttccagaaggacgagaagtccaaggtggagttcgcgtactacatcaactgcgacagcagcaacgggcggttctacctcgcctggcacgacaagggcagcaaggagcagcagttccgcatctccacccagaacctggtgctgatgcagaagtaccagatcgacgagctcgggaaggagatccggccgtgccgcctgaagaagcggccgcccgtgcgctga

SEQ ID NO: 1547 - RNA, 3246 nt, synthetic construct
  misc_feature 1..3246: note = Cas9 variant
  source 1..3246: mol_type = other RNA
atggccgccttcaagcccaaccccatcaactacatcctgggcctcgacatcgggatcgcgagcgtgggctgggccatggtcgagatcgacgaggacgagaaccccatctgcctgatcgacctgggggtgcgcgtgttcgagcgggccgaggtccccaagaccggcgactccctcgccgccgcgcgccggctggcccgcagcgtgcggcgcctgacccggcgccgggcccaccgcctcctgcgggcccgccggctgctcaagcgcgagggggtgctgcaggcggccgacttcgacgagaacggcctgatcaagtccctccccaacacgccgtggcagctgcggagcgccgccctggaccgcaagctcacgcccctggagtggtccgccgtcctgctccacctgatcaagcaccggggctacctgagccagcgcaagaacgagggggagaccgcggacaaggagctcggcgccctgctgaagggggtggccaacaacgcccacgccctccagaccggcgacttccggacccccgcggagctggccctgaacaagttcgagaaggagtccgggcacatccgcaaccagcggggcgactacagccacaccttctcccgcaaggacctccaggccgagctgatcctcctgttcgagaagcagaaggagttcggcaacccccacgtgagcgggggcctgaaggaggggatcgagaccctgctcatgacccagcgcccggccctgtccggcgacgccgtccagaagatgctgggccactgcacgttcgagcccgcggagcccaaggccgccaagaacacctacaccgccgagcggttcatctggctcaccaagctgaacaacctgcgcatcctcgagcaggggagcgagcggcccctgacggacaccgagcgcgccaccctgatggacgagccgtaccggaagtccaagctcacctacgcgcaggcccgcaagctgctgggcctcgaggacacggccttcttcaaggggctgcggtacggcaaggacaacgccgaggcgagcaccctgatggagatgaaggcctaccacgccatctcccgcgccctcgagaaggaggggctgaaggacaagaagtccccgctgaacctgagccccgagctccaggacgagatcggcaccgccttcagcctgttcaagaccgacgaggacatcacgggccggctgaaggaccgcatccagcccgagatcctcgaggcgctgctgaagcacatctccttcgacaagttcgtgcagatcagcctcaaggccctgcggcgcatcgtgcccctgatggagcaggggaagcggtacgacgaggcctgcgccgagatctacggcgaccactacgggaagaagaacaccgaggagaagatctacctcccgcccatccccgccgacgagatccgcaaccccgtcgtgctgcgggcgctgagccaggcccgcaaggtgatcaacggcgtcgtgcggcgctacgggtcccccgcccggatccacatcgagaccgcccgcgaggtgggcaagagcttcaaggaccgcaaggagatcgagaagcggcaggaggagaaccgcaaggaccgggagaaggccgcggccaagttccgcgagtacttccccaacttcgtcggcgagcccaagtccaaggacatcctcaagctgcggctgtacgagcagcagcacgggaagtgcctctacagcggcaaggagatcaacctggggcgcctgaacgagaagggctacgtggagatcgaccacgccctcccgttctcccggacctgggacgacagcttcaacaacaaggtgctggtcctggggtccgagaaccagaacaagggcaaccagacgccctacgagtacttcaacggcaaggacaacagccgcgagtggcaggagttcaaggcccgggtggagacctcccgcttcccccggagcaagaagcagcgcatcctcctgcagaagttcgacgaggacgggttcaaggagcggaacctgaacgacacccgctacgtgaaccggttcctctgccagttcgtcgcggaccgcatgcggctgaccggcaaggggaagaagcgcgtgttcgcctccaacggccagatcacgaacctgctccggggcttctgggggctgcgcaaggtccgggccgagaacgaccgccaccacgccctggacgccgtggtggtcgcgtgcagcaccgtggccatgcagcagaagatcacccgcttcgtgcggtacaaggagatgaacgccttcgacggcaagaccatcgacaaggagacgggggaggtcctccaccagaagacccacttcccccagccgtgggagttcttcgcccaggaggtgatgatccgcgtgttcggcaagcccgacgggaagcccgagttcgaggaggccgacaccccggagaagctgcggaccctgctcgcggagaagctgtccagccgccccgaggccgtccacgagtacgtgacgcccctgttcgtgtcccgggcccccaaccgcaagatgagcggccagggccacatggagaccgtcaagtccgccaagcggctcgacgagggggtgagcgtgctgcgcgtcccgctgacccagctcaagctgaaggacctggagaagatggtgaaccgggagcgcgagcccaagctctacgaggccctgaaggcgcggctggaggcccacaaggacgaccccgccaaggccttcgcggagcccttctacaagtacgacaaggccggcaaccgcacccagcaggtcaaggccgtgcgggtggagcaggtccagaagaccggggtgtgggtgcgcaaccacaacggcatcgccgacaacgccacgatggtgcgggtcgacgtgttcgagaaggcggggaagtactacctcgtgccgatctactcctggcaggtcgccaagggcatcctgcccgaccgcgccgtggtggcctacgccgacgaggagggctggaccgtcatcgacgagagcttccggttcaagttcgtgctgtacagcaacgacctcatcaaggtgcagctgaagaaggactccttcctggggtacttcagcggcctcgaccgcgcgaccggggccatctccctgcgggagcacgacctggagaagtccaagggcaaggacgggatgcaccgcatcggcgtcaagaccgccctcagcttccagaagtaccagatcgacgagatgggcaaggagatccgcctgtgccggctgaagaagcgcccgcccgtgcggtga

SEQ ID NO: 1548 - RNA, 3246 nt, synthetic construct
  misc_feature 1..3246: note = Cas9 variant
  source 1..3246: mol_type = other RNA
atgctgaagcgcgtgctcggcatcgacgtcgggatcagctccatcggctgggccctgctggagttccagggggacatcgacaacaaggacctccccagcggcaagatcctggcctccggggtgcgggtgttcacccaggcggagaacccgaagaacggcgagagcctggccaagccccgccgggacgcccgcctcgcccggcgccggacccgccggcgcgcccagcggctgacggacatcaaggacctgttcttcaagtacaagctcgtcaccggcatctcccgcaacaagatcaacagcatctacaagaccgaggagaacaagaaggacccctggaccctgcggaaggaggcgctgtaccgcaagctcgacggggaggagttcgcccgggtgctgacgcacatcgccaagcaccgcggcttcaagtccatgcgcaagagcgaggaggaggggtccgacaccaaggccaaggagacccagcgggtgctgaccgagatcggcaagaacaaggacacgctcaagaccgggatctggcagaccgcgggcgagatgatcgccagccggcccaagggcgacgcccgccggaacaagaccgactcctacaagaacagcatctcccgcgagctgctgcaggacgagacgaagatcatcttcgagaagcagcgcgggatgaacagccagttcacctccgccgacctcgagaaggagtacagcgacatcgccttccaccaggcgccgatccagtccatgctgaagatggtcggcgggtgcaccttcgagaaggacgaggagggcaagcggctgaagcgcgcccccaagaacagctactccgccgaggtgttcaccgccctcacgaagatcaacaacctggtgctgaagaccaagaccgccaacatcaacgaccggttcctcaccacggaggagcgcaagaaggcgctggagctgtgccacagcaacgccaaggtcaccttcaagcagctccggggcgagctggggctgcccgaggactggatcttcaacaccgtggactacgccaagaagcccaagaagaccgccgtgaaggagacggagccggagagcgcctgcttcttccagatgcgcggctacaacgagatccggaagtccgtcgggaaggacctctggaccgagatcagcatgaagaaggagatcctgaactccatcgtgaccaccctggcgacggagaagtccgacgaggccatcaaggcccagctcaagaagtccgaggtgcccgacgagatcgccgagaaggtcctgggcctgaacttccgcgggttcctccacctgagcatcaaggccctggacaagatcatccccttcatgatggcgggcgacaagtacaccgacgcctgcgacaaggccggctacaaggagcagatcagcgggatcaagaagatcttcctccggaagctgaacgacgaggagaacgagcagatcaccaaccccgtggccaagcgcgcgatcacccagttccggaaggtgatcaacgccatcatccgcgagtacggcaagttcgaccagatgaacatcgagctggcccgggacctcgccaagagctacgacgaccgcaagaagatcaaggaggggcaggaggacttccgggccgagaaggaccgcgcggcccagcggtgcaaggacaacggcctggacccgaactccaaggacaacctgagcaagtaccgcctctgggagcagcaggacaacgggttctgcatctactgcggcaagcccatcgagctgcagcggctggccgagcagggctactgcgaggtcgaccacatcctcccctactcccgcagcctggacgactcccagcacaacaaggtgctggcccacatccacgacaaccagcagaagaagaaccagatccccttcgagcacttcgggggcgacgggccgaagtgggaggagttcgtgggccgcctgaacagccagttcaagaacctccccaagtccaagctgaaccggctggtcaagcgcaagttcgacgagaaggacatggaggggttcaaggagcggaacatcaacgacacgcgctacatcagccggttcatcaagaacttcgtggagaaccacctcgagttcgccgagtccgcgcagaagcagaaggtgttcgtccgcagcggctccctgaccgccttcctgcggcaccagtggggcctcatcaagaagcgcgacgagagcgaccggcaccacgccctggacgccctggtgaccgcctgcgcgacccaggccatggtcaagagcacggccatcaccgcccagaagatggagtcctacaactggatcaacaaggagaagccccgcatgcccctcccgtggctgaacttccgggacgacgtgcagaagtccctggacgcggtgttcgtcagccgcgcgccccggcacaaggtcgggggcgccgcccacaaggagaccatccgcagcatccggaagtgcggggaggagaacctcatcatcgagaagacgcccctggtggacatcgccaccaagtccggcatcaagctgaaggacatcgagaagctctacaagaaggagcagaaccgcaagctgtacgagaccctgaaggagcggctcgagcagaacggcaacgaccccgtgaaggccttcgggaacccggacgaccccgtgcgcatgcccaccaacgacctgaccaagaccggccccatcatcaagagcatcaagctgatcacgaacaagaagtccgggctcaacgtgcgggccggcatcgccgacaacggggagatcgcccgcctggacgtctacgagcggaagggcaagttctacctgatcccgaactacgtggccgacttcgcgaacaaggagctccccaagaaggccatcaaggccaacacccccgagaccgagtggccgatcatcgaccgcaactacaacttcaagttcagcctgttcaaggacgacctgatctccatcaagcagaagctcgacagccccgaggagttctactactacaagggccccgacgtgtccaccgccagcatcacggtcgagtccgtggaccgcaagcggctgtgggaggagaagaagaaggggaagatcgagaacgtgttccacacccgcatcggcaccaagaccctcaagagcttccggaagttcaacctggacatcctggggacgaaggcccccgtcgagatcaagaaggagacctgggtgggcgtgatccgcaagaacggggtcgcgaacaacaccggcaacaaggccatgtga

SEQ ID NO: 1549 - RNA, 3249 nt, synthetic construct
  misc_feature 1..3249: note = Cas9 variant
  source 1..3249: mol_type = other RNA
atggccgccttcaagcccaacccgatgaactacatcctgggcctcgacatcgggatcgcgagcgtgggctgggccatggtcgagatcgacaaggaggagaaccccatccgcctgatcgacctgggggtgcgggtgttcgagcgcgccgaggtccccaagaccggcgactccctcgccatggcccggcgcctggcgcggagcgtgcgccggctgacccgccggcgcgcccaccggctcctgcgcgcccggcgcctgctcaagcgggagggggtgctgcaggacgccgacttcgacgagaacggcctggtcaagtccctccccaacacgccgtggcagctgcgcgcggccgccctggaccggaagctcacctgcctggagtggagcgccgtgctgctccacctgatcaagcaccgcggctacctgtcccagcggaagaacgagggggagaccgccgacaaggagctcggcgcgctgctgaagggggtggccgacaacgcccacgccctccagaccggcgacttccgcacgcccgccgagctggcgctgaacaagttcgagaaggagagcgggcacatccggaaccagcgcggcgactactcccacaccttcagccgcaaggacctccaggccgagctgaacctgctcttcgagaagcagaaggagttctccaacccccacgtcagcgactccctgaaggagggcatcgagaccctgctcatggcccagcggcccgccctgagcggggacgccgtgcagaagatgctgggccactgcaccttcgagccggcggagcccaaggccgccaagaacacgtacaccgccgagcgcttcatctggctcaccaagctgaacaacctgcggatcctcgagcaggggtccgagcgccccctgaccgacacggagcgggccaccctgatggacgagccctaccgcaagagcaagctcacctacgcgcaggcccggaagctgctgggcctcgaggacaccgccttcttcaagggcctgcgctacgggaaggacaacgccgaggcgccgacgctgatggagatgaaggcctaccacgccatctcccgggccctcgagaaggagggcctgaaggacaagaagagccccctgaacctgtccaccgagctccaggacgagatcgggaccgccttcagcctgttcaagaccgacaaggacatcacgggccgcctgaaggaccgggtgcagcccgagatcctcgaggcgctgctgaagcacatctccttcgacaagttcgtccagatcagcctcaaggccctgcgccggatcgtgcccctgatggagcaggggaagcgctacgacgaggcctgcgccgagatctacggcgaccactactgcaagaagaacgccgaggagaagatctacctcccgcccatccccgcggacgagatccggaaccccgtggtcctgcgcgccctgagccaggcccggaaggtgatcaactgcgtggtccgccggtacggctccccggcccgcatccacatcgagaccgcccgcgaggtggggaagagcttcaaggaccggaaggagatcgagaagcgccaggaggagaaccggaaggaccgcgagaaggcggccgccaagttccgggagtacttccccaacttcgtgggcgagcccaagtccaaggacatcctcaagctgcgcctgtacgagcagcagcacgggaagtgcctctacagcggcaaggagatcaacctggtccggctgaacgagaaggggtacgtggagatcgaccacgccctccccttctcccgcacctgggacgacagcttcaacaacaaggtgctggtcctgggctccgagaaccagaacaagggcaaccagaccccgtacgagtacttcaacgggaaggacaacagccgggagtggcaggagttcaaggcgcgcgtggagacgtcccggttcccccgcagcaagaagcagcggatcctcctgcagaagttcgacgaggagggcttcaaggagcgcaacctgaacgacacccggtacgtcaaccgcttcctctgccagttcgtggccgaccacatcctgctgaccgggaagggcaagcggcgcgtgttcgcctccaacgggcagatcaccaacctcctgcggggcttctggggcctgcgcaaggtccgggccgagaacgaccgccaccacgccctcgacgcggtggtggtcgcctgcagcacggtggccatgcagcagaagatcacccgcttcgtgcggtacaaggagatgaacgccttcgacgggaagaccatcgacaaggagaccggcgaggtcctgcaccagaaggcccacttcccccagccctgggagttcttcgcgcaggaggtgatgatccgcgtgttcgggaagccggacggcaagcccgagttcgaggaggccgacacgcccgagaagctgcggaccctcctggccgagaagctgtccagccgcccggaggccgtccacgagtacgtgacccccctcttcgtgtcccgggcccccaaccgcaagatgagcggccaggggcacatggagaccgtcaagtccgcgaagcggctggacgagggcatcagcgtgctgcgcgtgcccctcacgcagctgaagctgaaggggctcgagaagatggtcaaccgggagcgcgagccgaagctgtacgacgccctgaaggcccagctcgagacccacaaggacaaccccgccaaggcgttcgccgagcccttctacaagtacgacaaggccggcaaccggacccagcaggtgaaggccgtgcgcatcgagcaggtccagaagaccggggtgtgggtgcggaaccacaacggcatcgccgacaacgcgaccatggtccgcgtggacgtgttcgagaagggcgggaagtactacctggtccccatctactcctggcaggtggccaagggcatcctgccggaccgggccgtggtcgccttcaaggacgaggaggactggacggtgatggacgacagcttcgagttccgcttcgtgctctacgccaacgacctgatcaagctgaccgcgaagaagaacgagttcctcgggtacttcgtcagcctgaaccgggccaccggcgccatcgacatccgcacccacgacacggactccaccaaggggaagaacggcatcttccagagcgtgggcgtgaagaccgccctgtccttccagaagaaccagatcgacgagctcgggaaggagatccggccctgccgcctgaagaagcgcccccccgtccggtga

SEQ ID NO: 1550 - RNA, 3249 nt, synthetic construct
  misc_feature 1..3249: note = Cas9 variant
  source 1..3249: mol_type = other RNA
atggccgccttcaagcccaacccgatcaactacatcctgggcctcgacatcgggatcgcgagcgtgggctgggccatggtcgagatcgacgaggaggagaaccccatccgcctgatcgacctgggggtgcgggtgttcgagcgcgccgaggtccccaagaccggcgactccctcgccatggcccggcgcctggcgcggagcgtgcgccggctgacccgccggcgcgcccaccggctcctgcgcgcccggcgcctgctcaagcgggagggggtgctgcaggccgcggacttcgacgagaacggcctgatcaagtccctccccaacacgccgtggcagctgcgcgccgccgccctggaccggaagctcacccccctggagtggagcgccgtcctgctccacctgatcaagcaccgcggctacctgtcccagcggaagaacgagggggagaccgcggacaaggagctcggcgccctgctgaagggggtggccaacaacgcccacgccctccagaccggcgacttccgcacgcccgcggagctggccctgaacaagttcgagaaggagagcgggcacatccggaaccagcgcggcgactactcccacaccttcagccgcaaggacctccaggccgagctgatcctgctcttcgagaagcagaaggagttcggcaacccccacgtgtccgggggcctgaaggaggggatcgagaccctgctcatgacccagcggccggccctgagcggcgacgccgtccagaagatgctgggccactgcacgttcgagcccgcggagcccaaggccgccaagaacacctacaccgccgagcgcttcatctggctcaccaagctgaacaacctgcggatcctcgagcaggggtccgagcgccccctgacggacaccgagcgggccaccctgatggacgagccgtaccgcaagagcaagctcacctacgcgcaggcccggaagctgctgggcctcgaggacacggccttcttcaaggggctgcgctacggcaaggacaacgccgaggcgtccaccctgatggagatgaaggcctaccacgccatcagccgggccctcgagaaggaggggctgaaggacaagaagtcccccctgaacctgagctccgagctccaggacgagatcggcaccgccttcagcctgttcaagaccgacgaggacatcacgggccgcctgaaggaccgggtgcagcccgagatcctcgaggcgctgctgaagcacatctccttcgacaagttcgtgcagatcagcctcaaggccctgcgccggatcgtccccctgatggagcaggggaagcgctacgacgaggcctgcgccgagatctacggcgaccactacgggaagaagaacaccgaggagaagatctacctcccgcccatccccgccgacgagatccggaaccccgtggtgctgcgcgcgctgagccaggcccggaaggtcatcaacggcgtggtgcgccggtacgggtccccggcccgcatccacatcgagaccgcccgcgaggtcggcaagagcttcaaggaccggaaggagatcgagaagcgccaggaggagaaccggaaggaccgcgagaaggccgcggccaagttccgggagtacttccccaacttcgtgggcgagcccaagtccaaggacatcctcaagctgcgcctgtacgagcagcagcacgggaagtgcctctacagcggcaaggagatcaacctggtgcggctgaacgagaaggggtacgtcgagatcgaccacgccctccccttctcccgcacctgggacgacagcttcaacaacaaggtgctggtgctgggctccgagaaccagaacaaggggaaccagacgccgtacgagtacttcaacggcaaggacaacagccgggagtggcaggagttcaaggcccgcgtcgagacctcccggttcccccgcagcaagaagcagcggatcctcctgcagaagttcgacgaggacggcttcaaggagtgcaacctgaacgacacccgctacgtgaaccggttcctctgccagttcgtcgcggaccacatcctgctgaccgggaagggcaagcgccgggtgttcgcctccaacgggcagatcacgaacctcctgcgcggcttctggggcctgcggaaggtgcgcgccgagaacgaccggcaccacgccctcgacgccgtcgtggtggcgtgcagcaccgtcgccatgcagcagaagatcacccgcttcgtgcgctacaaggagatgaacgccttcgacgggaagaccatcgacaaggagacgggcaaggtgctgcaccagaagacccacttcccccagccctgggagttcttcgcccaggaggtcatgatccgggtgttcgggaagccggacggcaagcccgagttcgaggaggccgacacccccgagaagctgcgcaccctcctggcggagaagctgtccagccggccggaggccgtgcacgagtacgtcacgcccctcttcgtgtcccgcgcccccaaccggaagatgagcgggcagggccacatggagaccgtgaagtccgccaagcgcctggacgagggcgtcagcgtgctgcgggtgcccctcacccagctgaagctgaaggacctcgagaagatggtcaaccgcgagcgggagccgaagctgtacgaggccctgaaggcgcgcctcgaggcccacaaggacgaccccgccaaggccttcgcggagcccttctacaagtacgacaaggccgggaaccggacccagcaggtgaaggccgtgcgcgtcgagcaggtgcagaagaccggcgtgtgggtccggaaccacaacgggatcgccgacaacgccacgatggtgcgcgtggacgtcttcgagaagggcgacaagtactacctggtgcccatctactcctggcaggtggcgaaggggatcctgccggaccgggccgtcgtgcagggcaaggacgaggaggactggcagctcatcgacgacagcttcaacttcaagttcagcctgcaccccaacgacctggtggaggtcatcaccaagaaggcccgcatgttcggctacttcgcctcctgccaccgggggaccggcaacatcaacatccgcatccacgacctcgaccacaagatcgggaagaacggcatcctggaggggatcggcgtgaagaccgccctgagcttccagaagtaccagatcgacgagctcggcaaggagatccggccctgccgcctgaagaagcgccccccggtgcggtga

SEQ ID NO: 1551 - RNA, 3249 nt, synthetic construct
  misc_feature 1..3249: note = Cas9 variant
  source 1..3249: mol_type = other RNA
atggccgccttcaagcccaacccgatcaactacatcctgggcctcgacatcgggatcgcgagcgtgggctgggccatggtcgagatcgacgaggacgagaaccccatctgcctgatcgacctgggggtgcgcgtgttcgagcgggccgaggtccccaagaccggcgactccctcgccatggcccgccggctggcgcgcagcgtgcggcgcctgacccggcgccgggcccaccgcctcctgcgggcccgccggctgctcaagcgcgagggggtgctgcaggccgcggacttcgacgagaacggcctgatcaagtccctccccaacacgccgtggcagctgcgggccgccgccctggaccgcaagctcacgcccctggagtggagcgccgtcctgctccacctgatcaagcaccggggctacctgtcccagcgcaagaacgagggggagaccgcggacaaggagctcggcgccctgctgaagggggtggccgacaacgcccacgccctccagaccggcgacttccggacccccgcggagctggccctgaacaagttcgagaaggagagcgggcacatccgcaaccagcggggcgactactcccacaccttcagccgcaaggacctccaggccgagctgatcctcctgttcgagaagcagaaggagttcggcaacccccacgtgtccgggggcctgaaggaggggatcgagaccctgctcatgacccagcgcccggccctgagcggcgacgccgtccagaagatgctgggccactgcacgttcgagcccgcggagcccaaggccgccaagaacacctacaccgccgagcggttcatctggctcaccaagctgaacaacctgcgcatcctcgagcaggggtccgagcggcccctgacggacaccgagcgcgccaccctgatggacgagccgtaccgcaagagcaagctcacctacgcgcaggcccggaagctgctgggcctcgaggacacggccttcttcaaggggctgcggtacggcaaggacaacgccgaggcgtccaccctgatggagatgaaggcctaccacgccatcagccgcgccctcgagaaggaggggctgaaggacaagaagtccccgctgaacctgagccccgagctccaggacgagatcggcaccgccttctccctgttcaagaccgacgaggacatcacgggccggctgaaggaccgcatccagcccgagatcctcgaggcgctgctgaagcacatcagcttcgacaagttcgtgcagatctccctcaaggccctgcggcgcatcgtgcccctgatggagcaggggaagcggtacgacgaggcctgcgccgagatctacggcgaccactacgggaagaagaacaccgaggagaagatctacctcccgcccatccccgccgacgagatccgcaaccccgtcgtgctgcgggcgctgagccaggcccgcaaggtgatcaacggcgtcgtgcggcgctacgggagccccgcccggatccacatcgagaccgcccgcgaggtgggcaagtccttcaaggaccgcaaggagatcgagaagcggcaggaggagaaccgcaaggaccgggagaaggccgcggccaagttccgcgagtacttccccaacttcgtcggcgagcccaagagcaaggacatcctcaagctgcggctgtacgagcagcagcacgggaagtgcctctactccggcaaggagatcaacctggggcgcctgaacgagaagggctacgtggagatcgaccacgccctcccgttcagccggacctgggacgactccttcaacaacaaggtgctggtcctggggagcgagaaccagaacaagggcaaccagacgccctacgagtacttcaacggcaaggacaactcccgcgagtggcaggagttcaaggcccgggtggagaccagccgcttcccccggtccaagaagcagcgcatcctcctgcagaagttcgacgaggacgggttcaaggagcggaacctgaacgacacccgctacgtgaaccggttcctctgccagttcgtcgcggaccgcatgcggctgaccggcaaggggaagaagcgcgtgttcgccagcaacggccagatcacgaacctgctccggggcttctgggggctgcgcaaggtccgggccgagaacgaccgccaccacgccctggacgccgtggtggtcgcgtgctccaccgtggccatgcagcagaagatcacccgcttcgtgcggtacaaggagatgaacgccttcgacggcaagaccatcgacaaggagacgggggaggtcctccaccagaagacccacttcccccagccgtgggagttcttcgcccaggaggtgatgatccgcgtgttcggcaagcccgacgggaagcccgagttcgaggaggccgacaccccggagaagctgcggaccctgctcgcggagaagctgagctcccgccccgaggccgtccacgagtacgtgacgcccctgttcgtgagccgggcccccaaccgcaagatgtccggccagggccacatggagaccgtcaagagcgccaagcggctcgacgagggggtgtccgtgctgcgcgtcccgctgacccagctcaagctgaaggacctggagaagatggtgaaccgggagcgcgagcccaagctctacgaggccctgaaggcgcggctggaggcccacaaggacgaccccgccaaggccttcgcggagcccttctacaagtacgacaaggccggcaaccgcacccagcaggtcaaggccgtgcgggtggagcaggtccagaagaccggggtgtgggtgcgcaaccacaacggcatcgccgacaacgccacgatggtgcgggtcgacgtgttcgagaagggggacaagtactacctcgtgccgatctacagctggcaggtcgcgaagggcatcctgcccgaccgcgccgtggtgcagggcaaggacgaggaggactggcagctgatcgacgactccttcaacttcaagttcagcctccaccccaacgacctggtcgaggtgatcaccaagaaggcccggatgttcgggtacttcgccagctgccaccgcggcaccgggaacatcaacatccggatccacgacctggaccacaagatcggcaagaacgggatcctcgagggcatcggcgtgaagaccgccctgtccttccagaagtaccagatcgacgagctgggggaggagatccgcccctgccgcctcaagaagcggccgcccgtccgctga

SEQ ID NO: 1552 - RNA, 3249 nt, synthetic construct; identical to SEQ ID NO: 1390
  misc_feature 1..3249: note = Cas9 variant
  source 1..3249: mol_type = other RNA

SEQ ID NO: 1553 - RNA, 3249 nt, synthetic construct
  misc_feature 1..3249: note = Cas9 variant
  source 1..3249: mol_type = other RNA
atggccgccttcaagcccaacccgatcaactacatcctgggcctcgacatcgggatcgcgagcgtgggctgggccatggtcgagatcgacgaggacgagaaccccatctgcctgatcgacctgggggtgcgcgtgttcgagcgggccgaggtccccaagaccggcgactccctcgccgccgcgcgccggctggcccgcagcgtgcggcgcctgacccggcgccgggcccaccgcctcctgcgggcccgccggctgctcaagcgcgagggggtgctgcaggcggccgacttcgacgagaacggcctgatcaagtccctccccaacacgccgtggcagctgcgggccgccgccctggaccgcaagctcacgcccctggagtggagcgcggtcctgctccacctgatcaagcaccggggctacctgtcccagcgcaagaacgagggggagaccgccgacaaggagctcggcgccctgctgaagggggtggccgacaacgcccacgcgctccagaccggcgacttccggacccccgccgagctggccctgaacaagttcgagaaggagagcgggcacatccgcaaccagcggggcgactactcccacaccttcagccgcaaggacctccaggccgagctgatcctcctgttcgagaagcagaaggagttcggcaacccccacgtgtccgggggcctgaaggaggggatcgagaccctgctcatgacccagcgcccggccctgagcggcgacgcggtccagaagatgctgggccactgcacgttcgagcccgccgagcccaaggccgccaagaacacctacaccgccgagcggttcatctggctcaccaagctgaacaacctgcgcatcctcgagcaggggtccgagcggcccctgacggacaccgagcgcgcgaccctgatggacgagccgtaccgcaagagcaagctcacctacgcccaggcccggaagctgctgggcctcgaggacacggccttcttcaaggggctgcggtacggcaaggacaacgcggaggcctccaccctgatggagatgaaggcctaccacgccatcagccgcgccctcgagaaggaggggctgaaggacaagaagtccccgctgaacctgagccccgagctccaggacgagatcggcaccgcgttctccctgttcaagaccgacgaggacatcacgggccggctgaaggaccgcgtgcagcccgagatcctcgaggccctgctgaagcacatcagcttcgacaagttcgtgcagatctccctcaaggccctgcggcgcatcgtccccctgatggagcaggggaagcggtacgacgaggcctgcgccgagatctacggcgaccactacgggaagaagaacaccgaggagaagatctacctcccgcccatccccgcggacgagatccgcaaccccgtggtgctgcgggccctgagccaggcccgcaaggtcatcaacggcgtggtgcggcgctacgggagccccgcccggatccacatcgagaccgcccgcgaggtcggcaagtccttcaaggaccgcaaggagatcgagaagcggcaggaggagaaccgcaaggaccgggagaaggcggccgccaagttccgcgagtacttccccaacttcgtgggcgagcccaagagcaaggacatcctcaagctgcggctgtacgagcagcagcacgggaagtgcctctactccggcaaggagatcaacctggggcgcctgaacgagaagggctacgtggagatcgaccacgccctcccgttcagccggacctgggacgactccttcaacaacaaggtcctggtgctggggagcgagaaccagaacaagggcaaccagacgccctacgagtacttcaacggcaaggacaactcccgcgagtggcaggagttcaaggcgcgggtggagaccagccgcttcccccggtccaagaagcagcgcatcctcctgcagaagttcgacgaggacgggttcaaggagcggaacctgaacgacacccgctacgtcaaccggttcctctgccagttcgtggccgaccgcatgcggctgaccggcaaggggaagaagcgcgtcttcgccagcaacggccagatcacgaacctgctccggggcttctgggggctgcgcaaggtgcgggccgagaacgaccgccaccacgccctggacgcggtggtcgtggcctgctccaccgtggccatgcagcagaagatcacccgcttcgtccggtacaaggagatgaacgccttcgacggcaagaccatcgacaaggagacgggggaggtgctccaccagaagacccacttcccccagccgtgggagttcttcgcccaggaggtgatgatccgcgtcttcggcaagcccgacgggaagcccgagttcgaggaggcggacaccccggagaagctgcggaccctgctcgccgagaagctgagctcccgccccgaggccgtgcacgagtacgtgacgcccctgttcgtcagccgggcccccaaccgcaagatgtccggccagggccacatggagaccgtcaagagcgccaagcggctcgacgagggggtgtccgtgctgcgcgtgccgctgacccagctcaagctgaaggacctggagaagatggtgaaccgggagcgcgagcccaagctctacgaggcgctgaaggcccggctggaggcccacaaggacgaccccgccaaggcgttcgccgagcccttctacaagtacgacaaggccggcaaccgcacccagcaggtcaaggccgtgcgggtggagcaggtccagaagaccggggtgtgggtgcgcaaccacaacggcatcgccgacaacgcgacgatggtccgggtggacgtgttcgagaagggggacaagtactacctcgtcccgatctacagctggcaggtcgccaagggcatcctgcccgaccgcgccgtggtgcagggcaaggacgaggaggactggcagctgatcgacgactccttcaacttcaagttcagcctccaccccaacgacctggtggaggtgatcaccaagaaggcccggatgttcgggtacttcgccagctgccaccgcggcaccgggaacatcaacatccggatccacgacctggaccacaagatcggcaagaacgggatcctcgagggcatcggcgtcaagaccgcgctgtccttccagaagtaccagatcgacgagctggggaaggagatccgcccctgccgcctcaagaagcggccgcccgtgcgctga

SEQ ID NO: 1554 - RNA, 3249 nt, synthetic construct
  misc_feature 1..3249: note = Cas9 variant
  source 1..3249: mol_type = other RNA
atggccgccttcaagcccaacccgatcaactacatcctgggcctcgacatcgggatcgcgagcgtgggctgggccatggtcgagatcgacgaggaggagaaccccatccgcctgatcgacctgggggtgcgggtgttcgagcgcgccgaggtccccaagaccggcgactccctcgccatggcccggcgcctggcgcggagcgtgcgccggctgacccgccggcgcgcccaccggctcctgcgcacgcggcgcctgctcaagcgggagggggtgctgcaggccgccaacttcgacgagaacggcctgatcaagtccctccccaacaccctgtggcagctgcgcgcggccgccctcgaccggaagctgaccccgctggagtggagcgccgtcctcctgcacctgatcaagcaccgcggctacctctcccagcggaagaacgagggggagaccgccgacaaggagctgggcgcgctgctcaagggggtggccggcaacgcccacgccctgcagacgggggacttccgcacccccgccgagctggcgctcaacaagttcgagaaggagagcggccacatccggaaccagcgcggcgactactcccacaccttcagccgcaaggacctgcaggccgagctgaacctcctgttcgagaagcagaaggagttcgggaacccccacatctccgacggcctgaaggaggggatcgagaccctcctgatgacgcagcggcccgccctgagcggcgacgccgtgcagaagatgctcggccactgcaccttcgagccgaccgagcccaaggccgcgaagaacacctacacgaccgagcgcttcatctggctgaccaagctgaacaacctccggatcctggagcaggggtccgagcgccccctgaccgacacggagcgggccaccctcatggacgagccctaccgcaagagcaagctgacctacgcccaggcccggaagctgctcgagctggacgacatcgccttcttcaagggcctgcgctacgggaaggacaacgcggaggcctccaccctcatggagatgaaggcctaccacgccatcagccgggcgctggagaaggagggcctgaaggacaagaagtccccgctgaacctcagccccgagctgcaggacgagatcgggacggccttctccctgttcaagaccgacgaggacatcaccggccgcctcaaggaccggatccagcccgagatcctggaggccctgctcaagcacatcaacttcgacaagttcgtccagatcagcctgaaggccctgcgccggatcgtgcccctcatggagcagggcaagcgctacgacgaggcctgcgcggagatctacggggaccactacggcaagaagaacaccgaggagaagatcgacctgccgcccatccccgccgacgagatccacaaccccgtggtcctgcgggccctctcccaggcccgcaaggtgatcaacggggtggtccggcgctacggcagcccggcccggatccacatcgagacggcgcgcgaggtgggcaagagcttcaaggaccgcaaggagatcgagaagcggcaggaggagaaccgcaaggaccgggagaaggccgccgccaagttccgcgagtacttccccaacttcgtgggggagcccaagtccaaggacatcctgaagctgcggctctacgagcagcagcacggcaagtgcctgtacagcgggaaggagatcaacctgggccgcctcaacgagaaggggtacgtcgagatcgaccacgccctgcccttctcccggacctgggacgacagcttcaacaacaaggtgctggtgctcggctccgagaaccagaacaaggggaaccagaccccgtacgagtacttcaacggcaaggacaacagccgcgagtggcaggagttcaaggcgcgggtcgagacctcccgcttcccccggagcaagaagcagcgcatcctgctgcagaagttcgacgaggacggcttcaaggagcggaacctcaacgacacgcgctacgtgaaccggttcctgtgccagttcgtggccgaccgcatgcggctgaccgggaagggcaagaagcgcgtcttcgcctccaacgggcagatcaccaacctcctgcggggcttctggggcctgcgcaaggtgcgggccgagaacgaccgccaccacgcgctcgacgccgtcgtggtggcctgcagcaccgtcgccatgcagcagaagatcacgcgcttcgtgcggtacaaggagatgaacgccttcgacgggaagaccatcgacaaggagaccggcgaggtgctgcaccagaagacccacttcccccagccctgggagttcttcgcgcaggaggtcatgatccgcgtgttcgggaagccggacggcaagcccgagttcgaggaggccgacacgcccgagaagctgcggaccctcctgaccgagaagctgtccagccgcccggaggccgtgcacgagtacgtcacgcccctcttcgtgtcccgggcccccaaccgcaagatgagcgggcagggccacatggagaccgtgaagtccgccaagcggctggacgagggcatcagcgtcctgcgcgtgcccctcacccagctgaagctgaaggacctcgagaagatggtgaaccgggagcgcgagccgaagctgtacgaggcgctgaaggcccggctcgaggcccacaaggacgaccccgccaaggccttcgcggagcccttctacaagtacgacaaggccgggaaccgcacccagcaggtcaaggccatgcgggtggagcaggtccagaagaccggcgtgtgggtgcgcaaccacaacgggatcgccgacaacgcgaccatggtgcgggtcgacgtgttcgagaagggcgacaagtactacctggtgcccatctactcctggcaggtcgccaaggggatcctgccggaccgcgccgtggtgcagggcaaggacgaggaggactggcagctcatcgacgacagcttcaacttcaagttctccctgcaccccaacgacctggtcgaggtgatcacgaagaaggcccggatgttcggctacttcgccagctgccaccgcgggaccggcaacatcaacatccggatccacgacctcgaccacaagatcgggaagaacggcatcctggaggggatcggcgtgaagaccgcgctgagcttccagaagtaccagatcgacgagctcggcaaggagatccgcccctgccgcctgaagaagcggcccccggtccgctga

SEQ ID NO: 1555 - RNA, 3249 nt, synthetic construct
  misc_feature 1..3249: note = Cas9 variant
  source 1..3249: mol_type = other RNA
atggccgccttcaagcccaacccgatcaactacatcctgggcctcgacatcgggatcgcgagcgtgggctgggccatggtcgagatcgacgaggacgagaaccccatctgcctgatcgacctgggggtgcgcgtgttcgagcgggccgaggtccccaagaccggcgactccctcgccatggcccgccggctggcgcgcagcgtgcggcgcctgacccggcgccgggcccaccgcctcctgcgggcccgccggctgctcaagcgcgagggggtgctgcaggccgcggacttcgacgagaacggcctgatcaagtccctccccaacacgccgtggcagctgcgggccgccgccctggaccgcaagctcacgcccctggagtggagcgccgtcctgctccacctgatcaagcaccggggctacctgtcccagcgcaagaacgagggggagaccgcggacaaggagctcggcgccctgctgaagggggtggccgacaacgcccacgccctccagaccggcgacttccggacccccgcggagctggccctgaacaagttcgagaaggagagcgggcacatccgcaaccagcggggcgactactcccacaccttcagccgcaaggacctccaggccgagctgaacctcctgttcgagaagcagaaggagttcggcaacccccacatctccgacgggctgaaggagggcatcgagaccctgctcatgacccagcgcccggccctgagcggggacgccgtgcagaagatgctgggccactgcacgttcgagcccgcggagcccaaggccgccaagaacacctacaccgccgagcggttcatctggctcaccaagctgaacaacctgcgcatcctcgagcagggctccgagcggcccctgacggacaccgagcgcaccaccctgatcgacgagccgtaccgcaagagcaagctcacgtacgcccaggcgcggaagctgctggagctcgacaacaccgccttcttcaaggggctgcggtacggcaaggacaacgccgaggcctccaccctgatggagatgaaggcgtaccacgccatcagccgcgccctcgagaaggaggggctgaaggacaagaagtccccgctgaacctgagccccgagctccaggacgagatcggcaccgccttctccctgttcaagacggacgaggacatcaccgggcggctgaaggaccgcgtccagcccgagatcctcgaggccctgctgaagcacatcagcttcgacaagttcgtgcagatctccctcaaggcgctgcggcgcatcgtgcccctgatggagcagggcaagcggtacgacgaggcctgcgccgagatctacggcgaccactacgggaagaagaacaccgaggagaagatcgacctcccgcccatccccgccgacgagatccgcaaccccgtcgtgctgcgggccctgagccaggcgcgcaaggtgatcaacggcgtcgtgcggcgctacgggagccccgcccggatccacatcgagaccgcccgcgaggtgggcaagtccttcaaggaccgcaaggagatcgagaagcggcaggaggagaaccgcaaggaccgggagaaggccgccacgaagttccgcgagtacttccccaacttcgtcggggagcccaagagcaaggacatcctcaagctgcggctgtacgagcagcagcacggcaagtgcctctactccggcaaggagatcaacctggggcgcctgaacgagaagggctacgtggagatcgaccacgcgctcccgttcagccggacctgggacgactccttcaacaacaaggtgctggtcctggggagcgagaaccagaacaagggcaaccagaccccctacgagtacttcaacgggaaggacaactcccgcgagtggcaggagttcaaggcccgggtggagaccagccgcttcccccggtccaagaagcagcgcatcctcctgcagaagttcgacgaggagggcttcaaggagcggaacctgaacgacacgcgctacgtgaaccggttcctctgccagttcgtcgccgaccacatgctgctgaccggcaaggggaagcgccgggtgttcgccagcaacggccagatcaccaacctcctgcgcgggttctggggcctgcggaaggtccgcgcggagaacgaccggcaccacgccctcgacgccgtggtggtcgcctgctccaccgtggccatgcagcagaagatcacgcgcttcgtgcgctacaaggagatgaacgcgttcgacggcaagaccatcgacaaggagaccggggaggtcctgcaccagaagacccacttcccccagccgtgggagttcttcgcccaggaggtgatgatccgggtgttcggcaagcccgacgggaagcccgagttcgaggaggccgacacgccggagaagctgcgcaccctcctggccgagaagctgagctcccggcccgaggccgtccacgagtacgtgacgcccctcttcgtgagccgcgcgcccaaccggaagatgtccggccaggggcacatggagaccgtcaagagcgccaagcgcctggacgagggcgtgtccgtgctgcgggtcccgctcacccagctgaagctgaaggacctcgagaagatggtgaaccgcgagcgggagcccaagctgtacgaggccctgaaggcccgcctcgaggcccacaaggacgaccccgcgaaggccttcgccgagcccttctacaagtacgacaaggccggcaaccggacccagcaggtcaaggcggtgcgcgtggagcaggtccagaagaccggggtgtgggtgcggaaccacaacggcatcgccgacaacgccaccatggtgcgcgtcgacgtgttcgagaagggggacaagtactacctggtgccgatctacagctggcaggtcgccaagggcatcctgcccgaccgggccgtggtgcaggggaaggacgaggaggactggcagctcatcgacgactccttcaacttcaagttcagcctgcaccccaacgacctggtcgaggtgatcaccaagaaggcgcgcatgttcggctacttcgccagctgccaccggggcacggggaacatcaacatccgcatccacgacctcgaccacaagatcggcaagaacgggatcctggagggcatcggggtgaagaccgccctgtccttccagaagtaccagatcgacgagctcggcaaggagatccggccctgccgcctgaagaagcgcccgcccgtccggtga

SEQ ID NO: 1556 - RNA, 3249 nt, synthetic construct
  misc_feature 1..3249: note = Cas9 variant
  source 1..3249: mol_type = other RNA
atggccgccttcaagcccaacccgatgaactacatcctgggcctcgacatcgggatcgcgagcgtgggctgggccatcgtcgagatcgacgaggaggagaaccccatccgcctgatcgacctgggggtgcgcgtgttcgagcgcgccgaggtccccaagaccggcgactccctcgccgccgcgcggcgcctggcccggagcgtgcgccggctgacccgccggcgcgcccaccggctcctgcgcgcccggcgcctgctcaagcgggagggggtgctgcaggcggccgacttcgacgagaacggcctgatcaagtccctccccaacacgccgtggcagctgcgcgccgccgccctggaccggaagctcacgcccctggagtggagcgcggtcctgctccacctgatcaagcaccgcggctacctgtcccagcggaagaacgagggggagaccgccgacaaggagctcggcgccctgctgaagggggtggccgacaacacccacgccctccagaccggcgacttccgcacccccgcggagctggccctgaacaagttcgagaaggagagcgggcacatccggaaccagcgcggcgactactcccacaccttcaaccgcaaggacctccaggccgagctgaacctcctgttcgagaagcagaaggagttcggcaacccccacgtgagcgacgggctgaaggagggcatcgagaccctgctcatgacgcagcggccggccctgtccggggacgccgtccagaagatgctgggccactgcaccttcgagcccaccgagcccaaggcggccaagaacacctacacggccgagcgcttcgtgtggctcaccaagctgaacaacctgcggatcctcgagcagggcagcgagcgccccctgaccgacaccgagcgggccacgctgatggacgagccgtaccgcaagtccaagctcacctacgcccaggcgcggaagctgctggacctcgacgacaccgccttcttcaaggggctgcgctacggcaaggacaacgccgaggccagcaccctgatggagatgaaggcgtaccacgccatctcccgggccctcgagaaggaggggctgaaggacaagaagtccccgctgaacctgagccccgagctccaggacgagatcggcacggccttcagcctgttcaagaccgacgaggacatcaccgggcgcctgaaggaccgggtgcagcccgagatcctcgaggccctgctgaagcacatctccttcgacaagttcgtccagatcagcctcaaggcgctgcgccggatcgtgcccctgatggagcagggcaaccgctacgacgaggcctgcaccgagatctacggcgaccactacgggaagaagaacacggaggagaagatctacctcccgcccatccccgccgacgagatccggaaccccgtggtcctgcgcgccctgtcccaggcccggaaggtgatcaacggcgtggtccgccggtacgggagccccgcgcgcatccacatcgagaccgcccgcgaggtgggcaagagcttcaaggaccggaaggagatcgagaagcgccaggaggagaaccggaaggaccgcgagaagtccgccgccaagttccgggagtacttccccaacttcgtgggggagcccaagagcaaggacatcctcaagctgcgcctgtacgagcagcagcacggcaagtgcctctactccggcaaggagatcaacctggggcggctgaacgagaagggctacgtcgagatcgaccacgccctcccgttcagccgcacctgggacgactccttcaacaacaaggtgctggcgctggggagcgagaaccagaacaagggcaaccagaccccctacgagtacttcaacgggaaggacaactcccgggagtggcaggagttcaaggcccgcgtggagacgagccggttcccccgctccaagaagcagcggatcctcctgcagaagttcgacgaggacggcttcaaggagcgcaacctgaacgacacccggtacatcaaccgcttcctctgccagttcgtcgccgaccacatgctgctgaccggcaaggggaagcggcgcgtgttcgccagcaacggccagatcaccaacctcctgcgggggttctggggcctgcgcaaggtccgggcggagaacgaccgccaccacgccctcgacgccgtggtggtcgcctgctccacgatcgccatgcagcagaagatcacccgcttcgtgcggtacaaggagatgaacgcgttcgacggcaagaccatcgacaaggagaccggggaggtgctgcaccagaaggcccacttcccccagccgtgggagttcttcgcccaggaggtcatgatccgcgtgttcggcaagcccgacgggaagcccgagttcgaggaggccgacacgccggagaagctgcggaccctcctggccgagaagctgagctcccgccccgaggcggtgcacaagtacgtcacgcccctcttcatcagccgggcccccaaccgcaagatgtccggccaggggcacatggagaccgtcaagagcgccaagcggctggacgagggcatctccgtgctgcgcgtgccgctcacccagctgaagctgaaggacctcgagaagatggtgaaccgggagcgcgagcccaagctgtacgaggccctgaaggcccggctcgaggcgcacaaggacgaccccgccaaggccttcgccgagcccttctacaagtacgacaaggcgggcaaccgcacccagcaggtcaaggccgtgcgggtggagcaggtccagaagaccggggtgtgggtgcacaaccacaacggcatcgccgacaacgccaccatcgtgcgcgtcgacgtgttcgagaagggcgggaagtactacctggtgccgatctacagctggcaggtcgccaaggggatcctgcccgaccgggcggtggtgcagggcaaggacgaggaggactggaccgtcatggacgactccttcgagttcaagttcgtgctctacgccaacgacctgatcaagctgacggccaagaagaacgagttcctcggctacttcgtgagcctgaaccgcgccaccggggccatcgacatccggacccacgacaccgacagcacgaagggcaagaacgggatcttccagtccgtcggcgtgaagaccgcgctgagcttccagaagtaccagatcgacgagctcgggaaggagatccgcccctgccggctgaagaagcggcccccggtgcgctga

SEQ ID NO: 1557 - RNA, 3249 nt, synthetic construct
  misc_feature 1..3249: note = Cas9 variant
  source 1..3249: mol_type = other RNA
atggccgccttcaagcccaacagcatcaactacatcctgggcctcgacatcgggatcgcgtccgtgggctgggccatggtcgagatcgacaaggaggagaaccccatccgcctgatcgacctgggggtgcgggtgttcgagcgcgccgaggtccccaagaccggcgacagcctcgccgccgcgcggcgcctggcccggtccgtgcgccggctgacccgccggcgcgcccaccggctcctgcgcacgcggcgcctgctcaagcgggagggggtgctgcaggccgcgaacttcgacaagaacggcctgatcaagagcctccccaacaccctgtggcagctgcgcgccgccgccctcgaccggaagctgacgcccctggagtggtccgccgtcctcctgcacctgatcaagcaccgcggctacctcagccagcggaagaacgagggggagaccgcggacaaggagctgggcgccctgctcaagggggtggccggcaacgcccacgccctgcagaccggggacttccgcaccccggcggagctggccctcaacaagttcgagaaggagtccggccacatccggaaccagcgcggcgactacagccacaccttctcccgcaaggacctgcaggccgagctgaacctcctgttcgagaagcagaaggagttcgggaacccccacatcagcggcgggctgaaggagggcatcgagaccctcctgatgacgcagcggcccgccctgtccggcgacgccgtgcagaagatgctcgggcactgcaccttcgagcccaccgagccgaaggcggccaagaacacctacacgaccgagcgcttcatctggctgaccaagctgaacaacctccggatcctggagcagggcagcgagcgccccctgaccgacacggagcgggccaccctcatggacgagccctaccgcaagtccaagctgacctacgcccaggcccggaagctgctcagcctggaggacaccgcgttcttcaaggggctgcgctacggcaaggacaacgccgaggcctccacgctcatggagatgaaggcctaccacaccatcagccgggcgctggagaaggaggggctgaaggacaagaagtccccgctgaacctcagccccgagctgcaggacgagatcggcaccgccttctccctgttcaagaccgacgaggacatcacgggccgcctcaaggaccggatccagcccgagatcctggaggccctgctcaagcacatcagcttcgacaagttcgtccagatcagcctgaaggccctgcgccggatcgtgcccctcatggagcaggggaagcgctacgacgaggcctgcgcggagatctacggcgaccactacgggaagaagaacaccgaggagaagatctacctgcccccgatccccgccgacgagatccggaaccccgtggtcctgcgcgccctctcccaggcccggaaggtgatcaacggcgtggtccgccggtacgggagccccgcccgcatccacatcgagaccgcgcgcgaggtgggcaagtccttcaaggaccggaaggagatcgagaagcgccaggaggagaaccggaaggaccgcgagaaggccgccgccaagttccgggagtacttcccgaacttcgtgggcgagcccaagagcaaggacatcctgaagctgcgcctctacgagcagcagcacgggaagtgcctgtactccggcaaggagatcaacctggtccggctcaacgagaaggggtacgtggagatcgaccacgccctgcccttcagccgcacctgggacgactccttcaacaacaaggtgctggtcctcggcagcgagaaccagaacaaggggaaccagacgccctacgagtacttcaacggcaaggacaactcccgggagtggcaggagttcaaggcgcgcgtggagaccagccggttcccgcgctccaagaagcagcggatcctgctgcagaagttcgacgaggacggcttcaaggagcgcaacctcaacgacacccggtacgtgaaccgcttcctgtgccagttcgtcgccgaccacatcctgctcaccgggaagggcaagcggcgcgtgttcgccagcaacgggcagatcacgaacctgctgcggggcttctggggcctccgcaaggtccgggccgagaacgaccgccaccacgcgctggacgccgtggtggtcgcctgctccaccgtggccatgcagcagaagatcacccgcttcgtgcggtacaaggagatgaacgccttcgacgggaagaccatcgacaaggagacgggcgaggtcctgcaccagaagacccacttcccccagccctgggagttcttcgcgcaggaggtgatgatccgcgtgttcgggaagcccgacggcaagccggagttcgaggaggccgacaccctcgagaagctgcggaccctgctcgccgagaagctgagctcccgccccgaggccgtccacgagtacgtgacgcccctgttcgtgagccgggccccgaaccgcaagatgtccgggcagggccacatggagaccgtcaagagcgcgaagcggctcgacgagggcgtgtccgtgctgcgcgtccccctgacccagctcaagctgaaggacctggagaagatggtgaaccgggagcgcgagcccaagctctacgaggccctgaaggcccggctggaggcccacaaggacgaccccgccaaggcgttcgccgagccgttctacaagtacgacaaggccgggaaccgcacccagcaggtcaaggccgtgcgggtggagcaggtccagaagaccggcgtgtgggtgcgcaaccacaacgggatcgcggacaacgccacgatggtgcgggtcgacgtgttcgagaagggcgacaagtactacctcgtgcccatctacagctggcaggtcgccaaggggatcctgcccgaccgcgccgtggtgcagggcaaggacgaggaggactggcagctgatcgacgacagcttcaacttcaagttctccctccaccccaacgacctggtcgaggtgatcaccaagaaggcccggatgttcggctacttcgcgagctgccaccgcgggaccggcaacatcaacatccggatccacgacctggaccacaagatcgggaagaacggcatcctcgaggggatcggcgtgaagaccgccctgtccttccagaagtaccagatcgacgagctgggcaaggagatccgcccgtgccgcctcaagaagcggccgcccgtccgctga

SEQ ID NO: 1558 - RNA, 3249 nt, synthetic construct
  misc_feature 1..3249: note = Cas9 variant
  source 1..3249: mol_type = other RNA
atggccgccttcaagcccaacccgatcaactacatcctgggcctcgacatcgggatcgcgagcgtgggctgggccatggtcgagatcgacgaggaggagaaccccatccgcctgatcgacctgggggtgcgggtgttcgagcgcgccgaggtccccaagaccggcgactccctcgccatggtgcggcgcctggcccggagcgtgcgccggctgacccgccggcgcgcgcaccggctcctgcgcgcccggcgcctgctcaagcgggagggggtcctgcaggccgccgacttcgacgagaacggcctgatcaagtccctccccaacacgccgtggcagctgcgcgcggccgccctggaccggaagctcacgcccctggagtggagcgccgtgctgctccacctgatcaagcaccgcggctacctgtcccagcggaagaacgagggggagaccgccgacaaggagctcggcgcgctgctgaagggggtggccgacaacgcccacgccctccagaccggcgacttccgcacccccgccgagctggcgctgaacaagttcgagaaggagagcgggcacatccggaaccagcgcggcgactactcccacaccttcagccgcaaggacctccaggccgagctgatcctcctgttcgagaagcagaaggagttcggcaacccccacatctccgggggcctgaaggaggggatcgagaccctgctcatgacccagcggccggccctgagcggcgacgccgtccagaagatgctgggccactgcacgttcgagcccgccgagcccaaggcggccaagaacacctacaccgccgagcgcttcatctggctcaccaagctgaacaacctgcggatcctcgagcaggggtccgagcgccccctgacggacaccgagcgggccaccctgatggacgagccgtaccgcaagagcaagctcacctacgcccaggcgcggaagctgctgggcctcgaggacacggccttcttcaaggggctgcgctacggcaaggacaacgccgaggcctccaccctgatggagatgaaggcgtaccacgccatcagccgggccctcgagaaggaggggctgaaggacaagaagtccccgctgaacctgagccccgagctccaggacgagatcggcaccgccttctccctgttcaagaccgacgaggacatcacgggccgcctgaaggaccggatccagcccgagatcctcgaggccctgctgaagcacatcagcttcgacaagttcgtgcagatctccctcaaggcgctgcgccggatcgtgcccctgatggagcaggggaagcgctacgacgaggcctgcgccgagatctacggcgaccactacgggaagaagaacaccgaggagaagatctacctcccgcccatccccgccgacgagatccggaaccccgtcgtgctgcgcgccctgagccaggcgcggaaggtgatcaacggcgtcgtgcgccggtacgggagccccgcccgcatccacatcgagaccgcccgcgaggtgggcaagtccttcaaggaccggaaggagatcgagaagcgccaggaggagaaccggaaggaccgcgagaaggccgccgcgaagttccgggagtacttccccaacttcgtcggcgagcccaagagcaaggacatcctcaagctgcgcctgtacgagcagcagcacgggaagtgcctctactccggcaaggagatcaacctggggcggctgaacgagaagggctacgtggagatcgaccacgccctcccgttcagccgcacctgggacgactccttcaacaacaaggtgctggtcctggggagcgagaaccagaacaagggcaaccagacgccctacgagtacttcaacggcaaggacaactcccgggagtggcaggagttcaaggcccgcgtggagaccagccggttcccccgctccaagaagcagcggatcctcctgcagaagttcgacgaggacgggttcaaggagcgcaacctgaacgacacccggtacgtgaaccgcttcctctgccagttcgtcgccgaccggatgcgcctgaccggcaaggggaagaagcgggtgttcgcgagcaacggccagatcacgaacctgctccgcggcttctgggggctgcggaaggtccgcgccgagaacgaccgccaccacgccctggacgccgtggtggtcgcctgctccaccgtggcgatgcagcagaagatcacccggttcgtgcgctacaaggagatgaacgccttcgacggcaagaccatcgacaaggagacgggggaggtcctccaccagaagacccacttcccccagccgtgggagttcttcgcccaggaggtgatgatccgggtgttcggcaagcccgacgggaagcccgagttcgaggaggccgacaccccggagaagctgcgcaccctgctcgccgagaagctgagctcccggcccgaggcggtccacgagtacgtgacgcccctgttcgtgagccgcgcccccaaccggaagatgtccggccagggccacatggagaccgtcaagagcgccaagcgcctcgacgagggggtgtccgtgctgcgggtcccgctgacccagctcaagctgaaggacctggagaagatggtgaaccgcgagcgggagcccaagctctacgaggccctgaaggcccgcctggaggcgcacaaggacgaccccgccaaggccttcgccgagcccttctacaagtacgacaaggcgggcaaccggacccagcaggtcaaggccgtgcgcgtggagcaggtccagaagaccggggtgtgggtgcggaaccacaacggcatcgccgacaacgccacgatggtgcgcgtcgacgtgttcgagaagggggacaagtactacctcgtgccgatctacagctggcaggtcgccaagggcatcctgcccgaccgggcggtggtgcagggcaaggacgaggaggactggcagctgatcgacgactccttcaacttcaagttcagcctccaccccaacgacctggtcgaggtgatcaccaagaaggcccgcatgttcgggtacttcgccagctgccaccggggcaccgggaacatcaacatccgcatccacgacctggaccacaagatcggcaagaacgggatcctcgagggcatcggcgtgaagaccgccctgtccttccagaagtaccagatcgacgagctggggaaggagatccgcccctgccggctcaagaagcgcccgcccgtccggtga

SEQ ID NO: 1559 - RNA, 3249 nt, synthetic construct
  misc_feature 1..3249: note = Cas9 variant
  source 1..3249: mol_type = other RNA
atgcgcgtgctgggcctcgacgccgggatcgccagcctgggctgggcgctgatcgagatcgaggagtccaaccgcggggagctcagccagggcaccatcatcggggccggcacctggatgttcgacgcccccgaggagaagacgcaggccggcgccaagctgaagtccgagcagcggcggaccttccgcgggcagcggcgcgtcgtgcggcgccggcgccagcggatgaacgaggtgcgccggatcctgcacagccacggcctcctgccgtccagcgaccgcgacgcgctgaagcagcccgggctcgacccctggcggatccgcgccgaggccctggaccggctgctcggccccgtcgagctggccgtggcgctggggcacatcgcccgccaccggggcttcaagtccaacagcaagggcgccaagaccaacgacccggccgacgacacctccaagatgaagcgcgccgtgaacgagacgcgggagaagctcgcgcgcttcgggagcgccgccaagatgctggtcgaggacgagtccttcgtgctgcgccagacccccaccaagaacggcgccagcgagatcgtgcggcgcttccggaaccgcgagggggactactcccggagcctcctgcgcgacgacctggccgcggagatgcgggccctcttcaccgcccaggcccgcttccagtccgccatcgcgacggccgacctgcagaccgccttcaccaaggccgccttcttccagcggcccctgcaggacagcgagaagctcgtcggcccctgcccgttcgaggtggacgagaagcgcgcgcccaagcggggctactccttcgagctgttccgcttcctgagccggctcaaccacgtgaccctgcgcgacgggaagcaggagcggacgctgacccgcgacgagctcgccctggccgccgcggacttcggcgccgccgccaaggtctccttcaccgccctgcggaagaagctcaagctgcccgagaccacggtgttcgtgggggtcaaggcggacgaggagagcaagctggacgtggtggcccgcagcggcaaggccgccgaggggaccgcccggctccgctccgtcatcgtggacgcgctgggcgagctggcctggggcgccctcctgtgcagccccgagaagctggacaagatcgccgaggtgatctccttccgcagcgacatcgggcggatctccgagggcctcgcccaggcggggtgcaacgccccgctggtcgacgccctgaccgccgcggccagcgacggccgcttcgaccccttcaccggggccggccacatctccagcaaggccgcccggaacatcctctccggcctgcgccaggggatgacgtacgacaaggcgtgctgcgccgccgactacgaccacaccgccagccgggagcgcggcgccttcgacgtgggcgggcacgggcgggaggcgctgaagcgcatcctccaggaggagcggatctcccgcgagctggtgggcagccccaccgcccggaaggccctgatcgagtccatcaagcaggtcaaggccatcgtggagcgctacggcgtccccgaccggatccacgtggagctggcccgcgacgtgggcaagagcatcgaggagcgggaggagatcacccgcgggatcgagaagcggaaccgccagaaggacaagctccgggggctgttcgagaaggaggtcggccgcccgccccaggacggcgcgcgggggaaggaggagctgctccgcttcgagctgtggtccgagcagatgggccgctgcctgtacacggacgactacatcagcccctcccagctcgtggccaccgacgacgccgtgcaggtcgaccacatcctgccctggagccggttcgccgacgactcctacgcgaacaagaccctgtgcatggccaaggccaaccaggacaagaaggggcgcaccccgtacgagtggttcaaggccgagaagacggacaccgagtgggacgccttcatcgtgcgggtggaggcgctcgccgacatgaagggcttcaagaagcgcaactacaagctgcggaacgccgaggaggccgccgcgaagttccgcaaccggaacctgaacgacacccgctgggcctgccggctcctggccgaggccctgaagcagctctaccccaagggggagaaggacaaggacggcaaggagcgccggcgcgtcttcagccggcccggcgccctgaccgaccgcctgcggcgcgcgtgggggctccagtggatgaagaagtccacgaagggcgaccggatccccgacgaccgccaccacgccctggacgccatcgtgatcgccgccaccaccgagagcctgctccagcgggcgacccgcgaggtgcaggagatcgaggacaaggggctgcactacgacctggtcaagaacgtgacgccgccctggcccggcttccgcgagcaggccgtggaggccgtcgagaaggtgttcgtggcccgggcggagcgccggcgcgcccgggggaaggcccacgacgccaccatccgccacatcgccgtccgggagggcgagcagcgcgtgtacgagcggcgcaaggtggcggagctcaagctggccgacctggaccgggtcaaggacgccgagcgcaacgcccggctcatcgagaagctgcgcaactggatcgaggccggcagccccaaggacgacccgcccctgtcccccaagggggacccgatcttcaaggtgcggctcgtgaccaagagcaaggtcaacatcgcgctggacaccggcaaccccaagcgccccgggaccgtggaccggggcgagatggcccgcgtggacgtcttccggaaggcctccaagaaggggaagtacgagtactacctggtgcccatctacccgcacgacatcgccacgatgaagaccccgcccatccgcgccgtgcaggcgtacaagcccgaggacgagtggcccgagatggacagctcctacgagttctgctggagcctcgtccccatgacctacctccaggtgatctccagcaagggcgagatcttcgagggctactaccgggggatgaaccgctccgtgggcgccatccagctgagcgcccactccaacagctccgacgtcgtgcaggggatcggcgcccgcaccctgacggagttcaagaagttcaacgtggaccggttcgggcgcaagcacgaggtcgagcgggagctgcgcacctggcggggcgagacctggcgcggcaaggcgtacatctga

SEQ ID NO: 1560 - RNA, 3255 nt, synthetic construct
  misc_feature 1..3255: note = Cas9 variant
  source 1..3255: mol_type = other RNA
atgaagaacaccctgtacggcatcgggctcgacatcggcgtggccagcgtcgggtgggccgtggtgggcctgaacgggaccggcgagcccgtcggcctgcaccgcctcggggtgcggatcttcgacaaggcggagcagccgaagacgggcgagtccctggccgcgccccgccggatggcccgcgggatgcggcgccggctgcgccggaaggccctccgccgggcggacgtgtacgccctgctggagcgcagcggcctctccacccgggaggccctggcccacatgttcgaggccgggggcctggaggacatctacgccctccgcacccgggccctggacgagcccgtcggcaaggccgagttcagccgcatcctgctccacctggcccagcggcgcgggttcaagtccaaccggcgcaccgcgagcgacggcgaggacgggcggctgctcgccgccgtgaacgagaaccgccgccggatggcccagggcggctggcgcacggtgggggagatgctgtaccggcacgaggccttcgcgctgcacaagcgcaacaaggccgacgagtacctctccaccgtcggccgggacatggtggccgaggaggccagcctgctgttccagcgccagcgggagctcgggtgcgcctgggcgacccccgagctgcaggccgagtacctgtccatcctcctgcgccagcggagcttcgacgagggccccgggggcaactccccgtacggcgggaaccaggtggagaagatggtcggccgctgcaccttcgagcccgacgagccccgggccgccaaggccgcgtacagcttcgagtacttctccctgctccagaagatcaaccacatccgcctggtggagaacggggagacgcggccgctgacccagcagcagcgccagcagctcctgagcctggcccacaagacccccgacgtgtccctcgcccggatccgcaaggagctggccctgcccgagaccgtccagttcaacggcgtgcggtgccgcgcgaacgagacgctcgaggagagcgagaagaaggagaagttcgcctgcctgcccgcctaccacaagatgcggaaggccctggacggggtggtcaagggccgcatctccagcctctccatcagccagcgcgacgccgcggccaccgccctgagcctgtacaagaacgaggacaccctccgggccaagctgaccgaggccggcttccaggcgccggagatcgacgccctggccgggctcacgggcttctccaagttcgggcacctgagcctgaaggcctgccgcaagctgatcccccacctcgagcagggcctgacctacgaccaggcctgctccgcggccgggtacgacttcaagggccacggcgccggggagcgggccttcaccctgcccgcggccgcccccgagatggagcagatcaccagcccggtggtgcgccgggccgtcgcccagacgatcaaggtggtgaacggcatcatccgcgagatggacgcgtcccccgcctgggtccggatcgagctcgcccgcgagctgagcaagaccttcggggagcggcaggagatggaccgctccatgcgggagaacgccgcccagaacgagcgcctgatgcaggagctccgggacaccttccacctcctgagccccaccggccaggacctggtgaagtaccgcctgtggaaggagcaggacggcgtctgcgcgtactccctgcggcgcctcgacgtggagcggctgttcgagcccgggtacgtggacgtcgaccacatcgtgccgtacagcctgtccttcgacgaccgccggagcaacaaggtgctcgtcctgtccagcgagaaccgccagaagggcaaccggctgcccctccagtacctgcaggggaagcgccgcgaggacttcatcgtgtggacgaactccagcgtgcgggactaccgcaagcggcagaacctgctccgcgagaagctgtccggcgacgaggccgaggggttccggcagcgcaacctgcaggacacccagcacatggcccggttcctctacaactacatcagcgaccacctggccttcgcccagtccgaggcgctgggcaagaagcgcgtcttcgccgtgagcggcgccgtgaccagccacctccggaagcgctgggggctgtccaaggtccgggccgacggcgacctgcaccacgcgctcgacgccgccgtgatcgcctgcaccacggacgggatgatccgccggatcagcggctactacgggcacatcgagggcgagtacctgcaggacgccgacggcgcggggtcccagcacgcccgcaccaaggagcggttccccgccccctggccgcgcttccgggacgagctgatcgtgcgcctcagcgagcagcccggcgagcacctcctggacatcaaccccgagttctactgcgagtacgggaccgagcacatccggcccgtcttcgtgtcccgcatgccgcgccggaaggtgaccggccccgggcacaaggagacgatcaagggcgccgccgcggccgacgagggcctgctgaccgtccgcaaggccctgaccgagctcaagctggacaaggacggggagatcaaggactactacatgcccagctccgacaccctgctctacgaggccctgaaggcccagctgcggcgcttcggcggggacagcaagaaggcgttcgccgagccgttctacaagcccaaggccgacggcacgcccgggcccctcgtgcggaaggtgaagaccaccgagaaggccaccctgaccgtcccggtgcacggcggcgccgcgtccaacgacacgatggtgcgcgtcgacgtgttcctggtgcccggggacggctactactgggtccccgtgtacaccgccgacaccctcaagcccgagctgccgaaccgggccgtggtccaggggaagccctacagcgagtggaaggagatgcgcgaggaggacttcatcttctccctgtaccccaacgacctcgtgtacgtggagcacaagagcggcctgaagttcaccctgcagaacgccgactccacgctcgagaagacccggacccagaccagcgcgttcgtctacttcgtgggcgggtccatcagcacggcctccatcaccatccgcacccacgacaacgcctacggcatccccagcctgggggtgaagaccctgaagacgttccacaagtaccaggtcgacgtgctcggcaacgtgttcccggtccacaaggagacccggcagaagttccgctga

SEQ ID NO: 1561 - RNA, 3255 nt, synthetic construct
  misc_feature 1..3255: note = Cas9 variant
  source 1..3255: mol_type = other RNA
atgaagaacaccctgtacggcatcgggctcgacatcggcgtggccagcgtcgggtgggccgtggtgggcctgaacgggaccggcgagcccgtcggcctgcaccgcctcggggtgcggatcttcgacaaggcggagcagccgaagacgggcgagtccctggccgcgccccgccggatggcccgcgggatgcggcgccggctgcgccggaaggccctccgccgggcggacgtgtacgccctgctggagcgcagcggcctctccacccgggaggccctggcccagatgttcgaggccgggggcctggaggacatctacgccctccgcacccgggccctggacgagcccgtcggcaaggccgagttcagccgcatcctgctccacctggcccagcggcgcgggttcaagtccaaccggcgcaccgcgagcgacggcgaggacgggcggctgctcgccgccgtgaacgagaaccgccgccggatggcccagggcggctggcgcacggtgggggagatgctgtaccggcacgaggccttcgcgctgcacaagcgcaacaaggccgacgactacctctccaccgtcggccgggacatggtggccgaggaggccagcctgctgttccagcgccagcgggagctcgggtgcgcctgggcgacccccgagctgcaggccgagtacctgtccatcctcctgcgccagcggagcttcgacgagggccccgggggcgactccccgtacggcgggaaccaggtggagaagatggtcggccgctgcaccttcgagcccgacgagccccgggccgccaaggccgcgtacagcttcgagtacttctccctgctccagaagatcaaccacatccgcctggccgagaacggggagacgcggccgctgacccagccccagcgccagcagctcctgagcctggcccacaagacccccgacatgtccctcgcccggatccgcaaggagctggcgctgcccgagaccgtgcagttcaacggcgtgcggtgccgcgccaacgagacgctcgaggagagcgagaagaaggagaagttcgcctgcctgccggcctaccacaagatgcggaaggccctcgggggcgtcgtgaagggccgcatctccagcctgtccatcagccagcgcgacgcggccgccaccgccctgagcctgtacaagaacgaggacaccctccgggccaagctgaccgaggcggggttccaggcccccgagatcgacgccctggccggcctcacggggttctccaagttcggccacctgagcctgaaggcctgccgcaagctgatcccccacctcgagcaggggctgacctacgaccaggcgtgctccgccgccggctacgacttcaagggccacggggccggcgagcgggcgttcaccctgcccgccgccgccccggagatggagcagatcaccagccccgtggtccgccgggccgtggcgcagacgatcaaggtggtcaacgggatcatccgcgagatggacgcctcccccgcctgggtgcggatcgagctcgcccgcgagctgagcaagaccttcggcgagcggcaggagatggaccgctccatgcgggagaacgccgcgaagaacgagcgcctgatgcaggagctccgggacaccttccacctcctgagccccaccggccaggacctggtgaagtaccgcctgtggaaggagcaggacggggtctgcgcctactccctgcagcggctcgacgtggagcagctgttcgagccgggctacgtcgacgtggaccacatcgtgccctacagcctgtccttcgacgaccgccggagcaacaaggtcctcgtgctgtccagcgagaaccgccagaaggggaaccggctgcccctccagtacctgcagggcaagcgccgggaggacttcatcgtgtggacgaactccagcgtccacgactaccgcaagcgccagaacctgctccgggagaagctgtccgacgacgaggccgaggggttccgccagcggaacctgcaggacacccagcacatggcccgcttcctctacaactacatcagcgaccacctggccttcgcgcagtccgaggccctgggcaagaagcgggtgttcgccgtgagcggcgccgtcaccagccacctccgcaagcggtgggggctgtccaaggtgcgcgcggacggcgacctgcaccacgccctcgacgccgccgtggtcgcctgcaccacggacgggatgatccggcgcatcagcggctactacgggcacatcgagggcgagtacttccaggacgcggacggcgccgggtcccagcacgcccggaccaaggagcgcttccccgccccgtggccccggttccgcgacgagctgatcgtgcggctgagcgagcagcccggcgagcccctcctggacatcaacccggccttctactgcgagtacgggaccgagcacatccgccccgtgttcgtctcccggatgccccgccggaaggtgaccggcccgagccacaaggagacggtgaagggggcggccgccgccgacgagggcctgctcaccgtccgcaaggccctgaccgagctgaagctcgacaaggacggcgagatcaaggactactacatgccctccagcgacaccctgctgtacgaggcgctcaaggcccagctgcgccggttcgggggcgacgggaagaaggccttcgccgagcccttctacaagcccaaggccgacggcacgccggggcccctggtgcgcaaggtgaagaccaccgagaaggcgaccctcaccgtccccgtgcacggcggcgccgcctccaacgacacgatggtgcggatcgacgtcttcttcatgcccggggacggctactactgggtgccgctgtacgtggccgacaccctgaagcccgagctccccaaccgcgcggtcgtggcccacaagccctacagcgagtggcaggagatgcgggaggaggacttcgtgttctccctgtacccgaacgacctggtctacgtggagcacaagagcgagctcaagttcaccgtgcagaacgccgactccaccctggagaagacgcgcacccaggccagcgccttcgtctacttcgtgtccgggggcatcagcggcgggaccatcaccgtgcggacgcacgacaactcctacggcatccccagcctggggctcaagaccctcaagagcctgtgcaagtaccaggtcgacgtgctgggcaacgtgttccccgtccacaaggagacccgccagaagttccggtga

SEQ ID NO: 1562 - RNA, 3255 nt, synthetic construct
  misc_feature 1..3255: note = Cas9 variant
  source 1..3255: mol_type = other RNA
atgaagaacaccctgtacggcatcgggctcgacatcggcgtggccagcgtcgggtgggccgtggtgggcctgaacgggaccggcgagcccgtcggcctgcaccgcctcggggtgcggatcttcgacaaggcggagcagccgaagacgggcgagtccctggccgccccgcgccggatggcccgcgggatgcggcgccggctgcgccggaaggccctccgccgggcggacgtgtacgccctgctggagcgcagcggcctctccacccgggaggagctggcccagatgttcgaggccgggggcctggaggacatctacgcgctccgcacccgggccctggacgagcccgtcggcaaggccgagttcagccgcatcctgctccacctggcccagcggcgcgggttcaagtccaaccggcgcaccgccagcgacggcgaggacgggcggctgctcgcggccgtgaacgagaaccgccgccggatggcccagggcggctggcgcacggtgggggagatgctgtaccggcacgaggccttcgccctgcacaagcgcaacaaggcggacgactacctctccaccgtcggccgggacatggtggccgaggaggccagcatcctgttcgagcgccagcgggccatggggtgctcctgggccgcgcccgagctgcaggccgagtacctcagcatcctgctgcgccagcggtccttcgacgagggccccgggggcaacagcccctacggcgggaaccaggtggagaagatggtcggccgctgcaccttcgagcccgacgagccccgggccgccaaggccgcgtactccttcgagtacttcagcctcctgcagaagctgaaccacatccgcctcgccgagaacggggagacccggccgctgacgcagccccagcgccagcagctgctctccctggcccacaagacccccgacatcagcctggcccggatccgcaaggagctcgcgctgcccgagaccgtgcagttcaacggcgtgcggtgccgcgccaacgagaccctggaggagtccgagaagaaggagaagttcgcctgcctcccggcctaccacaagatgcggaaggccctggacggggtcgtgaagggccgcatcagctccctgagcatcagccagcgcgacgcggccgccacggccctctccctgtacaagaacgaggacaccctgcgggccaagctcaccgaggcgggcttccaggcccccgagatcgacgccctggccgggctgaccggcttcagcaagttcgggcacctctccctgaaggcctgccgcaagctgatcccccacctggagcagggcctcacgtacgaccaggcgtgcaccgccgccgggtacgacttcaagggccacggcgccggggagcgggcgttcaccctgcccgccgccgccccggagatggagcagatcaccagccccgtggtccgccgggccgtggcgcagacgatcaaggtggtcaacggcatcatccgcgagatggacgcctcccccgcctgggtgcggatcgagctggcccgcgagctcagcaagaccttcggggagcggcaggagatggaccgctccatgcgggagaacgccgcgcagaacgagcgcctgatgcaggagctgcgggacaccttccacctcctgagccccaccggccaggacctggtgaagtaccgcctctggaaggagcaggacggcgtctgcgcctactccctgcggcgcctggacgtggagcggctgttcgagccggggtacgtcgacgtggaccacatcgtgccctacagcctgtccttcgacgaccgccggagcaacaaggtcctggtgctctccagcgagaaccgccagaagggcaaccggctgcccctgcagtacctccaggggaagcgccgcgaggacttcatcgtgtggacgaactccagcgtccacgactaccggaagcgccagaacctgctgcgggagaagctctccggcgacgaggccgaggggttccgccagcggaacctgcaggacacccagcacatggcccgcttcctgtacaactacatcagcgaccacctcgccttcgcgcagtccgaggccctgggcaagaagcgggtgttcgccgtgagcggcgccgtcaccagccacctccgcaagcggtgggggctctccaaggtgcgcgcggacggcgacctgcaccacgccctggacgccgccgtggtcgcctgcaccacggacgggatgatccggcgcatcagcggctactacgggcacatcgagggcgagtacctccaggacgcggacggcgccgggtcccagcacgcccggaccaaggagcgcttccccgccccgtggccccggttccgcgacgagctgatcgtgcggctgagcgagcagcccgccgagcccctcctggacatcaacccggagttctactgcgagtacggcaccgagcacatccgccccgtgttcgtctcccggatgccccgccgcaaggtgaccgggccgggccacaaggagacgatcaagggggcggccgccgccgacgagggcctgctcaccgtgcggaaggccctgaccgagctgaagctcgacaaggacggcgagatcaaggactactacatgcccagctccgacaccctgctgtacgaggcgctcaaggcccagctgcgccggttcgggggcgacgggaagaaggccttcgccgagcccttctacaagcccaaggccgacggcacgccggggcccctggtccgcaaggtgaagaccaccgagaaggcgaccctcaccgtgcccgtccacggcggcgccgccagcaacgacacgatggtgcgggtggacgtcttcctggtgcccggggacggctactactgggtgccggtctacaccgccgacaccctgaagcccgagctccccaaccgcgcggtggtgcaggggaagccctactccgagtggaaggagatgcgggaggaggacttcatcttcagcctgtacccgaacgacctggtctacgtggagcacaagtccggcctcaagttcaccctgcagaacgccgacagcacgctggagaagacccgcacccagacctccgccttcgcctacttcgtgagcggctccatcagcacggcctccatcaccatccggacccacgacaacgcgtacgggatccccagcctcggcgtcaagaccctgaagacgttccacaagtaccaggtggacgtgctggggaacgtcttccccgtgcacaaggagacccgccagaagttccggtga

SEQ ID NO: 1563 - RNA, 3255 nt, synthetic construct
  misc_feature 1..3255: note = Cas9 variant
  source 1..3255: mol_type = other RNA
atgcgcctgggcctcgacatcgggaccaacagcatcggctggtggctgtacgggaccgagggcgggcggatcacggaggtggtcgacggcggcgtgcgcatcttctccgacgggcgggacccccagagcaaggcctccctggccgtggaccgccgggcggcccgcagccagcggcgccggcgcgaccggtacctccgccggaaggccgccctgatgaagcgcatggcccaggtcggcctgatgccggcggaccccgccgaggccaaggtgctcgaggtgctgaacccctacgagctgcgggcctccgggctcgacggccccctgccgctgacccacttcgggcgcgccctcttccacctgaaccagcggcgcggcttcaagagcaaccggaagaccgaccgcggcgacaacgagtccgggaagatcaaggacgccaccgcccggctggaccaggccatgatggccaagggcgcgcgcacgtacggggagttcctccacatgcgccgggccgccgccctggaccccaagagcgtcccctccgtgcgcacccggctgaccgtggcccgccgggacgacgcggagaaggaggaggccggctacgacttctaccccgaccgcaagcacctcagcgaggagttcgacaagctgtgggccgcccaggcccggcacgcgccggacgtcctgaccgaggacctccgcgacgagatcgccacgatcatcttccaccagcggcccctgaagacccccgaggtgggcctgtgcctcttcaccgggcagcacggcgtgcccgagcgcgacaagcggatcccgtccgcccaccccctgaaccagcgccggatcctgatggagaccgtcaacaacctcaaggtggccgcccagggggagcccagccgccccctgacgcgggaggagcgcgaccagatcgtgcacgcgctggacaacaagaagcacaccaagtccctcagcggcatgaccatgaagctgaaggccctggggaaggtcatcaagctccggccggagcagggcttcaccctggagacggccaaccgcgacgccatcgcgtgcgaccccgtgcgggcctccctgagccaccccgaccgcttcggcgcccgctggtccaccctcgagagcgccgggcagtgggacgtggtccagcggatccgcgccgtgcagtccgacgcggagcacgccgacctggtgggctggctgatggacgtccacgggctcgaccgggaccacgccgaggagaccgccaacgcgcccctgccggagggctacgggcgcctgggcctcaccgcgacgacccggatcctggccgccctggaggccgacgtgctcaactacagcgccgcggtggccgcctgcggctggcaccacagcgacgggcgcaccggcgaggtcctggagtccctgccctactacggggagatcctcgagcggcacgtgatccccggcaccggggaccccaacgacgacgacgtcaagcgctacggccggatcacgaacccgaccgtgcacatcggcctgaaccagctgcgccggctggtgaaccgcatcatcaccgtctacgggcggcccgacgagatcgtggtggagctcgcccgcgacctgaagctgagcgaggaccagaagaaggacgtccagcgggacatcaagaagaacaccgaggcggccatccgccggggcaagaagctcgaggagatgggggtgcccaacacgggcgccaaccgcatggtgctgcggctgtgggaggacctcggcgacgacgtcatgacccgcaactgcccctacaccgggaagcggatctccgccggcatgctgttcgacgggagctgcgacgtggaccacatcctgccgtactcccgcaccctcgacgacagcttcgccaaccgcacgctgtgcctgaaggaggcgaaccggcagaagaccgacaagaccccctgggaggcctggggcgagaccgagcagtgggaggccatcgccgccaacctcaagaacctgcccgcgaacaaggcctggcgcttcgccccggacgccatggagcggttcgagggggagaaggacttctccgcccgcgcgctggccgacacgcagtacctcagccggatcgcccgcgcctacctggacgcgctgtacgacggcgacgacggcaagtcccacgtgtgggtcgtgcccgggcggctcaccgagatgctgcgccggcactggggcctgaacggggtggccgccctcaccgacagcgacaagcagaccgtcaaggccaagaaccgcaccgaccaccggcaccacgccatcgacgcggccgtggtggccgccacggaccgcggcctgatcaagcggatcgccgacatggcgaagcgcgacgagttcaacggggccgaggaggtcgcccggtccatcccgccgccctgggagggcttccgcgacgacgtgagcgcccaggtgacccggatcatcgtctcccaccgcgccgaccacggccggatcgaccccgcggcccgcaagagcgggcgcgactccaccagcggccagctgcacaacgacaccgcctacgggatcggccgggacgggacggtggtgtcccgcaagcccctcgccagcctgtcccccaacgacatcgtcgtgaccaagcggggcgccaacatccgcgacgtggacctgcagaagcacctcgcgcgggtcacccacggcctggacgggaaggccttcgaggccgccctgctcgcgttcgccgccagccccatcctgcccgacaacaccgacaacccctacttcggcctgcgccgggtgcgcctcgaggagacgctgcaggagagcgcccgggtggaggtcgccgaccaggaggggcgcccctacaaggcgtacaagggcgactccaaccactgctacgagatctggtgcctgccggacgggaagatcaagccccaggtggtgaccacctacgaggcccaccagagcggcgccgagaagaagccccaccccgccgccaagcggctcatgcgcatcttcaagcgggacatggtcatgctggagcgcgacggcgagaccatcatcgggtacgtgcagaagatgaagcagaacggctccatcttcgtggcgccgcacacggaggccaacgccgacgcccgggaccgcgaccccaaggacgacttcaagctgatccagctcggggccggcagcctggtcaaggcgaaggcccggcgcgtgatcgtggacgagatgggccggctgcgcgaccccgggcccccgctctga

SEQ ID NO: 1564 - RNA, 3258 nt, synthetic construct
  misc_feature 1..3258: note = Cas9 variant
  source 1..3258: mol_type = other RNA
atggacaagggcaccaacagcatcgggtgggccgccctgcgcctcgacgagcagggcgagcccgtggggatcatcgaggcgggcgtccggatctacgccgacgggcgcgagccgaagtccggcaccagcctggccgagggccggcgcatcgcccgggggatgtcccgccggcgcgaccggtacaagcgccggcgccggacggtgctgaacaccctcaccgagttcggcctgatgcccgccaccaaggcggcccgcaaggccctggtggccgagacgaacgaccggcgcttcggggaggtcgcgagcaacgtgtacgccctccgggcccgcgccctggacgagaagctgcccctctaccagctgggccgggccctgttccacctcaaccagcgccgggggttcaagtccaaccgcaagaccgacaagcgcgacaacgaccagggcaagatcgcgagcgccatctcccggctgggccgcaagctggacgaggccggggcccggaccctcggcgagttcctgcacaagcagcacgccgcggggaagtgggtgcgcgtccggcccagccgcgtgccgggcgaggacgacaaggaggaggacggctacgggttctaccccgagcggtccttcctggagcgcgagttcgccgccatctgggaggcccaggccgcgttctaccccgagctcctgaccgaggagcggcgcgaccacctccactgggtgatgttcttccagcggcccctgaagcgcccgacggtcggcaagtgcagcttccaccccgacgaggaccggctgcccaaggcccaccccctgttccaggagttccgcctcatcaaggagctgaacgagctggaggtggtgcaccgcggggaccggcgggagaagctcaccccggaccagcgcgaccggctgttcaaccagctgcgcacccagcgctccagcgccttcaccgccctccggaagacgatcaaggcccccaccggcacccgcttcaacaaggagtccgacgcgcgggacaagctgaagggggacgaggtcgccgccgagatgagccacaaggaccgcttcggccaggcctggatcggcatgcccctggcggagcggtgggccgtggtggccatgctcctggacaccgaggaccccctggaggtcaaggcctggctcgaggagcgctacgggttcgccgcggaccggatcgacgccatcgccgccgccaagctgccgacgggctacgggcgcctgggcgagaccgcgctccgggacatgctggacgagctgcgcaacgggaccgtgaaggacgacgccggccgggacgtggtcctcaccgagcgccaggccatggacaacatctggggcgacaaccccgccctgcagcgggccgtgacggacgcgcgcgagctgccgccctaccaggaggtgctcgggcggcgcatcccgcccggcaccgggaagcccgccgacccctacgacgtccagaagggccggctgaccaaccccaccgtgcacatcgggctgaaccagctcaagcgcatcgtgaacgtcctgatgcggcgccacggccggcccgagcagatcgccctggagctggcccgcgacctcaagctgaacgaggagcagaaggcggagaagaaccgcgagatcgcccggaacacgaaggccgccgaggcccgcggcaagaagctggaggagctcgggcacgcgaacaacggctacaaccgggtgctgctgaagctctgggaggacctgaacctgaagcagcccgagaaccgcgagtgcatctactgcgggaaggccatcggcatcggcaccctcctgtccaaccaggtcgacatcgaccacatcctgccctggagcaagaccctcgacgactcccaggccaaccggatcgtgtgccacgtggagtgcaaccgccagaaggggaaccacgccccggccgaggtcccccagtggcacgaccggtacgacgacatcctggcgcgcgccgagcggctgccccgcaacaaggcctggcggttcggccgcgaggccatgaagaagttcaaggacgacgagagcttcctcgcccggcagctgaccgacacgcagtacctgtcccgcctcgcgcacgagtacctgggggccctgtacccggacgaggagcccgacgagtggggcgggcccgcccggcgcaaccacgtgcgggtgatccccggccgcatgaccgagatgctccggcgccagtggggcctgaacgccatcatcagcgaccacaaccagaagaaccgcaacgaccaccggcaccacgcgatcgacgccatcgtcgtgggggtgaccacccgccggctgctccagcgcatcgccacggtcgccggcgggcgggaggccctggcgctggaggagaccatcggcaagatcgagccgccctggcccgggttctacgacgacgtgaaggccgccatcgaccgcatcgtggtcagccacaagcccgaccacggctccctcccgaagcccggcaagcccgggcggaccgccggccagctgcacaacgacaccgcctacgggttcacgggcgaggcgcgcaacggggtgcccatcatggtgcaccgggtcccgttcgccagcctgaccgagaaggacatcccctccatccgcgaccggcagctcgccgacgccctgtacgccgcgatcagcggcatctccggcaaggccgagctggccgccgccctcgcgcgcttcagcgagtccgggccctacaagggcatccggcacgtgcgcgtggtcgagcccgtgagcgtgatcgccatcaaggaccaggccgggaaggcctacaagggctacaagggggacgcgaactaccggtacgacgtctgggagctgccgaacggcaagtggacccacgaggtggtgtccatgttcaacgcccaccgccccgactggcagagcgagatccggtccaagaaccccgccgcccgcaaggtcctgagcctccaccagaacgacatggtggcctacgagcacccccaggacggctacaccatcgggcgggtggtcaagttctccgcgggcgggcagatggccctggccggcaaccgcgagggcggggccctcaagagccgggacgccgacccggaggaccgcttccgctacttctacaagtccggcggggcgatgcgggacgtgcagctgcgccaggtgcgggtcgacgagaccggccgcgtgttcgaccccgggccccaggaccgggagagccgcaacgcccggaagcagaacgacgccggctga

SEQ ID NO: 1565 - RNA, 3264 nt, synthetic construct
  misc_feature 1..3264: note = Cas9 variant
  source 1..3264: mol_type = other RNA
atgcgctacaagatcggcctggacatcgggatcaccagcgtgggctgggccgtcatgaacctcgacatcccccggatcgaggacctgggggtgcgcatcttcgaccgggccgagaacccgcagaccggcgagtccctggcgctcccccgccggctggcccgcagcgcccggcgccggctgcgccggcgcaagcaccggctcgagcgcatccggcgcctggtgatccgggaggggatcctgacgaaggaggagctcgacaagctgttcgaggagaagcacgagatcgacgtctggcagctgcgcgtggaggccctcgaccggaagctgaacaacgacgagctggcccgcgtgctcctgcacctggcgaagcggcgcggcttcaagtccaaccgcaagagcgagcggtccaacaaggagaacagcaccatgctcaagcacatcgaggagaaccgcgccatcctgtccagctaccggaccgtcggcgagatgatcgtgaaggaccccaagttcgccctgcacaagcgcaacaagggggagaactacaccaacacgatcgcccgggacgacctcgagcgcgagatccggctgatcttctccaagcagcgcgagttcggcaacatgagctgcaccgaggagttcgagaacgagtacatcaccatctgggcgtcccagcggcccgtggccagcaaggacgacatcgagaagaaggtcgggttctgcaccttcgagccgaaggagaagcgcgcccccaaggccacgtacaccttccagtccttcatcgcctgggagcacatcaacaagctgcggctcatcagcccctccggcgcgcgcgggctgaccgacgaggagcggcgcctgctctacgagcaggccttccagaagaacaagatcacctaccacgacatccggacgctgctgcacctccccgacgacacctacttcaagggcatcgtgtacgaccgcggcgagagccggaagcagaacgagaacatccgcttcctggagctggacgcctaccaccagatccggaaggccgtggacaaggtctacgggaagggcaagtccagctccttcctcccgatcgacttcgacaccttcgggtacgccctgaccctgttcaaggacgacgcggacatccacagctacctccgcaacgagtacgagcagaacggcaagcgcatgcccaacctggccaacaaggtgtacgacaacgagctgatcgaggagctcctgaacctgagcttcacgaagttcggccacctctccctgaaggccctgcggagcatcctcccctacatggagcagggggaggtgtactccagcgcctgcgagcgcgccggctacaccttcaccgggcccaagaagaagcagaagaccatgctgctgccgaacatcccgcccatcgcgaaccccgtcgtgatgcgggccctcacgcaggcccgcaaggtggtcaacgccatcatcaagaagtacggctcccccgtgagcatccacatcgagctggcccgggacctgtcccagaccttcgacgagcgccggaagaccaagaaggagcaggacgagaaccgcaagaagaacgagaccgcgatccggcagctgatggagtacgggctcacgctgaaccccaccggccacgacatcgtgaagttcaagctgtggagcgagcagaacggccgctgcgcctactccctccagcccatcgagatcgagcggctgctggagcccgggtacgtcgaggtggaccacgtgatcccgtacagccgctccctcgacgacagctacaccaacaaggtcctggtgctgacccgggagaaccgcgagaagggcaaccggatccccgccgagtacctcggggtcggcacggagcgctggcagcagttcgagaccttcgtgctgaccaacaagcagttctccaagaagaagcgggaccgcctgctccggctgcactacgacgagaacgaggagaccgagttcaagaaccgcaacctgaacgacacgcggtacatcagccgcttcttcgccaacttcatccgcgagcacctcaagttcgcggagtccgacgacaagcagaaggtgtacaccgtcaacgggcgggtgaccgcccacctccgcagccggtgggagttcaacaagaaccgcgaggagtccgacctgcaccacgccgtggacgccgtcatcgtggcctgcaccacgcccagcgacatcgcgaaggtgaccgccttctaccagcggcgcgagcagaacaaggagctggccaagaagaaggagccccacttcccgcagccctggccccacttcgccgacgagctgcgggcccgcctgtccaagcaccccaaggagagcatcaaggcgctcaacctgggcaactacgacgaccagaagctggagagcctccagccggtcttcgtgtcccggatgcccaagcgcagcgtgaccggcgccgcccaccaggagaccctgcggcgctacgtcgggatcgacgagcggtccggcaagatccagaccgtggtgaagacgaagctgagcgagatcaagctcgacgcctccgggcacttccccatgtacggcaaggagagcgacccgcgcacctacgaggccatccggcagcgcctgctggagcacaacaacgaccccaagaaggcgttccaggagcccctctacaagcccaagaagaacggggagccgggccccgtcatccggaccgtgaagatcatcgacaccaagaaccaggtgatccccctgaacgacggcaagacggtcgcctacaactccaacatcgtgcgcgtggacgtcttcgagaaggacgggaagtactactgcgtgcccgtgtacaccatggacatcatgaagggcatcctgccgaacaaggccatcgagcccaacaagccctacagcgagtggaaggagatgaccgaggactacaccttccggttctccctctaccccaacgacctgatccgcatcgagctgccgcgcgagaagacggtcaagaccgccgcgggggaggagatcaacgtgaaggacgtgttcgtctactacaagaccatcgacagcgccaacggcggcctcgagctgatctcccacgaccaccggttcagcctgcgcggggtgggctcccggaccctcaagcgcttcgagaagtaccaggtggacgtcctggggaacatctacaaggtgcggggcgagaagcgcgtggggctggccagctccgcccacagcaagcccggcaagacgatccggcccctccagtccacccgcgactga

SEQ ID NO: 1566 - RNA, 3264 nt, synthetic construct
  misc_feature 1..3264: note = Cas9 variant
  source 1..3264: mol_type = other RNA
atgctgcgcatgaagtacgccatcggcctcgacatcgggatcgccagcgtgggctacgcggtcctggccctggaccacgaggagaacccctgggggatcatccggctcggctcccgcatcttcgacgtggccgagaacccgaaggacggggccagcctggccctgccccggcgcgaggcgcggtccgtgcgccggcgcctccggcgccaccaccaccggctggagcgcatcaagaacctgctcatcaacaccgagttcatcaccaaggacgagctgctgcacctctacgacggcaacctgagcgacgtctacgagctgcgggtgaaggccctcgactactccgtgacgaacgccgagctgacccgcatcctgctccacctggcccagcggcgcggcttcaagagcaaccggaagtccgacgcgaacgacaaggaggccgggcagctgctcgaggccgtcagcgccaacgccaagcgcatgcaggagaaccactaccggaccgtgggcgagatgttctacaaggacgacctgttctccaagtacaagcgcaacaagggcgggacctacctgacgaccgtgcaccgggacatgatcgcggccgaggcccgcaccatcctcgagaagcagttcgccctggggaacaacatctgcacccaggacttcatcgacaagtacctgagcatcctcctgtcccagcgccagttcgacgagggccccggcgagcccagcccgtacgccgggaaccagatcgcgaacatgatcggcaagtgcacgttcgagcccaacgagtaccgggccgccaaggcctcctacagcttcgagcgcttcaacctgctccagaaggtcaaccacctccggctgctgctggaggggaagtccatcgccctggacaacgagcagcgcaagaagatcatcgcgctcgcccacgacaaggccgacctgcggtacagccacatccgcaaggccctgggcctcgacgagaaggtgctgttcaacaccatcacctacaacgacgacgtgtccgtcatcgagaagaagaccaagttcaacttcctgcaggcctaccaccagatcaagaaggtgctcgcggaggacatgcagaagctgacgaccgagcagctggacaacatcggccagatcctcagcacctacaagtccgacaacaagcggaccgaggagctgagcgccctggggctcgagaagaagatcatcgacgccctgctgggcatcaacgggctgagcaagttcgcccacctctccctgaaggcgctgcgcaagatcaacccctacctcgaggagggcaagatctacaacgaggcctgcacggccgccgggtacgacttcaaggcccacgcgaacacccagaagaccgagctgctgcccgcctacaaggaggagatggacgacatcaccagcccggtggcccggcgcgccatcgcccagtccatcaaggtcatcaacgcgatcatccgggagcagaagggcagccccctctacatcaacatcgagctggcccgcgagatggccaagggcttcgacgagcggacgcagatcgacaaggccaacaaggagaaccaggccaagaacgagcgcatcatggagcggatccgcaccgagttccacaaggcgaaccccaccgggatggacctgatcaagctcaagctgtgggaggagcaggacggccggtccccctacagccagaaggccatctccatcaaccgcctgttcgagccggggtacgtggacatcgaccacatcgtgccctacagcatctccttcgacgacagcttcaagaacaaggtcctcgtgttctccgacgagaaccgggacaagggcaaccgcctgcccatcgcctacctgcagagcaagttcggggccaaggcggccgagaacttcatgatctgggtgcagtccaacatcaaggactacaagaagcgccagaagctcctgaagcgggagatcaccgaggaggacatcaacaagttcaaggagcgcaacctgcaggacacgaagaccatcagccggttcctctacaactacatcaacgactacctgctgttcgccccctccgacaccggcaagaagaagcgcgtcaccgccgtgaacggcacgatcaccgcctacctccggaagcgctgggggatcaacaagatccgggcgaacggcgacaagcaccacgccgtggacgccgtcgtgatcgcctgcaccaccgacaagatgatcaaggacctgagctccttcagccgctaccacgagctggagtacacgcacaccgacaccgagtccttcctcgtcaacagcctgaccggggagatcctgaagcggttcccgtacccctgggaggacttccgccccgagctcatggcccggctgagcgacaaccccgcggacgccctgcgcaagctcaacctgatcttctaccacggcatcgacctgtccacgatcaagccgatcttcgtgagccggatgccccgccacaaggtgaccggggccgcccacaaggccaccatcaagtccgcgcggtgcctcgacaacggcatcgtcatctgcaagaccagcctgcagaacctgaagctcgacaaggagggcgagatcgccaactactacgcccccgagtccgacaccatcctgtacaacgccctgaaggagcgcctccggagctacgacaacaagcccgcgaaggccttcgccgagccgttctacaagcccaaggccgacgggacgcccggccccctggtgaagaaggtgaaggtctacgagaagtccaccctgaacgtggccgtgcagcagaacaccgcggtcgccgacaacgacagcatggtgcgcgtggacgtcttccacgtgaaggggaacggctactacctcgtgccgatctacatcgccgacaccctgaagaaggagctgcccaacaaggccatcgtcgcctacaagccctacgcggactggccggtgatggacgactccaacttcatcttcagcctctaccccaacgacctgatcaagttcgagcacaagaactccgtgaagttcgccaaggtcaacaaggagagcacgctgaacgacttctactccaccaagagcgagatcgtgtacttcaagggctgcaacatcaacaccggggccatcaccatcatcaaccacgagaacacgtacgtggtctccagcctcggcgtgaagaccctgccctccctggagaagtaccaggccgacgtgctcgggaactacaccaaggtcaagaaggaggtgcggaagcccttccgctga

SEQ ID NO: 1567 - RNA, 3264 nt, synthetic construct
  misc_feature 1..3264: note = Cas9 variant
  source 1..3264: mol_type = other RNA
atgcgctacaagatcggcctggacatcgggatcaccagcgtgggctgggccgtcatcaacctcgacatcccccggatcgaggacctgggggtgcgcatcttcgaccgggccgagaacccgcagaccggcgagtccctggcgctcccccgccggctggcccgcagcgcccggcgccggctgcgccggcgcaagcaccggctcgagcgcatccggcgcctgatcatccgggaggggatcctgacgaaggaggagctcgacaagctgttcgaggagaagcacgagatcgacgtgtggcagctgcgcgtcgaggccctcgaccggaagctgaacaacgacgagctggcccgcgtgctcctgcacctggcgaagcggcgcggcttcaagtccaaccgcaagagcgagcggtccaacaaggagaacagcaccatgctcaagcacatcgaggagaaccgcgccatcctgtccagctaccggaccgtgggcgagatgatcgtcaaggaccccaagttcgccctgcacaagcgcaacaagggggagaactacaccaacacgatcgcccgggacgacctcgagcgcgagatccggctgatcttctccaagcagcgcgagttcggcaacatgagctgcaccgaggagttcgagaacgagtacatcgcgatctgggcctcccagcggcccgtggccagcaaggacgacatcgagaagaaggtggggttctgcaccttcgagccgaaggagaagcgcgcccccaaggccacctacacgttccagtccttcatcgcgtgggagcacatcaacaagctgcggctcatcagcccctccggcacccgcgggctgaccgacgaggagcggcgcctgctctacgagcaggccttccagaagaacaagatcacctaccacgacatccggacgctgctgcacctccccgacgacacctacttcaagggcatcgtctacgaccgcggcgagagccggaagcagaacgagaacatccgcttcctggagctggacgcctaccaccagatccggaaggccgtggacaaggtgtacgggaagggcaagtccagctccttcctcccgatcgacttcgacaccttcgggtacgccctgaccctgttcaaggacgacgcggacatccgcagctacctccgcaacgagtacgagcagaacggcaagcggatgcccaacctggccaacaaggtctacgacaacgagctgatcgaggagctcctgaacctgagcttcacgaagttcggccacctctccctgaaggccctgcgcagcatcctcccctacatggagcagggggaggtgtactccagcgcctgcgagcgggccggctacaccttcaccgggcccaagaagaagcagaagaccatgctgctgccgaacatcccgcccatcgcgaaccccgtggtcatgcgcgccctcacgcaggcccggaaggtggtgaacgccatcatcaagaagtacggctcccccgtcagcatccacatcgagctggcccgcgacctgtcccagaccttcgacgagcggcgcaagaccaagaaggagcaggacgagaaccggaagaagaacgagaccgcgatccgccagctgatggagtacgggctcacgctgaaccccaccggccacgacatcgtgaagttcaagctgtggagcgagcagaacggccggtgcgcctactccctccagcccatcgagatcgagcgcctgctggagcccgggtacaccgaggtggaccacgtcatcccgtacagccggtccctcgacgacagctacaccaacaaggtgctggtgctgacgaaggagaaccgcgagaagggcaaccggatccccgccgagtacctcggggtcggcaccgagcgctggcagcagttcgagaccttcgtgctgaccaacaagcagttctccaagaagaagcgggaccgcctgctccggctgcactacgacgagaacgaggagacggagttcaagaaccgcaacctgaacgacacccggtacatcagccgcttcttcgccaacttcatccgcgagcacctcaagttcgcggagtccgacgacaagcagaaggtctacaccgtgaacgggcgggtgaccgcccacctccgcagccggtgggagttcaacaagaaccgcgaggagtccgacctgcaccacgccgtcgacgccgtgatcgtggcctgcacgacccccagcgacatcgcgaaggtcaccgccttctaccagcggcgcgagcagaacaaggagctggccaagaagaccgagccccacttcccgcagccctggccccacttcgccgacgagctgcgggcccgcctgtccaagcaccccaaggagagcatcaaggcgctcaacctgggcaactacgacgaccagaagctggagagcctccagccggtgttcgtgtcccggatgcccaagcgcagcgtcaccggcgccgcccaccaggagacgctgcggcgctacgtggggatcgacgagcggtccggcaagatccagaccgtggtcaagaccaagctgagcgagatcaagctcgacgcctccgggcacttccccatgtacggcaaggagagcgacccgcgcacctacgaggccatccggcagcgcctgctggagcacaacaacgaccccaagaaggcgttccaggagcccctctacaagcccaagaagaacggggagccgggccccgtgatccggacggtgaagatcatcgacaccaagaaccaggtcatccccctgaacgacggcaagaccgtggcctacaactccaacatcgtgcgcgtcgacgtgttcgagaaggacgggaagtactactgcgtgcccgtctacaccatggacatcatgaagggcatcctgccgaacaaggccatcgagcccaacaagccctacagcgagtggaaggagatgacggaggactacaccttccggttctccctctaccccaacgacctgatccgcatcgagctgccgcgcgagaagatcatcaagaccgccgggggcgaggagatcaagatcaaggacctcttcgcgtactacaagaccatccacagcggcacggccgggctggagctggtgtcccacgactgcagcttctccctcagcggcgtggggtcccggaccctgaagcgcttcgagaagtaccaggtcgacgtgctgggcaacatctacaaggtgcgcggggagaagcgggtcggcctcgccagctccgcccacagcaagaccggcgagaccatccggcccctgcagagcacgcgcgactga

SEQ ID NO: 1568 - RNA, 3264 nt, synthetic construct
  misc_feature 1..3264: note = Cas9 variant
  source 1..3264: mol_type = other RNA
atgcgctacaagatcggcctggacatcgggatcaccagcgtgggctgggccgtcatcaacctcgacctgccccggatcgaggacctgggggtgcgcatcttcgaccgggccgagaacccgcagaccggcgagtccctcgcgctgccccgccggctggcccgcagcgcccggcgccggctccgccggcgccggcaccgcctggagcggatccgccggctgctcacgcgcgagaacgtgctgacccaggaggagctggacaagctgttcgagaagaagcacgagatcgacgtctggcagctgcgggtggaggccctggaccgcaagctcaacaacgacgagctggcccgggtgctgctccacctggcgaagcgccgcgggttcaagtccaaccgcaagagcgagcggtccaacaaggagaacagcaccatgctgaagcacatcgaggagaaccggtccatcctcaccggctaccgcacggtcggcgagatgatcgtgcgggaccccaagttcgtgctgcacaagcgcaacaagggggagaactacaccaacaccatcgcccgggacgacctggagcgcgagatccagctcatcttcgcccggcagcgcgagttcggcaacatgatctgcaccgaggccttcgagaacgagtacatcgcgatctggagctcccagcggcccgtcgccagcaaggacgacatcgagaagaaggtggggttctgcacgttcgagccgaaggagaagcgcgcccccaaggccacctacaccttccagtccttcatcgcctgggagcacatcaacaagctgcggctggtgagcccctccggcacccgcgagctcacggacgaggagcggcgcctgctgtacgagcaggcgttccagaagaacaagctcacctaccacgacatccggaccctgctgcacctccccgacgacacctacttcaaggggatcgtctacgactggggcgagccgctgaagcagaacgagaacatccgcttcctggagctcgacgcctaccaccagatccggaagacggtggacaaggtgtacggccgcggcaagagctccagcttcctgcccatcgacttcgacaccttcgggtacgccctgaccctcttcaaggacgacgcccacatccgctcctacctgcggaacgagtacgagcagaacgggaagcgcatcgccaacctggcgaacaaggtctacgacaacgagctcatcgaggagctgctgaacctcagcttcaccaagttcggccacctgtccctgaaggccctccggaacatcctgccctacatggagcagggcgaggtgtacagcagcgcctgcgagcgcgccgggtacacgttcaccggccccaccaagaagcagaagaccgtgctgctgccgacgatcccgcccatcgccaaccccgtcgtgatgcgggcgctcacccaggcccgcaaggtggtcaacgccatcatcaagaagtacgggtcccccgtgagcatccacatcgagctggcccgggacctgtcccagaccttcgacgagcgcaagaagaccaagaaggagcaggacgagaaccggaagcgcaacgagacggccatccggcagctcatcgagtacggcctgacccgcaaccccaccgggcacgacatcgtgaagttcaagctgtggagcgagcagaacggccggtgcgcgtactccctccagcccatcgagatcaagcgcctgctggagcccggctacgtcgaggtggaccacgtcatcccgtacagccggtccctcgacgacagctacaccaacaaggtgctggtgctgacgaaggagaaccgcgagaaggggaaccggatccccgccgagtacctcggcgtcgggaccgagcgctggcagcagttcgagaccttcgtgctgaccaacaagcagttctccaagaagaagcgggaccgcctgctccggctgcactacgacgagaacgaggaggccgagtggaagaaccgcagcctgaacgacacgcgctacatctcccggttcttcgccaacttcatccgcgagcacctcaagttcgcggacagcgacgacaagcagaaggtgtacaccgtcaacggcggggtgaccgcccacctccggtcccgctgggacttcaacaagaaccgggaggagagcgacctgcaccacgccgtggacgccgccatcgtcgcgtgcaccaccctctccgacatcgcccgcgtgacggccttctaccagcggcgcgagcaggccaaggagctggccaagaagaccgagccccacttcccccagccgtggccccacttcgcggacgagctgcgggcccgcctcagcaagaaccccaaggagtccatcaaggccctgaacctgggcaactacgacaacgagaagctcgagagcctgcagcccgtgttcgtctcccggatgccgaagcgcagcgtgaccggcgccgcccaccaggagaccctgcggcgctacatcgggatcgacgagcggagcggcaagatccagacggtggtcaagaccaagctctccgagatcaagctggacgcgagcgggcacttccccatgtacggcaaggagtccgacccccgcacctacgaggccatccggctgcgcctcctggagcacaacaacgacccgcggaaggccttccaggagcccctgtacaagcccaagaagaacggggagctcggccccatcatccgcaccgtgaagatcatcgacacgaagaaccaggtgatcccgctgaacgacggcaagaccgtcgcctacaacagcaacatcgtgcgcgtggacgtcttcgagaaggacgggaagtactactgcgtgcccgtgtacaccatggacatcatgaagaaggtcctgcccaacaaggcgatcgagcccaacaagccgtactccgagtggaaggagatgaccgaggactacacgttccggttcagcctctaccccaacgacctgatccgcatcgagctgccccgggagaagaccgtgaagaccaccgccggccacgagatcaacatcaaggacgtgttcgtctactacaagacgatcgactccgccaccgggggcctcgagctgatcagccacgacaactccttcagcctgcgcggcatcgggtcccggaccctcaagcgcttcgagaagtaccaggtggacgtgctgggcaacatctacaaggtccgcggggagaagcgggtgggcctggccagctccgcccaccccgagacccgggagacgatccgcccgctccagagcacccgggactga

SEQ ID NO: 1569 - RNA, 3264 nt, synthetic construct
  misc_feature 1..3264: note = Cas9 variant
  source 1..3264: mol_type = other RNA
atgaagaagctggtgctcggcctggacatcggggtcgccagcgtgggctgggggatcatcgacgccgagaacggcgacgtggtcgacaccggggtgcgcctgttctccagccgggacgcgtccgagaacgagagccgccggacctcccgccagagccggcgcctctcccggcgcaagaagcaccggcgcgagcggatcaagcagctgctgctcgcccacgacatggacatctgcgacatcgtgaacgagaacccctacgagctgcgcgtcaagggcctgaacgagaagctcgaggtgagcgagatctacgtggccctgacgcacctggccaagcggcgcggcgtctcctacctcgacgacgtggtggaggagggcgggaccatcaagagcgagcacctgaacaagaacatggaggagatcaagtccgggaagatgccgtgcgagatccagctggagcggttcgagaagtacggccaggtccgcgggatgatcgagatcaaccaggacaccgaggagagctccttcctcgtgaacatcttccggaccagcgactacatcaaggaggccaagacgatcctggcgacccagcagaagttccacaagcagatcaccaacgagttcatcgacgagtacatccacatcatggcctccaagcgcgactacttcatcggccccggcaacgagaagtcccggaccgactacggggtgtaccgcacgaacggcgacacctgggacaacctgttcgagatcctcatcgggaagtgcagcgtcttccccgaggagacccgggccgcccgcagctcctacgtggcgcaggagttcaacctgctgaacgacctcaacaacctgaagatcagcaacctggagagcggcaagctctccgccagccagaagcacgacatcgtggagaaggtcaagaactccaagaagttcggcaccaaggacctgctgaagtacatcgccagcgtgtgcgagtgcaagatcgaggacatcgggggctgccgcgtggacaagaaccggaagcccatcatgcacacgttcgagaactaccgcaaggtccacaacgccctcaacgaggccggggtggacctgcggctgtccgagaccgactacgacgagctcatgaagatcatgaccctgaacagcgagaccctggagatcaagaagcagtgcaaggagaagctcccgcagctgacggaggactacctgaacgtgtgcctcgtcctgaacaagaagggcgcgttctccgggtggcacgccctgagcctcaaggccatgaagctgatgatgcccgagctgtacggcacctccaagaaccagatgcagatcatccacaccatgcagctcggcaaggcctacctgaagcccctgaaccagcagaagtacctcaacagcgaggccatcctggaggagatctacaaccccatcgcggcccgctccatccggcagaccatcaaggtgacgaacgccatcctgaagaagtacgggcacctcgacagcgtcatcatcgagatgccgcgcgactaccagacctccgaggacgagcggaagatgatcgagaagatgcagaaggagaacgagaaggagaagaaggccgccctgaagcgcgcgcgggaggagtaccccttccccgacgaggccttccgcaaccacaaggagctggccaccaagctgcggctctggtaccagcaggaccagttctgcgtgtacagcggccgcaagatctccgtggtcgacctggtgcggaaccccaaccagttcgagatcgaccacatcatcccgcagagcgtgtccctggacgacagcctcaacaacaaggtcctgtgcttctccgaggagaaccagaagaaggggcagcagacccccttctactaccacaagggcaagagcgggaactggacgtacgagcagtacaagctgttcgtggagaagctgttcgacaagaagaagatcagcaacaagaagcgcgagctgctcctcttcgaggaggacatcaacaagtgggacgtgcggcgcggcttcatcgcccggaacctggtcgacacccgctacgcctcccgggtgatcctgaacagctaccagcagtacttcggcaaccacgagatggggaccaaggtgaaggtcgtgcgcggcaagttcacctcccagctccgcaagaagtggcggatcttcaaggaccgcaacgagagccactcccaccacgcgatcgacgccctgatcgtggccgccacggcgaacctgcggctctggaagaagaacaccctgggggtcagcgacgagggcaaggtgtacgacaaggagaccggggagatcctgcccttcgagaagctcaccgagtccgagtacaacgagatgatgaacaaggagccctacctgaacttcaagacgaagctgcagaacatcgagaccaaggtgaagtacagctaccgcgtctccaagaaggtgaaccggaagatcagcgacgccaccatctactccacccgcgagcgggacggcatcgactacatcgtgggcaagatcaagaacatctacgacgtcaagacgtacaaggaccagttcctcaagcgctacaagaagaacaaggagcagttcctgatgtaccagcacgacccgcagaccttcgccatcctggagaacatcatggccacctaccaggacgccgagaaccccttcctcgcgtacaagaaggagtacggggtgatccggaagtacagcaagaagggcgggggctcccccgtgaccagcctgaagttcatcgacaaggtcctgggccagaagatcgacctcaccgccaagaaccaggccgccctgcccaagaacaagaaggtggtgctgcagtccatcacgccgtaccgcgccgacgtctactacgacgagatcgacaagcggtaccacctcatcggggtgaagtacagcctgttctccttcagcaagcagggctacgtgatcaaccccatcgcgtaccagaagctgctcgagaaggagcagatccacagcgagatgaagttctgcttctccctgtaccgcgaggacatcatcgagttcggggaggaccccgacagcctgacccggtaccgcttctggtccaagaacgagagcggcaagaacaagatcgaggtcaagcccatcgagaagccgaacttcgagaagcagaccgtgctcaccatcacgaagaagatcaagatcctgaacaagtaccagaccgacgtgctggggaactccttcaaggcccaggaggagaaggacccccggaacatcgagtga

SEQ ID NO: 1570 - RNA, 3264 nt, synthetic construct
  misc_feature 1..3264: note = Cas9 variant
  source 1..3264: mol_type = other RNA
atgcgctacaagatcggcctggacatcgggatcaccagcgtgggctgggccgtcatgaacctcgacatcccccggatcgaggacctgggggtgcgcatcttcgaccgggccgagaacccgcagaccggcgagtccctggcgctcccccgccggctggcccgcagcgcccggcgccggctgcgccggcgcaagcaccggctcgagcgcatccggcgcctggtgatccgggaggggatcctgacgaaggaggagctcgacaagctgttcgaggagaagcacgagatcgacgtctggcagctgcgcgtggaggccctcgaccggaagctgaacaacgacgagctggcccgcgtgctcctgcacctggcgaagcggcgcggcttcaagtccaaccgcaagagcgagcggtccaacaaggagaacagcaccatgctcaagcacatcgaggagaaccgcgccatcctgtccagctaccggaccgtcggcgagatgatcgtgaaggaccccaagttcgccctgcacaagcgcaacaagggggagaactacaccaacacgatcgcccgggacgacctcgagcgcgagatccggctgatcttctccaagcagcgcgagttcggcaacatgagctgcaccgaggagttcgagaacgagtacatcaccatctgggcgtcccagcggcccgtggccagcaaggacgacatcgagaagaaggtcgggttctgcaccttcgagccgaaggagaagcgcgcccccaaggccacgtacaccttccagtccttcatcgcctgggagcacatcaacaagctgcggctcatcagcccctccggcgcgcgcgggctgaccgacgaggagcggcgcctgctctacgagcaggccttccagaagaacaagatcacctaccacgacatccggacgctgctgcacctccccgacgacacctacttcaagggcatcgtgtacgaccgcggcgagagccggaagcagaacgagaacatccgcttcctggagctggacgcctaccaccagatccggaaggccgtggacaaggtctacgggaagggcaagtccagctccttcctcccgatcgacttcgacaccttcgggtacgccctgaccctgttcaaggacgacgcggacatccacagctacctccgcaacgagtacgagcagaacggcaagcgcatgcccaacctggccaacaaggtgtacgacaacgagctgatcgaggagctcctgaacctgagcttcacgaagttcggccacctctccctgaaggccctgcggagcatcctcccctacatggagcagggggaggtgtactccagcgcctgcgagcgcgccggctacaccttcaccgggcccaagaagaagcagaagaccatgctgctgccgaacatcccgcccatcgcgaaccccgtcgtgatgcgggccctcacgcaggcccgcaaggtggtcaacgccatcatcaagaagtacggctcccccgtgagcatccacatcgagctggcccgggacctgtcccagaccttcgacgagcgccggaagaccaagaaggagcaggacgagaaccgcaagaagaacgagaccgcgatccggcagctgatggagtacgggctcacgctgaaccccaccggccacgacatcgtgaagttcaagctgtggagcgagcagaacggccgctgcgcctactccctccagcccatcgagatcgagcggctgctggagcccgggtacgtcgaggtggaccacgtgatcccgtacagccgctccctcgacgacagctacaccaacaaggtcctggtgctgacccgggagaaccgcgagaagggcaaccggatccccgccgagtacctcggggtcggcacggagcgctggcagcagttcgagaccttcgtgctgaccaacaagcagttctccaagaagaagcgggaccgcctgctccggctgcactacgacgagaacgaggagaccgagttcaagaaccgcaacctgaacgacacgcggtacatcagccgcttcttcgccaacttcatccgcgagcacctcaagttcgcggagtccgacgacaagcagaaggtgtacaccgtcaacgggcgggtgaccgcccacctccgcagccggtgggagttcaacaagaaccgcgaggagtccgacctgcaccacgccgtggacgccgccatcgtcgcgtgcaccacgcccagcgacatcgccaaggtgaccgccttctaccagcggcgcgagcagaacaaggagctggccaagaagaccgagccccacttcccgcagccctggccccacttcgccgacgagctgcgggcgcgcctgtccaagcaccccaaggagagcatcaaggccctcaacctgggcaactacgacgaccagaagctggagagcctccagccggtgttcgtctcccggatgcccaagcgcagcgtgaccggcgccgcccaccaggagaccctgcggcgctacgtggggatcgacgagcggtccggcaagatccagacggtcgtgaagaccaagctgagcgagatcaagctcgacgcctccgggcacttccccatgtacggcaaggagagcgacccgcgcacctacgaggcgatccggcagcgcctgctggagcacaacaacgaccccaagaaggccttccaggagcccctctacaagcccaagaagaacggggagccgggccccgtgatccggaccgtcaagatcatcgacacgaagaaccaggtgatccccctgaacgacggcaagaccgtggcctacaactccaacatcgtccgcgtggacgtgttcgagaaggacgggaagtactactgcgtccccgtgtacaccatggacatcatgaagggcatcctgccgaacaaggccatcgagcccaacaagccctacagcgagtggaaggagatgaccgaggactacacgttccggttctccctctaccccaacgacctgatccgcatcgagctgccgcgcgagaagaccgtgaagaccgcggccggggaggagatcaacgtcaaggacgtgttcgtgtactacaagaccatcgacagcgccaacggcggcctcgagctgatctcccacgaccaccggttcagcctgcgcggggtcggctcccggacgctcaagcgcttcgagaagtaccaggtggacgtgctggggaacatctacaaggtccggggcgagaagcgcgtggggctggccagctccgcccacagcaagaccggcgagaccgtgcggcccctccagtccacccgcgactga

SEQ ID NO: 1571 - RNA, 3264 nt, synthetic construct
  misc_feature 1..3264: note = Cas9 variant
  source 1..3264: mol_type = other RNA
atgcgctacaagatcggcctggacatcgggatcaccagcgtgggctgggccgtcatgaacctcgacatcccccggatcgaggacctgggggtgcgcatcttcgaccgggccgagaacccgcagaccggcgagtccctggcgctcccccgccggctggcccgcagcgcccggcgccggctgcgccggcgcaagcaccggctcgagcgcatccggcgcctggtgatccgggaggggatcctgacgaaggaggagctcgacaagctgttcgaggagaagcacgagatcgacgtctggcagctgcgcgtggaggccctcgaccggaagctgaacaacgacgagctggcccgcgtgctcctgcacctggcgaagcggcgcggcttcaagtccaaccgcaagagcgagcggtccaacaaggagaacagcaccatgctcaagcacatcgaggagaaccgcgccatcctgtccagctaccggaccgtcggcgagatgatcgtgaaggaccccaagttcgccctgcacaagcgcaacaagggggagaactacaccaacacgatcgcccgggacgacctcgagcgcgagatccggctgatcttctccaagcagcgcgagttcggcaacatgagctgcaccgaggagttcgagaacgagtacatcaccatctgggcgtcccagcggcccgtggccagcaaggacgacatcgagaagaaggtcgggttctgcaccttcgagccgaaggagaagcgcgcccccaaggccacgtacaccttccagtccttcatcgcctgggagcacatcaacaagctgcggctcatcagcccctccggcgcgcgcgggctgaccgacgaggagcggcgcctgctctacgagcaggccttccagaagaacaagatcacctaccacgacatccggacgctgctgcacctccccgacgacacctacttcaagggcatcgtgtacgaccgcggcgagagccggaagcagaacgagaacatccgcttcctggagctggacgcctaccaccagatccggaaggccgtggacaaggtctacgggaagggcaagtccagctccttcctcccgatcgacttcgacaccttcgggtacgccctgaccctgttcaaggacgacgcggacatccacagctacctccgcaacgagtacgagcagaacggcaagcgcatgcccaacctggccaacaaggtgtacgacaacgagctgatcgaggagctcctgaacctgagcttcacgaagttcggccacctctccctgaaggccctgcggagcatcctcccctacatggagcagggggaggtgtactccagcgcctgcgagcgcgccggctacaccttcaccgggcccaagaagaagcagaagaccatgctgctgccgaacatcccgcccatcgcgaaccccgtcgtgatgcgggccctcacgcaggcccgcaaggtggtcaacgccatcatcaagaagtacggctcccccgtgagcatccacatcgagctggcccgggacctgtcccagaccttcgacgagcgccggaagaccaagaaggagcaggacgagaaccgcaagaagaacgagaccgcgatccggcagctgatggagtacgggctcacgctgaaccccaccggccacgacatcgtgaagttcaagctgtggagcgagcagaacggccgctgcgcctactccctccagcccatcgagatcgagcggctgctggagcccgggtacgtcgaggtggaccacgtgatcccgtacagccgctccctcgacgacagctacaccaacaaggtcctggtgctgacccgggagaaccgcgagaagggcaaccggatccccgccgagtacctcggggtcggcacggagcgctggcagcagttcgagaccttcgtgctgaccaacaagcagttctccaagaagaagcgggaccgcctgctccggctgcactacgacgagaacgaggagaccgagttcaagaaccgcaacctgaacgacacgcggtacatcagccgcttcttcgccaacttcatccgcgagcacctcaagttcgcggagtccgacgacaagcagaaggtgtacaccgtcaacgggcgggtgaccgcccacctccgcagccggtgggagttcaacaagaaccgcgaggagtccgacctgcaccacgccgtggacgccgtcatcgtggcctgcaccacgcccagcgacatcgcgaaggtgaccgccttctaccagcggcgcgagcagaacaaggagctggccaagaagaccgagccccacttcccgcagccctggccccacttcgccgacgagctgcgggcccgcctgtccaagcaccccaaggagagcatcaaggcgctcaacctgggcaactacgacgaccagaagctggagagcctccagccggtcttcgtgtcccggatgcccaagcgcagcgtgaccggcgccgcccaccaggagaccctgcggcgctacgtcgggatcgacgagcggtccggcaagatccagacggtggtgaagaccaagctgagcgagatcaagctcgacgcctccgggcacttccccatgtacggcaaggagagcgacccgcgcacctacgaggccatccggcagcgcctgctggagcacaacaacgaccccaagaaggcgttccaggagcccctctacaagcccaagaagaacggggagccgggccccgtcatccggaccgtgaagatcatcgacacgaagaaccaggtgatccccctgaacgacggcaagaccgtcgcctacaactccaacatcgtgcgcgtggacgtcttcgagaaggacgggaagtactactgcgtgcccgtgtacaccatggacatcatgaagggcatcctgccgaacaaggccatcgagcccaacaagccctacagcgagtggaaggagatgaccgaggactacacgttccggttctccctctaccccaacgacctgatccgcatcgagctgccgcgcgagaagaccgtcaagaccgccgcgggggaggagatcaacgtgaaggacgtgttcgtctactacaagaccatcgacagcgccaacggcggcctcgagctgatctcccacgaccaccggttcagcctgcgcggggtgggctcccggacgctcaagcgcttcgagaagtaccaggtggacgtcctggggaacatctacaaggtgcggggcgagaagcgcgtggggctggccagctccgcccacagcaagcccggcaagaccatccggcccctccagtccacccgcgactga

SEQ ID NO: 1572 - RNA, 3264 nt, synthetic construct
  misc_feature 1..3264: note = Cas9 variant
  source 1..3264: mol_type = other RNA
atgcgctacaagatcggcctggacatcgggatcaccagcgtgggctgggccgtcatcaacctcgacatcccccggatcgaggacctgggggtgcgcatcttcgaccgggccgagaacccgcagaccggcgagtccctggcgctcccccgccggctggcccgcagcgcccggcgccggctgcgccggcgcaagcaccggctcgagcgcatccggcgcctgatcatccgggaggggatcctgacgaaggaggagctcgacaagctgttcgaggagaagcacgagatcgacgtgtggcagctgcgcgtcgaggccctcgaccggaagctgaacaacgacgagctggcccgcgtgctcctgcacctggcgaagcggcgcggcttcaagtccaaccgcaagagcgagcggtccaacaaggagaacagcaccatgctcaagcacatcgaggagaaccgcgccatcctgtccggctaccggaccgtgggggagatgatcgtcaaggaccccaagttcgccctgcacaagcgcaacaagggcgagaactacaccaacacgatcgcccgggacgacctcgagcacgagatccgcctgatcttcagcaagcagcgggagttcgggaacatgtcctgcaccgagaagttcgagaacgagtacatcaccatctgggcgagccagcgccccgtggcctccaaggacgacatcgagaagaaggtgggcttctgcaccttcgagccgaaggagaagcgggcccccaaggccacgtacaccttccagagcttcatcgcctgggagcacatcaacaagctgcgcctcatcttcccctccggggcgcggggcctgaccgacgaggagcgccggctgctctacgagcaggccttccagaagaacaagatcacctaccacgacatccgcacgctgctgcacctccccgacgacacctacttcaagggcatcgtctacgaccgcggggagagccggaagcagaacgagaacatccggttcctggagctggacgcctaccaccagatccgcaaggccgtggacaaggtgtacggcaaggggaagtccagctccttcctcccgatcgacttcgacaccttcggctacgccctgaccctgttcaaggacgacgcggacatccacagctacctccggaacgagtacgagcagaacggcaagcgcatgcccaacctggccaacaaggtctacgacaacgagctgatcgaggagctcctgaacctgtccttcacgaagttcgggcacctcagcctgaaggccctgcgcagcatcctcccctacatggagcagggcgaggtgtactccagcgcctgcgagcgggccgggtacaccttcaccggccccaagaagaagcagaagaccatgctgctgccgaacatcccgcccatcgcgaaccccgtggtcatgcgcgccctcacgcaggcccggaaggtggtgaacgccatcatcaagaagtacgggtcccccgtcagcatccacatcgagctggcccgcgacctgtcccagaccttcgacgagcggcgcaagaccaagaaggagcaggacgagaaccggaagaagaacgagaccgcgatccgccagctgatggagtacggcctcacgctgaaccccaccggccacgacatcgtgaagttcaagctgtggagcgagcagaacgggcggtgcgcctactccctccagcccatcgagatcgagcgcctgctggagcccggctacgtggaggtcgaccacgtgatcccgtacagccggtccctcgacgacagctacaccaacaaggtgctggtcctgacccgcgagaaccgggagaaggggaaccgcatccccgccgagtacctcggcgtggggacggagcggtggcagcagttcgagaccttcgtcctgaccaacaagcagttctccaagaagaagcgcgaccggctgctccgcctgcactacgacgagaacgaggagaccgagttcaagaaccggaacctgaacgacacgcgctacatcagccggttcttcgccaacttcatccgcgagcacctcaagttcgcggagtccgacgacaagcagaaggtgtacaccgtgaacggccgcgtcaccagccacctccggtcccgctgggacttcaacaagaaccgggaggagagcgacctgcaccacgccgtggacgccgccatcgtggcctgcaccacgccctccgacatcgcgaaggtcaccgccttctaccagcgccgggagcagaacaaggagctggccaagaagaccgagccccacttcccgcagccctggccccacttcgccgacgagctgcgcgcccggctgagcaagcaccccaaggagtccatcaaggcgctcaacctgggcaactacgacgaccagaagctggagagcctccagccggtgttcgtgagccgcatgcccaagcggtccgtcaccggggccgcccaccaggagaccctgcgccggtacatcggcatcgacgagcgcagcgggaagatccagacggtggtgaagaccaagctgtccgagatcaagctcgacgccagcggccacttccccatgtacgggaaggagtccgacccgcggacctacgaggccatccgccagcggctgctggagcacaacaacgaccccaagaaggcgttccaggagcccctctacaagcccaagaagaacggcgagccgggccccatcatccgcaccgtcaagatcatcgacacgaagaaccaggtgatccccctgaacgacgggaagaccgtggcctacaacagcaacatcgtccgggtggacgtgttcgagaaggacggcaagtactactgcgtccccgtgtacaccatggacatcatgaaggggatcctgccgaacaaggccatcgagcccaacaagccctactccgagtggaaggagatgaccgaggactacacgttccgcttcagcctctaccccaacgacctgatccggatcgagctgccgcgcgagaagaccgtgaagaccaccacgggcgaggagatcaacgtcaaggacgtgttcgtgtactacaagaccatcgactccgccaccggcgggctcgagctgatcagccacgacaaccgcttctccctgcggggcgtcgggagccgcaccctcaagcggttcgagaagtaccaggtggacgtgctgggcaacatctacaaggtccgcggggagaagcgggtgggcctggcgtccagcgcccactccaagacgggcgagaccatccgccccctccagagcacccgggactga

SEQ ID NO: 1573 - RNA, 3264 nt, synthetic construct
  misc_feature 1..3264: note = Cas9 variant
  source 1..3264: mol_type = other RNA
atgcgctacaagatcggcctggacatcgggatcaccagcgtgggctgggccgtcatcaacctcgacatcccccggatcgaggacctgggggtgcgcatcttcgaccgggccgagaacccgcagaccggcgagtccctggcgctcccccgccggctggcccgcagcgcccggcgccggctgcgccggcgcaagcaccggctcgagcgcatccggcgcctgctgatccgggagggggtgctcacgaaggaggagctggacaagctgttcgaggagaagcacgagatcgacgtctggcagctccgcgtggaggccctggaccggaagctgaacaacgacgagctcgtgcgcgtcctgctgcacctcgccaagcggcgcggcttcaagtccaaccgccagagcgagcggtccaacaaggagaacagcaccatgctgaagcacatcgaggagaaccgcgcgatcctgtccggctaccggaccgtgggggagatgatcgtgaaggaccccaagttcgccctccacaagcgcaacaagggcgagaactacaccaacacgatcgcccgggacgacctggagcgcgagatccggctgatcttcagcaagcagcgcgagttcgggaacatgtcctgcaccgaggagttcgagaacgagtacatcgccatctgggcgagccagcggcccgtcgcctccaaggacgacatcgagaagaaggtgggcttctgcaccttcgagccgaaggagaagcgcgcccccaaggccacctacacgttccagagcttcatcgcctgggagcacatcaacaagctccggctgatctcccccagcgggacccgcggcctgaccgacgaggagcggcgcctcctgtacgagcaggcgttccagaagaacaagatcacctaccacgacatccggacgctgctccacctccccgacgacacctacttcaagggcatcgtgtacgactggggcgagtccctgaagcagaacgagaacatccgcttcctggagctggacgcctaccaccagatccggaaggccatcgacaaggtctacgggaagggcaagagctccagcttcctgccgatcgacttcgacaccttcgggtacgccctcaccctgttcaaggacgacgccgacatccgctcctacctgcggaacgagtacgagcagaacggcaagcgcatcgcgaacctcgccaacaaggtgtacgacaacgagctgatcgaggagctgctcaacctgagcttcacgaagttcgggcacctgagcctcaaggccctgcgcaacatcctgccctacatggagcagggcgaggtgtactccagcgcctgcgagaaggccgggtacaccttcaccggccccaagaagaagcagaagaccgtcctcctgcccacgatcccgcccatcgtgaaccccgtggtcatgcgggcgctgacccaggcccgcaaggtggtgaacgccatcatcaagaagtacgggtcccccgtcagcatccacatcgagctggcccgggacctctcccagaccttcgacgagcgccggaagaccaagcgcgagcaggacgagaaccggaagcgcaacgagacggccatccggcagctgatggagtacggcctgaccctcaacccgaccggcctggacatcgtgaagttcaagctgtggagcgagcagaacgggcgctgcgcgtactccctccagcccatcgagatcgagcggctgctggagcccggctacgtggaggtcgaccacgtgatcccctacagccgctccctcgacgacagctacaccaacaaggtcctggtgctgacgaaggagaaccgggagaaggggaaccgcatcccggccgagtacctcggcgtggggaccgagcggtggcagcagttcgagaccttcgtcctgaccaacaagcagttctccaagaagaagcgcgaccggctgctccgcctgcactacgacgagaacgaggagatggagttcaagagccggaacctgaacgacacgcgctacatctcccggttcttcgccaacttcatccgcgagcacctcaagttcgccgagagcgacgacaagcagaaggtgtacaccgtgaacggccgcgtcacctcccacctccggagccgctgggacttcaacaagaaccgggaggagtccgacctgcaccacgcggtggacgccgccatcgtggcctgcaccacgcccagcgacatcgccaaggtcaccgcgttctaccagcgccgggagcagaacaaggagctggccaagaagaccgagccccagttcccccagccgtggccccacttcgccgacgagctgcgcgcccggctgtccaagcaccccaaggagagcatcaaggccctcaacctgggcaactacgacgaccagaagctggagagcctccagcccgtgttcgtgtcccgcatgccgaagcggagcgtcaccggggcggcccaccaggagaccctgcgccggtacatcggcatcgacgagcgctccgggaagatccagacggtggtgaagaccaagctgagcgagatcaagctcgacgcctccggccacttccccatgtacgggaaggagagcgacccccggacctacgaggccatccgccagcggctgctggagcacaacaacgacccgaagaaggccttccaggagcccctctacaagcccaagaagaacggcgagcccggcccgatcatccgcaccgtcaagatcatcgacacgaagaaccaggtgatccccctgaacgacgggaagaccgtggcgtacaactccaacatcgtccggatcgacgtgttcgagaaggacggcaagtactactgcgtgcccgtctacaccatggacatcatgaagggggtgctgcccaacaaggccatcgagccgaacaagccctacagcgagtggaaggagatgaccgaggactacacgttccgcttctccctctaccccaacgacctgatccggatcgagctgccccgcgagaagaccgtgaagaccgccgccggcgaggagatcaacatcaaggacatgttcgtctactacaagaccatcgacagcgcgaacggcgggctcgagctgatctcccacgacaacagcttctccctgcgcggcgtggggagccggacgctcaagcgcttcgagaagtaccaggtggacgtcctgggcaacatctacaaggtgcgcggggagaagcgggtgggcctggcctccagcgcccactccaagaccggcgagaccatccggccgctccagagcacccgcgactga

SEQ ID NO: 1574 - RNA, 3267 nt, synthetic construct
  misc_feature 1..3267: note = Cas9 variant
  source 1..3267: mol_type = other RNA
atgcccaaggagttcgacccgctgaagcccgccaagtaccgcctcgccctggacatcggcagcaagtccatcgggttcgcgatcatcttcctgaaggaggacgtgaacaagctcctgaagccctacgccatcgtccggagcggcgtgcgcatcttcggggacggccggacccccgccgccccggggcagctgggctccagcctcgccgcggagcgccgggtgaagcgctccatccggcgccagtacgcccggaagcgcaagcggctgcagcgcctgctccggaacctgaaggagctgggcttcttccccgacgacagcaagctctgcaagtccttcgaggacctgaacccctacgagctgcgccacaaggggctcaccaaggagctgaagccccacgagttcggccggctgctcatgcacatggccaagaaccgcgggttccagagcaaccggaaggtcgacctgctggccgacaacatcgactcccaggcgaaggccgagacgagcgccatgaagtccgccatcgccaccctccagagccgcctgaacggcgagttcgagaccctgggggcgtacctctacgagcggttcaagaagggcgagaccatcaagtccagcaagacgcagaagggccagaaggccgagtacgagttctccatcagccgccggatggtgaagcaggagttcgaccgcctgtgggccgcccaggagcagttcaacccggagctgttcaacgagcaggccaagaacaccctcaaggacaccatcttcttccagcgcaacctgctgccccagaaggtggggaagtgcaccttcctccccgagcacgagcgggcgtccaaggccctgcccagctcccagtacttccgcatcatcagcgagctgaacaagatcagcttcacggacgccgagggcctcatcctgccgatctccctggagcagcggaacaagctcctcaagagcctgcgcatcaagcagaagctgtccttcgaccggatccgcaccgagctgaacctggacagcaccgtcctcatcaacctggagcacgcctccaaggacagcatcgagggggacaagaccggctacctgctctccaagaaggagtacttcggccccgcctggcgggacctgagcctggagacgcaggacgcgatcgtgaccgccctcctgacccacgagaacgaggccgagctggtgcagaagctggtcgacgacttcaacatcgcccacgacgtggccaaggcgctcgccaacgcccgcctggagtcccagtacatgcggctgagcaaggaggccatcgagcgcctcatccccgagctggagaagggggtggactcccaggacggctacaaggtccccgtgaagtaccacgaggcgaccgaggccgccgggttcggccaccacagcgccctgcaggagaactgggccgacttcccgacgctcgacctgaagcagctgcactccgacgacaacgacaagtacaccgtggcggagctccccctgccctactacgggaaggtcatcacccgccaggtggccttcggcaccggcgacgtgaacgaccccgtcgagaagcggttcgggaagatcgccaacccgacggtgcacatctgcctgaaccaggtgcgggtcctcctggacgagatcatcgccaagtacggctacccctacgaggtgaacatcgagctggcccgcgagctcaagcagaaccacgagcagcggcagcgcagcatcaagcagcaggcggccaacaagaaggagaacgaggagatccggcgcgagatcaagcaggcctacaaggtggagaaggcccggatcatcaccgactccgagatcagccgcgccgacatcgagaagtggcgcctgtggcggcgctccaagagcaagctgtgcgtctactccgggaagaagatctgcgagaccatgatcctcaacaacgaggtggaggtcgaccacatcctgccccggagccgcaccggcgacaacagctaccagaacaaggtgctggtgctcaacaaggcgaaccggatcaagtccaaccgcacgccctgggaggccaaggagctgttcgaggcccaggggtggagctacgaggacatcctgaaccggatgcgcgccctcgacaagcaccagctgttccggttcgcggagaactccatggacatctgggacaagaactaccgcagcttcgaggcccgggccctgaacgacacccgctacatctcccgggtcgtgaaggactacctcaaggtggtctgccacaaggaccgcatcgtggtgagcaacggcgcccacaccgccctgatccggcgcgagttcggcctgaacgacctcctggggaagaagggcgagaagaaccgggacgaccaccgccaccacgcgatcgacgcctgcgtcatcggggccctggaccggtccatgctccgcaagctgcagatcgccatggaggtggccgagaagcagaacagcgcgcggaacttcgtgggcctgcaggagccgtggttcaacttctccacccaggtccgccgcagcatcgggcagatctacgtgtcccacaagcccaaccacaactacgagggcgagatcttcgaggccagcatctacggcctccggctgatctccgacaagcgcacggagaagtacgtggggatcaagcggaaccccgagaccggcaagaccgacaagcccaagaagtccgtcgtggtgatcagcgacccgaagacccagaaccgctacgggctgcggcacaagttccacagcgagggcctccccaagaagtactacggcctgtccagcagctccgtcttctgcctggagatctaccgcgacgagaaggggaactggcaggcctacacgatcccccggtacgaggcctaccgcatcgtgaagcggcgcggcgtgaacgccctctacgacaacaagcggagcaacttcgaggggcgcccgctggtcatgcggctgatgcgcgacgactgcatcgcgttcgagaagaacggcgtgaaggaggtgtaccggatccagaagatcaacgggctcaagaagaacatcaccctgacccgccacttcgacgccaacgtcgacgaccggtaccgccggatgctgaaggcccagaaggccgagaaggcgggcgaggacttcgactccgaggacctctgcgacgacctggtgttcagctccttcggcgccagctccctgtacagcaacaaggcccgcaaggtgaccatctcccccatgggggtcctccgcgaccccggcttcaaggggtga

SEQ ID NO: 1575 - RNA, 3267 nt, synthetic construct
  misc_feature 1..3267: note = Cas9 variant
  source 1..3267: mol_type = other RNA
atgaagaagctggtgctcggcctggacatcggggtcgccagcgtgggctgggggatcatcgacgccgagaacggcgacgtgctggacgcgggggtccgcctcttctccagccgggacgcctccgagaacgagagccgccggacctcccgccggcagagccgccggctgtcccgccggaagaagcaccgccgggagcgcatcaagcagctgctcctggcccacgacatggacgtgtgcgacatcgtgaacgagaacccctaccagctgcgggtcaagggcctcaacgagaagctggagatcagcgagatctacgtggccctgacccacctcgccaagcgccggggcgtgtcctacctggacgacgtcgtggaggagggcggggcgatcaagagcgagcacctgaacaagaacatggaggagatcaagtccgggaagatgccgtgcgagatccagctcgagcgcttcgagaagtacggccaggtgcgggggatgatcgagatcaaccaggacacggaggagagctccttcctggtcaacatcttccgcaccagcgactacatcaaggaggccaagaccatcctggccacccagcagaagttccacaagcagatcacgaacgagttcatcgacgagtacatcaacatcatggcctccaagcgggactacttcatcggccccggcaacgagaagtcccgcaccgactacggggtgtaccggaccaacggcgacacctgggacaacctcttcgagatcctgatcgggaagtgcagcgtgttccccgaggagacgcgcgcggcccgcagctcctacgtcgcccaggagttcaacctgctcaacgacctgaacaacctgaagatcagcagcctcgagtccggcaagctgagcacctcccagaagcacgacatcgtggagaaggtgaagaacagcaagaagttcggcaccaaggacctgctcaagtacatcgcctccgtctgcgagtgcaagatcgagaacatcgacgggtgccggaaggacaagaaccgcaagcccatcatgcacaccttcgagaactaccggaaggtgcacaacgccctgaacgaggcgggcgtggacctgcgcctcagcgaggccgactacgacgagctgatgaagatcatgacgctgaactccgagaccctcgagatcaagaagcagtgcaaggagaagctgccgcacctgaccgaggactacctcaacgtctgcctggtgctgaacaagaagggggccttcagcggctggcacgccctctccctgaaggccatgaagctgatgatgcccgagctctacgggaccagcaagaaccagatgcagatcatccacacgatgcagctgggcaaggcgtacatcaagcccctgaaccagcagaagtacctcaactccgaggccatcctggaggagatctacaaccccatcgccgcccggagcatccgccagaccatcaaggtgaccaacgccatcctgaagaagtacggcccgctcgactccgtcatcatcgagatgccccgggactaccagaccagcgaggacgagcgcaagatgatcgagaagatgcagaaggagaacgagaaggagaagaaggcggccctgaagcgggcccgcgaggagtaccccttccccgacgaggccttccggaaccacaaggagctggccacgaagctgcgcctctggtaccagcaggaccagttctgcgtgtactccgggcggaagatcagcgtcgtggacctggtgcgcaacccgaaccagttcgagatcgaccacatcatcccccagtccgtcagcctggacgactccctcaacaacaaggtgctgtgcttcagcgaggagaaccagaagaagggccagcagacccccttctactaccacaagggcaagagcgggaactggacctacgagcagtacaagctgttcgtggagaagctgttcgacaagaagaagatctccaacaagaagcgggagctgctcctcttcgaggaggacatcaacaagtgggacgtccgccgggggttcatcgcgcgcaacctggtggacacccggtacgccagccgcgtgatcctgaactcctaccagcagtacttcggcaaccacgagatgggcacgaaggtcaaggtggtgcgcgggaagttcaccagccagctccggaagaagtggaagatcttcaaggaccgcaacgagtcccacagccaccacgccatcgacgccctgatcgtcgcggccaccgccaacctgcggctctggaagaagaacaagctgggcatctccgacgaggggaaggtgtacgacaaggagaccggcgagatcctgcccttcgagaagctcacggccagcgagtacaacgagatgatgaacaaggagccgtacctgaacttcaagaccaagctgcagaacatcgagaccaaggtgaagtactcctacaaggtcagcaagaaggtgaaccgcaagatctccaacgacaccatctacagcacgcgggagcgcgacgggatcgactacatcgtgggcaagatcaagaacatctacgacgtcaagacctacaaggaccagttcctcaagcggtacaagaagaacaaggagcagttcctgatgtaccagcacgacccccagaccttcgccatcctggagtccatcatggcgacctaccccgacgccgagaaccccttcctcgcctacaagaaggagcacggcgtgatccgcaagtacgccaagaacaaggccggggcgccggtgacgagcctgaagttcatcgacggcgccctggggcagaagatcgacgtcacctacaagaacaaggccgccctccccaagaacaagaaggtggtgctgcagtccatcaagccctaccgggccgacgtctactacgacgagggcaacaagcgctaccacctgatcggcgtgaagtacagcctcttctccttcagcaagcaggggtacgtgatcaaccccatcgcgtaccagaagctgctggagaaggagcagatccacagcgagatgaagttctgcttctccctctaccgggaggacatcatcgagagcggcgaggacccggactccctgacccgctaccggttctggagcaagaacgagtccgggaagaacaagatcgaggtcaagcccatcgagaagcccaacttcgaggaccgcaaggtgatcaccatcaccaagaagatcaagatcctgaacaagtaccagacggacgtgctcggcaacagcttcaaggcccaggaggagaaggacccccggtccatcgagtga

SEQ ID NO: 1576 - RNA, 3267 nt, synthetic construct
  misc_feature 1..3267: note = Cas9 variant
  source 1..3267: mol_type = other RNA
atgaactacaagatgggcctggacatcgggatcgccagcgtgggctgggccgtcatcaacctcgacctgaagcgcatcgaggacctgggggtgcggatcttcgacaaggcggagcacccccagaacggcgagtccctcgccctgccgcgccggatcgcccgcagcgcccggcgccggctgcgccggcgcaagcaccggctcgagcgcatccggcgcctgctggtgtccgagaacgtcctcaccaaggaggagatgaacctgctgttcaagcagaagaagcagatcgacgtgtggcagctccgggtggacgccctggagcgcaagctgaacaacgacgagctcgcgcgggtcctgctgcacctcgccaagcgccgggggttcaagagcaaccgcaagtccgagcggaacagcaaggagtccagcgagttcctgaagaacatcgaggagaaccagtccatcctggcccagtaccgcagcgtgggcgagatgatcgtgaaggactccaagttcgcctaccacaagcgcaacaagctcgacagctactccaacatgatcgcgcgggacgacctggagcgcgagatcaagctgatcttcgagaagcagcgggagttcaacaaccccgtctgcaccgagcgcctcgaggagaagtacctgaacatctggagctcccagcggcccttcgccagcaaggaggacatcgagaagaaggtgggcttctgcacgttcgagcccaaggagaagcgcgccccgaaggccacctacaccttccagtccttcatcgtgtgggagcacatcaacaagctgcggctcgtcagccccgacgagacccgcgccctgacggagatcgagcggaacctgctctacaagcaggcgttctccaagaacaagatgacctactacgacatccgcaagctgctgaacctcagcgacgacatccacttcaaggggctgctgtacgaccccaagagctccctcaagcagatcgagaacatccggttcctggagctggacagctaccacaagatccgcaagtgcatcgagaacgtgtacggcaaggacgggatccggatgttcaacgagaccgacatcgacaccttcggctacgccctcacgatcttcaaggacgacgaggacatcgtggcctacctgcagaacgagtacatcaccaagaacgggaagcgcgtctccaacctggccaacaaggtgtacgacaagagcctcatcgacgagctgctgaacctctccttcagcaagttcgcccacctgtccatgaaggcgatccggaacatcctgccctacatggagcagggcgagatctacagcaaggcctgcgagctcgccggctacaacttcaccgggccgaagaagaaggagaaggccctgctgctgcccgtgatccccaacatcgccaaccccgtcgtgatgcgcgcgctcacccagtcccggaaggtggtcaacgccatcatcaagaagtacggcagcccggtgtccatccacatcgagctggcccgcgacctgagccactccttcgacgagcggaagaagatccagaaggaccagacggagaaccgcaagaagaacgagaccgccatcaagcagctcatcgagtacgagctgaccaagaaccccaccgggctggacatcgtgaagttcaagctctggagcgagcagcagggccgctgcatgtactccctgaagcccatcgagctggagcggctcctggagcccggctacgtcgaggtggaccacatcctgccgtacagccgctccctcgacgacagctacgccaacaaggtcctggtgctgacgaaggagaaccgggagaaggggaaccacacccccgtggagtacctcggcctggggtccgagcgctggaagaagttcgagaagttcgtcctggcgaacaagcagttcagcaagaagaagaagcagaacctcctgcggctgcgctacgaggagaccgaggagaaggagttcaaggagcggaacctcaacgacacccgctacatcagcaagttcttcgccaacttcatcaaggagcacctgaagttcgccgacggcgacgggggccagaaggtgtacacgatcaacggcaagatcaccgcccacctccggtcccgctgggacttcaacaagaaccgggaggagagcgacctgcaccacgcggtggacgccgtcatcgtggcctgcgccacccaggggatgatcaagaagatcaccgagttctacaaggcccgcgagcagaacaaggagtccgcgaagaagaaggagcccatcttcccccagccgtggccccacttcgccgacgagctgaaggcccggctgagcaagttcccccaggagtccatcgaggccttcgccctcggcaactacgaccgcaagaagctggagagcctgcggcccgtgttcgtctcccgcatgccgaagcggagcgtgacgggggcggcccaccaggagaccctccgccggtgcgtgggcatcgacgagcagtccgggaagatccagaccgccgtcaagaccaagctgagcgacatcaagctggacaaggacggccacttccccatgtaccagaaggagtccgacccccgcacgtacgaggccatccggcagcgcctcctggagcacaacaacgaccccaagaaggccttccaggagccgctgtacaagcccaagaagaacggcgagcccgggccggtgatccgcaccgtgaagatcatcgacaccaagaacaaggtcgtgcacctcgacggcagcaagaccgtggcgtacaactccaacatcgtccggacggacgtgttcgagaaggacgggaagtactactgcgtgcccgtctacaccatggacatcatgaagggcaccctgcccaacaaggccatcgaggccaacaagccctacagcgagtggaaggagatgaccgaggagtacacgttccagttctccctgttcccgaacgacctcgtgcgcatcgtgctgccccgggagaagaccatcaagaccagcaccaacgaggagatcatcatcaaggacatcttcgcctactacaagaccatcgactccgcgaccgggggcctggagctcatcagccacgaccgcaacttcagcctgcggggcgtcgggtccaagacgctgaagcgcttcgagaagtaccaggtggacgtgctcggcaacatccacaaggtcaagggggagaagcgggtgggcctggccgcccccaccaaccagaagaagggcaagaccgtggacagcctgcagtccgtcagcgactga

SEQ ID NO: 1577 - RNA, 3270 nt, synthetic construct
  misc_feature 1..3270: note = Cas9 variant
  source 1..3270: mol_type = other RNA
atgaccgccttcaagcccaaccccctgaactacatcctcggcctggacatcgggatcgccagcgtgggctgggcgatggtcgagatcgacgacaaggagaaccccgtgcgcctgatcgacctcggggtgcgggtcttcgagcgcgccgagatgcccaagaccggcgactccctggccgccgcccggcgcctggcgcggagcgtgcgccggctcacgcgccggcgcgcccaccggctgctgcgcgcccggcgcctcctgaagcacgagggggtgctgaagcccgaggacttcgacgagaacggcctcgtcaagccgctgccctacatccccaagcagccccggaacaccccgtggcagctgcgcgccgcggccctcgaccggaagctgacgcccctggagtgggccgccgtgctcctgcacctggtgaagcaccgcggctacctctcccagcggaagaacgagggggagaccgacgacaaggagctgggcgccctgctcaagggggtcgcggacaacacccacgccctgcaggccggcaacttccgcacccccgccgagctggccctcaacaagttcgagaaggagagcgggcacatccggaaccagcgcggcgactactcccacaccttcagccgcaaggacctgcaggcggagctggtgctcctgttcgagaagcagaaggagttcggcaacccctacgtgtccgacgacctgaagaacgggatcgagaacctcctgatgacccagcggccggccctgagcggcgacgccatccagaagatgctcgggcactgcacgttcgagcccgccgagcccaaggccgcgaagaacacctacaccgccgagcgcttcatctggctgaccaagctgaacaacctccggatcctgaaccagggcaacgagcgccccctgacggacgccgagcggaccaccctcatggacgagccgtacaagaagtccaagctgacctacgcccaggcccgcaagctgctcgacctggacgacacggcgttcttcaagggcctgcggtacgggaaggacaacgccgagagcgccaccctcatggagatgaaggcctaccacgcgatctcccgcgccctggagaaggagggcctgaaggacaagaagtccccgctgagcctcagccccgagctgcaggacgagatcgggaccgccttctccctgttcaagaccgacgaggagatcacgggccggctcaaggggtgcctgcagcccgagatcctggacgccctcctgaagcacatcagcttcgacaagttcgtccagatctccctgaaggccctccgccggatcgtgcccctgatggagcagggcaagcgctacgacgaggcgtgcgccgagatctacggcgaccaccacgggcggcgcaacagcgaggagaccctgtacctcccgcccatccccgccgacgagatccggaaccccgtggtcctgcgcgccctgtcccaggcccggaaggtgatcaacggcgtggggcgccggtacggcagccccgcgcgcatccacatcgagaccgcccgcgaggtcggcaagagcttcaaggaccggaaggagatcgagaagcgccaggaggagaaccggaaggaccgcgagaaggccgccgccgagttccaggagtacttccccaacttcgtgggggagcccaagtccaaggacatcctcaagctgcggctgtaccgccagcagaactgcaagtgcctctacagcggcaaggagatcaacctggggcggctgaacgagaagggctacgtggagatcgaccacgcgctcccgttctcccgcacctgggacgacagcttcaacaacaaggtcctggtgctggggtccgagaaccagaacaagggcaaccggacgccctacgagtacctcaacgggaaggacaacagccgcgagtggcaggagttcaaggcccgggtggagacctcccgcttcccccacagcaagaagcagcggatcctgctgcagaagttcgacgaggagggcttcaaggagcgcaacctcaacgacacccggtacgtcaaccgcttcctgtgcaagttcgtggccgaccacatgcagctgaccggcaaggggaagcggcgcgtcttcgcctccaacggccagatcacgaacctcctgcgggggttctggggcctgcgcaaggtgcgggcggagaacgaccgccaccacgccctcgacgccgtggtcgtggcctgcagcaccgtggccatgcagcagcgcatcacccggttcgtccgctacaaggagatgaacgcgttcgacggcaagaccgtggacaaggagacgggggaggtgctgcaccagaagacccacttcccgcagccctgggagttcttcgcccaggaggtcatgatccgggtgttcggcaagcccgacgggaagcccgagctggaggaggccgacaccccggagaagctccgcgccctgctggccgagaagctctccagccggcccgaggcggtgcacgagtacgtcgcgcccctgttcgtgtcccgcgcccccaaccggaagatgagcggccaggggcacatggagaccatcaagtccccgaagcgcctggacgagggcatcagcgtggtccgggtgcccctcacgcagctgaagctgaaggacctcgagaagatggtgaaccgcgagcgggagcccaagctgtacgaggccctgaaggcccgcctcgaggcccacaaggacgaccccgccaaggccttcgccgagccgttctacaagcaggacaaggcgggcaaccggacccagcaggtcaaggccgtgcgcatcgagcaggtccagaagaccggggtgtgggtgcggaaccagaacggcatcgccgacaacgccaccatggtgcgcgtcgacgtgttcgagaagggcgggaagtactacctggtgcccatctactcctggcaggtcgccaaggggatcctgcccgacaaggcgatcatcgccttcaaggacgaggaggagtggcagctcatcgacgacagcttcaacttcaagttccccctgcacccgaacgacctggtggaggtgatcaccaagaaggcccggatcttcggctacttcgcctcctgccaccgcggcacggggaacatcaacatccggatccacgacctcgacaacaaggtcggcaagaacgggatcctggagggcatcggggtgaagaccgccctgagcttccagaagtaccagatcgacgagctcggcaaggagatccgcccctgccgcctgaagaagcggccgcccgtgcgctga

SEQ ID NO: 1578 - RNA, 3270 nt, synthetic construct
  misc_feature 1..3270: note = Cas9 variant
  source 1..3270: mol_type = other RNA
atgaacgtgcgctacaagatcggcctggacatcgggatcaccagcgtcggctgggccgtggtgaacctcgacatcccccggatcgaggacctgggggtccgcatcttcgaccgggccgagaacccgcagaccggcgagtccctggcgctcccccgccggctggcccgcagcgcccggcgccggctgcgccggcgcaagcaccggctcgagcgcatccggcgcctgctgatccgggaggggatcctcatgaaggaggagctggacaagctgttcgaggagcgccacgagatcgacgtgtggcagctccgggtggaggccctggaccgcaagctgaactccgacgagctcgcccgggtcctgctgcacctcgcgaagcgccgcggcttcaagagcaaccggaagtccgagcacaacagccgcgagaactccacgatgctgaagcacatcgaggagaaccgggccatcctgagctcctaccgcaccgtggccgagatgatcgtgaaggaccccaagttcgccctccacaagcggaacaagggcgagcactacaccaacaccatcgcgcgcgacgacctggagcgggagatccagctgatcttcacgaagcagcgcgagttcgggaacatgaactgcaccaaggagttcgagaacgagtacatcgccatctgggccagccagcggcccttcgcctccaaggacgacatcgagaagaaggtcggcttctgcaccttcgagccgaaggagaagcgcgcccccaaggcgacctacacgttccagagcttcatcgcctgggagcacatcaacaagctccggctggtgtcccccgccgggacccgcggcctgaccgacgaggagcggcgcctcctgtacgagcaggccttccagaagaacaagatcacctaccacgacatccggacgctgctccgcctgcccgacgacacctacttcaagggggtggtctacgaccggaacatgccgctgaagcagaacgagaccatccgcttcctcgagctggacgcctaccaccagatccggaaggtgatcgacaaggcgtacggcaagggcaagagctccagcttcctgcccatcgacttcgacaccttcgggtacgccctcacgctgttcaaggacgacgccgacgtgcgctcctacctgcagaacgagtacgagcagaacggcaagcccatgcccaacctcgccaacaagacctacgacaacgagctgatcgaggagctgctcaacctgagcttcaccaagttcgggcacctgtccctcaaggccctgcacaacatcctgccgtacatggagcagggcgaggtctacagcagcgcgtgcgagcgcgccggctacaagttcaccgggccccggaagaagcagaagacgatgctcctgcccaacatcccctccatcgccaacccggtggtgatgcgcgccctgacccaggcccggaaggtcgtgaacgcgatcatcaagaagtacggcagccccgtgtccatccacatcgagctggcccgcgacctcagccagaccttcgacgagcggcgcaagaccaagcgggagcaggacgagaaccgcaagaagaacgagacggccatccggcagctgatggagtacgggctgaccctcaaccccaccggccacgacatcgtcaagttcaagctgtggtccgagcagaacgggcgctgcgcctacagcctgcagcccatcgagatcgagcggctcctggagccgggctacaccgaggtggaccacgtgatcccctactcccgcagcctggacgactcctacacgaacaaggtcctcgtgctgaccaaggagaaccgggagaagggcaaccgcacccccgcggagtacctgggggtcggcaccgagcggtggcaccagttcgagacgttcgtgctcaccaacaagcagttcagcaagaagaagcgcgaccggctgctgcgcctccactacgacgagaacgaggagaccgagttcaagaaccggaacctgaacgacacccgctacatctcccggttcttcgccaacttcatccgcgagcacctgaagttcgccgagagcgacgacaagcagaaggtgtacacggtcaacgggcgcatcaccgcccacctccggtcccgctgggagttcaacaagaaccgggaggagagcgacctgcaccacgccgtggacgcggccatcgtggcctgcaccaccccctccgacatcgccaagatcaccgccttctaccagcgccgggagcagaacaaggagctggcgaagaagacggagccgcacttcccccagccctggccccacttcgccgacgagctccgcgcccggctgagcaagcacccgaaggagtccatcaaggccctgaacctcggcaactacgacaacgagaagctggagagcctgcaccccgtcttcgtgtcccgcatgcccaagcggagcgtgaccggggccgcgcaccaggagaccctccgccggtacgtcggcatcgacgagcgcagcggcaagatccagaccgtggtgaagacgaagctgtccgagatcaagctggacgccagcgggcacttcccgatgtacggcaaggagtccgacccccggacctacgaggccatccgccagcggctcctggagcacaacaacgaccccaagaaggccttccaggagcccctgtacaagccgaagaagaacggggagcccggccccatcatccgcaccgtcaagatcatcgacaccaagaaccaggtggtgcccctcaacgacgggaagacggtcgcgtacaacagcaacatcgtgcgggtggacgtcttcgagaaggacggcaagtactactgcgtgccggtgtacaccatggacatcatgaagggcgtcctgcccaacaaggccatcgagcccaacaagccctactccgagtggaaggagatgaccgaggactacaccttccagttcagcctgtacccgaacgacctcatccgcatcgagctgccccgggagaaggccatccgcacgtccaccggggaggagatcaagatcaaggacttcttcgcctactacaagaccatccacagcggcaccgggggcatggagctgatctcccacgaccgcagcttctccctcagcggcgtggggtcccggacgctgaagcgcttcgagaagtaccaggtggacgtcctgggcaacatctacaaggtgcgcggggagaagcgggtgggcctcgccagctccgcgcacagcaagaccgggaagaccgtccggcccctgcagtccacccgcgactga

SEQ ID NO: 1579 - RNA, 3273 nt, synthetic construct
  misc_feature 1..3273: note = Cas9 variant
  source 1..3273: mol_type = other RNA
atgcgctggcggctgggcctcgacatgggggccggcagcctggggtggtgcgccgtgggcctggacgaccaggggtaccccgactccatcctcgcggccggcagccacatcttcggcgacgggcgcgccccgtcccggggcgaccagcaggggacgcccctgggcgtcgagcgccgggccgccaaggcgatgcgccggcgccgggaccgcttcctggggcggcaggccaagctcctggcccgcctgaccctcgccggcctgttccccgcggaccccgtgcgggccaaggccctggagctcctggacccgtacgtgctgcgcgcccgggccctcgacgaggcgctgccgccccaccagctgggccgcgccttcttccacctcaaccagcggcgcgggttcaagagcaaccggaagaccgaccgcggcgtcgacgacgaggccgggaagatcgccatcggcatcgaccggctgcgcgccgcgatcgccgccgccgaggcccgcaccatgggcgagttcctgcacaagcggcgccagtccgcgcccgacgtgaaccagatccccagcgtgcggacccgcctccggcccgagaccggggaggaggccaagggcgacgggtacgacttctaccccggccgcgagctggtcgaggaggagttcgacgccatctgggacgcccaggcgccccaccacccgtccctgctcacgcccgacaaccgggccctgctgcacgaggccatcttctaccagcgccccctcaaggcccccaagatcgggaagtgcaccctgctgaacaacgagccgcggctccccaaggcccaccccctgttccagcgccggcgcctgctcgaggaggtgaacgcgctgcggatcgtgcgccccggcgaggtcgccaccaagctgacctgcgagcagcgggacctcctgatgctgaagctcaaggacaaggccaaggtgagcttcgagacgctgcgctccaaggtgctgaagctcgagccggaggcccggttcaacaaggagggcgagaaccgcaccgagctggtcggggacgaggtgtgcgcccagatgagcgcgaagacccggttcggcaaggcctgggcccacttcaccgacgagaagcgctgggccatcctgtcccgcctcatcgaggaggaggacgaggagcggctggacacgtggctgcgcaccgagcacgggctcgacgccgagcaggcgcgggccgtggccggcgcccgcctgcccgccgggttcggccggttcggcgagaccgcgacccgccggctgatcgccgccctgcaggccgaggtcatcgtgtacagcgaggcggtggtcgccgccgggctcggccaccactccgacatgcgcacgggggaggtgctggccgagctgccctactacggcatgaccctcgagcggcacctcctgcccgggaccggcgacaaggccgacccggaggagctccgcatcggccggctgaccaaccccacggtgcacatcgcgctgaaccgcctccggcgcatcgtcaaccggctgatcaagacctacgggcgccccgagcagatcgccatcgagctgggccgggagctcaagctgaccgacgaggacaagcagcgcctgagccggcagaacaaccgcaaccgggccgacgccgaggcccgctccaagaagctcgcggagctggggcaggccgacaacggcgccaaccgcgcccggctgaagctctgggaggagctgaaccgcgagaacgccctggaccggcgctgcatctacagcggccagcagatctccatcgcgatgctgttcagcgacgccgtggaggtggaccacatcctgcccttcgacgccaccctggacgactccaacaacaaccggatcctctgcctgcgcgagtggaaccggcgcaagcggaagcagagcccgtacgaggcctgggggcacacggactactggcccgacatcgcggcccgcgccgcccggctgcccaaggagaagcgctggcggttcgagccggacgccatgcagcgcttcagcgcggaggaccggttcatcgcccgccacctcgtcgacacccagtacatgtcccggctggcccgcgagtacctggaggccctctaccccgagaagggcgaggggagcggccacgtgtgggtctcccccgggcggctgaccgagctgatccgccgcaagctcggcctgaacgagctgctccccgaccacaacttcgccggcgtgaagaaccggctggaccaccgccaccacaccatcgacgcgttcgtggtcgccgtgacggaccggagcctgctccaggggatctcccgcgccagcgccctggagggcgaggaggggcgggagcgcgtgatcgtcccggagccctgggacggcttccgggaggccctgcgcaccaccctcaacaccatcacggtgtggcaccggcaggaccacgggaccgcgtccaaggccggcctggcccagggccgcgaccagaccgccgggaagctgcacaacgacaccgcctacggcctcacggggcggcaggacaccaagggcaacgacctggtggtcagccgcaagcccctgatgtccctcaagcccgcggacatcgagccggtgcccgacgtggcccccatcaccaagggggtccgggaccgcgacctgcggaaggccctggcccacttcacccaggcgaccgagggcaagggcttcctccaggccctggagcgcttcacgcggctggggcccctccacttccgcggcatccggcgcgtgcggctgatccagccgctggccgtgatccccatcaaggggcccggcggggtcccctacaagggctacctcggcggggagaacttccgctgcgacgtgtgggagatgccggacggcgcctggaagcccgaggtgaccagcatgttccaggcccaccagcccgggtggacctccgcgatccgcgccgcctgccccaccgcccggaaggtcctgagcctgcacaagcgcgacatgatcgccatcgagcgggaggagggcgtgcgcacgctcatggtggtcgcgcagatctggtccaacggccaggtgaccctggtggagccgcacgaggccggggacctgaacaagcggaacaagagcgaggacgaccccttcggctacttcatgcccaccgccgggggcctcaagcgcctgaaggcccggcaggtccgcgtggacgagctggggcgggtgcaggaccccggcttcccggcccgcaaggcgcggcgccggacccgccccaagcaggtcgactga

SEQ ID NO: 1580 - RNA, 3273 nt, synthetic construct
  misc_feature 1..3273: note = Cas9 variant
  source 1..3273: mol_type = other RNA
atggactggcgcctgggcctcgacctgggggccaacagcctgggctgggccgcgctccggctggaccgcgccggggaccccatcggcatcctggccatggggtcccggatcttcagcgacggccgcgacccgaagtccggcgccagcctcgccgtggaccggcgcgcggcccgggccatgcgccggcgccgggaccgcttcaagcagcggcaggccgcgctgctgaagtacctcatccgcgacgggctgttccccgccgaccaggccgaccggcagcgcctggccgacgaggacccctacgccctccgggcgcgcgccctggacgaggagctgtccctcttcgagatcggccgggccctgttccacctgaaccagcgccgggggttccagagcaaccgcaaggccgaccgcggccaggacgacgaggccgggaagatcgcggtcggcgtggaccggctcaaccagcagatggaggagcagggcgcccgcaccctgggggagttcctgcaccagcggcgccgggccgccaccgacgccaaccacatcccctccgtgcgcacgcggctccgcccggagaccggcgagggggcgaagggcgacggctacgacttctaccccagccgggccctgatcgccgaggagttcgaggagatctgggccgcccaggcgccccactaccccgacaccctgacccagcaggtccacgaccgcctctacgagatcatcttccaccagcggccgctgcgcgcgccccaggtggggcagtgcacgctggtggccggcgagacccggctccccaaggcccaccccctgttccagaagcgccggctgctcgaggagatcaacgccctgatgatcgtccgcccgggggagatcgcccagcggctgacccccgaggagcgcgacaccctctacctgaagctgaaggacaagcggacggtgtccttcgccaccctccgcaagaccctgaagctggacagcgccgcccgcttcaacaaggagtccgagaaccggaccgagctcaagggcgacgaggtggcggccgagctgggggccaagacgcgcctgggcacccggtggcagcacctcagcggcgaccagcagtgggaggtcgtgcaccgcctgatggccctggagtcccaggccgacgaggcggccttccgggactggatcagccagacctacgacctcctgcccgagcaggccgccgccgtgctgggggcgcgcctcccccagggccacgggcggttcggcccgaccgccacgaccaccctgatcgactccctgctgcacgaccgcaccgaggacgggcgggtcgtggtgtacagcgaggccgtccagcgctccggcctcggccaccacagcgacctgcggcacgaccgcgacgacgaggacgtgacggagctgccctactacggggtggccctcgagcggcacatcatgcccggcaccgcggagcccaccgacccggaggagatgcgcatcgggcggctgaccaaccccacggtccacatcggcctgaaccagctccgccacgtggtgaaccggctgatccgcgcctacgggccgcccaaggagatcgccatcgagctggcccgggagctcaagctgtccgaggacgagaagaagaagcgcaacagcgagaaccgggacaaccgcctggccgcggagggccgcagcaagaagctcgaggagatccggcagcgcgacaccggcgccaaccgggccctgctgaagctctgggaggagctgaaccccgggaacgtcctggaccgccggtgcatctacaccggcgagcagatctccatcgacatgctgttcagcgaccgcgtggaggtggaccacatcctccccttcgcccagaccctggacgactccaacgggaacaagctcctgtgcctgcgggaggccaaccgcgagaagcggcgccggagcccctacgaggcgtggggccacacggaccgctggcccgacatcgccgagcgggcctcccgcctcccgaagcccaagcggtggcgcttcgagcccgacgccatgcagcggttcgccaccgaggacggcttcctggcgcgccacctggtcgacacccagtacctcgggcggctggcccgcgagtacctgagctggctctacccgggccgcggggagggctccgggcacgtgtgggtcagccccggccggctgaccgagatggtgcgccggaagctgggcctcaacgacctgctgcccgaccacaacttcgggggcggggccgaccagcccaagaaccgcctcgaccaccggcaccacgccatcgacgcgctggtggtcgccatcgtggaccgcggcatgctgcaggccatcgcccgggcctccgggcaggacggcagcgagggccgcgagcggatccacatcccggcgccctgggacgggttccgcgacgacctccgggtggccgtcaacggcatcatcgtgtcccaccgccccgaccacgggacggtggccaaggccggcctggcccgggggcgcgaccagaccgcgggccggctgcacaacgacaccgcctacggcctcaccggggagacggacgccaagggcaacagcatcgtcgtgcgccggatccccctgtccgccatcaagaagccggccgacatcgcgcgcgtgcgggaccccctgctccgcaacgccctggccgagttcaccaaggggctggacggcaaggccttcgaggcccggatcgggcgcttccacgagctcggccccctgctgtaccgcggcatccggcgcgtccgggtggtggagaccctcaccgtcatccccatccgcgacgcggaggggcgggcctacaagggctacaagggggacagcaactaccgctacgacgtgtgggagatgccggacggcaagtggcggtgccaggtggtctccatgttcgacgcccaccagagcaccgagcaggcccgcccccaccccgcggcccggaagatcctgtccctgcagcgcaacgacatcctcgccatcgagcggacggagggcgaccgcgagctggtgcgggtggtcaagttcagcgagaagcagttcgccgtggcgcccccgcacgagggcgggtccctgaagacccgcgacgggaacgccgacgaccccttccggtacctctaccccagccccaacaccctgaagggctggcgcgcccgccaggtgcggatcgacgagctggggcgggtcctcgacccgggcttccccgcccgcaagagcgtgcgccggacccgcccccgggccgcccccgtggactga

SEQ ID NO: 1581 - RNA, 3276 nt, synthetic construct
  misc_feature 1..3276: note = Cas9 variant
  source 1..3276: mol_type = other RNA
atgtacagcaacctgctgttctccttcgacatcggcaccaacagcatcgggtggtgcgtgttcgccctggacgaggccggcgagccctaccgcatcgtcgacctgggggcgcggatctacgccgacggccgcgacccgcagtccaagaccagcctcgccgtggcccggcgcgaggcccgggcgatgtcccgccggcgcgaccggtacctgcgccggcgcaaggccacgctgcggaccatgatcgagtacgggctcatgcccggcgacaaggccggccaggaggccgtgctgcgcgagaccggggaccgggagggcggggacgagagcttcaacccctacgcgctgcgcgcccgggccctctccgagaagctgcccccggcctacatcggccgcgtcctgttccacctcgggcagcggcgcggcttcaagagcaaccggaagaccgaccgcaaggacaacgacaagggcaagatcgccctggggatcgacgagctgacggcggccatgcaccgctccggcagccccaccctcggggcctggctggccatgcggcgcgccgagggccactccgtgcggctgcgcgcgggcagcgaggtgttcgacgccgaggggtacgccttctaccccgagcggtccctcctggaggacgagttccgccagatctgggacgcccaggccgtccaccaccccgacatcctgaccccggagcggcgcgcgcacctcttccgggtgatgttctaccagcgccccctgaagaagcccctggtgggccggtgcagcttcaaccccgccgagttccgcctctcccgggcccacccgctgttccaggagttccgcctgtacaaggagatcaacgacctcgaggtcgtgctgcccgaccagagccaccggaagctgaccctcgacgagcgcaacgccctggtggccaagctgaagacgtcccggaaggcgagcttctccgccctccgcaagaccctgaagctgacccccgacctcgtcttcaacaaggagagcgaggcccggaaggagctgctgggggacgagatctacagcgtgctcgccgacgcgaagatgttcggcgcccgctggggcgggttctcccgcgcccggcagtgggagatcatcacccgcctgaaggaggaggaggaccccgccagcctgtccagctggctcaagtccgagttcggcctggacgacgagcgggtgacggccatcgcgaacgccagcctgccggacgggtacggccgcctcggggagaccgccctggcctccatgctggaggagctcaagaccgccgtcatccccgagagcgaggcggcccggctgtgcggctacgaccactccaacctggccaaggagcaggacgaggggctggacaccctccccgagtaccaggagatcctggagcgccacatcccgcccggcacgggcgaccccgacgacatctacgacctgcggaaggggcgcatcaccaaccccaccgtgcacatcggcctcaaccagctgcggcgcgtggtcaacgccctgatccaccggttcgggcgcccccagcggatcgtggtggagctcgcccgcgacctgcagctgagcgagaagcagaaggacgacgtcaaccggcgcatcgcgaagaacacccgggaggccgagggccgctcccagaagctcatcgagatggggcagctggacacgggctacaaccggctgctcctgaagctgtgggaggagctcaacctggacaagccggaggaccgcgtgtgcatctacagcggcaagcccatcgggatcgccatgctgttctccggcgaggtggacgtcgaccacatcctcccctggagcaagaccctggacgactcccaggccaacaagctgctctgcctcaagagcgcgaaccggcagaagcgcaaccgcaccccctccgacgtgccggagtggcgggaccgctacgacgaggtcctggcccgggccgcccgcctcccccggaacaagcgctggcggttcgccgcggacgccatgcagcagttcgaggccgagggcgggttcctggcccgccagctgaccgacacgcagtacctcagccggatggccctggagtacctgtccgcgctctaccccagcgaggaggccgacaagagcggcgagctgcgccagcggaagcgcgtgcacgtggtcccggggcggctgaccgagctcctgcgccggaactggggcctgaacaccctcctgcccgaccacaacctgggggagatggcccaggagaagaaccgccgggaccaccgccaccacgccatcgacgccgcggtgatcggcaccacgtcccggagcctcctgcagcgcatgtccggggccgccgcccgcctggacgacgtggcgttcgacgacctcgtccggaccgtggtgaaggacaacccgccctggcccggcttccgcgaggagctgctggccgccatcggccgggtcaccgtgagccacaagcccgaccacgggaccgtgtcccgcgccgcctacgcgcagggcaaggggcagacggccggcaagctccacaacgacaccgcctacgggctgaccggcctggtcgacgccaagggcagccccctcgtggtgcggcgcaagcccttcatggccctggaggtcaaggacatcgcgtccatccgggacaccgagctgcagagcgccctctacggggccatcggctccctgacggagaagaaggccctgcaggaggccctcatccgcttccgggacacccacccgcagttcaaggggatccgccgggtgcgcgtgctggagaccctgagcgtcatccccatcgtggaccgggacggcaaggcgtacaaggggtacaagggcgacgccaactaccgctacgaggtgtgggagaccctcgacggcaagtggcacaccgaggtcgtgtccatgttcgacgcccaccagcccgggtggcagagccccttccacaagcagaacccggccgcccggcgcgtgctgaagctgcagcagaacgacatggtcgcgtacgagcaccccgccgacggctacacgatcgcccgggtggtgaagttctccaacgacaagcgcatctacttcgccagccaccgggagtccgggagcctcaaggcgcgcgacgccgacaagggcgaccccttctcctacttcgccaaggccaacaacgggctgcgggacatcaagtgccgccaggtccgcatcgacgccgcgggccggatcttcgaccccggcccgcaggaccgcgagacccggcaggccaacaagggggtgtga

SEQ ID NO: 1582 - RNA, 3279 nt, synthetic construct
  misc_feature 1..3279: note = Cas9 variant
  source 1..3279: mol_type = other RNA
atggcctacaccatgggcatcgacgtggggatcgccagctgcggctgggcgatcgtcgacctggagcgccagcggatcatcgacatcggggtgcgcaccttcgagaaggccgagaaccccaagaacggcgaggccctcgccgtgccgcggcgcgaggcccggtccagccgccggcgcctgcggcgcaagaagcaccggatcgagcgcctgaagtacatgttcgtccggaacgggctcgcggtggacatccagcacctggagcagacgctgcgctcccagaacgagatcgacgtgtggcagctccgggtcgacggcctggaccgcatgctgacccagaaggagtggctccgggtgctgatccacctggcccagcgccggggcttccagagcaaccgcaagaccgacgggtccagcgaggacggccaggtgctcgtcaacgtgaccgagaacgaccggctgatggaggagaaggactaccgcacggtggccgagatgatggtcaaggacgagaagttctccgaccacaagcgcaacaagaacgggaactaccacggcgtggtgagccgggcctccctgctcgtcgagatccacaccctgttcgagagccagcgccagcaccacaacttcctggcgtccaaggacttcgagctcgagtacatcaacatctggagctcccagcggcccgtggccaccaaggaccagatcgagaagatgatcgggacctgcacgttcctgcccaaggagaagcgcgcccccaaggccagctggcacttccagtacttcatgctgctccagaccatcaaccacatccggatcaccaacgcccagggcacccgcccgctgaacaaggaggagatcgagcaggtcgtgaacatggcgctgacgaagtccaaggtgagctaccacgacatccggaaggtgctcgacctgtccgaggagtaccagttcgtcggcctggactacgggaaggaggacgagaagaagaaggtggagagcaaggagaccatcatcaagctcgacgactaccacaagctgaacaagatcttcaacgaggtggagctggccaagggcgagacctgggaggccgtcgactacgacaccgtggcctacgccctcacgttcttcaaggacgacgaggacatccgcgactacctgcagaacaagtacaaggactccaagaaccggctggtcaagaacgtggcgaacaaggagtacaccaacgagctcatcgagaaggtgagcaccctgagcttccgcaaggtcgggcacctgtccctcaaggccctgcggaagatcatccccttcctggagcagggcatgacctacgacaaggcctgccaggccgccggcttcaacttccaggggatcagcaagaagaagcgctccgtggtgctccccgtcatcgaccagatcagcaaccccgtggtgaaccgggcgctgacgcagacccgcaaggtcatcaacgccctgatcaagaagtacggctccccggagaccatccacatcgagaccgcccgggagctcagcaagcgcttcgacgagcggaagaacatcacgaaggactacaaggagaaccgcgacaagaacgagcgggccaagaagcacctgtccgagctggggatcatcaaccccaccggcctcgacatcgtgaagtacaagctgtggtgcgagcagcaggggcgctgcatgtacagcaaccagcccatctccttcgagcgcctgcgggagagcggctacaccgaggtggaccacatcatcccctactcccgcagcatgaacgactcctacaacaaccgggtcctcgtgatgacccgcgagaaccgggagaagtccaaccagacgccgtacgagtacatgggcaacgacacccagcgctgggacgagttcgagcagcgggtgaccaccaacccccagatcaagaaggagaagcgccagaacctgctgctgaaggggttcacgaaccggcgcgagctcgagatgctggagcggaacctgaacgacacccgccacatcaccaagtacctcagccacttcatcagcaccaacctggagttctcccccagcgacaagaagaagaaggtcgtgaacacgtccggccggatcaccagccacctccgcagccggtgggggctggagaagaaccgcgagcagaacgacctgcaccacgccatggacgcggtggtcatcgccgtgacctccgacagcttcatccagcaggtcaccaactactacaagcggaaggagcgccgggagctgaacggcgacgacaagttccccctcccgtggaagttcttccgcgaggaggtgatcgcccggctgtcccccaaccccaaggagcagatcgaggccctgcccaaccacttctacagcgaggacgagctcgcggacctgcagccgatcttcgtgtcccgcatgcccaagcgcagcatcaccggggaggcccaccaggcccagttccggcgcgtggtcggcaagacgaaggagggcaagaacatcaccgccaagaagaccgccctggtggacatctcctacgacaagaacggggacttcaacatgtacggccgggagaccgaccccgcgacgtacgaggccatcaaggagcgctacctcgagttcgggggcaacgccaagaaggccttcagcaccgacctgcacaagcccaagaaggacgggaccaagggcccgctgatcaagtccgtgcggatcatggagaacaagaccctcgtccaccccgtgaacaagggcaagggggtggtctacaacagctccatcgtgcgcacggacgtgttccagcggaaggagaagtactacctgctgcccgtctacgtgaccgacgtgaccaagggcaagctccccaacaaggtcatcgccgcgaagaaggggtacgacgactggatcgaggtggacgacagcttcaccttcctgtactccctgtacccgaacgacctcatcttcatccgccagaaccccaagaagaagatcagcctgaagaagcggatcgagtcccacagcatctccgacagcaaggaggtgcaggagatcctgacgtactacaagggcgtcgacagctccaccgccgccatcgagttcatcacccacgacggcagctactacgccaagggggtgggcgtgcagaacctcgactgcttcgagaagtaccaggtcgacatcctggggaactactccaaggtgaagggcgagaagcgcctggagctcgagaccagcgacaacaaccacaaggggaaggacgtgaactccatcaagagcacgtcccggtga

SEQ ID NO: 1583 - RNA, 3279 nt, synthetic construct
  misc_feature 1..3279: note = Cas9 variant
  source 1..3279: mol_type = other RNA
atgaagtacagcatcggcctggacatcgggatcgcctccgtgggctggagcgtcatcaacaaggacaaggagcgcatcgaggacatgggggtgcggatcttccagaaggccgagaaccccaaggacggctccagcctcgcgtccagccgccgggagaagcgcgggtcccggcgccggaaccgccggaagaagcaccgcctggaccggatcaagaacatcctgtgcgagagcggcctcgtgaagaagaacgagatcgagaagatctacaagaacgcctacctgaagtccccgtgggagctgcgcgccaagagcctcgaggccaagatctccaacaaggagatcgcccagatcctgctgcacatcgcgaagcggcgcggcttcaagagcttccggaagaccgaccgcaacgccgacgacaccgggaagctcctgtccggcatccaggagaacaagaagatcatggaggagaaggggtacctgacgatcggcgacatggtcgccaaggaccccaagttcaacacccacgtgcggaacaaggccgggagctacctcttctccttcagccgcaagctgctggaggacgaggtgcggaagatccaggcgaagcagaaggagctcggcaacacccacttcaccgacgacgtcctggagaagtacatcgaggtgttcaactcccagcgcaacttcgacgagggccccagcaagccctccccgtactacagcgagatcgggcagatcgccaagatgatcggcaactgcacgttcgagagctccgagaagcggaccgccaagaacacctggagcggggagcgcttcgtgttcctgcagaagctcaacaacttccgcatcgtcggcctgtccggcaagcggcccctgaccgaggaggagcgcgacatcgtggagaaggaggtgtacctcaagaaggaggtccggtacgagaagctgcgcaagatcctgtacctcaaggaggaggagcggttcggggacctgaactacagcaaggacgagaagcaggacaagaagacggagaagaccaagttcatctccctgatcggcaactacaccatcaagaagctcaacctgagcgagaagctgaagtccgagatcgaggaggacaagagcaagctcgacaagatcatcgagatcctgaccttcaacaagtccgacaagacgatcgagagcaacctgaagaagctcgagctgtcccgcgaggacatcgagatcctgctcagcgaggagttctccgggaccctgaacctgagcctcaaggccatcaagaagatcctgccctacctggagaagggcctctcctacaacgaggcctgcgagaaggcggactacgactacaagaacaacgggatcaagttcaagcggggcgagctgctgcccgtggtggacaaggacctcatcgccaacccggtcgtgctgcgcgccatcagccagacccggaaggtggtcaacgccatcatccgcaagtacggcacgccccacaccatccacgtggaggtggcccgggacctggcgaagtcctacgacgaccgccagaccatcatcaaggagaacaagaagcgggagctcgagaacgagaagaccaagaagttcatcagcgaggagttcgggatcaagaacgtcaagggcaagctgctgctgaagtaccgcctctaccaggagcaggaggggcggtgcgcctactcccgcaaggagctgagcctgagcgaggtgatcctcgacgagtccatgaccgacatcgaccacatcatcccctacagccggtccatggacgacagctactccaacaaggtgctggtcctgagcggcgagaaccgcaagaagtccaacctcctgcccaaggagtacttcgaccggcaggggcgcgactgggacacgttcgtgctgaacgtcaaggccatgaagatccacccgcgcaagaagtccaacctcctgaaggagaagttcacccgggaggacaacaaggactggaagtcccgcgccctgaacgacacccggtacatcagccgcttcgtggccaactacctcgagaacgcgctggagtaccgggacgacagccccaagaagcgcgtgttcatgatccccggccagctgaccgcccagctccgggcccgctggcggctgaacaaggtccgcgagaacggcgacctgcaccacgccctcgacgccgcggtggtggccgtcacggaccagaaggccatcaacaacatcagcaacatctcccggtacaaggagctgaagaactgcaaggacgtgatccccagcatcgagtaccacgccgacgaggagaccggggaggtgtacttcgaggaggtcaaggacacccgcttcccgatgccctggtccggcttcgacctggagctccagaagcggctggagagcgagaacccccgcgaggagttctacaacctgctctccgacaagcggtacctggggtggttcaactacgaggagggcttcatcgagaagctgcgccccgtgttcgtgagccggatgccgaaccgcggggtcaagggccaggcgcaccaggagaccatccggagctccaagaagatcagcaaccagatcgccgtgtccaagaagcccctcaacagcatcaagctgaaggacctggagaagatgcagggccgcgacacggaccggaagctctacgaggccctgaagaaccgcctggaggagtacgacgacaagcccgagaaggccttcgccgagcccttctacaagccgaccaactccgggaagcgcggccccctcgtgcgggggatcaaggtcgaggagaagcagaacgtgggcgtgtacgtcaacggcgggcaggcgagcaacggctccatggtgcgcatcgacgtgttccggaagaacgggaagttctacaccgtccccatctacgtgcaccagaccctgctgaaggagctccccaaccgcgccatcaacggcaagccgtacaaggactgggacctgatcgacgggagcttcgagttcctgtactccttctaccccaacgacctcatcgagatcgagttcggcaagagcaagtccatcaagaacgacaacaagctgacgaagaccgagatccccgaggtgaacctgagcgaggtcctcggctactaccgggggatggacacctccaccggcgccgccacgatcgacacccaggacgggaagatccagatgcgcatcggcatcaagaccgtgaagaacatcaagaagtaccaggtggacgtcctggggaacgtgtacaaggtgaagcgggagaagcgccagaccttctga

SEQ ID NO: 1584 - RNA, 3285 nt, synthetic construct
  misc_feature 1..3285: note = Cas9 variant
  source 1..3285: mol_type = other RNA
atgaagtccaccctggccatcgcctccatcagctccctcggctgggtgatcgagctgggggagaaccgcatcatgcggctgggcctcgacatcgggagcacctccatcggctggtggatctacgagacgaccgacgggcagatcaccagcgtcatcgacggcggcgtgcgcatcttctccgacgggcgggaccccaagagcaagggctccctggcggtggaccgccgggtcgcccgcgcccagcggcgccggcgcgaccggtacctgcgccggaaggccgccctcatgaagcgcatggcggaggtggggctgatgcccagcgaccccaagcaggccaagcagctggaggccctcgacccctacgagctgcgggcccgcggcctggacgagaccctcgagctgacggagctggggcgggccctcttccacctgaaccagcgccggggcttcaagtccaaccgcaagaccgacgccggcgacaacgagagcgggaagatcatcgacgccaccgcccggctggactgggccatgcgcgaccaccgcgcgcggacctacggcgagttcctccacatgcgccggcagaaggccgacacgccccgcaccaccccggccgtgcggacccgcctgacgatcgccgcccgggacggggcggagaaggaggagtccggctacgacttctaccccgaccgccagcacctccgcgacgagttcgacgccctgtgggaggcccaggccgagtaccacggcgtcctgaccgaggacctgcgcgacgagatcgggaccatcatcttccaccagcggcccctcaagacccccaaggtgggcaagtgcctgttcacgaacgaggagcgcgtggccagcgcgcacccgctgaaccagcggcgcatcctcgtcgagaccgtgaacgccctgcgggtggcccagctgggggaggtcgcccgcgccctcaccctggaggagcgggacaccatcctgcacgcgctcgacaacaaggcccacacgaagtccctgagcggcatgtccatcaagctgaaggccctcgggaaggtgatcaagctgcgcagcggccagtacttcaccctggagaccgccaaccgggacgcgatcgcgtgcgaccccgtgcgggccagcctcagcaagcccgaccgcatcggcagctactggtccaccctggaccacaacgcccagtgggaggtcgtgaaccggatccgcgccgtgcagagcgacgcggaccaccgggagctggtcgcctggctcgtgtcccagcaccgcctggccgccgagcacgccgagggggcggcctacgcgcccctgccggacggctacagccggctcgggatcacggccaccaagcgcatcctggccgccctggaggccaacgtgatcccctactccaaggccgtcgagagctgcggctggcaccactccgacgagcggaccggggaggtgctcgaccgcctgccctactacggcgagatcctggaccggcacgtgatccccggcacctacgacgacagcgacgacgacatcacgcgcttcgggcggatcaccaacccgaccgtccacatcggcctgaaccagctccgccggctggtgaaccgcatcatcgaggtccacgggaagcccgacgagatcgtggtggagctggcccgggacctcaagctgtcccaggaccagaaggcggacgtcgagcgcaccatcaagaagaacacgcaggccgccatccggcgcggcgagaagctggaggagatgggggtgcccaacaccggcggcaaccggatggtgctccgcctgtgggaggacctgaacgacgacgacgtcatgaagcggttctgcccctacaccgggcagcgcatcagcgccggcatgctgttcgacgggtcctgcgacgtggaccacatcctgccgttcagccgcaccctggacgacggcttcacgaacaagaccctctgcctgaaggaggccaaccggaagaagcgcaactacgcgccccacgaggccgccgagaagggcctgctcgaccgggacgccatggactccgtggccaagtacctgcccgacaacaaggcgtggcgcttcgcccccgacgccatcgagcggttcgagggggagcgcgacttcaccgcccgggccctgaaggacacccagtacctcagccgcctggcgcggacctacctggacgccctctacgacggcggggacgacaagtcccacgtctgggtggtgccgggccgcctgacggagatgctgcggcgccactgggggctcaacggcctggaggccctggccgacagcgacgagaagaccgtcaagcggaagaaccgcaccgaccaccggcaccacgcgatcgacgccgccgtggtggccgccaccgaccgctccctcatccagaagatcagcaagatcgcggcctccgacgagcaggccggcgccgaggacacgctcaagagcaccccgccgccctgggacagcttccgggacgacatcgccgcgcagctgcagaacatcaccgtctcccaccgcgccgaccacgggcggaccgacagcctcgccaagggccgcggggaggacacgacctccggcgccctgcacgaggccaccgcgctggggatcatcgacgagacccacgtgacggtgcgcatccccatcgagagcctcaagtccggccacctgatcgagggcagccggaacgggtacatccgcgacccctacctgcgggaccagctcaccctggccaccaagaacggctccgacaaggacttcaccacggtcctgcagaagttcttcgaccgcagcaagcggtacgggggcacccgccgggtgcgcatcatcaagaccctccaggacaccgcccggatctccgtgccccacaacgcccccatcaaggcctacaagggcggcagcaaccacgcgttcgagatctggcgcctgcccaacggcaagatcgagtcccaggtcatcacgacctgggagcaccacaacctgaccgagcccaagcggccccacccggccgccaagcgcatcatccggctccacaagaccgacatggtggccatcgagcgcgacgggaagacggtgatctgcttcgtccagaagaccgaccccagcaacggcgcgttcctggtgccccacttcgaggccaacgccgacgggcggaagcgcaagaacgagcccgtggagtggtaccagatgtccgccaacagcctgatcaaggccgacctccggcgcgtcggcgtggacgagatggggcgggtgcgcgacccggggcccccgcccatccggtga

SEQ ID NO: 1585 - RNA, 3285 nt, synthetic construct
  misc_feature 1..3285: note = Cas9 variant
  source 1..3285: mol_type = other RNA
atgaagtaccgcgtgggcttcgacctggggaccaacagcctcggctgggccgtcgtgcggctgaacgcctccggggagcccgaccgcatcgaggtggcgggcagccggatcttctccgacgggcgcgagcccaagagcggcgcctccctggccggcgcccggcgcgacgcccgggcgatgcgccggcgccgggaccgcttcaagcagcggcaggccgccctcatcaagtacctgacccaggccgggttcttccccgcggacgagagcgagcgcaaggccctgtccgccctcgacccctacgagctgcgggcccgcgccctggacgaggcgctccccctggcccacctgggccgggccctcttccacctgaaccagcgccgggggttcaagagcaaccgcaagacggaccggggcaagaacgacgacaccgggaagatccgcatcggcgtcgcccgcctgtacgagcagatgcgggacgccgacgcgcgcaccctcggcgagttcctgcacaagcggcgcgccgccgcctccgacccgaacgccatcccccacgtgcggacccgcatcgtgacgctggcggccgaggacgggaaggccagcgacgtctacgacttctaccccgaccggcagaccctcgaggaggagttcgaggccatctgggaggcccagacctcccaccaccccgaggcgctgaccgaggagcgccgggcccagttctacgagatcatcttccaccagcgcccgctgaagcagcccaagatcggcttctgcacgctcctgccgcccgagaagcggctgccgaaggcccaccccctcttccagcgccggcgcctgctggaggaggtgaacgccctccggatcgtgctgcccgggaaggagacccgcgcgctggagaaggccgagcgggacgccctcctgagcaagctgaaccagcgcaagaaggccgcctacgagtccctccggaaggcgctgaagctggaccccgacgcccgcttcaacaaggagagcgacaaccgcgaggacatgatcggcgacgagatcgccgccgagatggcccacaagtcccggttcggcaaggtctggctcgggatgagcgcggaggcccaggcccaggtgatcgagcgcctgcggggcctggagtccgacgccgacgccgacgacttcgaggcgtggctccgcgacgaccacgggctggcccaggagcaggccaaggccgtgaccgcggccaacctgccggagggctacgggcggttcggcgagaccgccacgcgcaagctcatcgccgccctggagcaggaggtcatcgtgtacagcgaggcggtgcagcgggccggcctggggcaccactccgacctccgcgacggccaggtctggaccgacaagaaggggaaccccgccctgccctactacggcgccgtgctggagcggcacatcgtgcccgggaccgccgacccgaacgagaccgacgacgcgctccgcatcggccggctgacgaaccccaccgtccacatcggcctgaaccagctgcgccgggtggtgaacgccctcatgcgccggtacgggcagccccaggagatcgccatcgagctggcccgcgagctgaagctcagcgacgaccggaagaaggagatcaacacccgcaaccgggagaaccgcaaggccgcggagaagcggagccagaagctgcgcaacatcggccaggccgacaagggcgggaaccgcgccctgctcaagctgtgggaggagctgaaccccgagaacgtcctcgaccggcgctgcgtgtacaccgggcgggtgatctccatcgacatgctgttcagcggcgccgcggaggtcgaccacatcctgccgttctccgtgagcctcgacgactccaacggcaaccgcatcctgtgcctgcgggaggtcaaccgcatcaagcggcagcgcacgccctgggaggcccgggacgacctccgcgcccacttcgggcccgacgccggctgggaggccatcgcggcccgggccgcccgcctgccccgggagaagcgctggcggttcgagccggacgccgcgaaccgcttcgacgcccagggcgggttcctggcccggcacctcaccgacacccagcacctgagccgcctggcccggtcctacctcagcgccctgtaccccgagaccggcgaggggtccggccacgtgtgggtgagccccgggcgcctgacggagatgctccgccgggcgtggtccctgaaccaccacctcccggaccacaacatcgccggcgccgccaaccagcccaagaaccgcaaggaccaccggcaccacgccatcgacgcgatcgtcgtggccctggccgaccgcgccatgctgaaccggatcgcgcgcgagagcgggaaggagggccacgaggccgccggccggctggtggcctccatccccgagccctgggaggggttcagcgacgaggtcggccgcgccgtgcgggcgatcaccgtgtcccaccgcccggaccacgggaccgccagcaaggccggccgggccaaggacaaggacgccaccgcggggcgcctccacaacgagacggcctacggcctgaccggcgagaaggacgcccgggggctggacatcgtcgtgacccgcaagcccctctccgccttcaagaagtccgccgacctggacgcgatccgggacgacgacctgaagcagaagctcaaggcctgggccgccggcaaggagggcggggcgttcgagcaggccatgcgcagcttcggggaccccgagcggggcccccgcagccacccgggcctgcggcgcatccgggtgaccgagcccctgagcgtcatccccatccgcgaccgcgacgggcggccctacaaggcctacaagggcgactccaactaccgcttcgacatctgggagctcaagacggggaagtggaaggacgaggtggtgagcatgttcgaggcccaccggccgaactggacctcccccatccgcgccggcaaccccaccgcgcggaaggtcctgagcgtgcgccagaacgacgtgatcgccatcgagcgggagaacgggcccgagctgatgcgcgtcgtgaagttctccgccggcagcctcgccctggccccgccccaggaggcgggctccctgaaggcccgggacgccgacaagaacgaccccttcaagtacgtgtacgggagcccctccagcctccagcgctggaaggcccggcaggtccgcatcgacgagctgggccgggtgttcgacccggggttcgccgtgcgctcccggcgcagctccgagtga

SEQ ID NO: 1586 - RNA, 3291 nt, synthetic construct
  misc_feature 1..3291: note = Cas9 variant
  source 1..3291: mol_type = other RNA
atgaagaacatcttcagcttcgacatcggcaccaactccatcgggtgggccgtgctggccctcgacggcaacggggaccccgtccgcatcgcggacgccggcgtgcggatcttcagcgacgggcgcgacccgaagtccaaggccagcctggccgaggcccggcgcatggcgcgggccatgtcccgccggcgcgaccggaccctgcgccggaagcgcgccacgctccggaccctggccgagatcggcctgatgcccgacaccagctccgcgcgccaggcccagctccgggagaccagcgaccccaagtccggcagcgggcagctgacgcgcaacccctacgccctgcgggccctcgccctggaggagaagctgcccctcttccacatcggccgcgcgctgtaccacctggggcagcggcgcggcttccagtccaaccggaagaccgaccgcaaggacaacgacaaggggaagatcgccctcggcatcgaggagctgcacgccgccatgcgccaggacggcgcccagacctacgggcagtggctggcgcggcgccacgccctcggccaggccgtgcggctgcgcagcggggccctggacctcgagggcgagggctacgccttctaccccgagcggaagctgctggaggacgagttccaccgcatctgggaggcgcaggcccggcactaccccgacatcctcacccccgagcgccgggaccacctgttcacggtcatgttcttccagcgcccgctgaagaagcccaaggtggggaagtgctccttcaacaaccaggaggagcggctcagcaaggcccaccccctgttccaggagttccgcctgtacaaggaggtgaacgagctcgagatcgtcgagcccgacctgacccacaagaagctgaccctcgaccagcggaacgccctggtgaagaagctccaggtgtcccgcgaggccagcttcgcggccctccggaaggtcctgaagctgcgcccggaccagcggctcaacaaggagtccgagagccgcaccaagctgaagggcaacgaggtgtacgccgtgctgtccgacaagacgcggttcgggccccgctggggcaccttcagccaggccgagcagtgggcgatcatcgagcgcctcaaggaggaggaggaccccgggcggctgttcgcctggctgcgcagcgccttcggcatcgagggcgagcaggccgccgacatcgcgaacgtccacctccccgaggggcacggccggctggggaagaccgccctggaggccatgctcgaggagctgaaggccgaggtgatcaccgaggccgaggcggccaagcgctgcggctacgaccacgcccggctcgggggcggctccgacgagggggagccggagctgccgccctaccaggagatcctgcagcaccgcatcccgcccggcacgaacaaccccgacgacccctacgacatcgagaaggggcggttcaccaaccccaccgtgcacatcgccctgaaccagctgcgccacgtcatgaacaccctcatccggcgctacggcaagccggcccagatcgcggtggagctggcccgggacctgaagctcagcgagcgccagaaggaggaggtgaaccggacgatcgcccgcaacacccgggacgccgagcgccgggggaagaccctggaggagaaccgcatccccaacaccggctacaaccggacgctgctccgcctgtgggaggagctgaaccccggcaaggtcgaggaccggtgctgcatctacaccgggaagcccatctccatcagcatgctgttctccggcgaggtggacatcgaccacatcctgccgtggagccgcaccctggacgactcccacgggaacaagctcctgtgcctgcgcgaggcgaaccgggtgaagcgcaaccgggcccccgccgacgtcaccgagtggcgcgacaactacgacgagatcctcagccgggccgcccgcctgccccagaacaagcgggaccgcttcgcgccggacgccatggagcggttcgagaaggccggcggcttcctggcccgccagctcacggacacccagtacctgtcccggatggccctggagtacctcgcgtgcctgttccccgccgaggagatggacgggttcggcgagctgcgccggcaccgctacatcaacgtgtgccccgggcggctcaccgagatgctgcgccggaactggggcctgaacagcatcctctccgacagccagctgggggagaccgcccaggagaagaaccgcaaggaccaccggcaccacgccatcgacgccatcgtgatcggcgtcacgggccgctccctgctcaaccgcatcagctacgcggccgggcggctggaggcccagcagctggagaccctcgtgaaggaggccgcggccaccaacaagccctgggacggcttccgcgaggacgtcgccaaggtggtcgggggcatcatcgtgtcccacaagccggaccacgggaccgccggccggaaggccaaggaccccgcgcgccagcagacggccggccggctgcacaacgacaccgcctacgggctgaccggcgagaccgacgcccgcgggaacaccatcgtggtgcggcgcaagcccttcctcagcctgacgtccaaggacatccccagcatccgggacgaggccctgcgcgcggtcctcgagcagcacctccggggcatcccggacgggaaggccttccaggccgccctggacgccttccgcaagcagaagggcttccaccactaccacggcatccggcacgtgcgcctgaccgagcccctgtccgtgatcgggatcaaggaccgggacggcaaggtctacaaggggtacaagggcgacgcgaaccagcgctacgacgtgtgggagaccctggacgggaagtggcacgccgaggtggtcagcatgttcgacgcccaccagcccggctggcagagccggttccacgccgagaaccccaccgcccgccgggtgctccgcctgcagcaggacgacatggtggcgctgaacgccccggacggcgggcggctcctggtccgcgtggtgaagttccgccagaacggccagatcacgttcgccgggcacaacgagtccggcaacctgaaggcccgggacgcggccagcaacgagcaggaccccttcaagtacatctcccgcatggccagctccctcaaggactgcggctgccggcaggtccgcatcgacgccaccggccaggtgttcgaccccgggccccaggaccgggccagccgcctgcagaagcagtccaagcggtga

SEQ ID NO: 1587 - RNA, 3294 nt, synthetic construct
  misc_feature 1..3294: note = Cas9 variant
  source 1..3294: mol_type = other RNA
atgaagaagcagccccagcgctacatcctgggcctcgacctggggatcgccagcgtgggctgggccctgatcctcgtcgacggggcggagaacccggtgggcctgctggactgcggggtgcggaccttcgagcgcgccgaggtccccaagaccggcgactccctcgccctggcccggcgccaggcccggagcgtgcgccggctgatccgccggcgcgcgcaccggctcctgcgcctgcggcgcctcctgaagcgggagggcatcctgtccgccgccgacttcaacagcgacgggctccccaacctgcccatcgacgcctggcagctgcgcgtggcgggcctcgagcggaagctgacgaaccaggagtgggccgccgtcctgctccacctggtgaagcaccgcgggtacctgtcccagcgcaagagcgagacccagaccgagaacaaggagctcggccggctgctggccggggtggccgagaactccaagctcctgagcgagtccagcgagcagtaccggaccccggcggagctggccgtcaagctgttcgccgagcagtccggccacctccgcaacaagggcggggagtacacgcacaccttcaaccgcctggacctccagaaggagctgcacctcctcttcgagcggcagtacgccctgggcaaccccttcgccagcgcggagctgcagtccaaggtggacgagctcctgatgacccagcgcagcgccctgcagggggaggccgtgctcaagatgctgggcaagtgcaccttcgagccctccgagtacaaggccgccaagaacacgtacagcgcggagcggttcatctggctgaccaagctcaacaacctgcgcatcctgtacaacggcgaggagcgggccctcgacgagggggaccgcaagaagctgctggacgagccctacaagaaggccaagctgacctacaagcaggtccggtccatcctcaacctgccggagagcgccgtgttcaagggcctgcgctacgggaaggactccgacggcctcaaggccgagaacgggaccctgatggagatgaaggcgtaccacaagatccggacgatcctggacaaggccggcctcaagggcgagtgggagaaccgcatccggaaccccgagatcctggacaagatcgggaccgccttcagcctgtacaagaccgacgaggacatccaggccgcgctcgccgacctgcgcctgcccgagaacgtgctcgacgccctgctggccggcctcaacttcgacaagttcatccagctgagcctgaaggccctccggaacatcctgcccctgatggagcgcgggatccggtacgacgaggcgtgcaaggaggtctacggcgaccaccgcgccctcgccgagtccaagaaccaggtgctgctgccgcccatccccgccgacgagatccggaaccccgtggtcctccgcaccctgacgcaggcccggaaggtgatcaacgcgatcatccgccgctacgggagcccgcagcgggtgcacatcgagaccgcccgcgagctgggcaagtccaagcaggagcgggacaagatcgaccgcaagaacaaggagaaccagaacgaccggaaccgcctcgccagcgacatccggaagcacttcaacttcgagcccacccccaaggacatcctgaagctgcgcctctacgagcagcagcacggcaagtgcctgtactccgacctgcgggaggagaagggggagtgcctctacaccggcaacgtcatcgagctgcaccgcctgttcgaggacgggtacgtggagatcgaccacgccctccccctgagccggacgtgggacaactccctgaacaacaaggtgctcgtcctcaagagctccaaccagaacaagggcaacaagaccccgtacgagtggctggacggggccaacaacagccgccggtggcgcgagttccaggcgcgggtgcagggctgccacttcccctacgtcaagaagcagcgcatccagaccgccaagctggactccaaggccgagcagggcttcctggagcggaacctgaacgacacccgctacatcagcaagttcatgtgccagttcatcacggccaacctccggctggcggagacctccaacgccctgatggaggaggtggccggggagaacccctactggaaggagcgcaagcggcagcgcgtgttcgcccccagcggctccatcatcgccctcctgcgcgggctgtggggcctcaagaaggtccgggaggacaacgaccgccaccacgcgctggacgccatcgtggtggcctgcagcaccgtctccatgcagcagaagatcaccaaggccatgcagcggcgcgagacgctggagaccgtggacagcgagaccggcgaggtgaagacccggatcccgcagccctgggacttcttccgccaggaggtcatgatccgggtgttctccgacagcccccgcgaggagctcgccgagaagctgaacagccggcccgaggcgctgcacgacttcgtgtccccgctgttcgtcagccgcgcccccaaccggaagatgacggggcagggccacctggagaccgtgaagtccgccaagcgcctgagcgagaacatctccgtggtccggaagcccctcaccgccctgaagctgaaggacatcgagaacatcgtggggtacccggaccgcgagcccgccctctaccaggcgctgcgggagcgcctgctcgcccacaaggacgaccccgtgaaggccttcgccgacaagcccttctacaagccggcgaaggacggcgggcagggcagcctggtcaaggccgtgcggatcatcgagaacaccaagcacggcctgaagatccgcaacgggatcacggacaccaacggcgacatggtgcggaccgacgtctaccagaagaccgacaagaaggggaagcgccagtacttcatcgtgcccgtgtacgcctggcaggtcgagaagaacgagctccccaccgtggactgcaagggctacgagatcgacgacaactacgagttctgcttctccctgtacaagtacgacctgatcgagatccagaaccccaacgacatcaaccaggagctccgcgcctactacatcaactgcgacagctccgacgggcggttctggctggcctaccacgacaagagcgcgaaggagcagcagttccgcatctccacgcagaaccagccgatcatcaagaagtaccaggtggacaccctgggcaaggagatccggctctgcaaggccgagaagcgcaccgccctgaacggcaagaagaagaagtga

SEQ ID NO: 1588 - RNA, 3294 nt, synthetic construct
  misc_feature 1..3294: note = Cas9 variant
  source 1..3294: mol_type = other RNA
atgggcaagggggacatcctgttcagcttcgacatcggcaccaactccatcgggtggtgcgtgttcgccctcagcgacaacggcgacccctgccgcatcctggacgccaacgcgcggatcttcgccgacgggcgcgagccgaagtccggcaacagcctggccgagggccggcgcgccgcccgggcgatggcccgccggcgcgaccggtacaagcgccggcgcaaggccgtcctccggaccctgacggagtacgggctgatgcccgccgaccccaaggcgcgccaggccctcgtggccaagaccggcgaccgggggcccaagtccgaggaggccctggccgacgtgtacagcctgcgcgcgcgggccctcatggagaagctgccgctgcaccacatcggccgcgccctcttccacctgaaccagcggcgcgggttcaagtccaaccggaagaccgaccgcaagagcaacgagaagggcgccatcgagaccggcgtcaaccgcctgctcgaggagatgcgggacacgggggcccccaccctgggcgcgtacctggccaagcgccggtccgacgggcgccccgtgcgggtgcgcgccggcgccagcgagcaggaggccgaggacggcaagcccgcgaagaccgcctacgacttctacccggtccggcgcctcctggaggaggagttcgacgccatctgggagaagcagtactcctaccaccccgaggtgctgaccgaggagcggcgcgggcacctcttccgggtgatgttccaccagcgccccctgaagcccgccatcgtcggccggtgcagcttcaactccgccgagacgcgcctggcgaaggcccaccccctcttccaggagttccggctgtacaaggaggtgaacgagctggaggtggtcatgcccgaccagagccaccgcaagctcaccctgcccgagcgggaccgcctggtgctcaagctgcgggggcagcgcaaggccacctacgccgcgctgcgcaaggagctccggctgcgcgacctgcggttcaacaaggagaccgagaaccgcacggacatgatgggcgacgaggtgaccgccgccctcgccgacaaggccgtcttcgggaaccggtggtccggcttcagcaccgacgagaagtggcgcatcgtggagcggctgcgcgaggaggaggaccccttcgcgctgcacgagtggctcgtgtccgagcacggcctgagcgacgccgaggccgagcaggccgccaaggtccacctcccggacgggtacggccggctcgggcccaccgcggtgtccacgatgctggaggagctgaaggccgacgtgatcaccgaggccgacgccgcccgcctcgcgggctacgaccacagcctggcccgggccgacgaggacgggctggaccgcctccccaagtaccaggaggtcctggagcggcgcatcccgccgggcaccaacgaccccgacgacccctacgacatcgccaagggccggatcaccaaccccacggtgcacatcgcgctgaaccagttccgccacgtggtcaacgccctggcccggcgcttcgggaagccggaccagatcgccatcgagctcgcccgggagctgaagctgaacgaccgccagaaggacgaggtgaaccgggtcatcggccgcaacacccgcgcggccgccctccggagccagaagctgcgcgacatcgggcagaaggacaacggctacaaccgggccctgctcaagctgtgggaggagctgaaccccgacaagcccgaggaccgcgtgtgcgtgtacaccgggcggcccatctgcatctccatgctgttcagcggcgaggtcgacgtggaccacatcctgccgtggtcccgcaccatggacgacagccaggccaaccggatcctgtgcgtggtcgaggcgaaccgcgtgaaggccaaccgggcccccgccgaggtggccgagtggggcgggcgctacgacgagatcctcgagcgggcggcccgcctgccccggaacaagcgctggcggttcgcccgcgacgccatggagaagtacaaggagaacgagggcttcctggcgcggcagctcacggacacccagtacctgtcccgcctggcccgggagtacgccgaggccctctacccgaccgaggagcccgaccgcctgggggagctgcgccggcgcaaccacgtccgggtgatccccggccgcctcaccgagatgctgcggcgcggctgggggctgaacgccctcctgcccgaccacaacttcggcgcggggcaggccaagaaccggaaggaccaccgccaccacgccatcgacgccgccgtggtcggcgtgacgacccgggggctgctccagcgcatcagcaccgaggcgggcctgcgggagaagctggccctcgaggagaccatcgccgacatcccgatgccctggcccggcttccgcgaggagctgaaggccgccatcgaccgggcggtggtctcccacaagcccgaccacgggacgctgccgaagcccggcgagcacgggcgcaccgccggccagctccacaacgacaccgcctacgggatcaccggcgagacggacgcccggggcaaccccatcgtggtgcgccggaagcccttcctgagcctgaccgacaaggacatcccgtccatccgcgacaccgagctccgggggcgcgtctacagcgccacctccggcctgagcgggcgggagctgtccgcggccctcgactacttccgcaagaccgacaagcagttccgcggcatccggcacgtgcgcgtgacggagagcctgtccgtcatccccatccgggaccgcgacgggaacatctacaagggctacaagggcgacgccaacttccggtacgacgtgtgggagctgcccgacgggaagtggaaggccgacgtggtcaccatgttcgacgcgcaccgccccgaccgggccgccgaggagcgccggccgcaccccgccgcccgcaaggtgctcagcctgaagcagaacgacatggtggcgtgcgagcaccccaaggacggctacaccatcgggcgggtcgtgaagttcaacaccgccggccagatctacttcgccgcccacaacgagggcgggtccctgaaggcccgcgacgcggaccgggccgaccccttcaagtacttcagcaagtccgccagcggcctcaaggagatcgccgcccgccaggtgcggatcgacgcgacggggcaggtcctggacccgggcccccaggaccgcgagagccggctggcccgcaacaagcggctcgagcgcgagcgcgcctga

SEQ ID NO: 1589 - RNA, 3303 nt, synthetic construct
  misc_feature 1..3303: note = Cas9 variant
  source 1..3303: mol_type = other RNA
atgaagtacaccatcggcctggacatcgggaccagctccgtgggctggggcgtcatcgacacggagcgcaaccggatccaggacctcggggtgcgcctgttcgagagcgccgagaaccagaaggacggggagtccctggccaagccccggcgcgacgcgcggagcatgcgccggcgcctcgcccggcgcggctcccggctggagcgcgtcaagagcatcttcgagaaggccaagttcctgacccggggccagatggggatcacccacgcccgcccgaacgacccctaccggctccgcgccgagggcctggaccggctgctctccaacgaggacctgttcatcgcggtgtaccacctggccaagcgccgggggtacaagagcaaccgcaagaacgtgctcgagggcgacggggaggacgtgcgggagggcaaggccgtcctggacggcgtggcccagaacaagaagctgatggcgttccgcgggtaccgcaccgtgggcgagatgttcttcaaggactccgtcttcacggaggccaagcggaacaaggccgggagctacaagcactgcgtgctccgcgagatgctggaggacgagctgggcaagatcctccacgcccagcggtccctgggcaacaccctggtgaccgacagcttcatctccaagctcctggagaagaagaccggggtcttcgtgtaccagcgccccttcgccagcggcaaccagatcctgaagctcgtggggccctgcacgttcgagccggaggagatccgggcggccaaggccacctactccttccagtacttcaacgtcctgcagcgcctgaacaacctcaccatcaagaacaccgacacgggcaccgagcggaagctgaccagcgaggagcgcgccaagatgatcgccttcatcttctcccacaaggacgtgcagtacgcgcagatccggctggagctcaagctgagcgacgtggaccgcttcaacatggtcaactacttcgtgcagcggaaggagctggagaccaagacggccgaggagctccgccgggagatcgagaagaagaccaagttcccctccctgagcgactactacaccatccgcaagaccgtgagcgagatcgactccgccttctggatccagatcgagaagcagcacgacgtcatcgacgccatcggggagatcttcacgctgtacaagaccgacgaggacatcatcgcccagctcaacacccggatccccagcatcccccgcccggtggtgtccgcgctgctgggcctcagcttcaccaagttcggccacctgtccctgaaggccctccggaagatcatcccccacctggagaacggggacacgtacgacgtcgcctgcgccaaggccgaccccaagtacaccgaccgcgcgaagacccgggcccgcaagctgcgccccctcgacaaggaggaccacagcatcaccaacccggtggcccggcgcgccatcgcgcagacgatcaaggtcgtgaacgccatcatcgacaagtacgactcccccagcgaggtgcacatcgagctgggccgggacctggccaagaacttcaaggagcgcatgaagatccagaaggagcagaagcagaaccaggaggggaacgagcgggccatcgccaagatccacgagctctacaagctggagaacccccgcggccaggacatcatcaagttccggctgtggaacgagcagaacgggcagtgcatgtactccggcgagcgcatcgacgagatccggctgttcgacaacggctacaccgagatcgaccacatcatccccttcagccgctccttcaacgacagctactccaacaaggtcctcgtgctgaagatgcggaaccaggagaagatgaacaagaccccgtacgagtacatgggcggggacgcggacacctggcagcgcttcgagaacctggtgaacagcatgcacaacatcgggccccggaagaagcagaacctcctgctgaagaagtacgtcgccgacgacctcacgctgcgcaccctgaacgacacccggttcatcgcccgctacatgaagaactacatcgagaacaccctcctgttcacggagggcccccagaagcagcgggtgtacaccgtgaacgggcaggccaccgcctacctgcgcaagcggtgggtcctccacaaggaccgcaccgagaacaaccggcaccacgcgcaggacgccgtggtggtcgccgtggccaccccctccctggtgcagggcatcatgcgccacgccaagatgggcgagatcgtcgactacctgcacagccagaagttcgcgccgaacgtgacggacatcgagaccgggaagcccttcgagtccgccgacatccagagcgccaaggagcgcatcatcgccaagcacgagcaccggctccgcatccccgagccctgggagggcttctccgacgagctggacgcgcggatgggggacgacgtggtcgagaagctgagcctccgcaagagcaacatccacggctacaagaccacctccgacttcagccagatccacccgatcttcgtgtcccggatgcccaagcgcaagacgaccggccgggcccaccaggagaccctgcgcagcccccggcgcttcaaggagttccaggagtccgtggtccggacgcccctgagctccatcaacctcaagaagctggaggagatgagcgggaagaactccgacaagctgctctacgacatcctgcgcaagcggctgctcgcccacggcgacgacccgaagaaggccttcaccgagcccgtgcacaagccccgcaaggacgggacccagggcccgctggtgcggagcatcaagatggtctccgaggggcagcgcagcggcatcctggtgaacaacgagcaggccctcgtggaccaggactccatgatccggatcgacatcttcagcaagcccaacaagaagggcaaggacgagtactacatcatccccgtctacgcgtaccacttcgcccagaaggagctgcccaacaaggtgatcaccgccaaggccgaggccgactggcgcaccatcgacgacacgttcgcgttcgagttctccctgtacccgaacgacctcgtgaagctgaccaagggggacgacatccggttcggctactacagcgggtgcaaccgcgccctggccgccatccacatcctcccccacgaccagaacatgcccctggtcaacaacggcatcaagaccctggacaagatcgacaagtacgtggtggacatcctcggggagtaccacaaggtcggcaaggagacccgccagcagatccagtga

SEQ ID NO: 1590 - RNA, 3303 nt, synthetic construct
  misc_feature 1..3303: note = Cas9 variant
  source 1..3303: mol_type = other RNA
atgggcgccaccatcgtgaccgacatcagccgctccgccttcgcgttcgacatcgggaccaagagcatcggctccgccgtcctgcggctcgacgaccgcggggagcccatcggcatcatcaacgccgccgtgcggatctacgccgacgggcgcgagcccaagagcggcacgtccctggcggagggccggcgcctggcccgggggatgagccgccggcgcgaccggtacaagcgccggcgccggaccctcctgaacaccctgacggagttcggcctcatgccgcccaccgacgaggcccgcaaggccctgctggcggagaccaacgaccggcgcttcggggccgtggccggcaacgtctacgccctccgggcccgcgcgctggacgagaagctgcccctccaccacctggggcgggccctgttccacctcaaccagcgccgcggcttcaagtccaaccggaagaccgacaagcgcgacaacgaccagggcaagatcgccagcgggatctcccggctgggccagaagctggacgaggccggggcccgcacgctcggcgagttcctgcaccggcagcacagcgcgggcaagtgggtgcgcgtgcggccgtcccgcgtccccagcaaggacgacaaggaggaggacgggtacggcttctaccccgagcggtccttcctggagcgcgagttcgccgccatctggaaggcccaggccgcgttctaccccgagctcctgaccgaggagcgcggggaccacctccaccgggtgatgttcttccagcggccgctgaagcgccccaaggtgggcaagtgcagcttctaccccgacgaggaccggctgcccaaggcccacccgctgttccaggagttccgcctcgtcaaggagctgaacgagctggaggtggtgcaccgcggggaccggcgggagaagctcaccctggagcagcgcgacaccctgttcaaccagctccgcacgcagcggtccagcgccttcaccgccctgcgcaagaccctgaaggcccccaccggcacgcggttcaacaaggagtccgacgcgcgcgacaagctcaagggcgacgaggtcgccgccgagatgagccacaaggaccggttcgggcaggcctggatcggcatgcccctggcggagcgctgggccgtgatcgagatgctgctcgacaccgaggaccccctggaggtgaaggcctggctggaggagcactacgggttcgccgccgaccggatcgacgcgatcgccgccgccaagctcccgcccggctacgggcgcctgggcgagaccgccctgcgggacatgctcgacgagctgaagaacggcaccgtcaaggacgactccgggcgcgacgtggtgctgacggagcggcaggcgatggacaacatctggaaggacaaccccgccctccagcgcgtcgtggccgacgcccgggagctgcccccgtaccaggaggtgctgggccgccggatcccgcccgggaccggcaagcccgaggacccctacgacgtccagaaggggcgcctgaccaaccccaccgtgcacatcggcctcaaccagctgaagcgggtggtcaacgccctggtgcgccggcacggccgccccgaccagatcgcgctcgagctggcccgggagctgaagctcaacgaggagcagaaggccgagaaggaccgcgagatcgcccgcaacacgaaggcggcccaggcccggagcgagaagctgcgccagctggacatcgacgacaacgggtacaaccgggtcctcctgaagctgtgggaggacctcaacctgcgccagcccgagaaccgggagtgcatctactgcggcaaggccatcgggatcggcaccctgttcagcaaccaggtggacatcgaccacatcctcccgtggtccaagaccctggacgacagccaggccaaccgcatcgtgtgccacgtcgagtgcaaccggcagaagggcaaccacgcgcccgccgaggtgccccagtggcacgaccgctacgacgacatcctggcccgggccgagcgcctcccgcggaacaaggcctggcgcttcgggcgggaggcgatgaagaagttcaaggacgacgagtccttcctggcccgccagctgaccgacacgcagtacctcagccggatggcccacgagtacgtggccgccctgtaccccgacgaggagcccgacgagtggggcgtcttcacccgccggaaccacgtgcgcgtgatccccgggcggatgaccgagatgctgcgccgccagtggggcctcaacgcgatcatctccgaccacgaccagaagaaccggaacgaccaccgccaccacgccatcgacgccatcgtcgtgggggtgaccacgcggcgcctgctgcagcggatcgccaccgcggccggcggccgcgaggccctcgccctggaggagaccatcgggaagatcgagccgccctggcccggcttctacgacgacgtcaaggaggccatcgaccggatcgtggtgagccacaagcccgaccacgggtccctgccgaagcccggcgagcccgcgcgcaccgccgggcagctccacaacgacacggcctacggcttcaccggcgaggagcggaagggggtccccatcatggtgcaccgcgtgccgttcgccaccctgaccgagaaggacatccccagcatccgggaccgccagctggccgaggcgctctacggcgccatcgccgggatctccggcaaggccgagctggccgcggccctggcccggttcagcgcctccgggccctacaagggcatccgccacgtccgggtggtggagcccgtcagcgtgatcgccatcaaggaccgcgacggcaccccgtacaaggggtacaagggcgacgcgaactaccggtacgacgtgtgggagctccccaacgggaagtggacgcacgaggtcgtgtccatgttcgacgcccaccgccccgactggcagagcgagatccggaacaagaaccccgccgcccgcaaggtgctgtccctgcaccagaacgacatggtcgcgtacgagcacccgcaggacggctacaccatcgggcgggtggtgaagttcggcagcggcgggcagatggccctcgccggcaaccgcgagggcggggccctgaagtcccgcgacgccgaccccgaggaccggttccgctacttctacaagagcggcggggcgatgcgggacgcccgcctgcggcaggtccgcgtggacgagaccggccgggtgttcgaccccgggccccaggaccgcgagtcccggaacgcccgcaagcagagcgccgccggctga

SEQ ID NO: 1591 - RNA, 3306 nt, synthetic construct
  misc_feature 1..3306: note = Cas9 variant
  source 1..3306: mol_type = other RNA
atgaagaccctgggcctcgacctggggaccaacagcctgggctgggccatcgtggagacgcgcgacgagcccaccaagtactccgaggggagcatcgtcgcctccggcgtgcggatcttcagccagtccgagatggcggggcgcgacccgcagagcaaggcctccctcgccgtggcccggcgccaggcccggggcagccgccggcgccgggaccgctacctgaagcggcgccagcggctggtcgacctcctggtggacctgggcctcatgcccgcggacaaggccgcccgcgccgagctggtgaagaaccacggggacggcaagaccggggacctgtccagctccgtctacgcgctccgggcccgcgccctggacgaggccctgagcccctacgagatcggccgggccatcttccacctcaaccagcgccgggggttcaagtccaaccgcaaggcggacagcaacgaccccgagcagggcgtgatctccgagggcatgcgggccctggacgagaagatggccgaggccggggcccgcaccatcggcgagtggctgcacatgcgccggctccaggggctgccggtgcgcgcgcggatcgcccccgacggcgagggctacgccttctaccccagccgcggggccctggagcgggagttcgaccgcatcatggcccggcagaccctcttccacacggacctgctgaccgacaccgcgatccgcgagctccgggaggtcgtgttccaccagcgccccctgcggccggtgaagcccggcaagtgctcctacaaccccctggaggagcgcctcgccaaggcccaccccctgttccagaagttccggctgctcaaggagctgaacgagctggagatcgtcggggaggaccagaagcacatcaagctcacgccggagcagcgcaacgccctggccctgcagctccggaccagcctgaccaagcagggcaaggtgcccttctccaagctgcgcagcaccctcaagctggggcgggaggtgcgcttcaacaaggagacggacaaccggagcgacctggagggcgacgtcatctacttccgcatgtcccgccccgagtgcttcggcaaccggtgggcggacctccccgtggagatgcaggccgccatcaccgagcgcctgcggaccgagccggactacaagaccctgatgaactggctcaaggccgagacggggctggacgaggtgcacgcgcgcgccgtcgccgacacccccgtgcccgacggcttcgggcggctgggccagagcgccctcaccgccctgatcgacgcgctggagaacgaggtgggggagggcggcttcgtcatcaccgaggccgaggccgccaagcgcgtgtacgggcggacgaactccgaggccgaccccgaccgcaagggcgtggacgagctgccgaagtaccaggaggtcctcgcgcggcacatcccgcccgggaccggcgagcccgacgacccctacgacgacttcatggggcgcatcaccaaccccaccgtgcacatcgccctgaaccagctgcggcgcgtcgtgaacgccctcatccggacgtacggcaagcccgaccgcatcgccatcgaggtgggccgggacctgaagatgaacgaccgcgagcgggacgaggtcaaccgccggatcgggcgcaacaccaaggccgcgatcgagcggggcgtgaagctgaccgagaccttccgccagctcgacacggggtacaaccgcctgcggctggagctctgggaggacctgaaccagaagcccgagaaccgcgtgtgcatctactgcggcaaggccatcgccggccacatgctgttcaacggggagaccgacatcgaccacatcctcccgtacagcaagaccctggacgactccaaggccaaccggatcctgtgctgcaccagctgcaaccgcgagaagaagaaccggccgccctcccgcgtcccccagtggcggagccgctacggcgagatcctcgcgcgggccacgaccctgcccaagaacaagcagtggcgcttcgccgaggacgccatgacccggttcggggaggaggagggcttcctggcccgccagctcaccgacatgcagtacatctcccggctggcgctgacgtacctcgcccacctgtacgactacgaggaggtggacctggacgggatctacaagcgccacgcccgggtgcgcgccctccccggccggatgaccgagatgctgcgccggcagtggggcctgaacgagctcctgcacgaccacaacctgatcgggggcgacgtcgccaagcccaagaaccgcctcgaccaccgccaccacgcgatcgacgccatcgtgatcgcctgcaccagccgggccctgatccagcgcctggccaccgcgtccgccgccgccgaggagcgcggggcggagcgggtggtcgagcggatcgacccgccctggagcggcttccgcgaggacgtgcgggccgccgtgggggccatcgtcgtgtcccacaagcccgaccacggcaccgtgggccgcgaggggtacgccaagggccgggggcagacggcgggcaagctccacaacgacaccgcctacgggcacaccggcgagaaggacgccagcggcaacgacatcgtcgtgcgccggatcgccgtgaccgacatccgctcccccgccgacatccggaagatccgcacgaacgcgcacgggcacagcgagctgcgggaccgcctgtacgaggccacccggggcctcgaggggaaggccttcgagcaggccgtcctggacttcgtgaagggcgacgccaagttccgcgggatccggcacgtgcgcatcaccgaggtcgcgaacccggtgtggatcacccacggcgacggccggcacaagaaggggtacctgcccggcgggaacgaccgcttcgacgtgtgggagctcgccgacggccgctgggacgccgaggtcgtgacgaccttcgacgcccaccggcccggcttcgtgccccgcatgcggctggagaaccacaacgcccgcaagatcatgtccctgaagaagggggacatgatcgcgtacaacgacccggtcagcggccagcggatcatcgccatcgtgcgcaagttcgaccagcggaacaagcagctctacctggacccccacaacgaggccgggaacctggaccgccgggagaaggagaagacctacaagcccctccgccccatgccgaaccccctgaagaagtaccggccccgccaggtgcggatcgacgagatcggccaggtcttcgaccccgggccgtggtgggagcgccaggacggctga

SEQ ID NO: 1592 - RNA, 3306 nt, synthetic construct
  misc_feature 1..3306: note = Cas9 variant
  source 1..3306: mol_type = other RNA
atggagcagaccagcctggacctctcccaggccatgaagaaggtggcccagccccagaagccgtaccgcctgggcgtcgacgtgggggtggcgagcatcggcgccgccgccgtcaccgacacggagatcctggggatccacgtgcggaccttcgagaagggcgagatcaacgggaagtccggccgcaagcccctcaacgccgactaccggcgccagaagggccagcggaagcgcctgcggcgcaagaagaaccggctgctcagcctgcgccggctgttccgccgggtggggatgatcgagtccgcggccatcgaggccttccccatcagctccaccagcccctggcagctccgcaccgagggcctggaccggcgcctgacgaacgaggagtgggcccaggtcctctaccacatcgcgaagcaccgggggttccagtccaaccgccgggtggacatggacgaggccaccaagctgagcgacgccgccggcgactccccggagaccaccacgaacaccgagagcgactccgacaccaagaagatgctggccggggtggcggacaacaagcgcctcctggccgagaagggctaccggaccatcggcgaggccgtcgcccgcgaccccaagttcagccaccgcatccggaacaaggaggagtcctacagccacacgatcgggcgcgacgagatcaacgccgagctgaactgcctcttccaggcgcagaaccactacggcaacccccacgccaccgaggagctgtccgagcagatcatcgacctgatcaactggcggcgcaagaccgtgaccggggacgacatcaagcggatggtgggccgctgcacgctcgagcccaaggagtaccgggccgccatccacagcgtctccgccgaggagttccgctggctgagcaccctgagccggctccgcatcgtgacccagggcgagtcccggccgctgaccaagtgcgagtgggacaaggtggtcgacctgccctggcgccaggaggcgatcacgtacaccagcatccggaacgccatcgggctccgccacgacatccggtcccgcttcaacatccggtacgagaccggcgggaagaagaccaagacggacaccaagaacgagaccaccaagggccagagcgccgacgccgtgacgtccgaggtgaagaccgccgagaaggagaccgcgttcaaggccaaggggtaccacatcctgcgcaaggcctacaaggccttcggctacgacgagcagtgggaccgggaccgcttcaacaccgagctgctcgacacgctggcgaccgccgtcaccttctacaaggacgacagcgagatccaggcccacctggagaccaacgacacgcccgagtacgccatccagatcgccctccgcctgcccaccctgaccaagttctccaagctcagcaacaaggcgatcctgaagatcctgccgcacatgcgggagcgccagtcctacagcaacgcctgcctcctggccggctacaagaaccaccacaagcagtacgacgacacgccccagaacgggaagatcccccggtccgccatcgagcacatcaagaacaccgtggtgtaccgcagcctgaaccaggcccggcgcgtcatcaacgcgatggtgaaggagtacggcgcgccccaggaggtgcacatcgagctcgcccgggacatggagaagtccgccaagaagaaggacgagatcgacctgtggatgaagaagcgcaagaagaagaacgacgagctgcgggagcgcttcgggaagaacctcagccgggacgagctgctgaagtacaagctctacgaggagcagaacggccagtgcgcctactccctgcagccgatccagctggggcgcctgctcgagcccaactacgtcgaggtggaccacgccctgccccggagccgctccatggacaacagctacaacaacaaggtcctggtgctcaccaagcagaaccgggacaagggcgaccgcacccccttcgagtacttcggcgaggaccaggagtccgtggactggaagcggttcaccaactgggtcgagagcaacccgcagatgccccaggccaagcgccggaagctgctgaccaagagcctccagaaggggatcctggacaacttctccgcccgcaacctgagcgacacgcggtacatcgcccgcgagctcaagaccctgatcgagcactacatcctgaacacccccgagcgcgagaagaccaagtacgagcggtgcgtggtgatctccggcaagctcacggcgcagatgcgccagctgtgggggatcagcaaggcccgggacgtctccgaccgccaccacggcagcgacgccgccgtgatcgcctgcatcaccccctccatggtgcggcgcatcacccggtacctgcagctccaggagcgccgggcgatgccgagcgcccccgggaagggcgacgagcaccccgccgtcgtggcccgcgccatcccccacgcgccggtgccctggcccaccttcgagcacgacctggaggccgccctggagaaggtcctcgtgtcccggccgcagagccgcaagtggtccggccccatccacgccgacacgatctacggggagcacaaggaccaggagaccaacaccgtggcccccacccagcggatcaagctgacgcagctgaccaagagcaactacaagaacatcgtcggctacgacgaggagcgcaacaaggacttcatcgaccagatcgaggagcggctcgagtgccacaacttcaacgggaagcaggcgttcggcacctcccagagccccatctaccgcatcaagaagaacggcgagctggggccggaggtgaagaaggtgaccatcaagctgcccatcaagaactccgtcttccggatccgccggggctacgtgaagaacgccaagaacagcacgatctacatcaacatctaccagaacaccaagaccgggaagttcgagatgcaccccgtgtacgccaaggacctcacctccagcgccaacgcgagcaagtccttcgagtacagccccgacctgcagctggtcgacacgatccgccgcggcgactacatcgagatcacccggcgcaacggggaggtgatctccggctactacgccacccacaacatcagcacctccgtgctcgagctgcagccgcacgacacgaccgacagccggaacaaccgcacccccgccatcaagacctccctgaacatcgagcggttccacatcgacatcctcggccgcaagcggcgcgtcgtgcggcgcgccaagaacgggctggccgacgaccgggacaagtga

SEQ ID NO: 1593 - RNA, 3309 nt, synthetic construct
  misc_feature 1..3309: note = Cas9 variant
  source 1..3309: mol_type = other RNA
atgggctaccgcatcgggctggacatcggcatcaccagcgtggggtacgccatcctcaagaccgacgagaagggctccccctacaagatcgagcacctgacgagcgtcatcttcccgatcgccgagaaccccaaggacgggaagtccctggcgatgccccggcgcgagcagcggggcgcccgccggcgcaaccggcgcaccaagttccggaagcaccgcaccaagatgctgttcgtgcggagcgagctcctgaccatcaagcagatcgaggccatctactccgagaagcagaagctcagctccatctacgagctgcgcacgaaggccctgaacgagcggctcaccaacgaggagctgttccgcatcctgtacttcttcagcggccaccgggggttcaagtccaaccgcaagagcgagctcaccgagaaggacatgggccccgtgctgaccgccatcaaggacatcgaggagaagctggcggacgggacgtaccggaccctcggcgagtacatggagctggacgagaagtaccaggagcacaagcgcaacaaggacgggatcgaccggtacctgggcaccgccaagcgctccctcatcgaggacgagatcaagcagatcatcatcgcccagcagcagttcggcaacaccaagctgacgagcgggttccaggtcgccttcatcggcgacgaggagcagaccgggatcttcaacgaccagcgggagttcgaggacggcccgggcaagcagtccccctacgcggggaaccagatcgagaagatgatcggcgcctgcaccttcgaggagaacgagaagcgcgcccccaaggccagctacaccttccagtacttcgacttcctgtgcaagctcaacaacctgaagtaccgcgagacgatcgggggcgagtaccggttcctgtccctcgagcagaagaacgtgctgaaggagaaggtgctgaccacccagaagatcaccttcagcggggtcaagaagctcctggacctgcccgagcacgcccagttcaacctcgtgaactacggcacgaagtccaccgtgaaggagaccgagaccaagagcgtcttctacgcgatgatctcctaccacaagctgaagaaggccatcccggcccccatcttcagcaacctgagcacggccgagctcgacgagatcggccgcatcctgaccctgtactccagcgacaaggggcggaagaacgagttctactcccgcctcgccatccccgaggaggtggtggaggcgctgctgcccatcaacttcagcaagttcggcaacctctccctgaaggccatgcggaagatcatcccgtacctggagatggggctcgtctacagcgaggccgccacccaggccggctacgacttccgccacaagaagatcgaccaggcgtacatccacgagaacgtgaccaaccccgtggtcaagcgggccgcctcccagacgatcaagatcgtgaacaacatcatccgcaagtacggggagcccgacggcatcaacatcgagctggcccgggagctgagcaagaacttctccgagcgcaagaagaccgtgaagtaccaggaggagaaccgggcccgcaacgagcggatcgcggacaagctccgcgagtgcgagctgcccgtcaacggcgccaacatcacccggctgaagctgttcgaggagcagggggagttcgacccgtacaccggcctcaagatccccttcgaccgcgccttcagcgaggagtacgaggtggaccacatcatcccctactccaagacgctggacgacagctacgggaacaagatcctggtgtccgccaaggcgaaccaggagaagggcaaccggatccccatggagtacctccaggggaagccggagcgcatcaagaagctggagagcatcaccgccaccatcaagaaccccaagaagcgggagaagctgctcaagcagcagctgaccaaggaggacgtcgacggctggaagacgcgcaacctgaacgacacccgctacatctccagcctcctgcacgactacttcaaccagaacatctccttcgccaagctggagagcgagaagaagaagcgggtgatcgccgtgaacggcgccatcacctccaagctccgcgcgcggtgggggttcaacaagatccgcgagaacggcgacgagcaccacgccctggacgccctgatcgtcgcctgcgtgaccgacaagtacatcaaggagatcaccagcttcagcaagcggaaggaggtccgcttcaacgagaacctctggaagcgggagaagacgccccaggagatcgagcaggaggtggtgcacttcaagaaggactacgaccgcatcttcaaccaggccttccccctgccgtggaccaacttccgggaggaggtctcctgccgcatgagcgagaaccccgcggagctgatgaagaaccacacctgggagacctacacggacgacgagatcgccgccctccggcccatcttcatcgtgcgcatgcccaacatgaagacctccgggccggcccaccaggagaccatccggagcggcaagctggaggagaagggcctgaacatctcccgcgtgagcatcgagaagctcaagctggacaaggaggggaccatcaagtccggcaacgcccagttctacaaggacagcgggaacggctggcagctgctccacgacaagctgaaggtcgcgctggagaagcacgacggggacggctccaaggccttccccgacggcgtgttcaagtaccagtacctcgacaaggagcacacggtgcggaaggtccgcctggtggccaagagcaccctgcagacctccctcaacgagaagaagtccgtggccgacaacgggagcatgatccggatcgacgtcttccgcaacgagcagggcaagtaccagttcgtgcccatctacgcgaaggaccgggtggccaagaagctgccgaaccaggccgtcgccgtggggaagatcgccaaggagtggcccctgatcgaggagagcgacttcaagttctccctctacagcaacgacctgatccgcgtgaagcacaagaagggcgtcaagcacgtgtccaaggacgggaacaaggaggagaagtccaagaccgacttcttcggctactacacgggcgcggacatcgccaccgccagcatcagcgggatcagccccaacaacttcttcgagttccggtccatgggcctggccaccctcatcagcatcgagaagtacaaggtggactacttcgggaactaccaccaggtcaacgagaaggtgcgccagaagttccccaagaaccgcatgtga

SEQ ID NO: 1594 - RNA, 3312 nt, synthetic construct
  misc_feature 1..3312: note = Cas9 variant
  source 1..3312: mol_type = other RNA
atgaagtacgacatcggcatcgacatcggggtggccagcgtcggcgaggccgtgatcgaccaggaggggaacatcctggaggcgtgctccaacctcttcgacgaggccgacgccgccagcaacgtggaccgccggaacttccgcgagggccggcgcaacaagcggcgcgagcggacccgcgtcaacgacttcaagaagctgtggaccaagttcgggttcgagatccccaagaacgtgatgaacgacacgatcctgctccggaacaagggcatcaagtgcgagctggacctgaccgagctctactccgtgctgctgtacatgctcaagcaccgcggcatcagctacctggaggacgccatcgacgaggcgaaggggtccaactacgccaagggcatcgccctgaaccagaaggagctcaaggagaagctgccgtgcgagatccagctggagcggctcaagatctacgggagctaccgcggcgactgcatcgtcaagaaggaggacgaggacgagtaccactccaacgtgttcaccatcagcgcctacaagaaggagctggagatcctgttccggaaccagaagctccccgaggagttcatccaggggtacatgaagatcttcgagcgcaagcgggagtactacatcggccccggcaacgagaagtcccgcaccgactacggggtgtacacgaccaacaaggacgaggagggccactacatcaccgacaagaacatcttcgagaagctgatcgggaagtgcagcgtctacaaggacgagttccgggcggccggcgcctcctacaccgcccaggagttcaacgtgctgaacgacctcaacaacctgacggtgaacaaccgcaagctgaccgagaacgagaagaagaagatcgtcgagaagatcaagagctccaacgccgtgaacatgcggagcatcatcaagaaggtgctcggcgaggacatcgagcagttcgggggcgcgcgcaaggacaaggccgacaaggagatctaccacaccttcgaggtctaccggaagatgaagaaggagttcgagaagaacgggatcgacatcgccgacttctcccgcgagaagctggacgagatcggcaacatcctgaccctcaacacggagaccgaggggatcaagggcgccctgcacgaggccaagaacagcttcacctactccgagatcgagaccctgatcgacatccgcaagaagaacagctccctcttcagcaagtggcagagcctgtccctgaagatcatgaacgagctcatcccccagatgtacgcgcagccgaaggagcagatgcagctgctgacggagatgggcgtgttcaagttcaagagcgtgaagttcaagaactccaagtacatccccgtcgaggagatcatcaaggacatctacaaccccgtggtggtccggagcgtgcgcaccaccatcaagatgatcaacgagaccatccggaagtacgggtaccccgacaacatcatcatcgagatgccgcgcgacaagaactccacggaggagaaggagcggatcaagaaggagcagagcaagaacgagaaggagtacgagggcatcctcaagcgcatcaaggacgagtacgacatcgagatcaaccgggacgactaccgcaagcaggagaagctggccctgaagctcaagctgtggaacgagcaggaggggcggtgcccctactccggcaagatgatcagcatctacgggctgctcgaggacccccagctgttcgagatcgaccacatcatccccaagtccatcagcttcgacgactcccgcaacaacaaggtgctggtctaccggagcgagaaccagaagaagggcaacaacaccccgtacatgtacctctccaagggcgacaagaactggaactacgaccagtacaagagctacgtgctggggctgaagaacaagggcaacatctccgacaagaaggtcaacaacatgctgttcatggaggacatcaacaagatcgacgtgctcaaggggttcatcacccgcaacctgaacgacacccggtacgccagccgcgtggtcctgaacatgctccagtccttcttcaacgagaaggacggctgccccacgaaggtgaaggtgatccgggggagcttcacccaccagatgcgcgtcaacctgcggatcaacaaggaccgcgacgagtcctacagccaccacgccgtggacgccatgctgatcgtgtacagccagcggggctacgaggcgtaccgcaagatccaggaggcctgcgtcgacttcgagaccggcgagatcatcgacgaggagcgctggcagcagtgcatctgggggaaggactacgaccaggtgatgtacgaggccaagtggtccaagatccgggagaagatcatcgaggccgagaagaacgtgaagtaccaccaccgcgtcgacaagaaggtgaaccggggcctctgcaaccagaccatctacgggacgcgcatcaaggacggcaagatctacaagatcagctcctacaacatctacgacaacaaggagtgcgccagcctgctgaagatgatcaagggcgggaaggagtccaagatcctcatgtacaactacgacagcaagacctaccgggacatgatcaagatcatcgacgagtactccgacgagaagaaccccttcgtggcgtacatgaaggagaccggcgactacttccgcaagtacgccaagaagcacaacgggcccaagatcgagaaggtcaagtactacaaggaggaggccggcagctgcatcgacatctcccacaagtacgggtacgagaagggcagcaagaaggtgatcctgggctccctgaacccgtaccggaccgacgtgttcttcaacgagcgcctcaagaagtactacctgatcgggatcaagtacaaccacatcaagtgcgagggcaacaactacgtcatcgacgaggacgcctacaacgggctgctccgggacgcgggcgtgatcagccacgagaacacgatcaacgacctggagaaggtgggggtcaagtacctgttctccctctacaagaacgacatcatcaagtacgagaagaacggcgagatgttcgtggagcgcttcctgagccggaccatggagtacgccaacaactacatcgagaccaagcccatccacaagcccttcttccagaagaaggacaagaagggcaacatcaagaactcccagaacctggtggggctcagcaagaccaagtacatcggcaagctggtcacggacgccctggggaacacctacatggtggagaaggagaagttctccctcatcgtggacatctga

SEQ ID NO: 1595 - RNA, 3315 nt, synthetic construct
  misc_feature 1..3315: note = Cas9 variant
  source 1..3315: mol_type = other RNA
atgaagctgatcctcgccctggacatcggcatcgccagcgtggggtgggcggtcctggacaagaagtccgagaccgtgctcgaggccggcagcaacatcttccccgaggcctccgccgccgggaaccaggtgcgccgggagatgcgccaggcgcggcgcatcaagcggcgccagcggacccgcctggacgacttcaacaagctgtggcggaagaacaacctcagcatcccgcagtacaagtccacggagatcgtcaacctgaaggtgaaggccctgcgcgaggagatcagcctcgacgagctgtacctgatcctctactcctacctgaagcaccggggcatcagctacctggaggacgcccaggacgactccctcagctccagcaacgcctacaccaacgggctgcgcgagaacgcgaaggccctggagaagcactacccctgcgagatccagcgggaccgcctccagaccatcggcaagtaccggggccagacccagatcacggacgacaacaacgagaagatcgacctgtccaacgtgttcaccatcggggcctaccgcaaggagatcaagaaggtcctggagacccagaagctctaccacaacgagctgaccgacgagctgtgcgacgactacatcctcatcttcaaccggaagcgcaagtactacgagggccccgggaacgagaagtcccggacggactacggccgcttcaccacccggctggaccagaacgggaactacatcgacgaggagaacatcttcgagaagctgatcggcaagtgcagcgtgtaccccgacgagctccgcggcgccgccgcgagctacaccgcccaggagttcaacctgctgaacgacctcaacaacctgacgatcaacgggcgcaagctggaggagtccgagaagcacgccatcgtgcagcggatcaagaccagcaacaccgtcaacatgcgcaagatcatcgccgactgcatgggcgagaccatcgagaacttctccggggcccggatcgacaagagcggcaaggagcagttccacaagttcgagacgtacaacaagatgcgcaagagcctctccgagatcggcaccgacatcgacgagttcagccgggacgagctggacaagatcgggtacatcatgaccatcaacaccgacaaggaggcgctgatggaggccttcaacgagtccggcctcaacctggacgacagcgtgaaggagtgcctgatctccttccgcaaggccaacagctccagcttctccaagtggcagagcttctccctcaagatcatgaacgagctgatcccggagatgtacatccagcccaaggagcagatgacgctgctcaccgagatgggggtggccaagggcagctccggggacttcgccggcctgaactacatccccgtcgacgtgatcagcgacgagatctacaaccccgtggtccggcgctccgtgcggatcagcttcaagatcctgaacgcggtgctcaagaagtacaaggtcctggacaccatcgtgatcgagatgccgcgcgaccggaactccgacgaggagcgcaagcggatcaccgacagccagaagctgaacgagaaggagatggagttcatcgagggcaagctcgcccagatctacaacatcaagctgtccagcagcgacttctccagccagaagcagctgtccctgaagctcaagctgtggaacgagcaggacgggatctgcctgtacagcggccgcacgatcgaccccgaggacatcatcaagaaccccgacctcttcgagatcgaccacatcatcccccggtccatcagcttcgacgactcccgcagcaacaaggtgctggtctaccggtccgagaaccagaagaaggggaaccagaccccgtacttctacatcacccacagcgacggcgcctggacctacgagcagttcaaggccaacgtgatgaacctgtccaagaagaaggagtacgccatcagccgcaagaaggtgcagaacctcctgtactccgaggacatcacgaagcgggacgtcctgaaggggttcatcaaccgcaacatcaacgacaccggctacgcgagccgcgtggtcctcaacaccgtgcagaacttcttcaaggccaaggaggccgacaccaaggtgaaggtcatcaagggctcctacacgcaccagatgcggagcaacatgaagctggacaagaaccgcgacgagtcctacagccaccacgccgtggacgcgatgctgatggggttcagcgagatgggctacgaggcctaccggcgcctccagggggagttcatcgacttcgagaccggcgagatcctgaagaacgacatgtggaacgagaagatgtccgacgacgtgtacgtcgactacctgtacgggcggaagtggagcgccatccgcaacgagatcgtgaaggccgagaaggacgtgaagttctggcacttcatcgtccggaagtccaaccagggcctctgcaaccagaccatccgcggcacccgggagtacgacgggaagaagtacaagatcaacaagttcgacatccgcacgaaggagggcgtgaagctgttcaagaagctggccttcagcgagaaggagtccgaccgggagaagctcctggtgtacctgaacgaccgccagaccttcaacaacctcgtcaagatcttcgaggactacaaggacgcgcccaaccccttcgtgcagtacgagaaggagaccggggacgtggtccggaagtacagcaagcgccacaacggcccccggatcgacaagctgaagtacaaggacggcgaggtgggggcctgcatcgacatctcccacaagtacggcctggagaaggacagccgcaaggtgatcctcgagtccctggtcccgtaccggatggacgtgtactacaaggagagcgacaagatgtactacctggtgggggtcaagcagtccgacatcaagagccagaacggcgccaacgtgatcgacgaggacctctacacccgcatcctgatcaacgagaagatgatcgagcccgggcagtcccgggacgacctggagcagctcggctacgagttccgcttcagcttctacaagaacgacatcatcgagtacgagaaggagggcaaggtgttcgtcgagcggttcgtgtcccgcaccatgcccaaggtgcgcaactacatcgagacgaagcccatcaacaaggccaacttcgagaagcagaacccggtcgggctgggcaagaccaagagcatcaagaagtaccggaccgacatcctggggaaccgctacctctgcgagaaggagaagttcaccaagttctgctga

SEQ ID NO: 1596 - RNA, 3315 nt, synthetic construct
  misc_feature 1..3315: note = Cas9 variant
  source 1..3315: mol_type = other RNA
atgaaccactacgtgctgggcctcgacatcgggatcaccagcgtcggctacggggtgatcgacctggacaactaccagttcgtggactacggcgtccgcctgttcaaggaggggaccgccgaggacaacgtgaaccggcgcacgaagcggggctcccgccggctcaagcgccggcgccagacccggctggacgacatgaaggagctgctccagaaggagaagatcatgagcgagacctaccactccagctacgacccctacgacatgcgcatcaagggcctgtcccagaagctgagcaacgacgagctgacctgcgccatcctccacatcacgaagtgccgggggaccaccctggaggcgctcgactccgccgacgaggacagcgagggcaccaagtccatcctgagcaagaacgaccaggacctgaagaagtaccactacgtgtgcctcgtccagaaggagcgcctgaagcagtccgggaagatccggggcacggagaacaacttcaagaccgacgactacatcaaggagctggacgagatcctcagccaccaggacctgtccgaggacctgtgcgagaagatccgcaccatcgtgagccggcgccggcagtactacgaggggccgggctccgagaagtcccccaccccctacggccgctggatcgcccagggggtggcccccatcgacctcatcgagaagatgcggggcaagtgcagcgtcttcccggaccagctgcgcgccgcgaagaacagctacacggccgagctgttcaacctcctgaacgacctgaacaacctcgagtgcgagggggagaagctgaccacctcccagaagcaggacgtgatcgacttcgtgaacgagaagggcggcatcacccccaagcagctggccaagctcctgaacgtcgacctgaaccagatcaaggggttccggatcgacaagaacgacaagcccctcctgacggagttcaagggctacaaggccttcaagaagatcttcgacaccaacaactgcgacctgtacaagaaggacctcagcatcctggacgggctggcggagatcgtgaccggcaagaaggggatcgaggagcgcaagcaggccatccagcaggcctaccccgagatcgacgaggccatcgtggagcagtgcgccgtcatgaagggcatgacccagtaccacagcctctccctgaaggcgatgcacctgatcaaccaggagatgctccagagcccgcgcaaccagatgcaggtcctgcacgagtcccacgtgttcgacaagaaccgggtgagccacaagggccagaagtacatcgaggccgacgacgaggccatcctgtcccccgtggtgaagcgcgcccagcgggagacgttcaaggtcgtgaacgccctccgcgagaagtacggggagttcgagagcatcgtggtcgagaccacccgggaccgcaactcccaggagcagaagaagcggctgaacgacagccagaagtactacgagcaggagaaccgcaaggtggacgagctgctctcccacgagggctacgaccccagcaagatcaacgggaagaccaagctgaaggtccggctgtacctgcagcaggagggcaagacggcgtacaccaacgcccccatcgacctcaacctgctgatcaaggacgccaccgcctacgaggtggaccacatcatcccgctctccatcagcctggacgactccatcaacaacaaggccctgatcaaccgcaccgagaaccagaacaagagcaacatgacgcccatctacgcgatcctccgggggaagctgaacatctccctggacacctacaagaccgtggtcaagaacaaccgcaactacaccggcaagaagcggagctacctcctgtacgacaaggacatcacgaagttctccaacatgcaggagttcatcgcccgcaacctggtggacaccagctacgcctgccgggtggtcatgtccaccctcagcgactacttcaaggacaacgagatcagcacccacgtgcacacggtgcgcggccgggtcaccaacatgttccgcaaccggatcaacatgcagaaggagcgcgagaaggactacctgcaccacgccgtggacgccctgatcgtggcgtccatcaagaagctcaacctgctgaacacctacctcctgaagtacaacttcaacgacctgtacaacgaggagaccggggaggtcttcgccgtgggcgacgaccagcaggtcctcgaccccaagtacatccgcttcatcacccagctgaagacgatctacgacgagagcaacatgtactacaacgggctgatcgagcggaacgtgatgcagttcccgcccatcaagatctcccacaagatcgacaccaagcccaaccgccagatcagcgacgagaccatctactccacccggacggtgggcaacgaggagtacgtggtcaagaagtacagcgacatctacgaccccaagttcacccagctcaccgacgacatcatcaacgaccgccccctggaccggtggctgatgtaccgcaacgacaaccagaccttcaagatcatccagtccatcatcctcgaccacttccacatcttcaaggacgacgagaagcactacagctgcacgaagaagaaggggcagatccagtacgccctgaagggcaagaacccgctgtacctctacaagcaggagcacggcaaggtgcggaagtacgccaagaaggggaacggccccgagatcaccatgatgaagtacttcgacgggaagctgggcaacaacatcgacatctccaaccactaccacgtgcacaacaagaaggtcgtgctgctccagatcagcccctaccgcaccgacttctacgtgtcccccgagggcaagtacaagatgctgaccgtccggtacgcgaacgtgttctacaaggagagcaagaagaagtacgtgatcgacgagaagtggtacgcctccgagaagaagcgcaagaacatcacggacgacgacatcttcgtctgcagcctgcaccacgacgagctcatcgggatccagaagaaggacggcgccaagtacgtgtacgacctgtccaccgaggacgggggcaagccgcggctgtaccacggggagatggagatcctcaagttcaccgccaccaacaacgacagcaagaacatcatcgaggtgaagcccatctacacgtactgcaagaagcagctgatgatctccatcggccccatcaccaagctggccaagtacgcgaccgacgtcctcggcaacgtgtacgaggtgaagaagaacatcatcgaccacctgagccacctgtga

SEQ ID NO: 1597 - RNA, 3318 nt, synthetic construct
  misc_feature 1..3318: note = Cas9 variant
  source 1..3318: mol_type = other RNA
atgggcatccgcatcgggctggacatcggcatcgccagcgtggggtgggccgtcgtggacgacgactacaacatcatcgagtccggcgcgaacatcttcaacgaggccaaggccgccagcaacgtggaccggcgcacgttccggcagaccaagcgcctcctgcggcgccagaagacgcggctgcgcgacttcgacatcctctggatcaacgccgggctggacatccccaaggagaaggtcaacaagcagctgcagttccgggtgcagggcatgaccatggagctctccgagaacgagctgtacgcggccctgaagaacatgctcaagcaccgcggcatcagctacctggaggacgccctggacgaggagcagtccggcaagagcacctacgagaaggggctccaggtgaaccagaaggccctgaagtgcgacaagatgccgtgcgagatccagtacgagcggctgatgaagtacgggtcctaccgcggccacatcgaggtcaaggacgagagcggggaggagatgatcctctccaacatcttcaccctggacgcgtactgcaaggaggccaagaagatcctggagtgccagaagcagtaccacagcttcatcacggaggccttcgaggacgactacctcgccctgctgcggcgcaagcggaagtactacgagggccccggcaacgagcagtcccgcaccgactacgggaagtacaccaccaagctcaaccccgagacgggcgagtacgtgaccgaggagaacatcttcgagaagctgatcgggaagtgcagcgtgtaccccaaggagatgcgggcctccgcggccagctacaccgcccagatctacaacatgctgaacgacctcaacaacctgaccatcaacggccgcaagctggagtacgaggagaagaagtccatcgtcgaggaggtgcagaaggccagctccgtgaacatgctcaagatcatcaagaaggtcatcaacgaggacatcacgaccatcgagggcgcccggaaggacaagaacgacaaggagatcttccacaagatggagacctacaacaagatgcgccactacttcgagaagaacgggctggagttcaagaagatcagcaccgacgacctggacgagatcggcaacatcctcacgctgaacaccgagaaggaggcgatcctggaggccttcaacaagtcccagctcgagctgagccaggaggagaaggaggccttcatcgagatccggaagaagaacgggagcctgttcaacaagtggcactccttcagcctcaagatcatgaaggagctgatcccggagctgtacctccagtccaagaaccagatgcagctgctgaccgacatgggcgtgttcaagaagaagaccgagatcttccagaactacgacaagatccccacggacgtgatcatcgaggacatctacaaccccgtcgtgaagcgcagcatccgcatcaccgtgaagatcgtcaacgccctcatcaagaagtacgggtacccccgggaggtggtgatcgagatgccgcgcgaccggaactccgacgaggagaagaagcgcatccaggacgagcagaagaagaacgacaccgagctgaagaagatcatcgagaaggtcgagagcgagtacggcatcaagatcaccgacacgcacttccggaaccacaagaacctgcgcatgaagctccggctgtggcacgagcaggacggccgctgcctgtactccgggaaggtgatcgacatcagcgagctcctgaacgactgctccaagttcgagatcgaccacgtgatccccaagagcatctccttcgacgacagccggtccaacaaggtcctggtgtacagcaccgagaaccagaagaagaccaaccagaccccctaccagtacctggagggcaacgggaaggagtggtccttcgacgagtacatgaaccaggtcatcgagctcaaggaccgcaagctgatcagcaaggccaagatgaacaagctcctgttccgggaggacatcacgaagatcgaggtgctgaagggcttcatcgcgcgcaacatcaacgacacccggtacgcctcccgcgtggtcctgaacagcttccagaagtacttcgagtccaagcagagcgacaccaaggtgaaggtgatccgggggagcttcacccaccagatgcgcaagaagctccagctgtccaagaaccgggacgagagctacgcccaccacgccgtcgacgccatgctgatctgctactcccagatgggctacgaggcgtaccgccagctccaggaggacctgatcgaccccgacagcgagaagatccgggacctgggcctctggaaggagacgatcaccgaggccaagtacgacgaggtgctgtacaccgccaagtggctggagaaccgcgggaagatccaggaggccgagaagaaggtgaagttctggcacaaggtcgactccaaggcgaaccgcgccctctgcaaccagaccatccggggcacgcgcgtgatcgacgggagcatccagaagatcaacaagatcaacatctactccgtggacggctacaagaccttcaagaacatgatccagaaggggaaggagaaggacttcctgatgtaccggaacgaccgccggagctgggacgacctgatgaaggtctaccgcgagtactccgacgccaagaacgccttcgccgcgtaccaggaggagaccggcgactacgtgcggaagtacgccaagaagcacaacggcagcaagatcaccaacctcaagtactgcgccaaggagctggggtcctgcatcgacatcagccacaagtacggcctggagaaggactcccgcaaggtgatcctcgagagcctgtccccgtaccggagcgacgtctactacaacgccgggctgaagcagtactacatcgtgggcatcaagaactccgacctctgcttcctgaagggcgagtacttcatcgacagcaagcgctacctgcagatcctccgggaggagggggtgctgaccgagcagcacacgctgaacgacctcgccgcgatcggcaccgagttccagttcagcctgtacgagaacgactacctggagtacgagaagaacggggagatcaagaccgagcgcttcctctcccggaccaagcccaagcagaagaactacatcgagaccaagagcatcgacgcccccaagatcaagaacaagaagcagaacctggtcggcctggccaagtccaagagcatcaagaagatccgcgtggacatcctcgggaaccggtactacgcctccaaggagaagttcagcctgatggtggacaagttctga

SEQ ID NO: 1598 - RNA, 3318 nt, synthetic construct
  misc_feature 1..3318: note = Cas9 variant
  source 1..3318: mol_type = other RNA
atggacatggcctggcgcctgggcctcgacctggggaccaacagcctgggctgggccgcgctctccctggacgccgccggggcccccgacgccatcctggcggccggcagccggatcttcggggacggccgcgacccgcagtccggcaccagcctcgccgtggaccggcgcgccgcgcgggccgcccgccggcgccgggaccgcttcaagcagcggcagcgcgccctgctgaagcacctcgaggccgacgggctgttccccgcggaccccgaggtccagcaggccctggccgccctcgacccctacgccctgcgggcgcgcgccctggacgaggccctctccctgcacgagatcggccgggccctgttccacctcaaccagcgccgggggttccagagcaaccgcaaggccgaccggggcaaggacgaggacgcggggaagatcgccatcggcgtggaccgcctgaaggacgccatcgccgccgcgggcgcccggacgttcggggagttcctgcgccagcgccgggccggcgccaccggggagaaccagatcccgtccgtgcgcacccggctccgcgcggagaccggcgagggcgccaaggggagcggctacgacttctacccctcccgggccctgctgaaggacgagttcgacgccatctggcacgcccaggcggagcaccaccccaaggtcctcacggacgaggcctaccaccgcctgcacgagatcgtgttccggcagcgccccctgcgggccccgaaggtgggggcctgcaccctcgtccccggcgaggcccgcctgcccaaggcgcaccccctgttccagcggcgccggctcctggaggagctgaacgccctcatgatcgtgcgcgccggggccgtggccgagcggctgaccccggagcagcgcgacctgctcctgctgaagctcaaggacaagggcaaggtcaccttcaagagcctgcgggagaaggtgctgaagctcgacggcgacgcgcgcttcaacaaggagtccgagcaccggacggagctgaagggggacgaggtggccgccgagatgggcgggaagacccgcttcggcagcctgtggccccacctctccaccgagcagcagtggaccgtcatcgagcgccagcaggccctggagagcgacgcggacgaggccgccttccggacgtggctggtggagacccacaagctcaccgccgagcaggcccgcgcggtggccggggcccggctgcccgccggccacggccgcttcgggctgaccgccacggcggccctgctcgccgccctgcgggacggccgcacccccgaggggcggggcccgaacgcccccgcgaccgaggccgggcgcgtcgtggtgtactccgaggccgccgcgatcgccggctaccaccacagcgaccaccggtccggcgaggtcttcaccgacgccaaggggcgccccgccctgccctactacggcgtgccgctcgaccggcacatcgtgcccgggacggccgaccccgacgagcccgacgaggcggcccgcatcggccggctgaccaacccgaccgtccacatcgccctgaaccagctccgccgggtggtgaaccgcctgatccgggtctacggcccgcccgccgaggtggccctggagctcgcgcgcgagctgaagctgagcgaggacgagaagaaggagcggaaccgcgagaactcccggaaccgcctcgacgccgagaagcgcagcagcaagctggccgagctggggcagcgggacaacggcgggaaccgcgccctcctgaagctgtgggaggagctcaaccccgagaacatcctggaccggcgctgcatctactccggccggcagatcagcatcgggatgatcttctccggcgccgcggaggtcgaccacatcctgcccttcgacgccaccctcgacgacagcaacgccaacaagatcctgtgcctgcgcgaggccaaccgggacaagcgcaagcggtcccccttcgaggcctggggcgggacgccccagtgggaggagatcgcggagcgcgccagccggctcccgcgcaacaagcggtggcgcttcgagcccgacgccatggagcggttcgccgaggagggcgggttcctggcgcgccacctggtggacacccagtacctcggccggatcgcccacgactacctgcgctgcctgtaccccgacaagggggacggctccagccacgtgtgggtctcccccggccggctcaccgagatggtgcgccgcaagctggggctgaacggcctcctgggggaccacaacctgggcgccgagcagccgaagaaccggaaggaccaccgccaccacgccatcgacgccgtggtcaccgcgatcctcgaccggagcatgctgcagcgcatccagcgggcctccggggagggcgccagcgacgccgagctgctccgcatcatcgtgcccgagccctggacgggcttccgggacgacctgcagcgcgccgtggaccggatcgtcgtggcgcaccgcgccgaccacgggaccgtggccaaggccgccacccggggccgcgaccagaccgcggcccggctgcacaacgacacggcctacgggttcaccggcgaggccgacgcgaaggggacccccatcgtcgtgcaccgcgccccgctcggcgccctgaagaagcccgagcacatcgaccaggtgcgggaccccctgctccgcgccgccctgcacgacttcaccgcgggcctgtccgggaagcccttcgaggaccggatcgccgccttcccgcgcctcggccccctggactaccgggggatccgccgggtccgcgtggtggagcccctgcaggtcatccccatccgcgacgccgccggccgggcgtacaagggctacaagggggacagcaactaccgctacgacgtgtgggagctcccggacggcaagtgggagcagcgggtgctgcagatgtactacgcccaccagtccggggagccgccccgcccccaccccgccgcccggaaggtcctgagcctccaccgcgacgacgtgctggccatcgagcggggcgagggcgggcgcgagctggtgcgggtcgtgaagttctccacgaacgagttcaccctcgcgcccctgaacgagggcggggccctcaagagccgccacgccgacaagggcgaccccttccggtacctgtacccctccccgagcaccctgaaggcctggcgcgcgcgggaggtgcgcgtcgacgagctggggcgggtgctcgaccccggcttccccgcccgcaagcggcgccgggtgacccgcccggggcgcgccgacgccgactga

SEQ ID NO: 1599 - RNA, 3321 nt, synthetic construct
  misc_feature 1..3321: note = Cas9 variant
  source 1..3321: mol_type = other RNA
atgcagtacatcgtggccatcgacatcggcgtcgccagcgtggggtacgcggtgatcgacaagacctccgagaccgtcatcgaggccggcagcaacatcttccccgaggcctccgccacggacaaccaggagcgccgggggatgcgccaggcccggcgcctgaagcggcgcgagcggacccgcctcgacgacttcaccaagctgtgggagtaccacggcctggcgatcccccaggtgaagaagaacgacatcgtggggctcaaggtcaaggccctgtacgagagcatctccctggacgaggtgtacctcatcctgtacagctacctgaagcaccggggcatctcctacctcgaggacgtggaggacagctccgtcagcggctccaccgcctacgccaacgggctgaagctgaacgcgaaggagctcgagaagaacttcccgtgcgagatccagaagtaccgcctggagaacatcggcaagtaccgggggcagatccagatcgaggacgaccagggcgagaagctggacctcagcaacgtgttcacgatcggggcctacaccaaggagatccagcagatcctggacacccagaagaagtaccacgccgagatcgaggacgagttctgcgagaagtacctgaagatcttcacccgcaagcggaagtactacgagggccccggcaacgagaagtcccgcacggactacgggaagtacaccacccggctcaaggagaacggcgagtacatcaccgagaagaacatcttcgagaagctgatcgggaagtgcagcgtgtacaaggacgagctgcgcgccgcctccgcgagctacacggcccaggagttcaacctcctgaacgacctgaacaacctcaccgtcaacggccggaagctggaggagaacgagaagcacctgatcgtggacaaggtgaagacctccaacaccatcaacatgcgcaagatcatcgccgacgccatgggcgagaagatcgaggagttctacggggcccggatcgacaagagcgagaaggagatcttccacaagttcgaggtctacaacaagatgcgcaaggcgctcgccgccatccacgtgaacatcgaggagttctcccgggacgacctggacgagatcggctacatcctgacgatcaacaccgacaaggaggccatgatggaggccttcgacaacagccgcctcgagctgcccggggagatcaagaactgcctgatcagcctccgcaagaccaacggcaccctgtactccaagtggcacagcttctccctgaagatcatgaacgagctcatcccggagatgtaccggcagcccaaggagcagatgacgctgctgaccgagatgggggtgatgaagggccagaccgacgagttcgagaagaacaagtacatccccgtcgacgtggcgagcgaggacatcttcaaccccgtggtccgccggtccgtgcgcatcagcttcaagatcctcaacgccctgatgaagaagtacggcaccctggacgaggtggtcatcgagatgccgcgggaccgcaactccgacgagcagaagaagtgggagaaggagacgcagaagaagaacgagaaggagcaggagtacatcgagaacaagctcgccaccgtgtacgacatccggctgagctccgccgacttcagctcccagaagcagctgaacctcaagctgaagctgtggaacgagcaggacgggaagtgcctctacagcggcaagatcatcgagcccgaggacctgatcaagcactccgagctgttcgagatcgaccacatcatcccccgcagcatctccttcgacgacagccggtccaacaaggtcctggtgtaccgcaccgagaaccagaacaaggggaaccagaccccctactactacctcacgcacaccaacagcaagtggtccttcgagcagtacaaggccctggtgatggacctgagcaagaagaaggagtacggcctcagcaagaagaaggtccggaacctgctgtactccgaggacatcaccaaggcggacgtgctccgcgggttcatcaaccggaacatcaacgacaccagctacgccgcccgcgtggtcctgaacacggtgcagggctacttccgggccaaggagatgggcaccaaggtgaaggtcatccgcgggtcctacacccaccagatgcgggtgaacatgaagctggacaaggaccgcgagaagtcctacgcgcaccacgccgtggacgccatgctcatcgccttcagccagctgggctacgaggcctaccggaagctgcagggggagttcatcgacttcgagaccggcgagatcctcaacagcgagaagtggaaggaccagatgtccgacgaggtctacaagcagtacctgtaccgcaagaagtggagcaacatccgcaacgagatcacgcgggcggagaagaacgtgaagtactggtactacgtggaccacaagtccaaccgcgggctgtgcaaccagaagatccggggcacccgcgtctacgacggcaagatctacaagatcaacaagctcgacatccggaagaaggagggggccgccctgttcaagaagctggccttcagcgagaaggagtccgaccgcgagaagctcctggtgtacaagaacgacaagaagacctacgaggacctggtgcggatcatgcaggactacagcgactccaagaacccgttcgtccagtacgagaaggagaccggcgactacgtgcgcaagtacgccaagaagcacaacgggccccggatcgacaagctcaagtacatcgacggcgaggtgggcagctgcatcgacatctcccacaagtacgggtacgagaagggcagccgcaaggtcgtgctggagtccctggtgccctaccggatggacgtctactacaagaaggaggagcagacctactacctcgtggggatcaagcagagcgacgtgaagtgccagaagggcgagtacgtcatcgacgaggacgcgtacgccatcaacctggtgaaggagaagatgatccagcaggggcagaagcgcagcgacctggagtccctcggcttcgagttccagctgagcttctacaagaacgacatcatcgagtacgagaaggacggcaagatcgtgcgggagcgcttcctgtcccggacgatgcccaaggtcaagaactacatcgagaccaagccgatcgaccgcgccaagtacgagtggcacgaccggaagctcgtggggctgggcaagaccaagcgcatccggaagtaccgcatggacatcctggggaactactacctctgcaacaaggaggagttcagcaagtactgctga

SEQ ID NO: 1600 - RNA, 3324 nt, synthetic construct
  misc_feature 1..3324: note = Cas9 variant
  source 1..3324: mol_type = other RNA
atgggctacaccgtggggctggacatcggcgtcgccagcgtgggggtggccgtcctcgacgagaacgacaacatcgtggaggcggtgtccaacatcttcgacgaggccgacaccagcaacaacaaggtccgccggacgctgcgcgagggccggcgcaccaagcggcgccagaagacccggatcgaggacttcaagcagctgtgggagacctccgggtacatcatcccccacaagctccacctgaacatcatcgagctgcgcaacaagggcctcacggagctgctgagcctcgacgagctgtactgcgtgctgctctccatgctgaagcaccggggcatcagctacctggaggacgccgacgacggggagaagggcaacgcctacaagaaggggctcgccttcaacgagaagcagctgaaggagaagatgccgtgcgagatccagctggagcgcatgaagaagtacggcaagtaccacggggagttcatcatcgagatcaacgacgagaaggagtaccagtccaacgtgttcaccaccaaggcgtacaagaaggagctcgagaagatcttcgagacccagcggtgcaacggcaacaagatcaacacgaagttcatcaagaagtacatggagatctacgagcgcaagcgggagtactacatcggccccgggaacgagaagtcccgcaccgactacggcatctacaccacccggacggacgaggaggggaacttcatcgacgagaagaacatcttcggcaagctgatcggcaagtgcagcgtctaccccgaggagtaccgcgccagctccgccagctacaccgcccaggagttcaacctgctcaacgacctgaacaacctgaagatcaacaacgagaagctcaccgagttccagaagaaggagatcgtggagatcatcaaggacgcgtccagcgtgaacatgcggaagatcatcaagaaggtcatcgacgaggacatcgagcagtactccggggcccgcatcgacaagaagggcaaggagatctaccacaccttcgagatctaccggaagctgaagaaggagctgaagacgatcaacgtggacatcgacagcttcacccgcgaggagctcgacaagaccatggacatcctgaccctgaacacggagcgggagtccatcgtgaaggccttcgacgagcagaagttcgtctacgaggagaacctcatcaagaagctgatcgagttccgcaagaacaaccagcgcctgttcagcgggtggcactccttcagctacaaggccatgctccagctgatccccgtgatgtacaaggagccgaaggagcagatgcagctgctcaccgagatgaacgtgttcaagagcaagaaggagaagtacgtcaactacaagtacatccccgagaacgaggtggtgaaggagatctacaaccccgtcgtggtgaagtccatccggaccaccgtcaagatcctgaacgccctgatcaagaagtacggctaccccgagagcgtggtcatcgagatgccgcgcgacaagaactccgacgacgagaaggagaagatcgacatgaaccagaagaagaaccaggaggagtacgagaagatcctcaacaagatctacgacgagaaggggatcgagatcacgaacaaggactacaagaagcagaagaagctggtgctgaagctcaagctgtggaacgagcaggagggcctgtgcctctacagcggcaagaagatcgcgatcgaggacctgctgaaccaccccgagttcttcgagatcgaccacatcatccccaagtccatcagcctcgacgactcccggagcaacaaggtgctggtctacaagaccgagaactccatcaaggagaacgacaccccctaccactacctgacccgcatcaacgggaagtggggcttcgacgagtacaaggccaacgtgctggagctccggcgccgggggaagatcgacgacaagaaggtgaacaacctgctgtgcatggaggacatcacgaagatcgacgtcgtgaagggcttcatcaaccgcaacctcaacgacacccggtacgccagccgcgtggtcctgaacgagatgcagtccttcttcgagagccggaagtactgcaacaccaaggtgaaggtgatccgcgggtccctgacctaccagatgcggcaggacctccacctgaagaagaaccgcgaggagagctactcccaccacgccgtcgacgccatgctgatcgcgttcagccagaagggctacgaggcctaccggaagatccagaaggactgctacgacttcgagacgggcgagatcctcgacaaggagaagtggaacaagtacatcgacgacgacgagttcgacgacatcctgtacaaggagcgcatgaacgagatccggaagaagatcatcgaggccgaggagaaggtgaagtacaactacaagatcgacaagaagtgcaaccgcgggctgtgcaaccagaccatctacggcacccgggagaaggacgggaagatccacaagatctccagctacaacatctacgacgacaaggagtgcaactccctcaagaagatgatcaacagcggcaaggggagcgacctgctgatgtacaacaacgacccgaagacctaccgcgacatgctcaagatcctggagacgtactccagcgagaagaaccccttcgtggcctacaacaaggagaccggcgactacttccgcaagtactccaagaaccacaacggccccaaggtcgagaaggtgaagtactacagcgggcagatcaactcctgcatcgacatcagccacaagtacggccacgccaagaactccaagaaggtggtcctggtgagcctcaacccctaccggaccgacgtgtactacgacaacgacaccgggaagtactacctggtcggcgtgaagtacaaccacatcaagtgcgtgggcaacaagtacgtcatcgactccgagacctacaacgagctgctccgcaaggagggggtgctgaacagcgacgagaacctggaggacctcaactccaagaacatcacgtacaagttcagcctgtacaagaacgacatcatccagtacgagaagggcggggagtactacaccgagcggttcctgtcccgcatcaaggagcagaagaacctcatcgagaccaagccgatcaacaagcccaacttccagcggaagaacaagaagggcgagtgggagaacacccgcaaccagatcgcgctggccaagacgaagtacgtggggaagctggtcaccgacgtgctcggcaactgctacatcgtgaacatggagaagttcagcctggtcgtggacaagtga

SEQ ID NO: 1601 - RNA, 3324 nt, synthetic construct
  misc_feature 1..3324: note = Cas9 variant
  source 1..3324: mol_type = other RNA
atgggctacaccctggggctcgacatcggcatcgccagcgtggggttcggcctgatcgacaacgtcgacgggaagatcctggagtccggcgtgcgcctcttcagctccgccgaccccgacaacaaccagacccggcgcagctcccggcaggcgcgccggctgaaccgccggaaggtgcaccgcctggagcgggtcgcccacctcctggaggaggccggcttcgagaagggggaggtgctggccccgacgccctaccacctccgcgtgaagggcctgaccgagaagctgagcaagcccgaggtctacgccgcgctctacaacctgatgaagcaccgggggatctcctacctggaggacgtggagctcgacgaggccgacagctccagcgtgtcccagaacgtcgagctgctgaaggagtactacccctgcgagatccagctcgagcgctacgaggagtacggccagatccgggggatcatcgagacctacaacaaggacggcgagaaggagagcctggtgaacatcttcccgaccggcgcctacaagaaggaggccgaggcgatcatcctgaagcaggggcagttctaccccgagctcgacaaggtgttcctggagaagttcacggagatcctgaccgtcaagcgcccctactacgtgggccccgggaacaagaagtcccggaccgactacggcatctaccgcgagaacggcgagaccctcgagaacctgttcgacatcctgatcgggaagtgcacgatctacccgcaggaggcccgggccgccaagttcagctacaccgcccagctgttcgacttcctgaacgacatgaacaacatctccatcgcgggcgagaagctgaccgaggtgcagaagcgcgagatctaccaccagatcatgagctccaagaccgtcaacatgatgaagatcatcacgaaggtgaccgggtgcctcaaggaggaggtgaccggctaccgggtcgacagcaagtacaaggccgagttccactccttcgccagctaccgccagttccggaacaagatgctggactacgggttcgacgtgcagaccctgaacgtggagatgttcgacaagctcgccgccaagctgacgctgaacaccgagtaccaccagatcatcacccagctcgagagcctgaacctgggcctctccaaggagctgatcgagaagatcgcggacttccgcaagaagaaccgcagcctgttctccaagtggcacagcctctccctgaaggccatgaacgaggtcgtggacgagctgtggagcacctccaagaaccagatgcagatcttcagcgagctcggcgggttcaagtccaacatcgaggtgttcaagggcctgaagtacatccccctggacgccatggtcgacgagatctacaaccccgtggtccggtgcagcatccgcgagtccatcaagatcatcaacgccctcctgaagaagtacggggccctggacaaggtggtgatcgagatgccccgggacagcaacgagaaggaggagaaggaccgcatcacgaagctgaacaaggagaacgacaacaagaagaagcaggcgatcgagaaggcccggaacgagtacggcttcggggaggaggcctaccgccagcagaacgacctcaacaccaagctgcggctgtggtacgagcagaagcagcgctgcctctactccggcgagatcatcaagatcttcgacctgatcaagaacccgcacctgttcgacatcgaccacatcatccccaagagcatctcctacgacgacagcctctccaacaaggtcctgtgctacgccaccgagaaccgggagaagggcaacctgaccccctaccgctacttcaagcggaaggccagcctcacgtggaactacgaggcgtacaagtcctacgtgatcgagctgtacaaggacgggaagggcgacctgagccgcaccaagctcgagctgctcctcttcgaggaggacatcaacaagtacgaggtgcggcagcgcttcatcaaccggaacctggtcgacacccgctacgccagcaaggtggtgctgaacaccctccaggacttcatgaaggagaactaccccacgaccaccgtcgaggtggtgcgggggaagttcaccgcccagctgcgccggcactggggcatccgcaagaaccgcgacgagaaccacgcccaccacgcgatcgacgccctgatcatcgcctgcgtcccgcacctctccctgtggaaggagcagaagaaggtgttcagcacggacgagttccgggtggacgagaccaccggggagatcatcgagcagtcctacaaccagctgacctaccaggagcccttcagccagttcttctaccagctcgagaaggtctccatcgactgccgctacagctacaaggtggaccggaagttcaaccgccaggtggccgacgccacgatctactccacccggcagggcatcgtcaagcagaccagcggcgacaagtccttcaccctggacagcaactccaaggagcactacgtgatcgcgaagatcaagaacatctacgaggacgtggacgccaagcgcttcatggaccggtacaagaaggacaagacccagttcctgatgtaccaccacgacccccagacgttcagcatcctcgaggacgtcatgaagacctaccccgacaagaagaacccgttccaggcctaccgcctggagtacgggcccatccggaagtactccaagaagggcaacgggccccagatccagagcatcaagtactacgactccaagctgggccagcacatcgagctcaagcaggccaaccagagcaccaagaaggtggtgctgcagtccctgaacccctggcgctgcgacatctactacaacaagaaggacaagcggtacatcgccgcgggcctcaagtacgccgacctgagctaccagaaggggaccggcctgtacgggatcagcctccagcgctaccagcagatcctgaactccgagaagatcgagctgagcatcgagcagatcgagctcctgctggagggccggctcaacgagtccaacttcgagttctgcttcagcctgtacaagaacgacttcatccagtggaacgacgagaacaaccagacgttccagtaccgcttcctggcccggaacctctccagcccgaaccgcatcgaggtcaagcccatcaacaagtccaagtacgacaagcaggccgaggggctgaagaccctgaagaagggcctcaaccggttctacaagatcagcgtggacgtgctgggctaccagcacttcatcaagaaggagaagctgaagctcaccttcaagtga

SEQ ID NO: 1602 - RNA, 3330 nt, synthetic construct
  misc_feature 1..3330: note = Cas9 variant
  source 1..3330: mol_type = other RNA
atgagccactacgtgctgggcctcgacatcgggatcacctccgtcggctacgggatcatcgacctggacaccaacgacttcatcgactacggcgtgcgcctgttcaaggaggggacggccgccaacaacgaggaccggcgcaacagccggtcccgccggcgcctcctgagccggaagcacacccgcctgatggacatgcagaaggtgctcaaggaggcgggcatcatgaccgagtcctacagccccctgtccaacgtctacgagatccggaagaagggcctgaccaaggagctcacgaacgacgagctgaccgccgccatcctgcacatcaccaagcaccgcgggagcgtgatcgagaccgtggaggacgacgaggccgccgcgaaggagacgggcgagctcaagtccaccctgcacgagaacgccctgctcctggccaacaacaagttcgtctgcgagatccagctggagcggctcaacaccgagaacaagatccgcaaccacaagaacaacttcaagaccaaggactacgtggccgagctgaaggagatcctgaaccaccagaacctcagcgaggaggtgaagaacaagatcatccagatcgtcgagcggcgccgggcgtactacgaggggccgggctccttcaacagccccacgccctacgggcgcttcatcgaggtgaacggccaggtgcaggagatcgacctgatcgagaagatgcggggcaagtgctccgtctaccccgacgagttccgcgccccgaagatgagcatctccgccgacctgttcaacatcctcaacgacttcaacaacctgctggtgcagggggagaagctccaggaggaggacaagaagaacctgctgaagatcatcaacgacaagggcagcatcaccctccggcagatctccaagaagctggaggtgaacgaggacgagatcaaggggtaccgcatcgacaagaagggcaaggccctgttcaccgagttcaagggctacaagatcctcaagaagctgttcctgaactgcgggcagagcatctccctcgaggactacgagatgctggacgagatcatcgagatcgtcaccaagaagaagggcatcgacgagcggaaggacgccctgaaggagctcaagtgggacctgagcgacgacatcatcaacagcctgtccgaggtgacggggatcgtgggctaccacagcctctccctgaaggcgatccgcgagctggacagcgagctctacaagacctccctgaaccagatgcagctgctccacgagctgaagatgttcgacaagaaccgccccagctacaaggggaagaagaacatcgtcgccgaccccgaggccatcctgtcccccgtggccaagcgggcccagaacgagaccttcaaggtgatcaacgcgctgcgcaagaagtacggcgagttcgacagcatcgtcgtggagatgacccgggacaagaactcccaggagcagaagaagcgcatcaacgacagccagaaggccctcgagtccctgaacaaggaggtggaccagctgctccagcagaagggctacgacccgcagaaggtcaaggggaagacgaagcagaaggtgcggctgtacatgatgcaggagggcaagagcgcctacaccctgcaggagctcgacctgcaccgcgtcatcaaggacgacaagtacaccgagatcgaccacatcatccccatctccatcagcctggacgactcccagagcaacaaggtgctcgccctgcactccgagaaccagcagaaggggaacctgacccccttcatggccttccacacgggccggttcgcggacatggggtgcacctggaacaagttcaaggagaacgtgctcagcaacaagaactacaagcacaagaagaagaacaacctgctggacgagcgcgacatcaacaagttctccgtcatccaggagttcatcaaccggaacctcgtggacaccagctacgccaaccgcgtggtcctgaacaccctgacggactacttcaaggacaacgagatcgacaccaaggtgcacaccgtgaacggcaagctcaccgacctgttccggaagcgcatcaacctgaagaaggaccggaacgaggactacctccaccacgccatcgacgccctgatcgtcgccagcatcaagaagctgcgcctcctggacggctacctggcgaagtacgggttcgagacgctctacgacgagatgaccggcgagatcaaggagatccccgaggacaaggccttcttcgacgacaagtacatccggtacatcctgaacctgaagaccatctacgagtccagcaacatgtactaccgcgggatcctcgagcgggaggagctgatctaccagccgatcaagatctcccacaagatcgacaccaagcccaaccgcaaggtgagcgacgagacgatctactccacccggatcatcgacaacgaggaccacctgatcgagaagtacagcgacatctacgaccccaagttcaagaacctcaccgaggacatcctgaacggcgagaagaacaagtacctgatggagaagaacgacccccagaccttcaacatcctcaagcagatcatcttcaaccactacaacacctacaaggactccaaggagtactacaagatcgagaagaagaaggagaaggagatcatcaagctggtggggatcaacccgctgagcctctacaaggaggagaacggccccatcaagaagtactccaagaagggcaacgggcccgtcatcatgagcatgaagtacgactccgagaagctgggcaaccacatcgacatcacgcccgacagcgccaagaacaagaaggtgatcctgaagcagatctccccgtaccgcaccgacttctacaagtgcagcgacgagaagttccgcttcgtgaccgtccggtacaaggacgtgcactaccagaagtccatcgacaagtactgcatcgacaaggagtggtaccagaacgagaagaagaacaagaagatcgacgagaaggccgagttcctcttcagcatgcaccacgacgagctgatcgggatcacccgcaaggagtccgagcagttcatctacgacgagagcaaggagaaccacggcgacccccggtaccacgacggcgtgaagcccgagatcctgaagttcacggcgaccaacaacgacaccaaggggatcatcgaggtcaagcccctctacacctacagcgcctaccgcctgaagccgacggtgctgaacgtgaagaacatcaagaagtacgccaccgacgtcctcggcaacctgtacgaggtgaagcagaacgagctgaagctcgagttctga

SEQ ID NO: 1603 - RNA, 3333 nt, synthetic construct
  misc_feature 1..3333: note = Cas9 variant
  source 1..3333: mol_type = other RNA
atggccgagggcaagaagcgcatctggcggctgggggccgacctcggcgcgaacagcctggggtgggccgccatcgagctgtccgcccccgtgaacggcaagccgatcgccatcctcgcggccgggagccgcatcttctccgacggccgggaccccaagagcggcgcctccctggccgtcgaccgccgggacgcgcgcgccatgcggcgccggcgcgaccggttcaagcagcgccagaaggccctgatcaagtacctcatcgccgacgggctgttccccgccgacgaggcggcccggaacgccatggccgccatcgacccctacgcggtgcgcgcccgggccctggacgaggccctcagcctgccggagctgggccgcgccctcttccacctgaaccagcggcgcgggttcaagtccaaccggaaggcggaccgcaaggccgacgacgacgccggcaagatcgccatcgggatcgaccggacccgcgacgccatcgcggaggacgaggccgacgccggcgccgagcccggcagctggaccttcgggaagtggctgcacgagcgccggctcaagggccagtccgtgcgcacgcggctgcgccccgagagcggggaggacgcgaagggcgacggctacgacttctaccccgaccgggccctgatggaggaggagttcgacgccatctgggccgcccaggcgccgcaccaccccgacgtcctcaccaacgacgtgcacgaccgcctgcacgagatcatcttctaccagcggcccctgaaggcgccccaggtggggatgtgctccctcatcccgggcgaccgccggctgcccaaggcccaccccctgttccagcgccggcgcctcctggaggagctgaacgccctcatgatcgtccggcccggggaggtggcccagcgcctgacccgggaggagcgcgacatcctgctcctgaagctgaaggacaagaacaaggtgagcttcgccaccctccggaaggccctgaagctggacccggacgcccgcttcaacaaggagtccgaggaccggacggacctcaagggcgacgaggtcgccgccgtgatggggagcaagacccgcttcggcaacctgtgggtgcacctgtccatcgaggcgcagtgggacgtcctcgcccgcctggacgccgtggagagcgacgccgaggacgcggccttctgcgcctggctggtggagacctacgccctcacccccgagcaggcccgggcggtcgccaacgcgcccctgcccccgggctacgggcgcttcggcgagacggccacccggaagctgatcgaggccctccgcgacgggaagaaggacgaccgggtgctggtgtactccgaggccgtcaccgaggccggcctggggcaccacagcgaccgccggaccggcgaggtgttcgaggacgccaagggccgcccccagctcccctactacggggtggccctggagcggcacatcatgcccggcacgggggacccgtccgaccccgaggagatgcgcgtcggccggctgaccaaccccaccgtgcacatcgggctgaaccagctccgccggatcctgaacgtgctgatccgcgcctacgggcccccggcggagatcgccatcgagctcgcccgggagctgaagctgaccgacgaggacaagaagcgcatcaaccgggagaacaacgacaaccgcatcgccgcggagcggcgcagcgagaagctcctggccatcggccaggccgacagcggcgccaaccgggccctgctcaagctgtgggaggagctgaaccccgcgaacgtcctcgaccgccgctgcatctactccggccggcagatcagcatcgacatgctgttctccgccgccgtggaggtcgaccacatcctgcccttcgccgccacgctcgacgacagcaacgggaacaagatcgtgtgcctgcgcgaggcgaaccgggagaagcgcaagcggtccccgcacgacgcctggggccacagcgcccgctgggacgagatcgccgcccgggcggcccagctgccccgcaacaagcggtggcgcttcgagcccgacgccatggacaagttccgggacgagggcgggttccaggcccgccacctcgtggacacccagtacctggcccggctgtcccgcgagtacctcgcgaccctgtaccccgagaagggcgaggggagcggccacatctgggtctccccggggcggctgaccgagatggtgcgccggaagctcggcctgaacgacctgctccccgaccacaacttcggcgggggcgccgaccaggccaagaaccgcctggaccaccggcaccacgccatcgacgcggtggtcgtggccatcgtggaccgcgggatgctgaacgccatcgcccgcgccagcggccaggagggggcggagggccgggagcgcatcatcatccccgagccctgggacggcttccgggacgccctccgcgagacggtcaaccggatcaccgtgtcccaccgcaccgaccacgggaccgccagcaaggccggcctgccgaaggggaaggacgccacggcgggccggctgcacaacgacaccgcctacgggttcaccggcgacaccgacgccaagggcaactccatcgtggtccgccgggtgcccctcagctccttcaagaagctggccgacctggaccgcatccgggacgccgacctcaaggcggccctgtaccagcacctgaacgggctcgagggcaaggccttcgagaaggccctggcggagttccacaagctggagtggcacaacttcgggggcgtgcgccgggtccgcgtgacggagcccctcaccgtgatccccatcaaggaccggaacgggcgcatctacaagggctacaagggcgacagcaactaccggtacgacgtctgggagctgccggacgggaagtgggtgaccaactggaagaacgaggccggcgaggccatgtccagcgtgatctccatgttcgacgcccaccagagcagcgagccgccccgcccccaccccgccgcgcggaagatcctgtccctccaccagaacgacctgctggccatcgagcgcgagggggaggaccggaagctcatgcgcgtcgtgaagttcggccagagcggccagatcaccctggccgagcaccagcaggccggggacctgaagaagcgcgacgccgtgtccaacgacgacgaccccttcaagtacttcgcgcccacgagcggcgggctcaagaaggtcaaggcccgccaggtgcggatcgacgagatcggccgggtgctggaccccgggttcccggcccgcaccgcccggcgcaagacccggggctga

SEQ ID NO: 1604 - RNA, 3333 nt, synthetic construct
  misc_feature 1..3333: note = Cas9 variant
  source 1..3333: mol_type = other RNA
atgaccgcccgcacccacaagatctggcggctgggcgccgacctcggggcgaacagcctgggctgggccgccatcgagctgtccgcccccgtggacgggaagccgatcgccatcctccacgcgggcagccgcatcttctccgacgggcgggaccccaagagcggcgcctccctggccgtcgaccgccgggacgcccgcgcgatgcggcgccggcgcgaccggctgcagcagcgccagcgggccctcatcaagtacctgatcgccgacggcctgttccccgccgacgagaacgagcgcaaggccatggcgacgatcgacccctacgccgtgcgggcccgcgccctcgacgaggccctgaccctgccggaggtggggcgggccctcttccacctgaaccagcgccggggcttcaagagcaaccgcaaggccgaccggaaggccgacgaggacgccgggaagatcgccatcggcatcgaccgcacccgcgacgcgatccggcaggccgaggaggaggccggggccgagcccggctcctggacctacggcaagtggctgtacgagcgccgggccagcgcgacggacgccaacgccatcccctccgtccgcacccggctccgccccgagaccgacgagcacgccaagggggacggctacgacttctacccggggcgggcgctgatggaggccgagttcgccgccatctgggaggcccaggcggcccaccaccccgacgccctgaccaacgaggtgcacgaccgcctccacgagatcatcttctaccagcggcccctgaaggcgccccagatcggcgtgtgcacgctgatccgcggcgaccagcggctcccgaaggcccaccccctgttccagaagcgccggctgctcgaggagctgaacgcgctgaccatcgtccgccccggggagatggcccagcggctcacccgcgaggagcgggacaccctgttcctgaagctcaaggacaaggccaaggtgagcttcgtgtccctgcgcaagacgctgaagctcgaccccgacgcccggttcaacaaggagagcgagaaccgctccgacctgaagggcgacgaggtcgccgcggccatgggggccaagacccgcttcggcaaccggtgggtgcacctgagcatcgaggagcagtgggacgtgatcgcccgcctcgaggaggtcgagtccgacgcggaggacgccgcctgccgggcctggctggccgcgaccttcgacctgaccccggagcagatccgcgccgtgacgaacgcgcccctcccgcccgggtacagccggttcggcaaggtggccacccagcgcctgatcgacgccctgcgggacggcgagaaggacgggcgcgtcctcgtgtactccgaggccgtggccgccgccggcctggggcaccacagcgacctgcggaccggcgagatcttcgaggacgcccaggggcgcccccagctcccctactacggcgtcgcgctggagcggcacatcatgcccggcaccgggaaccccgaccactccgacgagatgcgcatcggccggctgacgaacccgaccgtgcacatcgggctcaaccagctgcgccggatcgtgaacaccctgatccgcgcctacggcccgcccgccgagatcgccatcgagctggcgcgggagctcaagctgaccgacgacgacaagaagcgcatcaacaaggagaacaacgagaaccggctggccgccgagaagcgcagcgagaagctcctgacgatcgggcggcccgacaccggcgccaaccgcgccctgctcaagctgtgggaggagctgaaccccgcgaacgtcctcgaccgccggtgcatctacaccggcacccagatcagcgtggacatgctgttctccgccgccgtggaggtcgaccacatcctgcccttcacggccaccctcgacgacagcaacgggaacaagatcgtgtgcatgcgcgaggccaaccggaccaagcgcaagcagtccccctacgaggcgtggggccacaccgaccggtgggaggagatcgccgcccgcgccgcccagctgccgcggaacaagcgctggcggttcgagcccgacgcgatggagaagttcaaggacgagagcgggttccaggcccgccacctggtcgacacgcagtacctcgcccggctgtcccgcgagtacctggagaccctctaccccggcagcggcgaggggtccagccacatctgggtgtcccccggccggctgaccgagatggtgcgccggaagctggggctcaacgacctgctgccggaccacaacttcggcgggggcgccgaccaggccaagaaccgcctcgaccaccggcaccacgcgatcgacgccgtcgtggtggccatcgtcgaccgcagcatgctgaccgagatctcccgggtgagcggcctggagggggccgagggccgcgagcgcatcatcatcccgccgccctgggacgagttccggaacgacctccgcacggcggtgaacgccatcaccgtctcccaccggaccgaccacgggaccatcagcaaggccggcctgcccaaggggaaggacgccaccgccggccgcctgcacaacgacacggcgtacggcttcaccggggagaccgacgccaagggcaactccatcgtggtgcggcgcgtccccctcgccagcttcaagaagctggccgacctggaccggatccgcgacaccgacctcaaggccgcgctgtaccagcacctggaggggctcgagggcaaggccttcgagaaggccgtgatggacttccccaacctggagtggcaccccttcgggaacgtgcggcgcgtccgggtgacggaggtgctgtccgtcatccccatcagcgaccagaacggccgcatctacaagggctacaagggggactccaactaccggtacgacgtgtgggagctccccggcgggaagtgggaggccgaggtggtcagcaccttcgacgcccaccagcccgactgggtgagcaagatccgctcccggagccccaccgcgcgcaaggtgctgtccctgcagcagaacgacctcatcgccgtcgagcgggcccacgagacccgcgagctgatgcgggtggtgaagttccgccagaacggcgagatcacgttcgccccgccccaggaggcggggagcctgaagcggcgcgacgccacccccaacgaggacgaccccttcaagtacttcgccgtcgccgcctccagcctccagaaggcgaaggcccgccaggtgcggatcgacgagctgggccgcgtgctggacccgggcttccccgcccggaccgcccgccggaagacccgcaagtccacgtga

SEQ ID NO: 1605 - RNA, 3333 nt, synthetic construct
  misc_feature 1..3333: note = Cas9 variant
  source 1..3333: mol_type = other RNA
atgcgcatcctgggcttcgacatcgggatcaccagcatcggctgggcctacgtggagggggaggagctcaaggactgcggcgtccggatcttcaccaaggccgagaacccccagaacggggactccctggcggccccgcgccgggaggcccgcggcgtgcggcgccggctggcccgccggaaggtgcgcctcaacgtcatcaagcggctgctgtgcaaggagttcggcctcaacctgagcgactacttcgccaacgacggggagctgcccaaggcgtacgagacgaccaaggacaccaagtccccctacgagctccgcagcctggccctggagcagaagctcgagcccaaggagctggcccgggtgatcctgcacatcgccaagcaccgcggctacgggaacaagcacgcgaagcgggacctcgaggccgaggagaaggccaagaaggccgccgagaaggcgccgcaggagaaggagtccaccacgaccaacggcgacagcaagaaggagcaggagaaggtgctgaaggccctgtaccagaacgagaccctcctgaagaagtaccagaccaactaccagacgaacaacaagaccaacgacgagaccaacaacaagaccatcttcctggtcgggaagtacctctacaaggagttccaggacaagggccagcgcatccggaacacgaccaacaactaccagcacaccatgcgccaggagtggctgaaggacgagctggagttcatcttcaagaagcagaaggacttcggcgccaccttctccgagaacttcgagagccagatcctcgagacggccttctaccagcgggacctgaagtccttcgaggacaaggtggggaagtgcgtgttctacgagaacgagaaccgcgcccccaaggacagcctgtccgcgatggagttcgtcgccctcacccggatcatcaacaccctgaagaacctggagaagaagtccaagaacctcggcatcggggagacctacggcaaggacaagatccaggagatcctgaagatcgtgctggacaagggcgagatgagctacaaggagctccgcaagatcctgaagctgaacgagagcatcctcttcgccaaggactccaagctggactacacgaaggggatgcaggaggccgagaaggccaagttcatcgagctgaagaacctcaaggcgttcaagaaggccatgggcggggacttcagcaagttcccccgcgaggagctggacaagatcgccaccgacatcgtgctgatcaagtccaaggagaacctcgccaagaagctgcagaactacagcgccctgtccaaggagcaggtcgaggcgctcagcaacctgaacttcgccaagcacatcgacctgagcctcaaggccctggacaagatcctgcccttcatgcgggagggcctgtcctacgacgaggtggtgaagaaggtcgggctccaggagcaccgcaagtacaagcagaagggcgagttcctgatcccgctgaaggagtacgagccctacctcgccaaccccgtggtggcgcgggccctgagcgagtaccgcaaggtcctgaacgccctcctgcggaagtacggcaacgtgcacaagatccacctggagttcacccgcgaggccgggaagaactacgacgagcggaagaagatcgagaaggagcagcgcgagcacttcgaggccaaccagaaggcgatcaagcagcgggagatcctcggcctgcccatcaacggggccaacatcctgaagatgaagctctggatcgagcagggcgagtgctgcgtgtactccggggagaagatcaccagcaagcacttcttcgactccaacgccctgcaggtcgaccacatctacccgtacagccgctccttcgacgacagctacatgaacaaggtgctggtgttcgccaaggagaaccagaacaagctcaacaagacgcccttcgaggccttcggctccgacaaggagaagtgggaccggatcctgagcctgtccgcgaagctccccaagcagaagcagcgccggatcagcaacaaggacttcaaggacaaggagctgggcttcatcgcccgcaacatcaacgacaccgggtacatcgcccggctggcctcccagtggaccaacaactgcctcaagttcgaggacctgcgcgagaacgaggtcaccatcgccggcgagaaggggagcaagaaccacctggaggtgatctccggccagctcacgagcatgctgcggcactactgggggctgggcgacaaggaccgcaacaaccacctccaccacgcggtcgacgccgtgatcatcgcctacaccaacgccaagaccatcaaggcgttcgccgacttcaagaagaaccaggagcagaaccgggccaagttctacgccaagcagatctccgagcaggagtacaagcgccagcgcaaccccttcgagccgtgcgccaacttccggcagcgcgtggaggagaagatcaacaagatcttcgtcagcaagccgccccggaagcgcgcgcggggcgccctgcacaaggagaccttcgggtccatctgcctggacggcaacaacaactgggtggcccgcttcaagatcaagagcaagaaggagcaggaggacatcacgaaggagaaggccaccaaggccaagtacaaggacgagttcaagggggaggagaacatccggaaggcgctcaagctgggcaagatccgccggatcaacaacacccagaaggacatcgccatcggcgacaagatcgtgaagaacgagaccatggtccgcgtggacatcttcaaggacaagaaggggaagttctacgccgtgcccatctacacgatggacttcgccctgggcatcctccccaacaaggccgtcgcgaccggggaggacgaggacggcgtgatcaaggactggatcgagatggacaagaccaagtacgagttctgcttcagcctgttcaaggacgacctgatcaaggtgcggaagaagaagatgaaggaggccgagctctgctacttcgtcgggttcgacaccgacggctcccgcatcatcgtggccaagcacaacaacgactaccagaccatgacggagaacgagtgcaagctgttcaccctgaaggagaagaagaagaagcagaagaccctcaacgacgaggaggacaaccaggagcggatcgagaccgagtacaagatcatcggcgggcgcacgggcatccagaacctggagaccttcgagaagcaccaggtgagccccctgggggaggtccagaaggccgagttcgaggaccggcaggagatcaagctcaagtccagccccaagggcaaggactga

SEQ ID NO: 1606 - RNA, 3333 nt, synthetic construct
  misc_feature 1..3333: note = Cas9 variant
  source 1..3333: mol_type = other RNA
atgagcgagaagtaccgcctgggcctcgacgtggggaccaactccctgggctgggccgtcatcgggctgaaggaggacgtgcccagctccgtgctcgccaccggcgtccggatcttcagcgaggggcgcgacgcgaagacgaagtccaccctgaaggccagccggaccgagaagcgctccgcccggcgccggcgcgaccggttcctgcagcgccagaccttcctcatcagcgagatggtgaagtccggcctgttcccgaaggacatcgtggagcagaagaacctggagctcctggacccctacgagatccggttcaaggccctgacggagcaggtccccctccaccacctgggccgcgccctgttccacatcaaccagcggcgcgggttcaagagctcccggaaggacaagagcgaggagaccacctccggcgtggtgagcaagtccgtccgcgcgctctacgaggagatgcagctgatcaaccccgccccggtgatcgacgaccccaaggccctgagcaaggaggagcggcgcgagatccgggtgcaggaggcctccagccgcgaggaggcgctcgtcaccctggccgagcagaagggggtgacgttcggcgccttcctgtaccggcgcctccagtccggcaagagcgtgcgcgcccggaaggacgccgacagccagctgtacgacgtctaccccacccgcgagctgctcaaggacgagtactccaagctgatgcagcaccaggcgcagtactaccccaacgtgatcaacgaggccctgatcagccggctccacgacgtgatcttcttccagcgcaagctgaaggagcaggagcgggggttctgcacctactacccgtccgagcgccggaccttccgctgcatgcccagcttccagcagtaccggatggtccaggagctgaacgccctcgagtgggtggacgccgccggcaagcactgcctgcgcgactaccccgagtcccgggacctgatcctcagcgagctggagaacatctccacgaaggcgggggagttcaccttcggcaacatgaagaagatcctgaagaagatgggggtgatcgacggcgaggtcagcttcaacttcgagggccccaagcgcaaggggttccagggcaacgtgacctcccgggagatgcgccacgaggactgcttcgggacccggtgggacgagctcagcctggacgagaaggacgacatcatcgacaagatcaacgacgaccacctggacgacgaggacatggagcgctacctcatcgacacgtacggcctgtccagcttctccgtggggaacgccatcaacgcccggctgctcgagggcaccgccaacgtcagccgcaaggccgcgcggaccctgtacgagaccatgctgtccgccaactgcctccagagcgacgccgtgatcgccgtctccgagcaggacgacacgttcgtgaacccgtacagccgcaccggccgcggggagctgctgtccgagctcccctactacggcgaggccttccaggacgggcggcacatcatccccggcaagcgcgagcccaaggtgagccacgaccagctgaagttctacgggggcgtcagcaacccgaccgtgcacatcgcgctgaaccagatccggctggtggtcaacgagatcatcaagcgctacggcctcccctccagcatctccatcgagctggcccggaacctgcccgaggggcaggacggccgccggaagatcgagaagatgcagagcgagaaccagaagaacaacgagcgctacgaccagatcctcaccgagaacgggcagtcccccaaccgggacaaccgcctgcggctggccctctgggaggagctgggcgaggggccgacggaccgcctgtgcgtgttcaccggcaagctcatcgagctggccgacctgttcaacggcagcgtggagatcgagcacctcatccccttctccgtcagcctggacgactccaaggcgaacaagaccgtgtgctggaaggaggccaaccggttcaaggggaacaagaccccctacgaggccttcgccaacaacagcggcgactactcctgggaggagatcatggagcgcgtgcgggccctgcccaacagcaagcagtggcgcttccaggaggacgcgctcaagatctggaactccgaccacagcgacttctccgggcggcacctgaacgacacgcgctacatcagccggctggcccgcgagtacctcgagaacatctgcccgttcaacaagatcgacgtcgtgaccggccggctgaccgccctgctccgcggccactgggggctgaacaacatcctgcgcggccacaacgagcccgagaccgccacgcccaagaagatgcgggacgaccaccgccaccacgccatcgacgcggtggtcatcgccatgacctccctcaccatcctgcagaaggtgagcagcgccgccgggaaggccgaggagctggacgtgggcaagctgttcgcgaaggacgagtccgggcggagcgtcatcgacccctgggacggcttccgcgacgaggtggccgagaaggtgcggaacatcatcgtctcccacaagaccaagcgcaagacgatcggcaacagcgggaagtccaccgaccgggccctccacaacgagaccgcctacggcctgatcgacgggccggacgagaagggcctctacagcgtggtgaccaccaagcccatctcctacttcgacaaccgcgacaagatcgagaagatccgggacgagaagctgcgcgacgacttcctgacggcgtgggacggggagggcgacaacaaggccagccagctcgccgtcctggacaaggcctccggcctgaacgtgaagaagtgccggtacgtggagcgcaagaaggtcatccccatcaacgggccggacggccagccctacaaggcctacgacgggaacagcaactggggcatggagatctacgagttccccaacgggcaccccaaggagaagaagtggaacggcgtggtgatctccacctacgacgcgaacaagagcgagttcaagccgggcgagaccttccggccccaccccgccgccaagctcgtcatgcgcctgcacatcaacgacatcgtggaggtgcagaacgacggggagcccatcctgtaccgggtccagctcatctccgccggcaccctgacggtgagcccgctgcacgaggccaacgtggactcccgcaaccgggacaagcacgacgagttcaagtacaagagcctctccgtcacccccatgcagaagatgggggcgaagaaggtgaacatcagccccaccggcctgaagaactactcccgctga

SEQ ID NO: 1607 - RNA, 3345 nt, synthetic construct
  misc_feature 1..3345: note = Cas9 variant
  source 1..3345: mol_type = other RNA
atgggcatcatcatcgggctggacatcggcatcgccagcgtggggatcgccgtcgtggacaaggacaccctcgacatcaagtgcgtggtctccgacctgttcgacagcgcggacgcctccaagaacatcgagcgccggaacaaccgccaggcccggcgcctgaaccggcgccggaagacccgcatcggcgacttcaacacgctctgggtgagcatgttcggggagctgcccgaggaggtggactccaacgtcctgctcctgcggaacgccggcctggacgagcagctcaccctggacgagatctactgcgtgctgaagtacatgctcaagcaccgcggcatcagctacctggaggacgccctgaacgaggagaacgtgaccgggtcctaccagaagggcatcgcgatcaaccagcgggagagcgagtacatgctcccgtgcgagatccagctggagcgcttccggaagtacgggcagtaccgcggcgagtgcgaggccgagaacgagaacggggagaagatcaccctgtccaacgtcttcatgacgaacagctaccggaaggagatcgacaagttcctcaacacccagggcaagtacggcatcctgaaccagaagttcatcgacgagtacctgaagatcttcaaccgcaagcggaagtactacgaggggcccggcaacgagaagtcccgcaccgactacgggaagtacaccacgggcaaggacctcgacggcaagtacatcaccgagaagaacatcttcgagaagctgatcgggaagtgcagcgtgtacaaggaggagctgcgggccgccggcgcgtcctacaccgcccaggagttcaacatcctcaacgacctgaacaacatcaccgtgaacaacaagaagctgacgacccagcagaagaaggacgtcatcgagatcgtgcagaacagcgaccgcatcaacatggagaagatcatctccagctgcatcggggagaagatcgagaagatcgagggcgcccggatcgacaagaacgagaagaacatctaccacaccttcgagcagtacaacaagatgcgcaagatcttcgccgagaagaactacgacatcaaggagctcaccatcgagcagctggacgagatcgggcgcatcctgacgatcaacaccgagcgggagggcatcaaggacgccatcatggagtccgagctcctgcacctgaacaacgagcagatcaacctcctgatcgagctgcgctacaagaacagctccctcttcaccaagtggcagagcctgagcatcaaggcgatgcgggagatcatccccgacctgtacgaccgcaacgtgaaccagatgaacatcctcgccgagcggggcgtcttcaaggacaagatcaacctgttcgagaactccgtgtacctgcccaaggagccggtgctcgaggagatctacaaccccgtcgtgcgccggagcatctccatgaccatcgacgccctgaacgccctgatcaagaagtacgggtaccccgaggacatcgtgatcgagatgccccgcgaccggaacgacgccgagcagaaggaccgcatcaagaagttccagaagacgcgggagaacgagctcaagaacatcaagaagaagatcaaggaggagtacggcatcgagatcaccgacgagtacttccgcaagcacaaggggctggagctggagctcaagctgtgggtcgagcagaacgagaagtgcccgtacagcggcaagtacatcaacgtgcaggacatcctgtaccaccacgagctgttcgagatcgaccacatcatccccctctccatcagctacgacgactcccggaacaacaaggtgctggtctacaaggaggagaaccaggacaaggggaaccgcacgcccctgatgtacctcagcaccgtgaaccggcagtacgaccagcacgagttcatgaactacgtcctgtccaccaagaccctgccccgcaagaagcgggagctcctgctgaactacgaggacatcaccaagatcgacgtgctcaagggcttcatcaaccgcaacctgaacgacacccggtacgcgagccgctccgtgctgaacgccatccagctgttcttcggcgggaaggagtgcgacacgaaggtccgcgtgatccggggcgccgtgaccaaccagctccgcatcaagctgaacctcccgaaggaccgggagaagtcctacagccaccacgccatcgacgccgcgatcatgtgctacagccagatggggctgatgaacttccgcaacatccagaacaagttcatcgacttcgagaacgagacctacctgtccgacgagcgggacagctgcttcgacaacaagtactacgacgaggccctcttcggccaggtcctgaagatgcgcaagaacctgctcaaggccgaggggaagccccagcggtccgtgcagagcaagggcgtgttcgacgaggaggagaagaacaacggcatcgtccgctaccaccacaaggtggacaagaagcccaaccgggggctgtccaacgccagcatctacggcacccgcaagatcgacgacaagatctacaagatcgtggggtacgacatccggaacaacaaggacgccgaggcgatcatcaacatcatcaagaagggcaagagcgacaacttcctgatggccaagcacgaccccgagacgttcaagaacctcatggagatctacgagcagtacaaggaggagaagaacccgttcctggcctacgagcaggagaccggcgactacatccgcaagtacgccaagaaccacaacgggcccatcatcaagaagatcaagtacgtcgactccgaggtgggcagctgcatcgacatctccgcgaactacgggtacaagaacggcgacaagcgggtgatcatggacaccctgaccccctaccgcgccgacgtctactacaactacaaggacgggacgtaccggatcatcggcgtgaagtacgccgacttcaagtacagcaacgccaagtacgtgctcgacgaggaggcctacgcgctgatcctgatcaaggagggcctcctgaagatcggggactccctggagaacatcagctccagcggctacgagtaccgcctctccttctacaagaacgacatcatcgagtacaccaagaacgacatcgtctacaaggagcggttcctgagccgcaccatgcccaaggtgaagaactacatcgagaccaagccgatctccgccgccctgtacgagaagcggaaccccatcgggctcaccaacgccacgaacatctgcaagatctacaccgacgtgctgggcaacgagaccaagatctacaaggagaagttcaagctgagcgtcgactga

SEQ ID NO: 1608 - RNA, 3345 nt, synthetic construct
  misc_feature 1..3345: note = Cas9 variant
  source 1..3345: mol_type = other RNA
atgaactacaccgagaaggagaagctgttcatgaagtacatcctcgccctggacatcggcatcgccagcgtggggtgggcgatcctggacaaggagtccgagaccgtcatcgaggccggcagcaacatcttccccgaggcctccgccgccgacaaccagctccgccgggacatgcgcggggcgaagcggaacaaccgccggctgaagacgcgcatcaacgacttcatcaagctgtgggagaacaacaacctcagcatcccgcagttcaagtccaccgagatcgtgggcctgaaggtgcgggccatcaccgaggagatcaccctggacgagctctacctgatcctgtacagctacctcaagcaccgcgggatctcctacctggaggacgccctggacgacacggtcagcggctccagcgcctacgcgaacggcctcaagctgaacgccaaggagctggagacccactacccctgcgagatccagcaggagcggctcaacaccatcgggaagtaccgcggccagtcccagatcatcaacgagaacggggaggtgctggacctgagcaacgtgttcaccatcggcgcctaccggaaggagatccagcgcgtcttcgagatccagaagaagtaccaccccgagctcacggacgagttctgcgacgggtacatgctgatcttcaaccggaagcgcaagtactacgagggccccggcaacgagaagtcccggaccgactacgggcgcttcaccaccaagctggacgccaacggcaactacatcacggaggacaacatcttcgagaagctcatcgggaagtgcagcgtgtacccggacgagctgcgggccgcggccgcctcctacaccgcccaggagtacaacgtgctgaacgacctcaacaacctgaccatcaacggccgcaagctggaggagaacgagaagcacgagatcgtcgagcggatcaagagctccaacaccatcaacatgcgcaagatcatcagcgactgcatgggcgagaacatcgacgacttcgccggggcgcggatcgacaagtccggcaaggagatcttccacaagttcgaggtgtacaacaagatgcgcaaggccctcctggagatcgggatcgacatcagcaactacagccgcgaggagctggacgagatcggctacatcatgacgatcaacaccgacaaggaggccatgatggaggccttccagaagtcctggatcgacctcagcgacgacgtgaagcagtgcctgatcaacatgcggaagaccaacggggccctgttcaacaagtggcagtccttcagcctcaagatcatgaacgagctgatccccgagatgtacgcgcagcccaaggagcagatgaccctgctcacggagatgggcgtcaccaagggcacccaggaggagttcgccgggctgaagtacatccccgtggacgtggtctccgaggacatcttcaacccggtggtgcgccggagcgtccgcatctccttcaagatcctgaacgccgtgctcaagaagtacaaggccctggacaccatcgtgatcgagatgccccgggaccgcaacagcgaggagcagaagaagcggatcaacgactcccagaagctgaacgagaaggagatggagtacatcgagaagaagctcgccgtcacgtacggcatcaagctgagcccctccgacttcagctcccagaagcagctgagcctcaagctgaagctgtggaacgagcaggacgggatctgcctgtactccggcaagaccatcgaccccaacgacatcatcaacaacccgcagctgttcgagatcgaccacatcatcccccgcagcatctccttcgacgacgcgcggagcaacaaggtgctcgtgtaccgctccgagaaccagaagaaggggaaccagaccccctactactacctgacccacagccacagcgagtggtccttcgagcagtacaaggccacggtcatgaacctcagcaagaagaaggagtacgccatctcccggaagaagatccagaacctgctgtacagcgaggacatcaccaagatggacgtgctcaagggcttcatcaaccgcaacatcaacgacacctcctacgccagccggctggtcctgaacaccatccagaacttcttcatggcgaacgaggccgacacgaaggtgaaggtgatcaagggctcctacacccaccagatgcgctgcaacctcaagctggacaagaaccgggacgagagctactcccaccacgccgtcgacgccatgctgatcgggtacagcgagctcggctacgaggcctaccacaagctgcagggggagttcatcgacttcgagaccggcgagatcctgcgcaaggacatgtgggacgagaacatgtccgacgaggtgtacgcggactacctctacgggaagaagtgggccaacatccggaacgaggtggtcaaggccgagaagaacgtgaagtactggcactacgtgatgcgcaagagcaaccggggcctgtgcaaccagaccatccgcggcacgcgcgagtacgacgggaagcagtacaagatcaacaagctggacatccggaccaaggagggcatcaaggtcttcgccaagctcgccttctccaagaaggacagcgaccgcgagcggctgctggtgtacctcaacgaccgccggaccttcgacgacctgtgcaagatctacgaggactactccgacgcggccaaccccttcgtgcagtacgagaaggagaccggggacatcatccgcaagtacagcaagaagcacaacggcccgcggatcgacaagctgaagtacaaggacggcgaggtcggggcctgcatcgacatctcccacaagtacggcttcgagaaggggagcaagaaggtgatcctcgagagcctggtgccctaccgcatggacgtctactacaaggaggagaaccactcctactacctggtgggcgtgaagcagagcgacatcaagttcgagaaggggcggaacgtcatcgacgaggaggcctacgcccgcatcctcgtgaacgagaagatgatccagcccggccagtcccgggcggacctggagaacctgggcttcaagttcaagctcagcttctacaagaacgacatcatcgagtacgagaaggacgggaagatctacaccgagcgcctggtgtcccggacgatgcccaagcagcgcaactacatcgagaccaagccgatcgacaaggccaagttcgagaagcagaacctggtcggcctcgggaagaccaagttcatcaagaagtaccggtacgacatcctgggcaacaagtacagctgctccgaggagaagttcaccagcttctgctga

SEQ ID NO: 1609 - RNA, 3348 nt, synthetic construct
  misc_feature 1..3348: note = Cas9 variant
  source 1..3348: mol_type = other RNA
atgagcgccacctacaccatcggcctggacatcgggatcgcctccgtgggctggtgcgcgttcggggagacgcacatcctcgacctgggcgtccgcgccttcgacaaggccgagaccgccaaggagggggagagcctgaacctcgcccggcgcaacgcgcggctgatgcgccggcgcctgttccggcgcacctggcggctcaagaagctggcccgccagctgaagtccgagggcctcatcgccgacaccaagctgttcaagcccgagctgcccttcagcaagtccctctggcagctgcgggtggacggcctggaccgccggctcaacgacgaggagtgggcccgcgtgatctaccacctgtgcaagcaccgggggttccactggatcagccgcgcggaggccaagcaggccgagggcgactccaagagcgagggcgggaaggtcaagcaggggctggccggcacggccaagctcatggacgagaagggctaccggtccgcggccgagatggtgctggccgagttcccccaggcccagcgcaacaagcagggggagtaccagaaggccctgagccgggagctcctggcgaaggagctggccctcctgttcgcccagcagcgcgagtacggcaacctgcacacccccggggccctcgagaccgccatcctgggcaacggcgacaagaagtccgggctgttctggcagcagaagcccgcgctcgccggcaccgacctgctgaagatgctcgggacgtgcaccttcgagaagggcgagtaccgggccccgaaggccagcttcaccgccgagcgccacgtgtggctgacccgcctgaacaacctccggatcgtcacggacggggtgacccgccagctgaccgagcaggagcggcagctgtgcctccccctgccctaccgccaggcgggcgacctgacctacaagcagctcggctccgccctggccaaggccgggctgctcgaggcgggcgggttcaagttcacgggcctggcctaccccaccgaggcccagaaggccgaggggaaggccaaggacccggagagcgcgaccctggtgaagatccccgcctggcacgagctccggcagaccctgacgaagggcggcctgaacgacgagtgggagaagctggccggggacgccctctgcggccagcccgagatcttcgacaagatcgcctgggtcctgtccgtgtacaaggacgacgacgaggtgcgcgcggagctggccaagctcgccctgcccaacccgcaggccctgaccgaggccctcctgaacatccggttcgacaagttccacagcctgtccctcaaggcgctgcgcgccatcgtcccccacatggagcaggggctgcggtacgacgaggcctgcgtgcaggccggctaccaccacagccagctcctgaaggtgggggagggcgagcacaagtacctgccgcccctctacgacggccgcgacggggacggccggatgatcttcgcggaggacgccgacatcccccgcaaccccgtcgtgctgcggtccctgaaccaggcccgcaaggtggtcaacgccatcatccggcgctacgggagccccagcgccgtgcacatcgagatggcgcgggacctctcccgccccttcgacgagcggaacaagatcaagaaggaccaggacgagtaccaggcccgcaaccagcgcgaccgggagcagttcagcgagctgttcggccacccgcccaagggcctggagttcgagaagtggcgcctctaccgggagcagaacgggcagtgcgcctactcccagcgccccctgaccgccagcggcaacgtggccgagatcttcctggacgggtccaccgagatcgaccacgcgctcccctacagccggtccttcgacgacagcaagaacaacaaggtcctggtgctgacgcgcgagaaccgggacaagggcaaccgcaccccgtacgagtacctcgggggcgccgagaactccgagagctggcagcggttcgtgtccttcgtcgagagcaacaaggcctaccgcctggccaagcggacccgcctgctccggaaggacttcggcgccaaggagtccgaggagttccgcgagcggaacctgaacgacacccgctacgtgtgccggttcttcaagaactacgtcgagcagcacctgaagctcgcggaggggagcgagacgaagcgctgcgtggtggtctccggccagctgaccaacttcctgcgggcccgctgggggctcctgaaggtgcggagcgactccgaccgccaccacgccctggacgccgcggtggtcgccgcctgcagccactccatggtgcagcgcctcagcaactacagccggacccgcgagctggagcaggtccgggacggcttcgtggacatcgagaccggggagatcgtgaaccccgccatgcaccagcagctgcgcgagcacttccccgacccctggccgtacttccggcacgagctcgaggcccgcctgaagatcgactcccccgagctgctccgggaggagatggcgcgcctgggcagctactccgaggaggagctgaaggtgctcaagcccctgttcgtcagccgggccccgcagcgccggaacggcggggccgcccacaaggacacgatctacggccagcccgagaagctgaagaagaacgggtccgtgacccagaaggtggccctcaccagcctgaccctgaaggacatcgacctcctggcggacccccaccgcaacgccaagctgtacggcgccatccgggagcgcctcgaggcccacgggggcaagggcgacaaggccttccccgcgacgaacccgctgcggaagcccgacaaggaggggaaccccaccggccccatcgtccgcaccgtgaccaaggtgatcgacaagctgtccgggatcccggtccggggcgggatcgccaagaacgacaccatgctccgcgtggacgtgttcacgaagggcggcaagttccacctggtccccgtgtacgtgcaccaccgggtcaccgggctgcccaaccgcgccatcatcgccttcaaggacgaggacgagtggaccctcatcgacgacagcttcgactggtgcttctccctgtaccccaacgacctgctccgcatcaagctgaagaaggagagccactccggctactacagctcctgcaaccggagcaccggggccgtgaacctgtgggcgcacgaccgcaacgtgaacgtcggcaaggacggcttcatcgagtccatcggggtgaagatggccgtgagcatcgagaagctccacgtcgacacgctgggcaacatctacccggccccgcccgagaagcggcgcgggctggcctga

SEQ ID NO: 1610 - RNA, 3351 nt, synthetic construct
  misc_feature 1..3351: note = Cas9 variant
  source 1..3351: mol_type = other RNA
atgagccagaaccagaaccccaacacccagtcccacctgaacccgaccacgcagagctccacccagagcaacccccagcccaccacccaggagtccctcaagatcctgggcttcgacatcggggtggccagcatcggctgggccttcgtggagggcggggagctgaaggactgcggggtgcgcatcttcacgaaggcggagaaccccaaggacggctccagcctcgccctgccgcggcgcgaggcccggggcgtgcgccggcgcctggcccggcgcaaggggcggctcaacgccctgaaggtcctgatctgcaaggagttcggcctcaaccgctccgactacctggcgaccgccggggagctgcccaaggcctacgccaccagcaaggagaccaagtccccctaccagctccgggcggagagcctggagcgcaagctgtccgccgacgagttcgcccgggtgatcctccacatcgccaagcaccgcggctacgggaacaagcacgccaaggagagctccgacgacgacagcggcaaggtgaagaaggcgatctccgagaaccagaaggtcatgagcgagaagggctacacgaccgccgggcagtacctgtacggcgagttctaccagaaggcccggaacttctccgaggccgagcccaagagcccgaagaacgcccgcgggacccaggagttcaagaacgtgcggaacaagagcgagaactacgcgcgctgcctggcccagtccgagctccagaaggagctggagatcatcttcgccaagcagcgggagttcggcttccagttcagcgacaagaagcacaagaccatcaacgccaacggcaagctgaaggagctcgacttcgccgacgcggtgctggagatcgccttcctgcagcgccccctcaagtccttcgccgacaaggtcgggaagtgcacgttctacgaggacaagccccgggcccccaaggacagcctgtccgccatcgagttcgtggcgctgacccgcatcatcaacaccctcgccaacatcaccaagcgcagcggcgaggtgtactccgccgacaaggtccgggagatcctgagcatcgtgctggacaagggggagatcacgtacaagaacctccgcaaggtgatcgccctggacgagcggctgcagttcccgaaggactccaagctcgactacgcgaaggaggacgccgagaaggccaaggccatcgagttcagcaagctgaaggccttccgcaaggcgctgggcgggtccttcgagggcttcatccgggccgagctcgacagcatcgccaccgacatcgccctgatcaagtccaaggacgagctgaaggccaagctcgcgaactaccagagcctgaacgacgagcagcgcgagaagctgtccgagctcagcttcgacaagttcatcgacctgtccttcaaggccctggaggccatcctccccctgatgcggggcgacaaggacgacaagatctaccgctacgacgaggcctggcgggaggccgggctggtcgaggtggcgaagaagacccagaagggcgacagcctcccgcccctgatcgagtacgagaaggacctggccaaccccgtggtcgcccgcgccctggcggagtaccggaaggtgctcaacgccctgctgaagaagcacgggaaggtgcacaagatccacctcgagttcacccgccaggccggcgtctccagcaaggagcgcggggagatcatcgccgagcagaacaagcggctgaaggccaacgaggaggcgcggaagcgctgcgaggagtacggcctgatccccagcggcaagaacatcctcaagctgaagctgtggcaggagcagggggagttctgcgtgtactccggcaagaagatcacgcagagcgacctccgggacgagtccaccctgcagatcgaccacatctacccctacagccgctcctacgacgacagccagaacaacaaggtgctggtcttcaccgacgccaaccagaacaagctcaaccagaccccctacgaggccttcgggaaggacatctccaagtggaaccagatcctgggccggatcgagaagctgccgaaggccaagaagaaccgcatcacgaacaagaacttcgccaacaaggaggcggggttcatcgcccgcaacatcgtggacaccagctacatcgcccggctctccgccagctacaccgacgccttcatcgagttctgccccctggcggagaacgaggacaccacgctgggccgcggcgagaaggggtccaagaagcacatcagcgtcgtgaacggctccctcaccgccaccatgcggcactactgggggctgaacaccctgctcgacggcgagaacagcgagtccaaggaccgcagcaaccacctccaccacgccctggacgccatcatcatcgcgtacgtgaacgactccgtcatcaaggccttcagcgacttcaagaagacgcaggagcagaacaaggcccggctgatcgccaaggagatcgagagcgccgagtacaagatctcccgccggttcttcagcccctccggcttcgagaacaacgaggcgttccgccaggccatcaagcggaagatcctggggcagagcctggagtcccgcgagaacgacatgaccatcaacagcgaggccctcggcgagaaggtcgggggcatcttcgtgtccaagcccccgcggaagcgcgcccgcggggccctgcacaaggagaccttcagctccatcgacgacaaggacctgctcaagacctacggcggcaaggagggggtgaaccgggcgatcaagctgggcaaggtgcggcagatcgggagcaagatcgccgacaacggcacgatggtgcgcgtcgacatcttccggcacaaggtgtccgggaagttctacggcgtgcccatctacaccatggacttcgccctgggcatcctccccaacaaggccgtcgtcgggggcaaggacaagagcggggtgatcaaggactggctgcccatggactccaactacgagttctgcttcagcctgttcaaggacgacctcatcctggtgcagaagaaggagatgtccaaggccgagctgtgctacttcgcgggcttcgacaccagcgggggccagatcaaggtggagaagcacgacaaccacttcgccaccctcaccgacaaccagcgcctgctgttcaacatcgccacgccgaaggaggtggccggcaagtccatcgggatccagaacctcaaggtcttcgagaagtggcaggtcagccccctgggcgaggtgtccaaggccgagttcaaggagcgggagcccatcgcgctcaagagcaccccgaagcgcttcctgcaggggtga

SEQ ID NO: 1611 - RNA, 3354 nt, synthetic construct
  misc_feature 1..3354: note = Cas9 variant
  source 1..3354: mol_type = other RNA
atgaagcacatcctgggcctcgacctggggagcaactccatcggctgggccttcgtgcagcaggacttcgagaacaagcaggggaagatcatcgccaccggcagccgcatcatccccatggaccaggggatcctgggcgacttcgagcggggcaacaccgtctcccagacggcggagcgcaccacctaccggagcatgcgccggctccgcgagcggcacctcctgcgccgggagcgcctccaccgggtgctgcacctcctcgggttcctgccgccccactacgacgcccagatcgacttcaccaagcgctacggcaagttcatcgacaacgccgagcccaagatcgcctacaacaacgggaacttcatcttcatgaactccttcaacgagatggtggaggacttcaagaagcaccagccccagctgttctacaagaagtccaacggcgaggagagccggatcccgtacgactggacgatctactacctccgcaagaaggccctgagccagaagatcacccagcaggagctggcgtggctcatcctgcacttcaaccagaagcgggggtactaccagctgcgcggcgaggaggagaccgagaaccccaacaaggaggtcgccttccactccctcaaggtggtggacgtcgaggccgaggcccccaacaagaagggcgagatctggtacaccatccggctggagaacgggtggatctaccgccggacgagcaagaaccccctggacgactggaagggcaagacccgcgacttcatcgtgaccaccgacctcaacgacgacgggacgatcaagctggacaaggagggcaaggagaagcggtccttccgcgcgccggacgagaacgactggaacctgctcaagaagaagaccgagcacgacatcgacttcagcggcaagcccgtggggacctacatctacgaccacctcctgcagaaccccaaccagaagatcaagggcaagctggtccgcaccatcgagcggaagtactacaaggacgagctgaaggccatcctggccaagcagatcgccctccagcccgagctgttcacggagaccctgctcgccgactgcatccgcgagctgtaccggaagaacgagacccagcagcagaacctgctctccaaggacttcctgcacctgttcgtggaggacatcatcttctaccagcgcccgctctgcagcaagaagtccaccatcgcgaactgcacgctggagaagcggagctacatcgacaaggagaccaacgagcgcaaggacgcccccatcaaggtgtgcgccaagtccaacccctactaccaggagttccgggtcctgcagtggctccagaacctgcgcatctacgagatcgagaccgaccgggaggtgaccgccgagttcatcgagacgccccaggactacgaggccctgttcaacttcctcatgagccagaaggagatcgacaacgaggggctgctgaagtacttcctcttcgcgaagaacccgcagatcaaggacaaggccgccaagtccgagctgaagaagtggctgaccacctaccgctggaactacgtgtacgacgccgccgacaacagcagcaagaagtaccccatgaacgagaccggctacgagctgcagcggtacctccagaaggtcgaggggctgcccgcgaacttcctgacgttcgacatcacctaccagctctggcacctcctgtactccgtgaaggacaaggtggagttcgagaaggccctgaagaagttcgccaagaagaagcagctggacaagaccagcttcgtcgactccttcaagaacttcaagccctacccgaacgagtacggcagcttctccgagaaggccatcaagaagctgctccccctgatgcgcttcggcaaccactgggacttcaaccggatcgacgtgagcacccagaagcgcatcgacgacctgatcaacggggtggccaacgaggacatccggacgatcatccgcgagaaggcggagaagtaccagctcaactccgagacctgcttccaggacctgcccctgtggctcgcccagtacgtcgtgtacaaccggcacgccgaggccaccgacatcgagaagtggaccagcgtgtccgacctggaggcgtacctggaggacttcaagcagcacagcctccgcaaccccatcgtcgagcaggtcgtgacggagaccctgcgggtggtgcgcgacatctggcagcagtactccggcgggcaggccaacttcttcgacgagatccacatcgagctgggccgcgagctcaagaagaccgccgaggagcggaagcagctgagcgacaagaaccaggagaacgagaacaccaacctgcgcatcaagaagctcctggccgagctgaaggaggacgcctccatccagaacgtccggccgtacagcctcgtgcagcaggagctgctgaagatctacgaggagggggtgttctccagcaccgacgagatcgaggaggacatccagaagatccgcaagaaggtcgagcccacgccgcccgagatccagcggtacaagctctggctggagcagaagtacaagtccccctacaccggcgaggtgatcagcctgaccaagctgttcaccgaggagtacgagatcgagcacatcatcccccagtcccgctactacgacgacagcctgagcaacaaggtgatctgcgagtccgcggtcaacaagctgaagacgaaccagctcggcctggagttcatccagaaccaccacggggagaaggtgcggatcaccgccaacaaggaggtgaccatcttcaccgaggagcagtacaaggagttcgtcaagaagcactacgccaacaacagcgccaagcagcagaagctgctcctgaacgagatccccgagaagatggtggcccgccagctgaacgacacgcggtacatctccaagtgcatcagcgagatcctctccaagatcgtgcgcagcgacgagaaggacgagggcgtcaactccaagaacatcatcccgtgcaccgggaagatcaccaccgcgctgaagcaggactggggcctgaacgacgtgtggaacgagctcatcctgccccggttcgagcgcatgaaccagctgacgcagacccagctgttcaccagctacaacgaccggctgcagaagaacctgcccaccgtgcccatcgagtactcccaggggttccagaagaagcgcatcgaccaccggcaccacgccatggacgccctcgtcatcgcctgcgccacgcgcgagcacatcaactacatgaacaaccagcacgcgctggacaagagcaaggacaagaaggagaagcagcagtcccggatcgacctgcacccgctctga

SEQ ID NO: 1612 - RNA, 3354 nt, synthetic construct
  misc_feature 1..3354: note = Cas9 variant
  source 1..3354: mol_type = other RNA
atgcagaccaagaacctgctctacaccctgggcctggacatcgggatcgccagcgtgggctggtgcgtcctcggggagaaccgcatcatcgacctgggcgtgcggtgcttcgacaaggccgagacgcccgaccgcggggagtccctgaacaaggtgcggcgcgacgcgcggctcatgcgccggcgcctgcggcgccgggcctggcgcctgaccaagctcgcccggctgctgaagcacgccggcctcatcgacagcacccgcatcgtccgggaccgccacgacggcgccgtgtccccctggcagctgcgggtggaggggctggaccgcaagctcgcgcccgaggagtgggcccgggtcatctaccacatcgtgaagcaccgcggcttccactggatcagccgggccgaggagcgcaaggccgagtccgacaagggggagggcgggaaggtgaagcagggcctgagcgcgaccaagcagctgatggtcgagaagaactaccgctccgccgccgagatggtgctcacggagttccccggcgcccagcggaacaagcgcggggagtacaccaaggccctgagccggatcctgctcgcggccgagctgaccaccctgttcgagcgccagcaggagctcggcaacccccacgccgggccggacctgcagacgaagatcctgggcaacggcgaccggaagtccgggctcctgtggatgcagaagccgcccctgagcggctccgccctcctgaagatgctggggaagtgcaccttcgagcgcgaggagtaccgggcccccaaggcgagcttcaccgccgagcgccacgtgtggctcaccaagctgaacaacctgcgggtcctcgtggacggcgtgacgcgccccctgtccgaccccgagcggcgcctggccctcagcctgccctaccagcaggcctccgacttcacctacaagcagctgcgggccgcgctctgcaagaacgggctgctgcccgacagcttccagttctccggcctcgcctacccgaccggcgcccagcagcccgacgggaaggccaagaaccccgagaacgaccgcctggtcaagctgcccgcctggcaggagttccggaagaccctccgcgacgcgggcctggagacggagtgggagagcatcgccgggatggccgccggcgggcagccggacctgctggaccagatcggctgggtgctctccgtgttcaaggacggcgacgaggtcctgcgggagctgcgcaagatccccctccccgggggcgagaagatggtgcaggcgctgagcggggtgagcttcgacaccttccacaacctgtccctcaaggccctgcggaagatcgtcccccacatggaggccggcctgcgctacgacgaggcctgcctcgccgcggggtaccaccacagcgacctgcgcaaggacaccgacgagcggtccctgtacctcccgcccctgtacagcggccgcaccacggacggccggatggtgttccgcgacgacatcgacgtgccccggaaccccgtcgtgctgcgcgccatcaaccaggcccggaccgtcgtgaactccgtggtccgccggtacgggagcccgtccagcatgcacatcgagatggcccgcgacctctcccggccctgggacgagcgcaacaaggtgaagcgggcccaggaggagtaccgcgaccggaacgagaagctgaagatcgacttcgcggccgagtacggcatcgagcccaagagccgcgagttcgagaagttcctgctctaccgggagcagggcgggaagtgcgcctactccctgaagcccctggacctcgaccgcgtgctgcgggacctgggctacgccgaggtcgaccacgccctcccgtacagccgctccttcgacgacagcaagaacaacaaggtgctggtgctggcggaggagaaccggaacaaggggaaccgcaccccctacgagtacctcgacggcacctccgagagcccccgctggcgggagttcaaggccttcgtcgagacgaacaaggcctaccgcctggccaagcgggcgcgcctgctccggaaggacttctccgggaagggcagcgaggagttccgcgaccggaacctgaacgacacccgctacatctcccggttcttcaagaactacgtggagcgcttcctgaagctcgccgaggagagcgaggagcggacctgcgtggtcctgagcgggcagctgaccgccttcctccgcgcccggtggggcctggccaaggtgcgcggcgactccgaccggcaccacgcgctggacgccgccgtgatcgccgcctgcagccgctccatggtcaagcggctcagcgactacgcgcgccggcacgagctggagaaggtgcgcacggggttcgtggacttcgagaccggcgagatcgtcgacgccgggaagtaccgccagatcgagcgggacttcccgtccccctggccctacttccgcgacgagctgctcacccggctgaacaccgacgaccccgccgagctgcgcgagcggatgcagagcctcggctcctacccgcccgaggccctggagacgctgcgccccatgttcgtgagccgggcgccccagcgccggaacgggggcgccgcccacaaggacaccatctaccgccagaccgagcggctcaagaaggtgggctccgtcacccagaaggtgccgctggccgccctgaacctccgcgacctggagaacctggtggacccccaccggaacgagaagctctacgcggccatccgcgcccggctggaggcccacgggggcaagggggagaaggccttcccgcccaacaaccccctgcgcaagcccgaccgggacggcaaccccacggggcccatcgtccgcaccgtgaccctcgtgatcgacaagatgagcggcatcccggtccggggcggggtggcgaagaacgacaccatgctgcgcgtggacatcttccggtccaagaaggacggcaagttccacctggtccccctctacgtgcaccacgccgtggccaagcagctgcccacccgcgccgtcatcgcctacaaggacgagggggagtggacgcccatcaacaaccacgacttcgacttcctgttcgcgctctacccgaacgacctggtgcgcatcaccctgaagaaggagcggcacttcggctactacgccgggtgcaaccgcgccaccggcgccgtgagcatctgggcccacgaccggaaccagcgcatcggcaaggacgggttcatcgacggcatcggggtcaagaccgcgctctccgtggagaagttccacgtggacacgctgggcaacgtctaccccgccccgcccgagacccggcgcggcctggcctga

SEQ ID NO: 1613 - RNA, 3357 nt, synthetic construct
  misc_feature 1..3357: note = Cas9 variant
  source 1..3357: mol_type = other RNA
atgggcacccgctacagcttcgacatcgggaccaacagcatcggctgggccgtgtggcggacggggcgcgaccccaagggcatcttcggggagaaggacgccccgctggagctcctgggcgcgggcgtccggctgttcaaggacgggcgcaaccccaaggacggccagagcctcgccaccatgcggcgcatcccccggcaggcccgcaagcggcgcgaccggttcgtgctgcgccgggaggccctggtggccgcgctcatcgaggccgggctgatgcccgcctccgagaaggagcgcaaggccctggcggacctcgacccgtaccagctgcgggccgccggcctggacaaggccctcgcgccccacgagctggggcgcgccatcttccacctccaccagcggcgcggcttcaagagcaaccggaagaccgaccgcaagtccgacgaccgggacaagggcaagatcgccaccgccagcgccgccctcgcgaagaagttcgaggacgagaacgcccgcacgttcggggagttcctgtggcgccggcaccgcgaccccgacatgaagcggcaggccgtcctgaaggcccacgaccccgccaagggcaagccggacctccgcgcggccaagctgcggcagcccacccgcatccggctggaggggcagggcgccaccgccctctacgagttctaccccacccgcgagatgctgtgccacgagttcgacgccctgtgggaggcgcaggcccggcaccaccccatgctcctgacgcgcgaggccggcgacaagatccggtccatcctgttccgccagcgggagctcaagccgcccctgatcgggctgtgcaccttcgagtacgccgcgggcgagaaggagagccgcctccccaaggccctgccctccgtgcaggcccgggagatctacgagcgcctggggcacatccggctcagcaccggctccgggaccgaccgcccgctcaagagctccgagcgggacgacctggccacggccctgctgcactgcggcctgaccaagatcaaggtgagcaagaccaagggcctcgcgttcaagaccgagttccgcaaggccctgcgcctcgggggcgaggtccggatcaacttcgaggagatgggggaggagggcctggtggacctgcgcacgaaccggctgctcgtgcaggacgaccactacgggccccgctggcgggccctgtcctggagcggcaaggacgccttcgtcaagaagctgctcgaggccaccgacgacgacaagctggtggcgcgcctgatgaccgaggacggcctgtccgccgtgcaggcccggaacgccgccagcatccccctccccgacgggtactcccgcctgggcccgaccgcgaacgccgccatcctgcaggccctcatcgacagccgggacgagaacgggttcgtcgtgacgtacgacaaggcggtgcgccgggccggcgagcgcctggggaaggactggcaccacagcgacgagcgggacggcgagatcctggacgccctcccctactacggcaaggtcctgcagcgccacatcctgcccgggatgatggaccccgccgaccggaaggacgaggccaagttctacggccgcatcatgaacccgtccgtgcacatcgggctcaaccagctgcggcgcctggtgaacgcgctcatcgagcggttcggcccgcccgaccagatcgtcgtggagctggcccgcgacctgaagatgagcgcccgggagaaggagcaggagcagcgccgcaaccgggacaaccgcgaggccaacgagaagcggaccaagaagctcgtggagctgggccaggacaacaacggggagaaccgcgcccggctgaagctctacgacgagcagcagcgcgcgggcaacggggtcgcccactgccccttcaccctggaccccatcggcatcacccagctgttctcccccgagatcgagatcgagcacgtgctcccccggagccgcacgctggacgactccgccgccaacaaggtgctgtgcttccggaccatcaaccgcatcaagcgggggaagaccccgtgggaggccttccacgcggaccccaagtggcccgacatcgccgccaacgccgagaagctgcccccgaacaagcgctggcggttccgcgaggacgcgatggacgtcttcgaggcccggaccagcggcaagatggacaagacgaccctggagcagatgggcctgaccaccgggttccaggcccgccacctcaacgagacgaagcacatgtcccggctggccaaggcctacctgggcaagatctgcgaccccgacgcggtgtacgtcacccccggggccctcaccagcctgctgcgcggcaagtgggggctcaactccatcctgagcgacgacaacctgaaggaccggaccgaccaccgccaccacgccatcgacgccatcacgatcggcgccatgacccgctccctcctgctggagctcaacaccctggcgggcaaggccgagcagagcgactacgacgacgtggtggggaaggtcccctggccgttcgacaacttccgggacgccgtgcgctccgtggtcgaccgggtggtggtcagcaacaagcccgagcacggcaagcagggggccctgcacgaggacaccgcctacggcatcgtgggggacgaggcggaggccgaggagatcggcaacctcgtgcgccggaagctgctggtcgacctcacccccggcgaggtggaccgcatccgggacgccgggctgcgcaaggccatgcaggccgcggtggccccctcccgggacgcccgcggcaaggtcagcgacgccaaggggttcgcggccgccctggacacgttcgccaaggcccagggcatgcggcgcatccgggtggggaaggaggacatgtccgcggtgaccatccacgaccgccagaccgacaaggcctacaaggccgtcgccccgggcgagaaccaccacgtggacgtggtccagatgcgggacggcgcctggaaggggttcgcggtgaccgtgttcgaggccaaccagaaggacttccgcccccagtgggagcgggagaagctcggcgggaagctggtcatgcgcctgcacaagggcgacgccgtggagctcgagagctccggcgtgcggctggtcaagttcgtgcagcagatctggatgaagtccaacctggtgctcctgacggagcacaacgagggcggggacctgcagaagcgccaccaggacgccgacgaccccttccggtgggacttcgccaacatcgggaagctcaaggagcgcggctgcgtcgcggtgaaggtggacgagctggggcgcgtcaccaagcggatcagcaacacctga

SEQ ID NO: 1614 - RNA, 3360 nt, synthetic construct
  misc_feature 1..3360: note = Cas9 variant
  source 1..3360: mol_type = other RNA
atgggctaccgcatcgggctggacgtgggcatcaccagcaccgggtacgccgtcctcaagacggacaagaacggcctgccctacaagatcctgaccctcgactccgtgatctacccgcgggccgagaacccccagaccggggcgagcctggccgagccccgccggatcaagcgcggcctgcggcgccggacccgccggacgaagttccgcaagcagcggacccagcagctgttcatccactccggcctcctgagcaagcccgagatcgagcagatcctcgccaccccgcaggccaagtactccgtgtacgagctgcgcgtcgccgggctggaccggcgcctcaccaacagcgagctgttccgggtgctgtacttcttcatcggccaccgcgggttcaagtccaaccggaaggcggagctcaaccccgagaacgaggccgacaagaagcagatgggccagctgctgaacagcatcgaggagatccgcaaggccatcgccgagaaggggtaccggacggtgggcgagctctacctgaaggaccccaagtacaacgaccacaagcgcaacaagggctacatcgacgggtacctgtccacccccaaccggcagatgctcgtcgacgagatcaagcagatcctggacaagcagcgcgagctgggcaacgagaagctcaccgacgagttctacgcgacctacctgctgggggacgagaaccgcgccggcatcttccaggcccagcgggacttcgacgagggcccgggggccggcccctacgccggggaccagatcaagaagatggtgggcaaggacatcttcgagcccacggaggaccgcgcggccaaggccacctacaccttccagtacttcaacctcctgcagaagatgaccagcctgaactaccagaacacgaccggggacacctggcacaccctcaacggcctggaccggcaggccatcatcgacgccgtgttcgcgaaggccgagaagcccacgaagacctacaagccgaccgacttcggcgagctgcgcaagctcctgaagctgcccgacgacgcccggttcaacctcgtcaactacgggtccctgcagacccagaaggagatcgagacggtggagaagaagacccgcttcgtggacttcaaggcctaccacgacctggtcaaggtgctccccgaggagatgtggcagagccggcagctgctggaccacatcggcaccgccctcaccctgtactccagcgacaagcgccggcgccggtacttcgcggaggagctgaacctccccgccgagctgatcgagaagctgctcccgctgaacttctccaagttcgggcacctgagcatcaagtccatgcagaacatcatcccctacctggagatgggccaggtgtacagcgaggccacgaccaacaccgggtacgacttccgcaagaagcagatctccaaggacaccatccgggaggagatcacgaaccccgtcgtgcgccgggccgtgaccaagaccatcaagatcgtcgagcagatcatccgccggtacggcaagcccgacggcatcaacatcgagctcgcccgcgagctggggcggaacttcaaggagcgcggcgacatccagaagcgccaggacaagaaccggcagaccaacgacaagatcgcggccgagctgacggagctcgggatcccggtgaacggccagaacatcatccgctacaagctgcacaaggagcagaacggggtggacccctacaccggcgaccagatccccttcgagcgggccttcagcgagggctacgaggtcgaccacatcatcccctacagcatctcctgggacgacagctacaccaacaaggtgctgacctccgccaagtgcaaccgcgagaaggggaaccggatcccgatggtgtacctcgcgaacaacgagcagcgcctgaacgccctgaccaacatcgccgacaacatcatccggaacagccgcaagcggcagaagctcctgaagcagaagctgtccgacgaggagctcaaggactggaagcagcgcaacatcaacgacacgcggttcatcacccgcgtcctgtacaactacttccggcaggccatcgagttcaaccccgagctggagaagaagcagcgcgtgctccccctgaacggcgaggtcaccagcaagatccggtcccgctgggggttcctgaaggtgcgggaggacggcgacctccaccacgccatcgacgcgaccgtgatcgccgccatcacgcccaagttcatccagcaggtcaccaagtacagccagcaccaggaggtgaagaacaaccaggccctgtggcacgacgccgagatcaaggacgcggagtacgccgccgaggcccagcgcatggacgccgacctgttcaacaagatcttcaacggcttcccgctcccctggcccgagttcctggacgagctgctcgcgcggatctccgacaacccggtggagatgatgaagtcccgcagctggaacacctacacccccatcgagatcgccaagctgaagcccgtcttcgtggtgcggctggccaaccacaagatcagcgggcccgcccacctcgacacgatccgctccgcgaagctgttcgacgagaagggcatcgtcctgagccgcgtgtccatcaccaagctcaagatcaacaagaagggccaggtggccaccggggacgggatctacgacccggagaacagcaacaacggcgacaaggtcgtgtactccgccatccggcaggccctggaggcccacaacggcagcggggagctggcgttccccgacggctacctcgagtacgtggaccacgggaccaagaagctggtccgcaaggtgcgggtggccaagaaggtctccctgcccgtgcgcctcaagaacaaggccgccgccgacaacggcagcatggtgcggatcgacgtcttcaacacggggaagaagttcgtgttcgtgcccatctacatcaaggacaccgtcgagcaggtcctgccgaacaaggcgatcgcccgcggcaagagcctgtggtaccagatcaccgagtccgaccagttctgcttcagcctctaccccggcgacatggtgcacatcgagtccaagaccgggatcaagcccaagtacagcaacaaggagaacaacacgtccgtggtgcccatcaagaacttctacggctacttcgacggggccgacatcgccaccgccagcatcctggtgcgggcgcacgactccagctacaccgcccgctccatcggcatcgccgggctgctcaagttcgagaagtaccaggtcgactacttcggccggtaccacaaggtgcacgagaagaagcgccagctgttcgtgaagcgggacgagtga

SEQ ID NO: 1615 - RNA, 3360 nt, synthetic construct
  misc_feature 1..3360: note = Cas9 variant
  source 1..3360: mol_type = other RNA
atgaacgacaagaagaacctgggccccctcaccttcgggttcgacatcggcatcgccagcgtggggtgggccgtcctgtccccgacccgcatcgtggacctgggcgtgcggtgcttcgacaaggcggagacggccaaggagggggagagcctcaacctggcccgccggtccgcccgcctgatgcggcgccggctccgccggcgcgcctggcggctgatcaagctggcgcgcctcctgaagcacgagggcctgatcgccgacaccaagaccttcatccagcccagcgcctcccacgccagcccctggcagctccggaaggacggcctggaccgcgcgctgtcccccgaggagtgggcccgggtcctctaccacctgtgcaagcaccgcgggttccactgggtgagccgggccgaggcccgcaaggccgacggcgacaccaagggggagggcgggaaggtgaagcagggcctggcgtccacgaccaagctcatgaacgacaagagctaccggaccgccgccgagatggtcctggccgagttcccgtccgcccagcgcaacaagcggggcgagtacaccaaggcgctgagccgcgagctcctggacaacgagctgaagcagctgttcgagcgccagcgggagtacgggaacccccacgccgacacgaacctcgaggccaagatccgcggctccggggaccacaagagcggcctgttctgggagcagaagcccgccctctccggcaacgacctgctgaagatgctcgggaagtgcaccttcgagaagcaggagtaccgggcccccaaggcgagcttcaccgccgagcgccacgtgtggctgacccggctgaacaacctccgcatcatcgtggacggccggacgcgcccgctggccgacgccgagcggaccatggccctgtccctcccctacgagcaggtcggggacttcacctacaagcagctgcgcgcggccctggtgaaggccggcctcatgcccgacagcttcaagttcgcctccctggcgtaccccagcgagttccagaaggccgaggggaaggccaaggacccggagagcgccgccctgaccaagctcgcggcctggcaggagctgcgggccacgctgaagaaggccgacctcgagtccgagtggcagcagatcagctgcgccgcgctggagggccagcccgagaccctggacgagatcgccggcgtgctctccgtcttcaaggacgacgacgaggtgctgaacgagctgcagaagctggggctccccggcggggccaagaccgagaacgccctgctggacatccgcttcgacaagttccacgccctcagcctgaaggcgctgcggaagatcgtgccctacatggagcgcggcctccggtacgacgaggcctgcgagcgcgccgagtaccaccactcccagctgcacaaggtcggggagggcaaccggaagtacctgccgcccctctacaagagccgcgacaaggacggccggatggtgttcaacgacgagctgggggacatcccccgcaaccccgtggtcctgcgctccctcaaccaggcccggaaggtgctgaacgcgctgatcgcccgctacggcagcccgtccagcgtgcacatcgagatggcccgggagctctccaagcccttcgacgagcgcatgaaggtcgggaaggagcaggaggcctaccgggagcgcaacgagaaggacaagcagaccttcgtggccgagttcggcatcgtgggggcggccaagggcggcgagttcgagaagtggaagctgtaccgggagcagcaggggaagtgcgcctacagcatccagggcatcgacctgaaccgcctcctggagcccgggtacgtcgagatcgaccacgccctgccctactcccggagcttcgacgactccaagagcaacaaggtgctcgtcctggccgcggagaaccgcaacaagggcaaccggacgccgtacgagtacctggacggcgagcacaactccgagcgctggcggcagttcgtggggttcgtggagagcaacaagctctaccgccaggccaagcggtcccgcctgctgcggaaggacttcggcaaggagcaggccgacgagttccgcgagcggaacctcaacgacacccgctacgtctgccggttcttcaagaaccaggtggagcagttcctgaagctggccgaggggagcgagagcaagcgctgcgtggtcctctccggccagctgaccgccttcctgcgcgcgcggtgggggctcatcaaggtgcgcgacgagagcgaccggcaccacgccctggacgccgtggtcgtggccgcgtgcacccacggcatggtgaagcgcatgtccgactacgcccggcgcaaggagctggaccaggtcgccgagggcttcgtggacgtggagacgggggagatcatcaacgccgccatgttccagcagctccacgagcacttccccgacccctggccccacttccgggacgaggtccagatgcgcctgaagatcgacgacccggcgcagctgcggagcgacctcctgcgcctgggcaactacgccgaggaggacgtgcacgccgtgcggcccctcttcgtctcccgcgcgccccagcggcgcaacagcggggccgcccacaaggagaccatctacggccagccggagcggctgaaggcccagggcggggtgaccgagaaggtggccctgaccgccctcacgatgaaggacctggaccgcctgatcgacccccaccggaacgagaagctctacgccgcgatccgcaagcggctggaggagttcggcgggaaggccgacaaggccttcgccgcctccaaccccctgcacaagcccgacaaggagggcaacccgaccgggcccatcgtccgcaccgtgaccctcgagatcgacaagctgagcggcgtgcccgtccgcgggggcatcgcgaagaacgacacgatgctgcgggtggacgtgttcaccaaggccggcaagttccacctcgtccccgtgtacgtgcaccacaaggtcaccgggctgccgaaccgcgccatcgtggcctccaaggacgaggacgagtggaccgcgatcgacgacagcttcgagttcctgttctccctctaccccaacgacctggtgacgatcacccagaagggcaaggcccccgtccgggggtactacgccagctgccaccgcggcaccggggccttctccctgtgggcccacgaccgggcgagctccgtgggcaagggcgggcagatcgagggcatcgggatcaagaccgccctcgccgtgcagaagtacaacgtcgacgtgctgggcaccacgtacgccgcgcccctggagcagcgccggggcctcgcctga

SEQ ID NO: 1616 - RNA, 3363 nt, synthetic construct
  misc_feature 1..3363: note = Cas9 variant
  source 1..3363: mol_type = other RNA
atgcgcaaggtgaccatcggcttcgacatcggggtcagctccgtgggctggagcgtggtcgacatgaacaacggggccatcgtggagaccggcgtgcggctgttctccgccagctccgcggagaacaacgtcgagcgccggaacaaccgccagacgcggcgcctcaaccggcgccggaagaaccgcctgaaggacgtgaagtacctgctcgagaccaaccacttcaccttcgaccaggagcaggggaccaacccctacgagctgcgggtggccggcctgcaccgcaagctcacgcggagcgagctggcccgcgccctgtaccacctcgtcaagcggcgcggcatctcctacgacctgaccgacatcgaggaggaggagatcgtgaccaccagcgcctacaagacggcgctggggaagaaccagtcccagctcgccgagaagaccccgggcgagatccagttcgcccggctggagaactacgggaaggtgcgcggcagcatcgagatcaacgagcaggacatcctgctcaacatcttccccacctccgcctacctgaacgaggcgaagcggatcctggccacccagcgcaagttctaccccgagatcacggaggccttcatcgagaagtactgcaccatcctcacccggaagcgcgagtactacgtcgggcccggcaccgagaagaaccgcacggactacggcatctaccggaccaacggggagaccctggacaacctgttcgagatcctcatcggcaaggacaagttctacccgaacgaggagcgcgccgccgggaacagctacaccgcgcagctgttcaacttcgtgaacgacctgaacaacctcaagatccagacgatcgaggaccagaagctgacccccaagcagaaggaggagatcatcgagcaggtcaagaccgccgagaagaaggtgtccctgatccagctcatcagcaagatcaccaagacgcccaaggaccagatcaccggctaccggaccgacaagaacggcaagcccgacctgcactccatggccgtgttccgcaaggtgcggaagcagttcctgaccatggagatcgacatcctccactggccggacgagctgctgaacgacctcgggcgcctgctgacgctcaacaccgagaagggcgagatccggaagcagctgaccaaggacttcatgaagcgctaccccatcctgaacgagcagctcgtcgaccagatcatcgagaaccggcacatcttcgccgtgagcgggaaccacaagtggcaccgcttctccctgcggaccatgaacgagctgctccccgagatgctggccacgagcaaggagcagatgaccctgctctccgagcgcggcatgatcaagcagcacaagcgggactacctgaagatgaacgagctggacgcgcgcctcatcagcgaggagatctacaaccccgtggtcggcaagagcgtgcgggaggccatcaagctgttcaacgagctgatgaagaagtaccaggaggtgcgctacgtcgtgctggagatgccgcgggacgacaacgaggagaaggccaagaaggagctccagaagtaccagaaggagaacgagaacgagaaggagatcgccctgtccgagttccagcgcaaggggttcttcagcgacgcccagctggagcgggcgctcatcaaggaccgcaagctgaagaccaagatccgcttctggcaccagcaggagggcaagtgcctgtactccgggcagatcatcacccccgtcgagctcctgacgaacagcttctccttcgacatcgaccacatcatcccccagagcgtgtccttcgacgacagcctgaacaacaaggtgctctgcaccaaggagatgaacgaccagaagggcaagcagaccccctacgggttcctgctgaacggcaacgggcagggcttcgaccggttcaaggccatggtcaacgccaaccgcctcatgtccaagggcaagaagaagaacctgctgttcatggaggacctcaacaacatcgagacccggaagcgcttcatcgcccggaacctggtggacacccgctacgccagccgggtggtcctgaacgagatccagcagtacctccgcgcgaagaacaaggacacccaggtggccgtggtccgggggaagttcacggccaccctgcgcaagcactggaacatcaacaagtcccgggagacccaccaccaccacgccctggacgcgagcatcatcgccatcacgccgctcctgtccgtgtggaagaagaagcagaccctgatccccaagaccctcagcgaggagaagctggagttcgagtacgacgacatcgtggaggacaccatcttcgagaaggccctgtaccagctccccaaggagaacttcaaggagcagctgaacaactcccagcccaacatcaagttcagctaccaggtcgacaagaagatgaaccgcaaggtgtccgacgccacgatctacagcgtgaagcaggccaagctgtccagcgacaagcagagcgaggagtacgtcctcgcgaagatcaaggacatctactccgtggagggctacaagaccttcgccaagatctacgagaaggacaagagcaagttcctgatggcccagaacgacccgaagaccttcgagaagctggaggagatcatccagtcctaccccagcacccgggagatcatcgtgggggagaaggtcaaggtggtggacgtctcccccttcgagctctaccgcaaggagtacggctacatcacgaagtacgccaagaagaacaacgggcccatcatccggcagctgaagtactacgaccacaagatcggcatgcacctggacatcaccaaccagaagaacaacggcaaggggaagaaggtgatcctccagcagctcaagagctggcgcaccgacgtgtactacaaccacgagaagcaggagtacgagatcatgggcctgaagtactccgacctgcggttcaagaaggaccagtacgggatcccgaaggagcgctaccaggaggtcaagcagatggagaagatcgcgccccagagcgagttctgcttctccctgtaccggaacgaccgcatcaaggtgctgaacaaggagaccgacgaggaggtggagctcctgttcggcgcccggaactacacgagcgccggctacgtcgacctgaagcccatcgaccgcgtggagttcgggaagaaggagtggatccccgtgtaccagtacgccacctccgacggcaagtgcaagaagaagttcgccaagaaggggtacgagatctacaaggtcaacaccaccatcctcggcgagagctactacatcaagaaggagcgcatgctgccgaagaacatcctggactga

SEQ ID NO: 1617 - RNA, 3363 nt, synthetic construct
  misc_feature 1..3363: note = Cas9 variant
  source 1..3363: mol_type = other RNA
atgagcgacctggtgctcggcctggacatcgggatcggctccgtcggggtgggcatcctgaacaaggtgaccggggagatcatccacaagaacagccgcatcttccccgccgcccaggcggagaacaacctcgtccggcgcaccaaccggcagggccgccggctgacgcgccggaagaagcaccgccgggtgcgcctgaaccgcctcttcgaggagatcggcctgatcaccgacttcaccaagatctccatcaacctgaacccgtaccagctccgggtgaaggggctgaccgacgagctgagcaacgaggagctgttcatcgccctgaagaacatggtcaagcaccggggcatctcctacctggacgacgccagcgacgacgggaactccagcgtgggcgactacgcccagatcgtgaaggagaactccaagcagctcgagacgaagacccccgggcagatccagctggagcgctaccagacctacggccagctgcggggcgacttcaccgtcgagaaggacgggaagaagcaccgcctcatcaacgtgttccccacgagcgcctaccggtccgaggcgctgcgcatcctgcagacccagcaggagttcaacccccagatcaccgacgagttcatcaaccggtacctcgagatcctgaccggcaagcgcaagtactaccacgggccgggcaacgagaagtcccggacggactacggccgctaccgcaccagcggggagaccctggacaacatcttcggcatcctcatcgggaagtgcaccttctaccccgacgagttccgggccgccaaggccagctacacggcgcaggagttcaacctgctgaacgacctcaacaacctgaccgtgcccaccgagaccaagaagctgtccaaggagcagaagaaccagatcatcaactacgtcaagaacgagaaggccatgggccccgccaagctgttcaagtacatcgccaagctcctgagctgcgacgtggccgacatcaaggggtaccgcatcgacaagtccggcaaggcggagatccacacgttcgaggcctaccggaagatgaagaccctcgagaccctggacatcgagcagatggaccgcgagaccctggacaagctcgcctacgtgctgacgctgaacaccgagcgggagggcatccaggaggccctcgagcacgagttcgccgacgggagcttctcccagaagcaggtcgacgagctggtgcagttccgcaaggcgaacagcagcatcttcggcaaggggtggcacaacttctccgtgaagctgatgatggagctcatcccggagctgtacgagaccagcgaggagcagatgaccatcctgacgcggctcggcaagcagaagaccacctccagctccaacaagaccaagtacatcgacgagaagctgctgacggaggagatctacaaccccgtcgtggccaagagcgtgcgccaggccatcaagatcgtcaacgccgccatcaaggagtacggggacttcgacaacatcgtgatcgagatggcgcgggagaccaacgaggacgacgagaagaaggccatccagaagatccagaaggccaacaaggacgagaaggacgccgccatgctcaaggcggccaaccagtacaacggcaaggccgagctgccccactccgtgttccacggccacaagcagctggccaccaagatccgcctgtggcaccagcagggggagcggtgcctctacaccggcaagacgatcagcatccacgacctgatcaacaaccccaaccagttcgaggtcgaccacatcctgccgctctccatcaccttcgacgacagcctggcgaacaaggtgctggtctacgccaccgccaaccaggagaaggggcagcgcaccccctaccaggccctcgactccatggacgacgcctggagcttccgggagctgaaggcgttcgtgcgcgagtccaagaccctgagcaacaagaagaaggagtacctcctgacggaggaggacatctccaagttcgacgtgcggaagaagttcatcgagcgcaacctggtcgacacccggtacgccagccgcgtggtgctcaacgccctgcaggagcacttccgggcccacaagatcgacaccaaggtctccgtggtgcgcggccagttcaccagccagctgcgccggcactgggggatcgagaagacgcgcgacacctaccaccaccacgccgtcgacgcgctcatcatcgccgcctccagccagctgaacctgtggaagaagcagaagaacaccctcgtgagctactccgaggaccagctgctggacatcgagaccggcgagctcatcagcgacgacgagtacaaggagtccgtgttcaaggccccctaccagcacttcgtcgacacgctcaagagcaaggagttcgaggactccatcctgttcagctaccaggtggactccaagttcaaccggaagatcagcgacgccaccatctacgcgacccgccaggccaaggtgggcaaggacaaggccgacgagacctacgtcctcgggaagatcaaggacatctacacgcaggacggctacgacgccttcatgaagatctacaagaaggacaagtccaagttcctgatgtaccggcacgacccccagaccttcgagaaggtgatcgagccgatcctggagaactaccccaacaagcagatgaacgagaaggggaaggaggtgccctgcaaccccttcctcaagtacaaggaggagcacggctacatccgcaagtacagcaagaagggcaacgggccggagatcaagtccctgaagtactacgacagcaagctgggcaaccacatcgacatcacccccaaggactccaacaacaaggtcgtgctccagagcctgaagccctggcggaccgacgtgtacttcaacaagaacacggggaagtacgagatcctgggcctcaagtactccgacatgcagttcgagaaggggaccggcaagtacagcatctccaaggagcagtacgagaacatcaaggtccgcgagggcgtggacgagaacagcgagttcaagttcaccctgtacaagaacgacctgctcctgctgaaggacagcgagaacggggagcagatcctcctgcggttcacctcccgcaacgacacgagcaagcactacgtggagctgaagccctacaaccggcagaagttcgagggctccgagtacctcatcaagagcctggggaccgtcgtgaagggcgggcgctgcatcaagggcctgggcaagtccaacatcagcatctacaaggtgcggaccgacgtcctcgggaaccagcacatcatcaagaacgagggcgacaagccgaagctggacttctga

SEQ ID NO: 1618 - RNA, 3363 nt, synthetic construct
  misc_feature 1..3363: note = Cas9 variant
  source 1..3363: mol_type = other RNA
atgggcctggacatcggggtggccagcgtcggcttctccgtgctcgacatcgacaaggggaaggtgatcgagctgggcgcccgcctgttcagcgcgaccgtcgccgccgggaaccaggaccggcgcgacatgcggggcgcccgccggctcctgaaccgcaacaagcagcggcgccaggacaccggcaagctgttcaagaagttcgggctcatcgacgacttcgacaagggctccttctacgacaacttcaaccagaacctgaacccctacgagctgcgggtgaaggggctcacggagcagctgaccaaggaggagctggccgagagcctctaccagatcgtgaagcaccgcggcatctcctacgcgctgaaggacgccgacgtcgacgagggcgggaccgactacagcgtgtccctgaagatcaacagccaggagctcgccgagaagaccccggcccagatccagctgcagcggctgaacgactacggcaaggtgcgcgggcaggtcgtgatcggcgacgaccccgacaaccagaaggtgctcctgaacgtcttccccacgtccgcgtacgagaaggaggccaagcagatcatcgccacccagcagcagttctaccccgagagcctgaccgacaagttcaccgaggagtactgccagatcctcacgcggaagcgcgactacttcgtggggccgggcaacgagaagtcccggaccgactacggcatctacaagaccgacgggcgcaccctggacaacctgttcgaggagctcatcggccacgacaagatctaccccgaggagctgcgggccagcgccgcgtcctacacggcccagctgttcaacgtgctcaacgacctgaacaacctgcgcatcctcaactacgaggacgggaagctgaccaaggaggacaaggagaagatcatcgccgagatcaagaacaacaccaccacgatcaacatgctgaacgtcatcaagaaggtggccggctgcagcaaggacgacatcaaggggttccgggtgaacgagaaggacaagcccgagatctccagcatgcccgtctaccgcaagatccacaaggacctcctgaaggccggcgtggacatctccgactggccggtggagttcatcgacgagctgagcttcatcctcaccctgaacaccgagaacggcgagatccggaagcagctgaacaaccgcctcgcgcccaagttcgacttcctgaacgccgacctgatccagctcatcatcgacaacaaggactccttcgagatcaagaccaacaacaagtggcaccgcttcagcgtcaagacgatgaacaagctgatccccgagatgatggagcggcccgtggagcagatgaccctgctcaacgagatggggctggtgaagaaggacaagaagcgcttcgagaacaacaagtacctgccgtacaaggagatcgccaaggacatcttcaaccccgtcgccagcaagtccgtgcgggaggccctcaagatcgtcaacgcggtgctgaagaagtacggccacatcgactacctggtggtcgagatgccccgcgacaagaacctgaaggaggagcaggacaacatcaaggagttccagaacaagaacaagaaggccaaggacgccgccttcgaggccttcgtcaagagcgtggggtccgagcagcgggtgaaggaggcgctcagcaagaaccgcaagctgcagatgaagatgcggctgtggtaccagcagcaggagatcgacccctacaacggcaagaccatcgacgccaccgacctcatcaacaacccggacaagttcgagatcgaccacatcatcccccagtccatcagcttctacgactccatcaacaacaagacgctgtgcttcgccagcatgaaccaggtgaaggggcagaagaccccctacgagttcatgctggagggccacggccagtcctacgacaagttcaaggccaccgtgatggcgaacaagaacttcgggaaggccaagcgcgccaactacctcttcgaggagaacgtcagcgacatcgagacccggaagcgcttcctgtcccggaacctggtggacacgcgctacagctcccgggtggtcctcaacagcctgcaggacttcttccgcgagaagtccgccgacaccaaggtgaccgtgatccggggcaagttcaccagcaacatgcgcaagcactggcacatcgacaagacgcgggagaccttccaccaccacgccatcgacgcgtccatcatcgccgccacccccttcctgcgcatgtggaagaagggcgggaccatcttcccggtcaaggtgggggaggagagcatcgacatcgagacgggcgagatcctcgacgacaagaacttcgacaaggccatgtacgaggagccctactccggcttcgtgagcgagatcatgaacgccgacgaccggatcaagttcagccaccaggtcgacaagaagatgaaccgcaaggtgtccgacgcgaccatctacagcacccgcaccgggaagctggccaaggacaagaaggacgccgagtacatcgtggccaaggtcaaggacatctactccgtggacggcttcaagaagttcaagaaggtgtacgacaaggacaagaccaagttcctgctctacaagtacgacccccggacgttcagcaagctggagcgcatcatctccgactgccccgacaaggtcgagaaggtgcagaccaacgggaaggtgaaggccgtcgacatcagcccgttcgagatgtaccggcgcgaccacggcatgatcaagaagtactccaagaagggcaacgggcccgcgatcaagcagctgaagtacctcgacaagaagctgggcagccacatcgacatcacccccgccaacgccaacgggaagcacgtgatcctgcagtccctcaagccctggcggaccgacgtgtacctgaaccacgagacgggcgagtacgagatcatggggatcaagtacagcgacctgaagttcaacaagaacgagggctacggcatcaagaaggacaagtacctcgagatcaagaaggtcgaggaggtgtccgagaagtccgagttcatgttcagcctgtaccgcaaggaccgggtgaaggtccaggacatgaagaccggggagagcgtggagctcctgttctggtcccgcaacttcagcaacaagaagtacgccgagctgaagccgatctcccaggcggagaacgacaagaagctgcccgtgtacggcaaggggcggctcatcaagcgcctgatccccaagaactgcaagatctggaaggtcaacaccaccatcctgggcgacccgtactacctcgagaaggagagcgacagccccaaggacatcctggactga

SEQ ID NO: 1619 - RNA, 3366 nt, synthetic construct
  misc_feature 1..3366: note = Cas9 variant
  source 1..3366: mol_type = other RNA
atgagcgacctggtgctcggcctggacatcgggatcggctccgtcggggtgggcatcctgaacaaggtgaccggggagatcatccacaagaacagccgcatcttccccgccgcccaggcggagaacaacctcgtccggcgcaccaaccggcagggccgccggctgacgcgccggaagaagcaccgccgggtgcgcctgaaccgcctcttcgaggagtccggcctgatcaccgacttcaccaagatcagcatcaacctgaacccgtaccagctccgggtgaaggggctgaccgacgagctgtccaacgaggagctgttcatcgccctgaagaacatggtcaagcaccggggcatcagctacctggacgacgcctccgacgacgggaacagctccatcggcgactacgcccagatcgtgaaggagaacagcaagcagctcgagacgaagacccccgggcagatccagctggagcgctaccagacctacggccagctgcggggcgacttcaccgtggagaaggacgggaagaagcaccgcctcatcaacgtcttccccacgtccgcctaccggagcgaggcgctgcgcatcctgcagacccagcaggagttcaacccccagatcaccgacgagttcgtgaaccggtacctcgagatcctgaccggcaagcgcaagtactaccacgggccgggcaacgagaagtcccggacggactacggccgctaccgcaccaacggggagaccctggacaacatcttcggcatcctcatcgggaagtgcaccttctaccccgacgagttccgggccgccaaggccagctacacggcgcaggagttcaacctgctgaacgacctcaacaacctgaccgtgcccaccgagaccaagaagctgtccaaggagcagaagaaccagatcatcaactacgtcaagaacgagaaggccatgggccccgccaagctgttcaagtacatcgccaagctcctgagctgcgacgtggccgacatcaaggggtaccgcatcgacaagtccggcaaggcggagatccacacgttcgaggcctaccggaagatgaagaccctcgagaccctggacatcgagcagatggaccgcgagaccctggacaagctcgcctacgtgctgacgctgaacaccgagcgggagggcatccaggaggccctcgagcacgagttcgccgacgggagcttctcccagaagcaggtcgacgagctggtgcagttccgcaaggcgaacagcagcatcttcggcaaggggtggcacaacttctccgtgaagctgatgatggagctcatcccggagctgtacgagaccagcgaggagcagatgaccatcctgacgcggctcggcaagcagaagaccacctccagctccaacaagaccaagtacatcgacgagaagctgctgacggaggagatctacaaccccgtcgtggccaagagcgtgcgccaggccatcaagatcgtcaacgccgccatcaaggagtacggggacttcgacaacatcgtgatcgagatggcgcgggagaccaacgaggacgacgagaagaaggccatccagaagatccagaaggccaacaaggacgagaaggacgccgccatgctcaaggcggccaaccagtacaacggcaaggccgagctgccccactccgtgttccacggccacaagcagctggccaccaagatccgcctgtggcaccagcagggggagcggtgcctctacaccggcaagacgatcagcatccacgacctgatcaacaactccaaccagttcgaggtcgaccacatcctgcccctcagcatcaccttcgacgactccctggcgaacaaggtgctggtctacgccaccgccaaccaggagaaggggcagcgcaccccgtaccaggccctcgacagcatggacgacgcctggtccttccgggagctgaaggcgttcgtgcgcgagagcaagaccctgtccaacaagaagaaggagtacctcctgacggaggaggacatcagcaagttcgacgtgcggaagaagttcatcgagcgcaacctggtcgacacccggtacgcctcccgcgtggtgctcaacgccctgcaggagcacttccgggcccacaagatcgacaccaaggtcagcgtggtgcgcggccagttcacctcccagctgcgccggcactgggggatcgagaagacgcgcgacacctaccaccaccacgccgtcgacgcgctcatcatcgccgccagcagccagctgaacctgtggaagaagcagaagaacaccctcgtgtcctacagcgaggaccagctgctggacatcgagaccggcgagctcatctccgacgacgagtacaaggagttcgtgttcaaggccccctaccagcacttcgtcgacacgctcaagagcaaggagttcgaggactccatcctgttcagctaccaggtggactccaagttcaaccggaagatcagcgacgccaccatctacgcgacccgccaggccaaggtgggcaaggacaaggccgacgagacctacgtcctcgggaagatcaaggacatctacacgcaggacggctacgacgccttcatgaagatctacaagaaggacaagtccaagttcctgatgtaccggcacgacccccagaccttcgagaaggtgatcgagcccatcctggagaactacccgaacaagcagatgaacgagaaggggaaggaggtgccctgcaaccccttcctcaagtacaaggaggagcacggctacatccgcaagtacagcaagaagggcaacgggcccgagatcaagtccctgaagtactacgacagcaagctgggcaaccacatcgacatcaccccgaaggactccaacaacaaggtcgtgctccagagcgtgtccccctggcgggcggacgtctacttcaacaacaccacggggaagtacgagatcctgggcctgaagtacgccgacctccagttcgagaaggggaccggcacctacaagatcagccaggagaagtacaacgacatcaagaagaaggagggcgtggactccgacagcgagttcaagttcaccctgtacaagaacgacctgctcctggtgaaggagacggagaccaaggagcagcagctgttccgcttcctcagccggaccatgcccaagcagaagcactacgtcgagctgaagccctacgacaagcagaagttcgagggcggggaggccctgatcaaggtgctcgggaacgtggccaacggcgggcagtgcatcaagggcctgggcaagtccaacatcagcatctacaaggtccgcaccgacgtgctggggaaccagcacatcatcaagaacgagggcgacaagccgaagctcgacttctga

SEQ ID NO: 1620 - RNA, 3366 nt, synthetic construct
  misc_feature 1..3366: note = Cas9 variant
  source 1..3366: mol_type = other RNA
atgaacggcctggtgctcgggctggacatcggcatcgccagcgtcggggtgggcatcctggagaagaactccgggaagatcatccacgccaacagccgcctcttccccgcggccaccgccgacaacaacgtggagcggcgcaagaaccggcaggcccgccggctgaaccgccggaagaagcaccgcggcgtccggttccaggacctgttcgaggactacggcctcctgaccgacttctccaaggtgagcatcaacctgaacccgtaccgcctccgggtggacgggctgaacaagcagctgacgaacgaggagctgttcatcgccctcaagaacatcgtcaagcgccggggcatctcctacctggacgacgcgagcgaggacgggggcaccgtgtccagcgactacgggaaggccgtggaggagaaccgcaagctcctggccgagcagacccccggccagatccagctggagcggttcgagaagtacggccagctccgcggggacttcaccgtcgtggagaacggcgagaagtgccggctgatcaacgtgttctccacgagcgcctacaagaaggaggcggagcgcatcctgcggaagcagcaggagttcaactccaagatcaccgacgagttcatcgaggactacctcaagatcctgaccgggaagcgcaagtactaccacggccccggcaacgagaagtcccggaccgactacgggcgcttccgcaaggacggcacgaccctggacaacatcttcgggatcctcatcggcaagtgcaccttctaccccaacgagtaccgggccagcaaggccagctacaccgcccaggagttcaacctgctgaacgacctcaacaacctgtccgtcccgacggagaccaagaagctgagcgaggagcagaagaagaccatcatcgagtacgccaagtccgcgaagaccctcggggccagcacgctgctgaagtacatcgccaagatgatcgacacctccgtggaccagatccgcggctaccgggtggacgtcaacaacaagcccgagatgcacaccttcgaggtgtaccgcaagatgcagagcctcgagaccatcagcgtgggcgagctgtcccggaacgtcctggacgagctcgcccacatcctgacgctgaacaccgagcgcgaggggatcgaggaggccatcaacaccaagctcaaggacagcttctcccaggaccaggtgctggagctggtgcagttccggaagaacaacagctccctcttcagcaagggctggcacaacttctccctgaagctgatgatggagctcatccccgagctgtacgagaccagcgaggagcagatgacgatcctgacccgcctcgggaagcagaagtccaaggagaccagcaagcggtccaagtacatcgacgagaaggagctgaccgaggagatctacaaccccgtcgtggccaagagcgtgcgccaggcgatcaagatcatcaacgaggccacgaagaagtacggcatcttcgacaacatcgtcatcgagatggcccgggagaacgacgaggaggacgccaagaaggactacatcaagcgccagaaggcgaaccaggacgagaagaacgccgccatggagaaggccgccttccagtacaacgggaagaaggagctgccggacaacatcttccacggccacaaggagctggcgaccaagatccggctctggcaccagcagggcgagaagtgcctgtacaccgggaagaccatccccatctccgacctgatccacaaccagtacaagtacgagatcgaccacgtgctccccctgagcctgtccttcgacgacagcctctccaacaaggtcctggtgctggccacggccaaccaggagaagggccagcgcacccccttccaggccctcgacagcatggacgacgggtggtcctaccgggagttcaagagctacgtgaaggagagcaagctgctgggcaacaagaagaaggagtacctcctgaccgaggaggacatctccaagatcgaggtcaagcagaagttcatcgagcgcaacctggtggacaaccggtacagctcccgcgtggtcctcaacgcgctgcaggacttctacaaggcccacaagttcgacaccacgatcagcgtggtgcgggggcagttcacctcccagctgcgccgcaagtggggcctcgagaagtcccgggagacctaccaccaccacgccgtcgacgccctgatcatcgccgcgagcagccagctgcgcctctggaagaagcacaacaacccgctgatctcctacaaggagggccggttcatcgacagcgagaccggggagatcatctccctgagcgacgacgagtacaaggagctcgtgttcaaggccccctacgaccacttcgtggacaccctgcgctccaagacgttcgaggacagcatcctgttctcctaccaggtcgacagcaagtacaaccggaagatctccgacgccaccatctacgccacccgcaaggccaagctcgacaaggacaagagcgaggagacctacgtgctgggcaagatcaaggacatctacagccaggcggggtacgacgccttcatcaagatctacaacaaggacaagtccaagttcctgatgtaccacaaggacccccagacgttcgagaaggtgatcgaggagatcctccggacctaccccagcaaggagctgaacgacaagaacaaggagatcccgtgcaaccccttcgagaagtaccgccaggagaacggccccatccggaagtactccaagaagggcaacgggcccgagatcaagagcatgaagtactacgacaagaacatcccggagtccttcatcaacatcacccccagcaactccaacaacaaggtcctgctccgccagctgtacccctggcggaccgacgtgtacttcaacccccagacggacaagtacgagctgctcggcctgaagtacgccgacctgcagttcgagaaggccaccgggaagtacagcatcaccatcgacaagtacaacgagatcaaggagaaggagggcgtgtccaaggagagcgagttcaagttcaccctctacaagaacgacctgctgctcatcaaggacacgaagaacaacgaggagcagatcttccgcttcctgtcccggaccatgccgaaccagaaccactacgtcgagctgaagccctacgacaaggggaacttcgagggcaaggagaagatcaaggtgttcaagatgaccagcaacggccgctgcatcaaggggctcggcaagaagtacctgtccatctacaaggtgaagaccgacatcctggggaacaagcacttcatcaagaaggagggcgacgagcccaagctcaagttctga

SEQ ID NO: 1621 - RNA, 3366 nt, synthetic construct
  misc_feature 1..3366: note = Cas9 variant
  source 1..3366: mol_type = other RNA
atgaacggcctggtgctcgggctggacatcggcatcgccagcgtcggggtgggcatcctggagaagaactccgggaagatcatccacgccaacagccgcctcttccccgcggccaccgccgacaacaacgtggagcggcgcaagaaccggcaggcccgccggctgaaccgccggaagaagcaccgcggcgtccggttccaggacctgttcgaggactacggcctcctgaccgacttctccaaggtgagcatcaacctgaacccgtaccgcctccgggtggacgggctgaaccagcagctgacgaacgaggagctgttcatcgccctcaagaacatcgtcaagcgccggggcatctcctacctggacgacgcgagcgaggacgggggcgccgtgtccagcgactacgggaaggccgtggaggagaaccgcaagctcctggccgagcagacccccggccagatccagctggagcggttcgagaagtacggccaggtccgcggggacttcaccgtggtggagaacggcgagaagcggcgcctcatcaacgtcttctccaccagcgcgtaccggaaggaggccgagaagatcctgcgcaagcagcaggagttcaacaaccagatcacggacgagttcatcgaggactacctgaagatcctcaccgggaagcggaagtactaccacggccccggcaacgagaagtcccgcaccgactacgggcgcttccggaccgacggcacgaccctggacaacatcttcggggtgctgatcggcaagtgcaccttctaccccaacgagtaccgcgccagcaagtccagctacaccgcccaggagttcaacctcctgaacgacctgaacaacctcacggtgccgaccgagaccaagaagctgtccgaggagcagaagaaggtcatcgtggagtacgccaaggaggcgaagaccctgggggccagcacgctcctgaagtacatcgtgaagatgatcgacgcctccgtcgaccagatcagcggctaccgggtggacgtgaacaacaagcccgagatgcacaccttcgaggtctaccgcaagatgcagtccctggagaccatcagcgtgggcgagctcagccggaacgtgctggacgagctggcccacatcctcaccctgaacacggagcgcgaggggatcgaggaggccatcaactccaagctgatgggcgtcttcagccaggaccaggtgctcgagctggtccagttccggaagaacaactccagcctgttctccaaggggtggcacaacttcagcctcaagctgatgatggagctgatccccgagctctacgagacctccgaggagcagatgaccatcctgacccgcctgggcaagcagaagtccaaggagacgagcaagcggaccaagtacatcgacgagaaggagctcaccgaggagatctacaaccccgtggtggccaagagcgtccgccaggcgatcaagatcatcaacgaggccaccaagaagcacgggatcttcgacaacatcgtgatcgagatggcccgggagaacaacgaggaggacgccaagaaggactacatcaagcgccagaaggcgaaccaggacgagaagaacgccgccatggagaaggccgccttccagtacaacggcaagaaggagctgccgggcaacatcttcaacgggcacaaggagctggcgacgaagatccggctgtggcaccagcagggcgagaagtgcctctacaccgggaagaccatccccatctccgacctgatccacaaccagtacaagtacgagatcgaccacatcctgcccctcagcctgtccttcgacgacagcctgtccaacaaggtgctcgtccacgccaccgccaaccaggagaagggccagcgcacgcccttccaggccctggacagcatggacgacgcgtggtcctaccgggagttcaagagctacgtgaaggacctgaagtccctcagcaacaagaagaaggactacctgctgaccgaggaggacatcagcaagatcgaggtgaagcagaagttcatcgagcgcaacctcgtcgacacccggtactccagccgcgtggtgctgaacgccctgcaggacttctacaagtcccaccagttcgacaccacgatcagcgtcgtgcgggggcagttcacctcccagctccgccgcaagtggggcctggagaagtcccgggagacctaccaccaccacgccgtggacgccctgatcatcgccgcgagcagccagctccgcctgtggaagaagcagaacaacccgctgatcacctacaaggagggccagttcatcgactcccagaccggggagatcatcagcctcacggacgacgagtacaaggagctggtcttcaaggccccctacgaccacttcgtggacaccctgcactccaagaccttcgaggacggcatcctcttcagctaccaggtggactccaagtacaaccggaagatcagcgacgccaccatctacgccacgcgcaaggccaagctggacaaggacaagtccgaggagacctacgtcctggggaagatcaaggacatctacagccaggcgggctacgacgccttcatcaagatctacaacaaggacaagcggaagttcctcatgtaccacaaggacccccagaccttcgagaaggtgatcgaggagatcctgcgcacctacccctccaaggagcggaacgacaagaacaaggaggtgccgtgcaaccccttcgagaagtaccgccaggagaacggccccatccggaagtacagcaagaaggggaacggccccgagatcaagtgcctgaagtactacgacaacaagctcgggaactacatcgacatcagcccggacggctccgacaaccaggtcgtgctgcagagcctgaagccctggcgcacggacgtgtacttcaaccaccagaccaagaagtacgagctcatggggctgaagtactccgacctgagcttcgagaagggctccggcaagtacagcatctccaacgagaagtacaacagcatcaagcggatcgagggggtcaacgagcagtccgagttcaagttcaccctctacaagaacgacctgatcctgatcaaggacagcgagaacaacgagcagaagctgttccgcttcaactcccggaacgacaccgccaagcactacgtggagctcaagccctacgacaaggcccgcttcgacggccagcaggagctgatcacgatcctcgggaacgtggccaagggcgggcagtgcctgaagggcctgaacaagagcaacatctccatcttcaaggtcaagaccgacgtgctcggcaagaagcacatcatcaagaaggagggggacgagcccaagctgaagttctga

SEQ ID NO: 1622 - RNA, 3366 nt, synthetic construct
  misc_feature 1..3366: note = Cas9 variant
  source 1..3366: mol_type = other RNA
atgagcgacctggtgctcggcctggacatcgggatcggctccgtcggggtgggcatcctgaacaaggtgaccggggagatcatccacaagaacagccgcatcttccccgccgcccaggcggagaacaacctcgtccggcgcaccaaccggcagggccgccggctgacgcgccggaagaagcaccgcatcgtgcggctgaaccgcctcttcgaggagtccggcctgatcaccgacttcaccaagatcagcatcaacctgaacccgtaccagctccgggtgaaggggctgaccgacgagctgtccaacgaggagctgttcatcgccctgaagaacatggtcaagcaccgcggcatcagctacctggacgacgcctccgacgacgggaacagctccgtgggcgactacgcccagatcgtgaaggagaacagcaagcagctcgagacgaagacccccgggcagatccagctggagcggtaccagacctacggccagctgcgcggcgacttcaccgtcgagaaggacgggaagaagcaccggctcatcaacgtgttccccacgtccgcctaccgcagcgaggcgctgcggatcctgaagacccagcaggagttcaacccccagatcaccgacgagttcatcaaccgctacctcgagatcctgaccggcaagcggaagtactaccacgggccgggcaacgagaagtcccgcacggactacggccggtaccgcaccaacggggagaccctggacaacatcttcggcatcctcatcgggaagtgcaccttctaccccgaggagttccgcgccgccaaggccagctacacggcgcaggagttcaacctgctgaacgacctcaacaacctgaccgtgcccaccgagaccaagaagctgtccaaggagcagaagaaccagatcatcaactacgtcaagaacgagaaggccatgggccccgccaagctgttcaagtacatcgccaagctcctgagctgcgacgtggccgacatcaaggggtaccggatcgacaagtccggcaaggcggagatccacacgttcgaggcctaccgcaagatgaagaccctcgagaccctggacatcgagcagatggaccgggagaccctggacaagctcgcctacgtgctgacgctgaacaccgagcgcgagggcatccaggaggccctcgagcacgagttcgccgacgggagcttctcccagaagcaggtcgacgagctggtgcagttccggaaggcgaacagcagcatcttcggcaaggggtggcacaacttctccgtgaagctgatgatggagctcatcccggagctgtacgagaccagcgaggagcagatgaccatcctgacgcgcctcggcaagcagaagaccacctccagctccaacaagaccaagtacatcgacgagaagctgctgacggaggagatctacaaccccgtcgtggccaagagcgtgcggcaggccatcaagatcgtcaacgccgccatcaaggagtacggggacttcgacaacatcgtgatcgagatggcgcgcgagaccaacgaggacgacgagaagaaggccatccagaagatccagaaggccaacaaggacgagaaggacgccgccatgctcaaggcggccaaccagtacaacggcaaggccgagctgccccactccgtgttccacggccacaagcagctggccaccaagatccggctgtggcaccagcagggggagcgctgcctctacaccggcaagacgatcagcatccacgacctgatcaacaaccccaaccagttcgaggtcgaccacatcctgccgctctccatcaccttcgacgacagcctggcgaacaaggtgctggtctacgccaccgccaaccaggagaaggggcagcggaccccctaccaggccctcgactccatggacgacgcctggagcttccgcgagctgaaggcgttcgtgcgggagtccaagaccctgagcaacaagaagaaggagtacctcctgacggaggaggacatctccaagttcgacgtgcagaagaagttcatcgagcgcaacctggtcgacacccggtacgccagccgcgtggtgctcaacgccctgcaggagcacttccgggcccacaagatcgacaccaaggtctccgtggtgcgcggccagttcaccagccagctgcggcgccactgggggatcgagaagacgcgcgacacctaccaccaccacgccgtcgacgcgctcatcatcgccgcctccagccagctgaacctgtggaagaagcagaagaacaccctcgtgagctactccgaggaccagctgctggacatcgagaccggcgagctcatcagcgacgacgagtacaaggagtccgtgttcaaggccccctaccagcacttcgtcgacacgctcaagagcaaggagttcgaggactccatcctgttcagctaccaggtggactccaagttcaaccggaagatcagcgacgccaccatctacgcgacccgccaggccaaggtgggcaaggacaagaaggacgagacctacgtcctcgggaagatcaaggacatctacacgcaggacggctacgacgccttcatgaagatctacaagaaggacaagtccaagttcctgatgtaccggcacgacccccagaccttcgagaaggtgatcgagccgatcctggagaactaccccaacaaggagatgaacgagaaggggaaggaggtgccctgcaaccccttcctcaagtacaaggaggagcacggctacatccgcaagtacagcaagaagggcaacgggccggagatcaagtccctgaagtactacgacagcaagctgggcaaccacatcgacatcacccccaagaactccaacaacaaggtcgtgctccagagcgtgtccccctggcgggccgacgtctacttcaacaagaccacggggaagtacgagatcctgggcctgaagtacgcggacctccagttcgagaaggggaccggcacctacaagatcagccaggagaagtacaacgacatcaagaagaaggagggcgtggactccgacagcgagttcaagttcaccctgtacaagaacgacctgctcctggtgaaggacacggagaccaaggagcagcagctgttccgcttcctcagccggaccatgcccaagaagaagcactacgtcgagctgaagccgtacgacaagcagaagttcgagggcggggaggccctgatcaaggtgctcgggaacgtggccaactccggccagtgcatcaaggggctggccaagagcaacatctccatctacaaggtccgcaccgacgtgctgggcaaccagcacatcatcaagaacgagggcgacaagcccaagctcgacttctga

SEQ ID NO: 1623 - RNA, 3366 nt, synthetic construct
  misc_feature 1..3366: note = Cas9 variant
  source 1..3366: mol_type = other RNA
atgagcgacctggtgctcggcctggacatcgggatcggctccgtcggggtgggcatcctgaacaaggtgaccggggagatcatccacaagaacagccgcatcttccccgccgcccaggcggagaacaacctcgtccggcgcaccaaccggcagggccgccggctgacgcgccggaagaagcaccgccgggtgcgcctgaaccgcctcttcgaggagtccggcctgatcaccgacttcaccaagatcagcatcaacctgaacccgtaccagctccgggtgaaggggctgaccgacgagctgtccaacgaggagctgttcatcgccctgaagaacatggtcaagcaccggggcatcagctacctggacgacgcctccgacgacgggaacagctccatcggcgactacgcccagatcgtgaaggagaacagcaagcagctcgagacgaagacccccgggcagatccagctggagcgctaccagacctacggccagctgcggggcgacttcaccgtggagaaggacgggaagaagcaccgcctcatcaacgtcttccccacgtccgcctaccggagcgaggcgctgcgcatcctgcagacccagcaggagttcaacccccagatcaccgacgagttcatcaaccggtacctcgagatcctgaccggcaagcgcaagtactaccacgggccgggcaacgagaagtcccggacggactacggccgctaccgcaccagcggggagaccctggacaacatcttcggcatcctcatcgggaagtgcaccttctaccccgacgagttccgggccgccaaggcctcctacacggcgcaggagttcaacctgctgaacgacctcaacaacctgaccgtgcccaccgagaccaagaagctgagcaaggagcagaagaaccagatcatcaactacgtgaagaacgagaaggccatgggccccgccaagctgttcaagtacatcgccaagctcctgtcctgcgacgtcgccgacatcaaggggtaccgcatcgacaagagcggcaaggcggagatccacacgttcgaggcctaccggaagatgaagaccctcgagaccctggacatcgagcagatggaccgcgagaccctggacaagctcgcctacgtgctgacgctgaacaccgagcgggagggcatccaggaggccctcgagcacgagttcgccgacgggtccttcagccagaagcaggtcgacgagctggtgcagttccgcaaggcgaacagctccatcttcggcaaggggtggcacaacttcagcgtgaagctgatgatggagctcatcccggagctgtacgagacctccgaggagcagatgaccatcctgacgcggctcggcaagcagaagaccaccagctccagcaacaagaccaagtacatcgacgagaagctgctgacggaggagatctacaaccccgtggtcgccaagtccgtgcgccaggccatcaagatcgtgaacgccgccatcaaggagtacggggacttcgacaacatcgtcatcgagatggcgcgggagaccaacgaggacgacgagaagaaggccatccagaagatccagaaggccaacaaggacgagaaggacgccgccatgctcaaggcggccaaccagtacaacggcaaggccgagctgccccacagcgtgttccacggccacaagcagctggccaccaagatccgcctgtggcaccagcagggggagcggtgcctctacaccggcaagacgatctccatccacgacctgatcaacaacagcaaccagttcgaggtggaccacatcctgcccctctccatcaccttcgacgacagcctggcgaacaaggtcctggtgtacgccaccgccaaccaggagaaggggcagcgcaccccgtaccaggccctcgactccatggacgacgcctggagcttccgggagctgaaggcgttcgtccgcgagtccaagaccctgagcaacaagaagaaggagtacctcctgacggaggaggacatctccaagttcgacgtgcggaagaagttcatcgagcgcaacctggtggacacccggtacgccagccgcgtcgtgctcaacgccctgcaggagcacttccgggcccacaagatcgacaccaaggtgtccgtcgtgcgcggccagttcaccagccagctgcgccggcactgggggatcgagaagacgcgcgacacctaccaccaccacgccgtggacgcgctcatcatcgccgccagctcccagctgaacctgtggaagaagcagaagaacaccctcgtcagctactccgaggaccagctgctggacatcgagaccggcgagctcatcagcgacgacgagtacaaggagtccgtgttcaaggccccctaccagcacttcgtggacacgctcaagagcaaggagttcgaggactccatcctgttcagctaccaggtcgactccaagttcaaccggaagatcagcgacgccaccatctacgcgacccgccaggccaaggtgggcaaggacaaggccgacgagacctacgtgctcgggaagatcaaggacatctacacgcaggacggctacgacgccttcatgaagatctacaagaaggacaagtccaagttcctgatgtaccggcacgacccccagaccttcgagaaggtcatcgagcccatcctggagaactacccgaacaagcagatcaacgagaaggggaaggaggtgccctgcaaccccttcctcaagtacaaggaggagcacggctacatccgcaagtacagcaagaagggcaacgggcccgagatcaagtccctgaagtactacgacagcaagctgggcaaccacatcgacatcaccccgaaggactccaacaacaaggtggtcctccagagcgtgtccccctggcgggcggacgtgtacttcaacaagaccacggggaagtacgagatcctgggcctgaagtacgccgacctccagttcgagaaggggaccggcacctacaagatcagccaggagaagtacaacgacatcaagaagaaggagggcgtcgacagcgactccgagttcaagttcaccctgtacaagaacgacctgctcctggtgaaggacacggagaccaaggagcagcagctgttccgcttcctcagccggaccatgcccaagcagaagcactacgtggagctgaagccctacgacaagcagaagttcgagggcggggaggccctgatcaaggtcctcgggaacgtggccaactccggccagtgcaagaaggggctgggcaagagcaacatctccatctacaaggtgcgcaccgacgtcctgggcaaccagcacatcatcaagaacgagggggacaagccgaagctcgacttctga

SEQ ID NO: 1624 - RNA, 3366 nt, synthetic construct
  misc_feature 1..3366: note = Cas9 variant
  source 1..3366: mol_type = other RNA
atgagcgacctggtgctcggcctggacatcgggatcggctccgtcggggtgggcatcctgaacaaggtgaccggggagatcatccacaagaacagccgcatcttccccgccgcccaggcggagaacaacctcgtccggcgcaccaaccggcagggccgccggctgacgcgccggaagaagcaccgccgggtgcgcctgaaccgcctcttcgaggagtccggcctgatcaccgacttcaccaagatcagcatcaacctgaacccgtaccagctccgggtgaaggggctgaccgacgagctgtccaacgaggagctgttcatcgccctgaagaacatggtcaagcaccggggcatcagctacctggacgacgcctccgacgacgggaacagctccgtgggcgactacgcccagatcgtgaaggagaacagcaagcagctcgagacgaagacccccgggcagatccagctggagcgctaccagacctacggccagctgcggggcgacttcaccgtcgagaaggacgggaagaagcaccgcctcatcaacgtgttccccacgtccgcctaccggagcgaggcgctgcgcatcctgcagacccagcaggagttcaacccccagatcaccgacgagttcgtgaaccggtacctcgagatcctgaccggcaagcgcaagtactaccacgggccgggcaacgagaagtcccggacggactacggccgctaccgcaccaacggggagaccctggacaacatcttcggcatcctcatcgggaagtgcaccttctaccccgaggagttccgggccgccaaggccagctacacggcgcaggagttcaacctgctgaacgacctcaacaacctgaccgtccccaccgagaccaagaagctgtccaaggagcagaagaaccagatcatcaactacgtgaagaacgagaaggccatgggccccgccaagctgttcaagtacatcgccaagctcctgagctgcgacgtggccgacatcaaggggtaccgcatcgacaagtccggcaaggcggagatccacacgttcgaggcctaccggaagatgaagaccctcgagaccctggacatcgagcagatggaccgcgagaccctggacaagctcgcctacgtcctgacgctgaacaccgagcgggagggcatccaggaggccctcgagcacgagttcgccgacgggagcttctcccagaagcaggtcgacgagctggtgcagttccgcaaggcgaacagcagcatcttcggcaaggggtggcacaacttctccgtgaagctgatgatggagctcatcccggagctgtacgagaccagcgaggagcagatgaccatcctgaagcggctcggcaagcagaagacgacctccagctccaacaagaccaagtacatcgacgagaagctgctgaccgaggagatctacaaccccgtggtggccaagagcatccgccaggccatcaagatcgtcaacgccgccatcaaggagtacggggacttcgacaacatcgtgatcgagatggcgcgggagacgaacgaggacgacgagaagaaggccatccagaagatccagaaggccaacaaggacgagaaggacgccgccatgctcaaggcggccaaccagtacaacggcaaggccgagctgccccactccgtgttccacggccacaagcagctggccaccaagatccgcctgtggcaccagcagggggagcggtgcctctacaccggcaagaccatcagcatccacgacctgatcaacaaccccaaccagttcgaggtcgaccacatcctgccgctctccatcacgttcgacgacagcctggcgaacaaggtgctggtctacgccaccgccaaccaggagaaggggcagcgcaccccctaccaggccctcgactccatggacgacgcctggagcttccgggagctgaaggcgttcgtgcgcgagtccaagaccctgagcaacaagaagaaggagtacctcctgaccgaggaggacatctccaagttcgacgtgcggaagaagttcatcgagcgcaacctggtcgacacgcggtacgccagccgcgtggtgctcaacgccctgcaggagcacttccgggcccacaagatcgacaccaaggtctccgtggtgcgcggccagttcaccagccagctgcgccggcactgggggatcgagaagacccgcgacacgtaccaccaccacgccgtcgacgcgctcatcatcgccgcctccagccagctgaacctgtggaagaagcagaagaacaccctcgtgagctactccgaggaccagctgctggacatcgagaccggcgagctcatcagcgacgacgagtacaaggagtccgtgttcaaggccccctaccagcacttcgtcgacaccctcaagagcaaggagttcgaggactccatcctgttcagctaccaggtggactccaagttcaaccggaagatcagcgacgccacgatctacgcgacccgccaggccaaggtgggcaaggacaagaaggacgagacctacgtcctcgggaagatcaaggacatctacacccaggacggctacgacgccttcatgaagatctacaagaaggacaagtccaagttcctgatgtaccggcacgacccccagacgttcgagaaggtgatcgagccgatcctggagaactaccccaacaaggagatgaacgagaaggggaaggaggtgccctgcaaccccttcctcaagtacaaggaggagcacggctacatccgcaagtacagcaagaagggcaacgacccggagatcaagtccctgaagtactacgacagcaagctggggaaccacatcgacatcacccccaaggactccaacaacaaggtcgtgctccagagcgtgtccccctggcgggccgacgtctacttcaacaagaccaccggcaagtacgagatcctggggctgaagtacgcggacctccagttcgagaagggcacggggacctacaagatcagccaggagaagtacaacgacatcaagaagaaggagggcgtggactccgacagcgagttcaagttcaccctgtacaagaacgacctgctcctggtgaaggacaccgagacgaaggagcagcagctgttccgcttcctcagccggaccatgcccaagcagaagcactacgtcgagctgaagccgtacgacaagcagaagttcgagggcggggaggccctgatcaaggtgctcggcaacgtggccaactccgggcagtgcaagaagggcctgggcaagagcaacatctccatctacaaggtccgcaccgacgtgctggggaaccagcacatcatcaagaacgagggcgacaagcccaagctcgacttctga

SEQ ID NO: 1625 - RNA, 3366 nt, synthetic construct
  misc_feature 1..3366: note = Cas9 variant
  source 1..3366: mol_type = other RNA
atgaacggcctggtgctcgggctggacatcggcatcgccagcgtcggggtgggcatcctggagaagaactccgggaagatcatccacgccaacagccgcctcttccccgcggccaccgccgacaacaacgtggagcggcgcaagaaccggcaggcccgccggctgcaccgccggaagaagcaccgcggcgtccggttccaggacctgttcgaggactacggcctcctgaccgacttctccaaggtgagcatcaacctgaacccgtaccgcctccgggtggacgggctgaaccagcagctgacgaacgaggagctgttcatcgccctcaagaacatcgtcaagcgccggggcatctcctacctggacgacgcgagcgaggacgggggcaccgtgtccagcgactacgggaaggccgtggaggagaaccgcaagctcctggccgagcagacccccggccagatccagctggagcggttcgagaagtacggccaggtccgcggggacttcaccgtggtggagaacggcgagaagcggcgcctcatcaacgtcttctccacgagcgcctaccggaaggaggcggagcgcatcctgcggaagcagcaggagttcaactccaagatcaccgacgagttcatcgaggactgcctgaagatcctcaccgggaagcgcaagtactaccacggccccggcaacgagaagtcccgcaccgactacgggcggttccgcacggacggcaccaccctggacaacatcttcgggatcctgatcggcaagtgcaccttctaccccgacgagtaccgggccagcaaggccagctacacggcccaggagttcaacctcctgaacgacctgaacaacctcaccgtgccgaccgagaccaagaagctgtccgaggagcagaagaaggtgatcgtcgagtacgccaaggaggcgaagacgctgggggccagcaccctcctgaagtacatcgccaagatgatcgacgcctccgtggaccagatccgcggctaccgggtggacgtcaacaacaagcccgagatccacaccttcgaggcctaccgcaagatgcagagcctggagaccatctccgtgggcgagctcagccggaacgtgctggacgagctggcgcacatcctcacgctgaacaccgagcgcgaggggatcgaggaggccatcaacaccaagctgaaggacagcttctcccaggaccaggtcctcgagctggtgcagttccggaagaacaacagctccctgttcagcaagggctggcacaacttctccctcaagctgatgatggagctgatccccgagctctacgagaccagcgaggagcagatgacgatcctgacccgcctggggaagcagaagtccaaggagatcagcaagcggaccaagtacatcgacgagaaggagctcaccgaggagatctacaaccccgtggtcgccaagtccgtgcgccaggccatcaagatcatcaacgaggccacgaagaagcacggcatcttcgacaacatcgtcatcgagatggcgcgggagaacaacgaggaggacgccaagaaggactacatcaagcgccagaaggccaaccaggacgagaagaacgccgccatggagaaggcggccttccagtacaacgggaagaaggagctgccggacagcatcttccacggccagaaggagctggccaccaagatccggctgtggcaccagcagggcgagaagtgcctctacaccgggaagaacatccccatctccgacctgatccacaaccagtacaagtacgagatcgaccacatcctgcccctcagcctgtccttcgacgacagcctgtccaacaaggtgctcgtgctggccaccgcgaaccaggagaagggccagcgcacgcccttccaggccctggacagcatggacgacgcctggtcctaccgggagttcaagagctacgtcaaggagtccaagctcctggggaacaagaagaaggagtacctgctcaccgaggaggacatcagcaagatcgaggtgaagcagaagttcatcgagcgcaacctgatcgacacccggtacagctcccgcgtggtcctgaacgccctccaggacttctacaaggcccacaagttcgacaccacgatcagcgtggtgcgcggccagttcacctcccagctgcggcgcaagtgggggctggagaagtcccgggagacctaccaccaccacgcggtcgacgccctcatcatcgccgccagcagccagctgcgcctgtggaagaagcagaacaacccgctcatcgcctacaaggagggccagttcgtggactccgagaccggcgagatcatcagcctgtccgacgacgagtacaaggagctggtgttcaaggcgccctacgaccacttcgtcgacaccctcagctccaagacgttcgaggacagcatcctgttctcctaccaggtggacagcaagttcaaccggaagatctccgacgccaccatctacgccacccgcaaggccaagctggacaaggagaagtccgaggagacctacgtgctcgggaagatcaaggacatctacagccaggccggctacgacgcgttcatcaagatctacaacaaggacaagagcaagttcctgatgtaccacaaggacccccagacgttcgagaaggtcatcgaggagatcctgcggacctaccccagcaaggagctcaacgacaagaacaaggagatcccgtgcaaccccttcgagaagtaccgccaggagaacgggcccatccggaagtactccaagaagtccaacggccccgagatcaagagcctgaagtactacgacaacaagctgggcaaccacatcgacatcaccccggagagctccgacaaccaggtggtgctccagagcctgaagccctggcgcaccgacgtctacttcaaccaccagacgaagaagtacgagctgatggggctcaagtactccgacctgagcttcgagaagggctccgggaagtacagcatctccaaccagaagtacaacagcatcaagcggatcgagggcatcgacgagcagtccgagttcaagttcaccctgtacaagaacgacctcatcctgatcaaggacagcgagaacaacgagcagaagctgttccgcttcaactcccggaacgacaccgccaagcactacatcgagctcaagccctacgacaaggccaagttcgacggggagcaggagctgatcaccatcctgggcaacgtggccaagggcgggcgctgcctcaagggcctgaacaagagcaacatctccatcttcaaggtgaagacggacgtcctggggaagaagcacatcatcaagaaggagggcgacgagcccaagctcaagttctga

SEQ ID NO: 1626 - RNA, 3366 nt, synthetic construct
  misc_feature 1..3366: note = Cas9 variant
  source 1..3366: mol_type = other RNA
atgaacggcctggtgctcgggctggacatcggcatcgccagcgtcggggtgggcatcctgaacaaggacaccggggagatcatccacaccaactcccgcatcttccccgccgcgacggccgacaacaacgtggagcggcgcaacagccggcaggaccgccggctcaaccgccggaagaagcaccgcggcgtccggctgcacgacctgttcgaggactacgacctcctgaccgacttctccaaggtgagcatcaacctgaacccgtaccgcctccgggtgcagggcctggacaactccctgaccaccgaggagctgttcatcgccctcaagaacatcgtcaagcgccgggggatcagctacctggacgacgcctccgaggacggcggggtggtgagctccgactacggcaaggccgtcgaggagaaccgcaagctcctggcggagcagacgcccgggcagatccagctggagcggttcaagaagtacggccaggtgcgcggcgacttcaccgtggtcgagaacggggagaagcggcgcctcatcaacgtgttcagcacctccgcctaccggaaggaggccgagcgcatcctgcggaagcagcaggagttcaacaaccagatcaccgacaagttcatcgaggactacctgaagatcctcacggagaagcgcaagtactaccacggccccgggaacgagaagtcccgcaccgactacggccggttccgcaccgacggcaccacgctggacaacatcttcgggatcctgatcggcaagtgcaccttctaccccaacgagtaccgggccagcaaggcgagctacaccgcccaggagttcaacctcctgaacgacctgaacaacctcaccgtgccgacggagaccaagaagctgtccgaggagcagaagaagaccatcgtcgagtacgccaagagcgccaagaccctgggggcctccacgctcctgaagtacatcgcgaagatgatcgacgccagcgtggaccagatccgcggctaccgggtggacgtcaacaacaagcccgagatgcacaccttcgaggtgtaccgcaagatgcagtccctggagaccatcagcgtgtgggagctcagccggaacatcctggacgagctggcccacatcctcaccctgaacacggagcgcgaggggatcgaggaggccatcaacaccaagctgatggacgtcttctcccaggaccaggtgctcgagctggtgcagttccggaagaacaacagctccctgttcagcaagggctggcacaacttctcccgcaagctcatgatggagctgatccccgagctgtacgagaccagcgaggagcagatgaccatcctcacgcggctgggcaagcagaagtccaaggagaccagcaagcgcaccaagtacatcgacgagaaggaggtcaccgaggagatctacaaccccgtggtcgccaagtccgtgcggcaggcgatcaagatcatcaacgaggccacgaagaagtacgggatcttcgacaacatcgtgatcgagatggcccgcgagaacaacgaggaggacgccaagaaggactacatcaagcggcagaaggccaaccaggacgagaagaacgtcgcgatcgagaaggccgccttccagtacaacggcaagaaggagctgccggacagcatcttccacgggcacaaggagctcgccaccaagatccgcctgtggcaccagcagggcgagaagtgcctgtacaccgggaagaacatccccatctccgacctgatccacaaccagtacaagtacgagatcgaccacatcctccccctgagcctgtccttcgacgacagcctctccaacaaggtgctggtgctggccaccgcgaaccaggagaagggccagcggacgcccttccaggccctcgacagcatggacgacgcctggtcctaccgcgagttcaagagctacgtcaaggactccaagctgctgggcaacaagaagaaggactacctcctgaccgaggaggacatcagcaagatcgaggtgaagcagaagttcatcgagcggaacctggtggacacccgctacagctcccgcgtcgtgctcaacaccctgcaggacttctacaaggcccacaagttcgacaccacgatcagcgtggtccgggggcagttcacctcccagctgcgccggaagtggggcctcgagaagtcccgcgagacctaccaccaccacgcggtggacgccctgatcatcgccgccagcagccagctgcggctctggaagaagcaggccaacccgctgatctcctacaaggaggaccagttcgtggacagcgagaccggggagatcatctccctgacggacgacaagtacaaggagctcgtcttcaaggcgccctacgcccacttcgtggacaccctgagctccaagaagttcgaggacagcatcctgttctcctaccaggtggacagcaagtacaaccgcaagatctccgacgccaccatctacgccacccggaaggtcaagctcgacaaggacaagagcgaggagacgtacgtgctgggcaagatcaaggacatctactcccaggccgggtacgacgcgttcatcaagatctacaacaaggacaagagcaagttcctgatgtaccacaaggacccccagaccttcgagaaggtgatcgaggagatcctccgcatctaccccagcaaggagttcaacgagaagaacaaggaggtcccgtgcaaccccttcgagaagtaccggcaggagaacggccccatctgcaagtactccaagaagggcaacgggcccgagatcaagagcctgaagtactacgacaagaacatcccggagtccttcatcgacatcacccccagcaactccaagaacaaggtgatcctgcgccagctcaacccctggcggaccgacgtgtacttcaaccaccagacggagaagtacgagctgctgggcctcaagtacgccgacctgcagttcgagaagaagaccgagacctacagcatcaccatcgacaagtacaacgagatcaaggagaaggagggggtcggcgagcactccgagttcaagttcacgctgtacaagaacgacctcctgctgatcaaggacatggagatcaaggaggagcagatcttccgcttcctcagccggaccatgcccaacaagaagcactacgtggagctgaagccgtactacaagggcaacttcgaggggaaggagcgcatcaaggtgttcaacaccacctccaacggccggtgcctgaaggggctcggcaagaaggggctgagcatctacaagatcaagacggacgtcctgggcaacaagcacttcatcaagaaggagggcgagaagcccaagctcaagttctga

SEQ ID NO: 1627 - RNA, 3366 nt, synthetic construct
  misc_feature 1..3366: note = Cas9 variant
  source 1..3366: mol_type = other RNA
atggaccgcaccgaggtgaacatcggcttcgacatcgggatcagctccgtcggctggagcgtggtggccaccaagtccgggcggatcctggagagcggcgtctccctcttcagcggggcctccgcggccaagaacgaggagcgccggaacttccgccagagccggcgcctgctgcggcgccggaagaaccgcatctccgacctcaagaagtacctgaaggagcagagcttcacgtacaacggcgagctgctcaacgagaacccctacgagatccgggtgaagggcctgaccgagaagctgtccaaggaggagatcgccctcgccctgctgcacatcgtgaagcgccgcggggtcagctacgacctcggcgacatcgaggaggaggggaccaccggctcctacaaggagggggtgaagaagaaccagaagctgctgaaggagaagacgccggccgagatccagttccagcggctcaagaagttccacaaggtgcggggccagatcgcgatcgacgagaacgacgtcctgctgaacgtgttccccaaccacgcctacgtggacgaggcccagcagatcctctacacccagcaggagttctaccccgagatcaacgagaccttcatcaaccaggtcaccgacttcatcagccgcaagcgggactacttcatcggccccgggtccgagaagtcccgcacggactacggcatctaccggaccgacgggaccaccctgcagaacctgttcagcatcctcatcggcaaggacaagatcttcccggacgagttccgcgccgcgggcaacagctacacggcccaggtgtacaacctgctgaacgacctcaacaacctggccatcgacgacaccgagaccgggaagctgaccaagcagcagaaggagaagatcatcatggagctcaagacgaccgagaagtccgtgaacatgatgaagctgatcgccaagaccgccggcgtcaccgtggagcagatcagccggtaccgcatcaaccgcgacggcaagagcgagatccacaacatggcggtgtaccggaagatccgcaaggtcttcctggagctcgggtacgagatcaacgagtggccctcccagctgctggacgagctcggggacgccctgagcctgaacacggagaacggcgagatccggcgcatcctcaccgacaacctggccaacaagtacaagatcctggaccagcagctcatcaacctgatcatcgagaacaagaacgccttcaccctgtccaccaaccagaagtggcaccggttcagctacaagacgatgaagatcctcatccccgagctgctggagaccaacaaggagcagatgaccatcctcaccgagatgggcctgatgaagaaggaccagcgcaactacgtggggaagaacaagatcgactccgaggccctgctcgagaacctgtacaaccccgtggtccgcaagagcacgcggcagaccatgaagctgttcaacaccctgctcaagaagtacccgaacatcgcgtacgtggtgatcgagatgccccgggaggacgacgaggacaaggcccgccgggactacgtcaagttccagaaggacaacgagaaggagaaggacgccgccctgaagaacttcatcatggagtccggcaagagcgaggccgaggtgatcgcgaagtaccgccagtccaagaagttccggagcaaggtccgcctgtggtaccagcagatggggcggtgcctctactccggcaaggccatgcccgccgagcgcgtgttccgggacgaccacttcaccgacatcgaccacgtgatccccctgagcgtctccttcgacgacgggatgaacaacaaggtgctgtgcctcgccgagatgaaccgccagaaggacaagcagacgccgtacgccttcttcaacgcgggccacggccaggggttccaggccatgaacgccatgctgaagaacaacaaccggatcagctccgccaagaagcgcaacctcctgttcaccgagaacctgaacgacctggaggtgcgcaagcggttcatcgagcgcaacctcgtcgacacccggtacgcgagccgcgtggtgctgaacgagctgcagcagttcgtcaaggccaagcagctcgacaccaaggtgacggtgatccggggcaagttcacctccaagctgcgcgagaagtggaacatcaacaagagccgggacacccaccaccaccacgccgtcgacgccgccgtgatcgcggtgtcccccatgctgaacctctgggagaagggggccagcatcatccccaacaaggtcggcgagaacgtgatcgacatcaagaccggggagatcatcaccgaccacgactacgaggccgacgtgtacgagctgccctacgccaagttcctggagcagatcccgaaggtcaagaaggacatcaagttccgccaccaggtggacaagaagaagaaccggaaggtgagcgacgccacgatctacaccacccgcaaggcgaaggtcggcaaggacaaggaggagaccgactacgtgctcggcacgatcaaggacatctactccctggaggggtacgtgagcttcaagaagatctacaacaaggacaaggccaagttcctgatggcccggatcgaccccaagaccttcgagaagctcgagaagatcgtcgccgagtaccccgagtccatcgaggtggtgcaggacaacggcaaggtcgacgtgcagaagatcagccccttcgagctgtaccgcaaggacaacgggttcgtgaccaagttcgccaagaagaacaacggcccggcggtcaagtccctgaagtactacgacagcaagctcggctccagcatcgacgtgacccccgacaacgccaagaacaagaaggtgatcctgcagtccctgaagccctggcggacggacgtctacttcaacgaggagaaccaggagtacgagatcatggggctcaagtacagcgacctgaagttcggcaagaacgggaagtacggcgtgcccaaggtgcgctacgaggagatcaagcaggaggaggagatctccgaggggagcaagttcctgttctccctctaccggggcgaccgcatcaaggtcaccaacgagctgggcgagaacctggacctcctgttcagctcccggaccctgccggcccagaaggggtacgtggagctcaagcccatcgacaagaccaagttcgacggcaaggagaaggtgagcttctacgggacggtcacccccaacggccagttcgtgaagaagttcgccaagaaggggtacaagatcctgaagctgaacaccgacgagctcggcaacacctacatcgagaacggcgagaaggagccctccgacatcctggacatgtga

SEQ ID NO: 1628 - RNA, 3366 nt, synthetic construct
  misc_feature 1..3366: note = Cas9 variant
  source 1..3366: mol_type = other RNA
atgaacggcctggtgctcgggctggacatcggcatcgggagcgtcggcgtggggatcctgaacaaggacaccggcgagatcatccacgccaactcccgcatcttccccgccgcgaccgccgacaacaacgtggtccggcgcagctcccggcagggccgccggctcaaccaccgcaagaagcaccggagcgtgcgcctgaaggacctgttcgagtactacgacctcctgacggacttctccaaggtgagcatcaacctgaacccgtaccggctccgcgtcaacgggctgaaccagcagctgaccaacgaggagctgttcatcgccctcaagaacatcgtgaagcggcgcggcatctcctacctggacgacgccagcgaggacgggggcgccgtgtccagcgactacgggaaggcggtcgaggagaaccggaagctcctggccgagcagacccccggccagatccagctggagcgcttcgagaagtacggccaggtgcgcggggacttcaccgtggtcgagaacggcgagaagcggcggctcatcaacgtgttctccacgagcgcctacaagaaggaggccgagcgcatcctgcggaagcagcaggagtacaacaaccagatcatggacgagttcatcgcggactacctgaccatcctcaccgggaagcgcaagtactaccacggccccggcaacgagaagtcccggaccgactacgggcgcttccgcacggacggcaccaccctggacaacatcttcgggatcctgatcggcaagtgcaccttctaccccgagaagtaccgggccagcaaggcctcctacacggcccaggagttcaacctcctgaacgacctgaacaacctcaccgtgccgaccgagaccaagaagctgagcgaggagcagaagaagacgatcgtcgagtacgccaagtccgcgaagaccctgggggccagcaccctcctgaagtacatcgccaagatgatcgacgcctccgtggaccagatccgcggctaccgggtggacgtcaagaacaagcccgagatgcacaccttcgaggtgtaccgcaagatgcagagcctggagacgatcagcgtgggcgagttctcccgggaggtcctcgacgagctggcccacgtgctgaccctcaacaccgagcgcgaggggatcgaggaggcgatcaacaccaagctgcgggacagcttctcccaggaccagatcctggagctcgtgcagttccgcaagaacaacagctccctgttcagcaagggctggcacaacttctccctgaagctcatgatggagctgatccccgagctgtacgagacgagcgaggagcagatggccatcctcacccggctggggaagcagaagttcaaggagacctccaagcgcaccaagtacatcgacgagcaggaggtcacggaggagatctacaaccccgtggtcgccaagagcgtgcggcaggccatcaagatcatcaacgaggccaccaagaagtacggcatcttcgacaacatcgtgatcgagatggcgcgcgagaacaacgaggaggaggccaagaaggactacatcaagcggcagaaggccaaccacgacgagaagaacgccgccatggagaaggcggccttccagtacaacggggagaaggagctgccggactccatcttccacggccacaaggagctcgccaccaaggtccgcctgtggcaccagcagggcgagaagtgcctgtacaccgggaagaacatccccatcagcgacctgatccacaaccagtacaagtacgagatcgaccacatcctccccctgtccctgagcttcgacgactccctcagcaacaaggtgctggtgctggccacggcgaaccaggagaagggccagcggacccccttccaggccctcgactccatggacgacgcctggagctaccgcgagttcaagtcctacgtcaaggacagcaagagcctggggaacaagaagaaggactacctgctcaccgaggaggacatctccaagatcgaggtgaagcagaagttcatcgagcggaacctggtggacacccgctacagctcccgggtcgtgctgaacacgctccaggacttctacaaggcccacaagttcgacaccaccatcagcgtggtccgcggccagttcacctcccagctgcgccggaagtgggggctggagaagtcccgcgagacctaccaccaccacgccgtggacgcgctcatcatcgccgccagcagccagctgcggctgtggaagaagcagaacaacccgctcatctcctacaaggagggccagttcgtggacagcgagacgggcgagatcatctccctgaccgacgacgagtacaaggagctggtcttcaaggccccctacgaccacttcgtggacaccctccgcagcaagaagttcgaggactccatcctgttcagctaccaggtggactccaagttcaaccggaagatcagcgacgccaccatctacgcgacgcgcaagaccaagctggacaaggacaagtccgaggagacctacgtcctcgggaagatcaaggacatctacagccagagcggctacgacgccttcatcaagatctacaacaaggacaagtccaagttcctgatgtaccacaaggacccccagaccttcgagaaggtgatcgaggagatcctgcggacgtaccccagcaaggagttcaacgagaagaacaaggaggtgtcctgcaacccgttcgagaagtacaagcaggagaacgggcccatccgcaagtacagcaagaagggcaacggccccgagatcaagtccctcaagtactacgacaagaacatccccgagagcttcatcaacatcaccccgtccaacagcaagaacaaggtcatcctgcggcagctgaacccctggcgcaccgacgtgtacttcaaccaccagaccgagaagtacgagctcctggggctgaagtacgccgacctccagttcgagaagaagacgggcacctactccatcaccatcgacaagtacaacgagatcaaggagaaggagggggtgagcgagcactccgagttcaagttcaccctgtacaagaacgacctgctcctgatcaaggacacggagatcaaggaggagcagatcttccggttcctgagccgcaccatgcccaaccagaagcactacgtcgagctcaagccctactacaagggcaacttcgaggggaaggagcggatcaaggtgttcaacaccacctccaacggccgctgcctgaagggcctgcggaagaaggggctcagcatctacaagatcaagacggacgtgctgggcaacaagcacttcatcaagaaggagggggagaagccgaagctgaagttctga

SEQ ID NO: 1629 - RNA, 3366 nt, synthetic construct
  misc_feature 1..3366: note = Cas9 variant
  source 1..3366: mol_type = other RNA
atgagcgacctggtgctcggcctggacatcgggatcggctccgtcggggtgggcatcctgaacaaggtgaccggggagatcatccacaagaacagccgcatcttccccgccgcccaggcggagaacaacctcgtccggcgcaccaaccggcagggccgccggctgacgcgccggaagaagcaccgcatcgtgcggctgaaccgcctcttcgaggagtccggcctgatcaccgacttcaccaagatcagcatcaacctgaacccgtaccagctccgggtgaaggggctgaccgacgagctgtccaacgaggagctgttcatcgccctcaagaacatggtcaagcaccgcggcatcagctacctggacgacgcctccgacgacgggaacagctccgtgggcgactacgcccagatcgtgaaggagaacagcaagcagctcgagacgaagacccccgggcagatccagctggagcggtaccagacctacggccagctgcgcggcgacttcaccgtcgagaaggacgggaagaagcaccggctcatcaacgtgttccccacgtccgcctaccgcagcgaggcgctgcggatcctgcagacccagcaggagttcaacccccagatcaccgacgagttcatcaaccgctacctcgagatcctgaccggcaagcggaagtactaccacgggccgggcaacgagaagtcccgcacggactacggccggtaccgcaccagcggggagaccctggacaacatcttcggcatcctcatcgggaagtgcaccttctaccccgacgagttccgcgccgccaaggcctcctacacggcgcaggagttcaacctgctgaacgacctcaacaacctgaccgtgcccaccgagaccaagaagctgagcaaggagcagaagaaccagatcatcaactacgtcaagaacgagaaggccatgggccccgccaagctgttcaagtacatcgccaagctcctgtcctgcgacgtggccgacatcaaggagtaccggatcgacaagagcgggaaggcggagatccacacgttcgaggcctaccgcaagatgaagaccctcgagaccctggacatcgagcagatggaccgggagaccctggacaagctcgcctacgtgctgacgctgaacaccgagcgcgagggcatccaggaggccctcgagcacgagttcgccgacggctccttcagccagaagcaggtcgacgagctggtgcagttccggaaggcgaacagctccatcttcgggaagggctggcacaacttcagcgtgaagctgatgatggagctcatcccggagctgtacgagacctccgaggagcagatgaccatcctgacgcgcctcgggaagcagaagaccaccagctccagcaacaagaccaagtacatcgacgagaagctgctgacggaggagatctacaaccccgtcgtggccaagtccgtgcggcaggccatcaagatcgtcaacgccgccatcaaggagtacggcgacttcgacaacatcgtgatcgagatggcgcgcgagaccaacgaggacgacgagaagaaggccatccagaagatccagaaggccaacaaggacgagaaggacgccgccatgctcaaggcggccaaccagtacaacgggaaggccgagctgccccacagcgtgttccacggccacaagcagctggccaccaagatccggctgtggcaccagcagggcgagcgctgcctctacaccgggaagacgatctccatccacgacctgatcaacaacagcaaccagttcgaggtcgaccacatcctgcccctctccatcaccttcgacgacagcctggcgaacaaggtgctggtctacgccaccgccaaccaggagaagggccagcggaccccgtaccaggccctcgactccatggacgacgcctggagcttccgcgagctgaaggcgttcgtgcgggagtccaagaccctgagcaacaagaagaaggagtacctcctgacggaggaggacatctccaagttcgacgtgcgcaagaagttcatcgagcggaacctggtcgacacccgctacgccagccgggtggtgctcaacgccctgcaggagcacttccgcgcccacaagatcgacaccaaggtctccgtggtgcgggggcagttcaccagccagctgcgccgccactggggcatcgagaagacgcgggacacctaccaccaccacgccgtcgacgcgctcatcatcgccgccagcatccagctgaacctgtggaagaagcagaagaacaccctcgtgtcctacagcgaggaccagctgctggacatcgagaccggggagctcatctccgacgacgagtacaaggagagcgtgttcaaggccccctaccagcacttcgtcgacacgctgaagtccaaggagttcgaggacagcatcctgttctcctaccaggtggacagcaagttcaaccgcaagatctccgacgccaccatctacgcgacccggcaggccaaggtgggcaaggacaaggccgacgagacctacgtcctcggcaagatcaaggacatctacacgcaggacgggtacgacgccttcatgaagatctacaagaaggacaagagcaagttcctgatgtaccgccacgacccccagaccttcgagaaggtgatcgagcccatcctggagaactacccgaacaagcagatcaacgagaagggcaaggaggtgcccgtcaaccccttcctcaagtacaaggaggagcacgggtacatccggaagtactccaagaagggcaacggccccgagatcaagagcctgaagtactacgactccaagctggggaaccacatcgacatcaccccgaaggacagcaacaacaaggtggtgctccagtccgtcagcccctggcgcgcggacgtgtacttcaacaagaccacgggcaagtacgagatcctggggctgaagtacgccgacctccagttcgagaagggcaccgggacctacaagatctcccaggagaagtacaacgacatcaagaagaaggagggcgtggacagcgacagcgagttcaagttcaccctgtacaagaacgacctgctcctggtcaaggacacggagaccaaggagcagcagctgttccggttcctctcccgcaccatgcccaagcagaagcactacgtggagctgaagccctacgacaagcagaagttcgagggcggggaggccctgatcaaggtgctcggcaacgtcgccaacagcgggcagtgcaagaagggcctggggaagtccaacatcagcatctacaaggtgcggaccgacgtgctgggcaaccagcacatcatcaagaacgagggcgacaagccgaagctcgacttctga

SEQ ID NO: 1630 - RNA, 3366 nt, synthetic construct
  misc_feature 1..3366: note = Cas9 variant
  source 1..3366: mol_type = other RNA
atgaacggcctggtgctcgggctggacatcggcatcgccagcgtcggggtgggcatcctggagaagaactccgggaagatcatccacgccaacagccgcctcttccccgcggccaccgccgacaacaacgtggagcggcgcaagaaccggcaggcccgccggctgaaccgccggaagaagcaccgcggcgtccggttccaggacctgttcgaggactacggcctcctgaccgacttctccaaggtgagcatcaacctgaacccgtaccgcctccgggtggacgggctgaaccagcagctgacgaacgaggagctgttcatcgccctcaagaacatcgtcaagcgccggggcatctcctacctggacgacgcgagcgaggacgggggcgccgtgtccagcgactacgggaaggccgtggaggagaaccgcaagctcctggccgagcagacccccggccagatccagctggagcggttcgagaagtacggccaggtccgcggggacttcaccgtggtggagaacggcgagaagtgccggctcatcaacgtcttctccaccagcgcgtaccgcaaggaggccgagaagatcctgcggaagcagcaggagttcaacaaccagatcacggacgagttcatcgaggactacctgaagatcctcaccgggaagcgcaagtactaccacggccccggcaacgagaagtcccggaccgactacgggcgcttccgcaccgacggcacgaccctggacaacatcttcggggtgctgatcggcaagtgcaccttctaccccaacgagtaccgggccagcaagtccagctacaccgcccaggagttcaacctcctgaacgacctgaacaacctcacggtgccgaccgagaccaagaagctgtccgaggagcagaagaaggtcatcgtggagtacgccaaggaggcgaagaccctgggggccagcacgctcctgaagtacatcgtgaagatgatcgacgcctccgtcgaccagatcagcggctaccgcgtggacgtgaacaacaagcccgagatgcacaccttcgaggtctaccggaagatgcagtccctggagaccatcagcgtgggcgagctcagccgcaacgtgctggacgagctggcccacatcctcaccctgaacacggagcgggaggggatcgaggaggccatcaactccaagctgatgggcgtcttcagccaggaccaggtgctcgagctggtccagttccgcaagaacaactccagcctgttctccaaggggtggcacaacttcagcctcaagctgatgatggagctgatccccgagctctacgagacctccgaggagcagatgaccatcctgacccggctgggcaagcagaagtccaaggagacgagcaagcgcaccaagtacatcgacgagaaggagctcaccgaggagatctacaaccccgtggtggccaagagcgtccggcaggcgatcaagatcatcaacgaggccaccaagaagcacgggatcttcgacaacatcgtgatcgagatggcccgcgagaacaacgaggaggacgccaagaaggactacatcaagcggcagaaggcgaaccaggacgagaagaacgccgccatggagaaggccgccttccagtacaacggcaagaaggagctgccgggcaacatcttcaacgggcacaaggagctggcgacgaagatccgcctgtggcaccagcagggcgagaagtgcctctacaccgggaagaccatccccatctccgacctgatccacaaccagtacaagtacgagatcgaccacatcctgcccctcagcctgtccttcgacgacagcctgtccaacaaggtgctcgtccacgccaccgccaaccaggagaagggccagcggacgcccttccaggccctggacagcatggacgacgcgtggtcctaccgcgagttcaagagctacgtgaaggacctgaagtccctcagcaacaagaagaaggactacctgctgaccgaggaggacatcagcaagatcgaggtgaagcagaagttcatcgagcggaacctcgtcgacacccgctactccagccgggtggtgctgaacgccctgcaggacttctacaagtcccaccagttcgacaccacgatcagcgtcgtgcgcgggcagttcacctcccagctccggcgcaagtggggcctggagaagtcccgcgagacctaccaccaccacgccgtggacgccctgatcatcgccgcgagcagccagctccggctgtggaagaagcagaacaacccgctgatcacctacaaggagggccagttcgtcgactcccagaccggggagatcatcagcctcacggacgacgagtacaaggagctggtgttcaaggccccctacgaccacttcgtggacaccctgcactccaagaccttcgaggacggcatcctcttcagctaccaggtcgactccaagtacaaccgcaagatcagcgacgccaccatctacgccacgcggaaggccaagctggacaaggacaagtccgaggagacctacgtgctggggaagatcaaggacatctacagccaggcgggctacgacgccttcatcaagatctacaacaaggacaagcgcaagttcctcatgtaccacaaggacccccagaccttcgagaaggtgatcgaggagatcctgcggacctacccctccaaggagcgcaacgacaagaacaaggaggtcccgtgcaaccccttcgagaagtaccggcaggagaacggccccatccgcaagtacagcaagaaggggaacggccccgagatcaagtgcctgaagtactacgacaacaagctcgggaactacatcgacatcagcccggacggctccgacaaccaggtggtgctgcagagcctgaagccctggcggacggacgtctacttcaaccaccagaccaaggagtacgagctcatggggctgaagtactccgacctgagcttcgagaagggctccggcaagtacagcatctccaacgagaagtacaacagcatcaagcgcatcgagggggtgaacgagcagtccgagttcaagttcaccctctacaagaacgacctgatcctgatcaaggacagcgagaacaacgagcagaagctgttccggttcaactcccgcaacgacaccgccaagcactacgtggagctcaagccctacgacaaggcccggttcgacggccagcaggagctgatcacgatcctcgggaacgtcgccaagggcgggcagtgcctgaagggcctgaacaagagcaacatctccatcttcaaggtgaagaccgacgtgctcggcaagaagcacatcatcaagaaggagggggacgagcccaagctgaagttctga

SEQ ID NO: 1631 - RNA, 3366 nt, synthetic construct
  misc_feature 1..3366: note = Cas9 variant
  source 1..3366: mol_type = other RNA
atggccgacaagaccctgggcgccctcaccttcgggttcgacatcggcatcgcgagcgtggggtggtgcgtcctgggcgagaaccgcatcgtggacctgggggtgcgggccttcgacaaggccgagacggccaaggagggcgagtccctcaacctggcccgccggaccgcgcgcctgatgcggcgccggctccgccggcgcgcctggcggctgaccaagctggcccgcctcctgaagcgggagggcctgatcgccgacgcgttccagatgcaccagcccagcgccacctccccgtggaagctccgcgtcgaggccctggaccggcgcctgacggacgacgagtgggcccgggtgatctaccacctctgcaagcaccgcgggttccactggatcagccgggccgaggagaagaaggcggagggcgacgccaagggggagtccggccgcgtgaagaaggggctgagcgacacccagcggcgcatgggcgagaagggctaccgctccgccgccgagatggtcctggccgagttccccgaggcgcagcggaacaagcagggggactacggcaaggccctcagccgcgtgctgctgtccgaggagctcgccctgctgttccggcgccagcgggagctcgggcacacccacgccagcaaggagctggaggccgcgatcctgggcaacggcgaccgcaagggcggcctcttctgggcccagaagccgcccctggccggggccgacctgctcaagatgctggggaagtgcaccttcgagaaggacgagtaccgggcccccaaggcgtccttcacggccgagcgccacgtgtggctgacccggctcaacaacctgcgcgtcgtggtggacgggaccacccggcccctgacggaggacgagcgccgggtcgccctccccctgccctacggctacgccgacgcgaagctgacctacaagcagctccgcgccgccctgagcaaggccggcctgtccaacttcagcttcgccgggatcgcggacgacaaggagaaggacaccctcaccaagctgccggcctgggagacgctgtccaagaccctcaagggcaaggggctggagaccgagtgggagggcatggccggggccgccaccggcggcgaccccacgctgctcgacgagatcagccgggtgctgtccgtgtacaaggacggggacgaggtcgacgtggagctgcgcaagctgcccctccccggcggggagaagatggtggagaccctgagcgagatctccttcgacaagttccacgcgctgagcctcaaggccctgcggaagatcgtcccgcacatggagaccggcctgcgctacgacgaggcctgcgccgccgcggggtaccaccacagccagctccacgaggccggcgccggcgggcagaagtacctgccgcccttctacacccggcgcgacaaggacggccgcatggtgttcgacgaggagctggacgtgccccggaaccccgtcgtgctccgcgccctgaaccaggcgcggaaggtgctgaacgccctcgtccgcgcctacgggtcccccagcgccgtgcacatcgagatggcccgggacctgtccaagcccctggtcggccaccccacgccgaacggcgggtacatcgagggccgccgggacatcgagaagctccagaaggagtaccgcgagcggaacgagaaggacaaggcggccttcgccgccgagcacgggatcgccgccaagagccgcgagttcgagaagttccagctgtaccgggagcagcagggcaagtgcgcctactccctgaagcccctcgacctgcaccgcgtgctgcacgacatcgggtacgccgaggtggaccacgccctcccctacagccggtcctacgacgacggcaagaacaacaaggtcctggtgctgaccgaggagaaccgcaacaagggcaaccggaccgcctacgagtacctctgcgcgttccccgggggcgagaacggggagcgctggcggaacttcgtggcctacgtcgagagcaacaagtcctaccgcctggccaagcggacccgcctgctccggaaggacttcggcgggaaggccgcggaggagttccgcgagcgcaacctgaacgacacgcggtacatctgcaagttcttcaagaacttcgtggagcgcttcctgcagctcaaggtgggcgccgacggcaccgccgccaagcggtgcgtcgtgctgagcgggcagaccaccgccttcctgcgcgcgcggtggggcctcctgaaggtgcgcggggcctccgaccggcaccacgccctggacgccgccgtcgtggcggcctgcagccacggcatggtgaagcgcctcgccgactactcccggacgaaggagctggccaaggtccgcgacgggttcccggaccccgagaccggcgagatcgtggaccccgccatgttccagcagctgcacgcgcacttccccgacccgtggccccacttccggggcgagctcgaggcccgcctgcagctggacgacagcgccgagctccgggcccagctggagatgttcgggacctaccccgccgaggcgctggagaccctccgcccgctgttcgtgtcccgggcgccccagcgccggaacggcggggccgcccacaaggagacgatctacgcgcagcccgagcgcctgaaggagcagggcggggtcacccagaaggtgagcctcgcctccctgaagcccaccgacatcgacaagctgatcgacccgcaccggaacgagaagctctacgccgccatccgcgcccgcctggaggcgcacggcggcaagagcgacaaggccttccccgccgacaaccccctgcggaagcccgaccgcgacgggaacccgaccggccccatcgtgcgggccgtcaccatggtgatcgacaagctctccgggatccagatccgcggcggcatcgccaagaacgacacgatgctgcgggtggacgtcttccgccacaagaaggacgggaagttccacctggtgcccctctacgtgcaccacgcggtcgcccaggagctgcccaaccgggccatcgtggccttcaaggacgaggacgagtggaccctgatcgacgacaacttccacttcctcttcagcttccacccgaacgacttcatccgcatcacccagaagaacaaggcccccatcctgggctactacgcgagctgccaccgggggaccggcaacctgaacctctgggcccacgaccgcaaccagaaggtggggaaggacggccagatcgagggcatcggggtcaagacggccgtggccctggagaagttccacgtggacgtcctgggcaacatctaccccgcgcccccggagcagcggcacgggctcgcctga

SEQ ID NO: 1632 - RNA, 3366 nt, synthetic construct
  misc_feature 1..3366: note = Cas9 variant
  source 1..3366: mol_type = other RNA
atgagcgacctggtgctcggcctggacatcgggatcggctccgtcggggtgggcatcctgaacaaggtgaccggggagatcatccacaagaacagccgcatcttccccgccgcccaggcggagaacaacctcgtccggcgcaccaaccggcagggccgccggctgacgcgccggaagaagcaccgccgggtgcgcctgaaccgcctcttcgaggagtccggcctgatcaccgacttcaccaagatcagcatcaacctgaacccgtaccagctccgggtgaaggggctgaccgacgagctgtccaacgaggagctgttcatcgccctgaagaacatggtcaagcaccggggcatcagctacctggacgacgcctccgacgacgggaacagctccgtgggcgactacgcccagatcgtgaaggagaacagcaagcagctcgagacgaagacccccgggcagatccagctggagcgctaccagacctacggccagctgcggggcgacttcaccgtcgagaaggacgggaagaagcaccgcctcatcaacgtgttccccacgtccgcctaccggagcgaggcgctgcgcatcctgcagacccagcaggagttcaacccccagatcaccgacgagttcatcaaccggtacctcgagatcctgaccggcaagcgcaagtactaccacgggccgggcaacgagaagtcccggacggactacggccgctaccgcaccagcggggagaccctggacaacatcttcggcatcctcatcgggaagtgcaccttctaccccgacgagttccgggccgccaaggcctcctacacggcgcaggagttcaacctgctgaacgacctcaacaacctgaccgtgcccaccgagaccaagaagctgagcaaggagcagaagaaccagatcatcaactacgtcaagaacgagaaggccatgggccccgccaagctgttcaagtacatcgccaagctcctgtcctgcgacgtggccgacatcaaggggtaccgcatcgacaagagcggcaaggcggagatccacacgttcgaggcctaccggaagatgaagaccctcgagaccctggacatcgagcagatggaccgcgagaccctggacaagctcgcctacgtgctgacgctgaacaccgagcgggagggcatccaggaggccctcgagcacgagttcgccgacgggtccttcagccagaagcaggtcgacgagctggtgcagttccgcaaggcgaacagctccatcttcggcaaggggtggcacaacttcagcgtgaagctgatgatggagctcatcccggagctgtacgagacctccgaggagcagatgaccatcctgacgcggctcggcaagcagaagaccaccagctccagcaacaagaccaagtacatcgacgagaagctgctgacggaggagatctacaaccccgtcgtggccaagtccgtgcgccaggccatcaagatcgtcaacgccgccatcaaggagtacggggacttcgacaacatcgtgatcgagatggcgcgggagaccaacgaggacgacgagaagaaggccatccagaagatccagaaggccaacaaggacgagaaggacgccgccatgctcaaggcggccaaccagtacaacggcaaggccgagctgccccacagcgtgttccacggccacaagcagctggccaccaagatccgcctgtggcaccagcagggggagcggtgcctctacaccggcaagacgatctccatccacgacctgatcaacaacagcaaccagttcgaggtcgaccacatcctgcccctctccatcaccttcgacgacagcctggcgaacaaggtgctggtctacgccaccgccaaccaggagaaggggcagcgcaccccgtaccaggccctcgactccatggacgacgcctggagcttccgggagctgaaggcgttcgtgcgcgagtccaagaccctgagcaacaagaagaaggagtacctcctgacggaggaggacatctccaagttcgacgtgcggaagaagttcatcgagcgcaacctggtcgacacccggtacgccagccgcgtggtgctcaacgccctgcaggagcacttccgggcccacaagatcgacaccaaggtctccgtggtgcgcggccagttcaccagccagctgcgccggcactgggggatcgagaagacgcgcgacacctaccaccaccacgccgtcgacgcgctcatcatcgccgccagctcccagctgaacctgtggaagaagcagaagaacaccctcgtgagctactccgaggaccagctgctggacatcgagaccggcgagctcatcagcgacgacgagtacaaggagtccgtgttcaaggccccctaccagcacttcgtcgacacgctcaagagcaaggagttcgaggactccatcctgttcagctaccaggtggactccaagttcaaccggaagatcagcgacgccaccatctacgcgacccgccaggccaaggtgggcaaggacaaggccgacgagacctacgtcctcgggaagatcaaggacatctacacgcaggacggctacgacgccttcatgaagatctacaagaaggacaagtccaagttcctgatgtaccggcacgacccccagaccttcgagaaggtgatcgagcccatcctggagaactacccgaacaagcagatcaacgagaaggggaaggaggtgccctgcaaccccttcctcaagtacaaggaggagcacggctacatccgcaagtacagcaagaagggcaacgggcccgagatcaagtccctgaagtactacgacagcaagctgggcaaccacatcgacatcaccccgaaggactccaacaacaaggtcgtgctccagagcgtgtccccctggcgggcggacgtctacttcaacaagaccacggggaagtacgagatcctgggcctgaagtacgccgacctccagttcgagaaggggaccggcacctacaagatcagccaggagaagtacaacgacatcaagaagaaggagggcgtggacagcgactccgagttcaagttcaccctgtacaagaacgacctgctcctggtgaaggacacggagaccaaggagcagcagctgttccgcttcctcagccggaccatgcccaagcagaagcactacgtcgagctgaagccctacgacaagcagaagttcgagggcggggaggccctgatcaaggtgctcgggaacgtggccaactccggccagtgcaagaaggggctgggcaagagcaacatctccatctacaaggtccgcaccgacgtgctgggcaaccagcacatcatcaagaacgagggggacaagccgaagctcgacttctga

SEQ ID NO: 1633 - RNA, 3366 nt, synthetic construct
  misc_feature 1..3366: note = Cas9 variant
  source 1..3366: mol_type = other RNA
atgaacggcctggtgctcgggctggacatcggcatcgggagcgtcggcgtggggatcctgaacaaggacaccggcgagatcatccacgccaactcccgcatcttccccgccgcgaccgccgacaacaacgtggtccggcgcagctcccggcagggccgccggctcaaccaccgcaagaagcaccggagcgtgcgcctgaaggacctgttcgagtactacgacctcctgacggacttctccaaggtgagcatcaacctgaacccgtaccggctccgcgtcgacgggctgaaccagcagctgaccaacgaggagctgttcatcgccctcaagaacatcgtgaagcggcgcggcatctcctacctggacgacgccagcgaggacgggggcgccgtgtccagcgactacgggaaggcggtcgaggagaaccggaagctcctggccgagcagacccccggccagatccagctggagcgcttcgagaagtacggccaggtgcgcggggacttcaccgtggtcgagaacggcgagaagcggcggctcatcaacgtgttctccacgagcgcctacaagaaggaggccgagcgcatcctgcggaagcagcaggagtacaacaaccagatcatggacgagttcatcgcggactacctgaccatcctcaccgggaagcgcaagtactaccacggccccggcaacgagaagtcccggaccgactacgggcgcttccgcacggacggcaccaccctggacaacatcttcgggatcctgatcggcaagtgcaccttctaccccgaggagtaccgggccagcaaggcctcctacacggcccaggagttcaacctcctgaacgacctgaacaacctcaccgtgccgaccgagaccaagaagctgagcgaggagcagaagaagacgatcgtcgagtacgccaagtccgcgaagaccctgggggccagcaccctcctgaagtacatcgccaagatgatcgacgcctccgtggaccagatccgcggctaccgggtggacgtcaacaacaagcccgagatgcacaccttcgaggtgtaccgcaagatgcagctgctcgagacgatccccgtgggcgagttcagccgggaggtcctggacgagctggcccacatcctcaccctgaacaccgagcgcgaggggatcgaggaggcgatcaacaccaagctgatggacgtgttcagccaggaccagatcctcgagctggtgcagttccggaagaacaactccagcctgttctccaagggctggcacaacttcagcctcaagctgatgatcgagctgatccccgagctctacgagacgtccgaggagcagatggccatcctgacccgcctggggaagcagaagttcaaggagaccagcaagcggaccaagtacatcgacgagcaggaggtcacggaggagatctacaacccggtggtcgccaagtccgtgcgccaggccatcaagatcatcaacgaggccaccaagaagtacggcatcttcgacaacatcgtgatcgagatggcgcgggagaacaacgaggaggaggccaagaaggactacatcaagcgccagaaggccaaccacgacgagaagaacgccgccatggagaaggcggccttccagtacaacggggagaaggagctccccgacagcatcttccacggccacaaggagctggccaccaaggtccggctgtggcaccagcagggcgagaagtgcctgtacaccgggaagaacatccccatctccgacctcatccacaaccagtacaagtacgagatcgaccacatcctgcccctgagcctctccttcgacgacagcctgtccaacaaggtgctggtgctcgccacggcgaaccaggagaagggccgccggaccccgttccaggccctggacagcatggacgacgcctggtcctaccgcgagttcaagagctacgtcaaggactccaagagcctggggaacaagaagaaggactacctcctgaccgaggaggacatctccaagatcgaggtgaagcagaagttcatcgagcggaacctggtggacacccgctacagcagccgggtcgtgctcaacacgctgcaggacttctacaaggcccacaagttcgacaccaccatctccgtggtccgcggccagttcaccagccagctgcgccggaagtgggggctcgagaagtcccgcgagacctaccaccaccacgccgtggacgcgctgatcatcgccgccagctcccagctgcggctctggaagaagcagaacaaccccctgatcagctacaaggagggccagttcgtggactccgagacgggcgagatcatcagcctgaccgacgacgagtacaaggagctcgtcttcaaggccccctacgaccacttcgtggacaccctgcgctccaagaagttcgaggacagcatcctgttctcctaccaggtggacagcaagttcaaccggaagatctccgacgccaccatctacgcgacgcgcaaggccaagctcgacaaggacaagagcgaggagacctacgtcctggggaagatcaaggacatctactcccagagcggctacgacgccttcatcaagatctacaacaaggacaagtccaagttcctgatgtaccacaaggacccccagaccttcgagaaggtgatcgaggagatcctccggacctacccgagcaaggagttcaacgagaagaacaaggaggtgagctgcaaccccttcgagaagtacaagcaggagaacgggcccatccgcaagtactccaagaagggcaacggccccgagatcaagagcctgaagtactacgacaagaacatcccggagtccttcatcaacatcacgcccagcaactccaagaacaaggtcatcctgcggcagctcaacccctggcgcaccgacgtgtacttcaaccaccagaccgagaagtacgagctgctggggctcaagtacgccgacctgcagttcgagaagaagaccggcacgtacagcatcaccatcgacaagtacaacgagatcaaggagaaggagggggtgtccgagcacagcgagttcaagttcaccctgtacaagaacgacctcctgctgatcaaggacaccgagatcaaggaggagcagatcttccggttcctctcccgcacgatgcccaaccagaagcactacgtcgagctgaagccgtactacaagggcaacttcgaggggaaggagcggatcaaggtgttcaacaccaccagcaacggccgctgcctgaagggcctccggaagaaggggctgtccatctacaagatcaagaccgacgtgctgggcaacaagcacttcatcaagaaggagggggagaagcccaagctcaagttctga

SEQ ID NO: 1634 - RNA, 3369 nt, synthetic construct
  misc_feature 1..3369: note = Cas9 variant
  source 1..3369: mol_type = other RNA
atgaacggcaagatcctggggctcgacatcggcgtggccagcgtcggggtgggcatcctggacaagaagaccggggagatcatccacgcctccagccgcatcttccccgcggccaccgccgactccaacgtggagcggcgcggcttccggcagggccgccggctggggcgccggaagaagcaccgcaaggtccggctcgccgacctgttcagcgacacgggcctgatcaccgacttctccaaggtgagcatcaacctcaacccgtacgagctgcgcatcaaggggctgaacgagaagctcaccaacgaggagctgttcatcgccctgaagaacatcgtgaagcggcgcggcatctcctacctcgacgacgcgaacgaggacggggagagctccagctccgagtacggcaaggccgtcgaggagaaccggaagctgctggccgacaagacccccggccagatccagctcgagcgcttcgagaagtacgggcaggtccggggcgacttcacgatcgaggagaacggggagaagcaccgcctgctgaacgtgttcagcacctccgcctacaagaaggaggcggagcggatcctcaccaagcagcaggactacaaccaggacatcaccgacgagttcatccaggcctacctgacgatcctgaccggcaagcgcaagtactaccacggccccgggaacgagaagtcccggaccgactacggccgcttccggaccgacgggacgaccctcgacaacatcttcggcatcctgatcgggaagtgcaccttctaccccgaggagtaccgcgccgccaaggccagctacaccgcgcaggagttcaacctgctcaacgacctgaacaacctgacggtgccgaccgagaccaagaagctcagcgaggagcagaagcgccagatcatcgagtacgccaagggcgccaagaccctgggcgccgccacgctgctcaagtacatcgcgaagctggtggacgggtccgtggaggacatcaagggctaccggatcgacaagagcgagaagcccgagatgcacaccttcgacatctaccgcaagatgcagaccctggagaccgtcgacgtggagaagctctcccgggaggtgctggacgagctggcccacatcctcacgctgaacaccgagcgcgaggggatcgaggaggccatcaaggtcagcttcatcaagcgggagttcgagcaggaccagatcgccgagctggtgagcttccgcaagtccaacagctccctcttcggcaaggggtggcacaacttcagcatcaagctgatgaccgagctgatccccgagctctacgagacctccgaggagcagatgacgatcctgacccggctgggcaagcagaagaccaaggcccgcagcaagcggaccaagtacatcgacgagaaggagctcacggacgagatctacaaccccgtggtcgcgaagtccgtgcgccaggccatcaagatcatcaacctggccaccaagaagtacggcgtgttcgacaacatcgtcatcgagatggcccgggagaacaacgaggaggacgccaagaaggactacgtgaagcgccagaaggcgaacgaggacgagaagaacgccgccatggagaaggccgcgcaccagtacaacgggaagaaggagctgccggacaacgtgttccacggccacaaggagctcgccaccaagatccggctgtggcaccagcagggggagaagtgcctgtacaccggcaagaacatccccatcagcgacctgatccacaaccagtacaagtacgagatcgaccacatcctccccctgtccctgagcttcgacgactccctcgccaacaaggtcctggtgctggccacggccaaccaggagaaggggcagcgcacccccttccaggcgctcgacagcatggacgacgcctggtcctaccgggagttcaaggcctacgtccgcggcgcccgggccctgagcaacaagaagaaggactacctgctcaacgaggaggacatcaacaagatcgaggtgaagcagaagttcatcgagcgcaacctggtggacacccggtactccagccgcgtcgtgctgaacgcgctccaggacttctacaagctgaacgacttcgacaccaagatctccgtggtccgcggccagttcaccagccagctgcggcgcaagtggcggatcgacaagtcccgcgagacgtaccaccaccacgccgtggacgccctcatcatcgccgccagcagccagctgcggctgtggaagaagcaggggaacccgctcatctcctacaaggagaaccagttcgtggacagcgagaccggcgagatcatctccctgaccgacgacgagtacaaggagctggtcttccgcgcgccctacgaccacttcgtggacaccgtgagctccaagaagttcgaggaccggatcctcttcagctaccaggtcgactccaagtacaaccgcaagatcagcgacgccacgatctactccacccggaaggccaagctggggaaggacaagagcgaggagacctacgtgctgggcaagatcaaggacatctacacccagacgggctacgacgccttcatcaagctctacaagaaggacaagtccaagttcctgatgtaccacaaggaccccatcaccttcgagaaggtgatcgaggagatcctgaagacctaccccgacaaggagatcaacgagaaggggaaggaggtcgcgtgcaacccgttcgagaagtaccgccaggagaacggccccctccggaagtacagcaagaaggggaagggccccgagatcaagtccctgaagtactacgacaacaagctggggaaccacatcgacatcacccccgacaacagcgagaaccaggtgatcctccagtccctgaagccgtggcgcacggacgtgtacttcaaccacaagaccaagatctacgagctgatgggcctcaagtacagcgacctgtccttcgagaagggcagcgggaagtaccggatcagcctggacaagtacaacgtcatcaagaagaaggagggcgtgcacaaggagtccgagttcaagttcaccctctacaagaacgacctgatcctgatcaaggacctcgagaagtccgagcagcagctgttccgctacaacagccggaacgacaccagcaagcactacgtggagctgaagccctacgacaaggccaagttcgaggggaaccagcccctcatggccctgttcggcaacgtcgccaagggcgggcagtgcctgaagggcctcaacaaggccaacatctccatctacaaggtgcagacggacgtgctggggaacaagcgcttcatcaagaaggagggcgacgcgcccaagctggagttctga

SEQ ID NO: 1635 - RNA, 3369 nt, synthetic construct
  misc_feature 1..3369: note = Cas9 variant
  source 1..3369: mol_type = other RNA
atgagcgacctggtgctcggcctggacatcgggatcggctccgtcggggtgggcatcctgaacaaggtgaccggggagatcatccacaagaacagccgcatcttccccgccgcccaggcggagaacaacctcgtccggcgcaccaaccggcagggccgccggctgacgcgccggaagaagcaccgcatcgtgcggctgaaccgcctcttcgaggagtccggcctgatcaccgacttcaccaagatcagcatcaacctgaacccgtaccagctccgggtgaaggggctgaccgacgagctgtccaacgaggagctgttcatcgccctcaagaacatggtcaagcaccgcggcatcagctacctggacgacgcctccgacgacgggaacagctccgtgggcgactacgcccagatcgtgaaggagaacagcaagcagctcgagacgaagacccccgggcagatccagctggagcggtaccagacctacggccagctgcgcggcgacttcaccgtcgagaaggacgggaagaagcaccggctcatcaacgtgttccccacgtccgcctaccgcagcgaggcgctgcggatcctgcagacccagcaggagttcaactcccagatcaccgacgagttcatcaaccgctacctcgagatcctgaccggcaagcggaagtactaccacgggcccggcaacgagaagtcccgcacggactacggccggtaccgcaccaacggggagaccctggacaacatcttcggcatcctcatcgggaagtgcaccttctacccggacgagttccgcgccgccaaggccagctacacggcgcaggagttcaacctgctgaacgacctcaacaacctgaccgtgcccaccgagaccaagaagctgagcaaggagcagaagaaccagatcatcaactacgtcaagaacgagaaggtgatgggccccgccaagctgttcaagtacatcgccaagctcctgtcctgcgacgtggccgacatcaaggggcaccggatcgacaagagcggcaaggccgagatccacacgttcgaggcgtaccgcaagatgaagaccctcgagaccctggacatcgagcagatggaccgggagaccctggacaagctcgcctacgtcctgacgctgaacaccgagcgcgagggcatccaggaggccctcgagcacgagttcgccgacgggtccttcagccagaagcaggtcgacgagctggtgcagttccggaaggccaacagctccatcttcggcaaggggtggcacaacttcagcgtgaagctgatgatggagctcatccccgagctgtacgagacctccgaggagcagatgaccatcctgacgcgcctcggcaagcagaagaccaccagctccagcaacaagaccaagtacatcgacgagaagctgctgacggaggagatctacaacccggtggtggcgaagtccgtccggcaggccatcaagatcgtgaacgccgccatcaaggagtacggggacttcgacaacatcgtgatcgagatggcccgcgagaccaacgaggacgacgagaagaaggcgatccagaagatccagaaggccaacaaggacgagaaggacgccgccatgctcaaggccgcgaaccagtacaacggcaaggccgagctgccccacagcgtcttccacggccacaagcagctggccaccaagatccggctgtggcaccagcagggggagcgctgcctctacaccggcaagacgatctccatccacgacctgatcaacaaccccaaccagttcgaggtggaccacatcctgcccctcagcatcaccttcgacgactccctggccaacaaggtcctggtgtacgcgaccgccaaccaggagaaggggcagcggaccccgtaccaggccctcgacagcatggacgacgcctggtccttccgcgagctgaaggccttcgtgcgggagagcaagaccctgtccaacaagaagaaggagtacctcctgacggaggaggacatcagcaagttcgacgtccgcaagaagttcatcgagcggaacctggtggacacccgctacgcgtcccgggtggtcctcaacgccctgcaggagcacttccgcgcccacaagatcgacaccaaggtgagcgtggtccggggccagttcacctcccagctgcgccgccactgggggatcgagaagacgcgggacacctaccaccaccacgccgtggacgccctcatcatcgcggccagcagccagctgaacctgtggaagaagcagaagaacaccctcgtgtcctacagcgaggagcagctgctggacatcgagaccggcgagctcatctccgacgacgagtacaaggagagcgtcttcaaggccccctaccagcacttcgtggacacgctgaagtccaaggagttcgaggacagcatcctgttctcctaccaggtggacagcaagttcaaccgcaagatctccgacgccaccatctacgccacccggcaggcgaaggtcggcaaggacaagaaggacgagacctacgtgctcgggaagatcaaggacatctacacgcaggacggctacgacgccttcatgaagatctacaagaaggacaagagcaagttcctgatgtaccgccacgacccccagaccttcgagaaggtgatcgagcccatcctggagaactacccgaacaaggagatgaacgagaaggggaaggaggtcccctgcaaccccttcctcaagtacaaggaggagcacggctacatccggaagtactccaagaagggcaacgggcccgagatcaagagcctgaagtactacgactccaagctgctcggcaacccgatcgacatcacccccgagaacagcaagaacaaggtggtgctgcagtccctgaagccctggcgcaccgacgtctacttcaacaagaacacggggaagtacgagatcctcggcctgaagtacgccgacctgcagttcgagaagaagaccgggacctacaagatcagccaggagaagtacaacggcatcatgaaggaggagggcgtggactccgacagcgagttcaagttcaccctctacaagaacgacctgctgctcgtgaaggacacggagaccaaggagcagcagctgttccggttcctgagccgcaccatgcccaacgtcaagtactacgtggagctcaagccgtactccaaggacaagttcgagaagaacgagagcctgatcgagatcctggggtccgccgacaagagcggccggtgcatcaaggggctcggcaagtccaacatcagcatctacaaggtgcgcaccgacgtcctggggaaccagcacatcatcaagaacgagggcgacaagcccaagctggacttctga

SEQ ID NO: 1636 - RNA, 3369 nt, synthetic construct
  misc_feature 1..3369: note = Cas9 variant
  source 1..3369: mol_type = other RNA
atgagcaacggcaagatcctggggctcgacatcggcatcgcctccgtgggggtcggcgtgatcgacgcccagaccggggagatcatccacgcgagctcccgcatcttccccagcgccaacgccgccaacaacgccgagcggcgcaccttccggggctcccgccggctgatccgccggaagaagcaccgcatcaagcggctggacgacctcttcaacgacttccacatcaacctggacggcgagatgagcacggacaacccgtacgtgctgcgcgtcaaggggctctcccagaagctgaccgtggaggagctgtacatcagcatcaagaacatcatgaagcggcgcggcatctcctacctcgacgacgcggagagcgacaacgaggccgggcggtccgactacgccaaggccatcgagcgcaaccggcagctgctgaccagcaagacccccggcgagatccagctcgagcgcctggagaagtacgggcagctgcggggcaacttcacgatcatcgacgaggagggccagtcccagcagatcatcaacgtgttcagcacctccgactacgtcaaggaggtggagaagatcctcgactgccagaagatgtaccacaagttcatcagcgacgagttctgcgacaagctgatcgagctgctccgcgagaagcggaagtactacgtggggcccggcaacgagaagtcccgcaccgactacgggatctaccggaccgacggcacgaccctggagaacctgttcggcatcctcatcgggaagtgcaccttctaccccgaccagtaccgcagctcccgcgcgagctacaccgcccaggagttcaacttcctgaacgacctgaacaacctcacggtcccgaccgagaccaagaagctgagccaggagcagaaggagttcctggtgaactacgccaaggagacctccgtgctcggcgccgggaagatcctgcagcagatcgccaagctggcggactgcaaggtcgaggacatccggggctaccgcctcgacaacaaggacaagcccgagctgcacatcttcgagacgtaccgggccatgaaggggctggtgcccctcgtggacatcggcgtcctgagccgcgagcagctggacatcctcgccgacatcctgaccctgaacaccgacttcgagggcatccgggaggccctcaagaagcagctgcccaacgtgttcgacgagaagcaggtcaaggggctggcctccttccgcaagagcaagtcccagctgttcgcgaagggctggcacaacctcagccagaagatcatgctggaggtgatcccggagctctacgccacctccgacgagcagatgacgatcctgacccggctggggaagttcgagaagtccagcgtggccgagtaccccagctccatcaacgtggacgagatcaccgacgagatctacaaccccgtcgtggccaagagcatccgccagaccatcaagatcatcaacgcctccatcaagaagtggggcgagttcgaccagatcgtgatcgagatgccccgggaccgcaacgaggacgaggagaagaagcggatcgcggacgggcagaaggccaacgccaaggagaaggccgacagcatcctccgcgccgcggagctgtactgcgccggcaaggtcctgccggactacgtgtacaacggccacaaccagctggccacgaagatccggctctggtaccagcagggggagcgctgcatctacaccggccagcccatctccatccacgacctgatccacaaccagaaccagtacgagatcgaccacatcctgcccctcagcctgaccttcgacgactccctgagcaacaaggtcctcgtgctggccaccgcgaaccaggagaaggcccagcggacgccctacaactacctgaagtccgccaccagcgcctggagctaccgcgagttcaaggactacgtgaccaagcggaaggggatcggcaagaagaagtgcgagtacctcaccttcgaggaggacatcaacgggttcgaggtccgctccaagttcatccagcggaacctggtggacacgcgctacgccagcaaggtgatcctgaacgcgctccaggactacttcaagatctccggcatccagaccaaggtcagcgtggtgcgcggccagttcacctcccagctgcggcacaagtgggggatcgagaagacccgcgagacgtaccaccaccacgccgtcgacgccctgatcatcgccgccagctcccagctccggctgtggaagaagcaggagagcccgctggtggtggactaccaggagggccgccaggtcgacctcgagaccggggagatcctggagctgaccgacgagcagtacaaggagctcgtgtaccagccgccctaccagggcttcgtgaacaccatctccagctccgcgttcgacaacgagatcctgttcagctaccaggtcgactccaaggtgaaccggaagatcagcgacgccaccatctacgccacgcgcaacgcccagctgggcaaggacaagaccgaggggatctacgtgctcggcaagatcaaggacatctacacccaggccgggtacgaggcgttcctgaagcggtacaccaaggacaagacgtccttcctgatgtaccacaaggacctcgacacctgggagaaggtcatcgagatcatcctgcgcgactaccgggagtacgacgagaagggcaaggagatcgggaaccccttcgagcgctaccggcgcgagaacggctacgtgaagaagtacagccggaagggcaacgggaccgccatcaagtccctgaagtactacgacaacaagctcggcaaccacatcgacatcacccccgagaacagccgcaacgccgtggtcctgcagagcctgaagccctggcggacggacgtgtacttcaacaaggagaccgggaagtacgagttcctcggcatcaagtactccgacctgagcttcgagaaggggaccggcgagtacggcatctcccaggagaagtacgacagcatcaagatcgccgagggggtggcgaagaagtccatcttcaagttcaccctgtacaagcaggacctcctgttcatcaaggacatcgagaacaacttcggcaagctgctccgcttcacgagcaagaacgacacctccaagcactacgtcgagctgaagccctacgacaagaacaagttcgggaccgaggagcccctgctcccggtgctgggcaacgtggccaagagcgggcagtgcatcaagggcctgaacaagtccaacatcagcatctacaaggtccggaccgacatcctcggctaccgccacttcatcaagcaggagggggagcacccccagctgaagttcaagaagtga

SEQ ID NO: 1637 - RNA, 3369 nt, synthetic construct
  misc_feature 1..3369: note = Cas9 variant
  source 1..3369: mol_type = other RNA
atgagcaacggcaagatcctggggctcgacatcggcatcgcctccgtgggggtcggcgtgatcgacgcccagaccggggagatcatccacgcgagctcccgcatcttccccagcgccaacgccgccaacaacgccgagcggcgcaccttccggggctcccgccggctgatccgccggaagaagcaccgcatcaagcggctggacgacctcttcaacgacttccacatcaacctggacggcgagatgagcacggacaacccgtacgtgctgcgcgtcaaggggctctcccagaagctgaccgtggaggagctgtacatcagcatcaagaacatcatgaagcggcgcggcatctcctacctcgacgacgcggagagcgacaacgaggccgggcggtccgactacgccaaggccatcgagcgcaaccggcagctgctgaccagcaagacccccggcgagatccagctcgagcgcctggagaagtacgggcagctgcggggcaacttcacgatcatcgacgaggagggccagtcccagcagatcatcaacgtgttcagcacctccgactacgtcaaggaggtggagaagatcctcgactgccagaagatgtaccacaagttcatcagcgacgagttctgcgacaagctgatcgagctgctccgcgagaagcggaagtactacgtggggcccggcaacgagaagtcccgcaccgactacgggatctaccggaccgacggcacgaccctggagaacctgttcggcatcctcatcgggaagtgcaccttctaccccgaccagtaccgcagctcccgcgcgagctacaccgcccaggagttcaacttcctgaacgacctgaacaacctcacggtcccgaccgagaccaagaagctgagccaggagcagaaggagttcctggtgaactacgccaaggagacctccgtgctcggcgccgggaagatcctgcagcagatcgccaagctggcggactgcaaggtcgaggacatccggggctaccgcctcgacaacaaggacaagcccgagctgcacacgttcgagacctaccgggccatgaaggggctggtgcccctcgtggacatcggcgtcctgagccgcgagcagctggacatcctcgccgacatcctgaccctgaacaccgacttcgagggcatccgggaggccctcaagaagcagctgcccaacgtgttcgacgagaagcaggtcaaggggctggcctccttccgcaagagcaagtcccagctgttcgcgaagggctggcacaacctcagccagaagatcatgctggaggtgatcccggagctctacgccacgtccgacgagcagatgaccatcctgacccggctggggaagttcgagaagtccagcgtggccgagtaccccagctccatcaacgtggacgagatcaccgacgagatctacaaccccgtcgtggccaagagcatccgccagacgatcaagatcatcaacgcctccatcaagaagtggggcgagttcgaccagatcgtgatcgagatgccccgggaccgcaacgaggacgaggagaagaagcggatcgcggacgggcagaaggccaacgccaaggagaaggccgacagcatcctccgcgccgcggagctgtactgcgccggcaaggtcctgccggactacgtgtacaacggccacaaccagctggccaccaagatccggctctggtaccagcagggggagcgctgcatctacaccggccagcccatctccatccacgacctgatccacaaccagaaccagtacgagatcgaccacatcctgcccctcagcctgaccttcgacgactccctgagcaacaaggtcctcgtgctggccacggcgaaccaggagaaggcccagcggaccccctacaactacctgaagtccgccaccagcgcctggagctaccgcgagttcaaggactacgtgaccaagcggaaggggatcggcaagaagaagtgcgagtacctcacgttcgaggaggacatcaacgggttcgaggtccgctccaagttcatccagcggaacctggtggacacccgctacgccagcaaggtgatcctgaacgcgctccaggactacttcaagatctccggcatccagaccaaggtcagcgtggtgcgcggccagttcacctcccagctgcggcacaagtgggggatcgagaagacgcgcgagacctaccaccaccacgccgtcgacgccctgatcatcgccgccagctcccagctccggctgtggaagaagcaggagagcccgctggtggtggactaccaggagggccgccaggtcgacctcgagaccggggagatcctggagctgaccgacgagcagtacaaggagctcgtgtaccagccgccctaccagggcttcgtgaacaccatctccagctccgcgttcgacaacgagatcctgttcagctaccaggtcgactccaaggtgaaccggaagatcagcgacgccacgatctacgccacccgcaacgcccagctgggcaaggacaagaccgaggggatctacgtgctcggcaagatcaaggacatctacacccaggccgggtacgaggcgttcctgaagcggtacacgaaggacaagacctccttcctgatgtaccacaaggacctcgacacctgggagaaggtcatcgagatcatcctgcgcgactaccgggagtacgacgagaagggcaaggagatcgggaaccccttcgagcgctaccggcgcgagaacggctacgtgaagaagtacagccggaagggcaacgggaccgccatcaagtccctgaagtactacgacaacaagctcggcaaccacatcgacatcacgcccgagaacagccgcaacgccgtggtcctgcagagcctgaagccctggcggaccgacgtgtacttcaacaaggagaccgggaagtacgagttcctcggcatcaagtactccgacctgagcttcgagaaggggaccggcgagtacggcatctcccaggagaagtacgacagcatcaagatcgccgagggggtggcgaagaagtccatcttcaagttcacgctgtacaagcaggacctcctgttcatcaaggacatcgagaacaacttcggcaagctgctccgcttcaccagcaagaacgacacctccaagcactacgtcgagctgaagccctacgacaagaacaagttcgggaccgaggagcccctgctcccggtgctgggcaacgtggccaagagcgggcagtgcatcaagggcctgaacaagtccaacatcagcatctacaaggtccggacggacatcctcggctaccgccacttcatcaagcaggagggggagcacccccagctgaagttcaagaagtga

SEQ ID NO: 1638 - RNA, 3372 nt, synthetic construct
  misc_feature 1..3372: note = Cas9 variant
  source 1..3372: mol_type = other RNA
atggccaagatcctgggcctcgacctggggaccaacagcatcggctgggccctgatcgacgacgtgcagaacaagatcctcggggtcggctcccgcatcttccccatgggggtggagaacctgggcgacggcgacggggagatcagcaagaacgcgtcccggaccggcacgcgcggggtgcggcgccagttcttccggcgccggctgcgcaagaaggtcctcctgaaggccctgagcgagaacaacatgtgcccgatgatcacctccgacttcgacaactggaagaagaccaagcagttccccagcgagaagctcgcctcctggttcgccctgaacccctacgagctgcggaacaaggccctcagcgagaagctgaccctggaggagatcggccgcatcttctaccacctcatccagcggcgcgggttcctgtccaacagccggaagggcggcacggacgacggggcgatcttcaagggcaaccccaaggaggggaagatcggcatcaccgacacccaggagtccatccaggacaagaccctgggcagctacctcttcgagatctacccgaaggagaaccagcccttccagaacgggctggagcgcatccggaaccgctacacggtgcggaagatgtacgtggacgagttcgagatgatctgggagaagcaggcccagtactactccaacctgaacgaggacctcaagaccctgttcggcgggcgcaagctggacggctacaaggaggacgggatcctcttccaccagcggcccctgcgcagccagaagcacctggtcggcaactgcgtgttcgagcccaacaagaccaagtgcccgatctccgccatccccttcgagcagttccgggtgtggcagtgggtcaacaccgtggagtacaacggcaagaagatcagccaggtggagaaggagaagatcgtcgagttcctctacgccaacgacaagacggacttcaagaagatccgcaaggcgatcgggaaggagtccaccgagttcaagttcaactacaaggacgacgacaagatcgtgggcacctacaccgtgagccacctgtccaacaagaagtacttcgggaagaagtggttcgagttcagcgagaaggagcaggaggacatctggcacatcctgtacttcttcgacagcaagtccaacctcaaggagtacgccatcaagaactggaacttcacggaggagcaggccgagagcatcgccaagttcaacgtcaaggacggctactccagcctgtcccgcaaggccatcagcaacatcctgcccttcctcaagctggggttcacctacgacgtggcggtggtcctgggcggcatcaagaacgtgttcgggcacgagtgggagaagctctccgacgagaagcggaacttcctgatcgacaacgtggagggcatcgtccgcagcaagaccaagggcgggttcatcgacgtgatcaaggacatcctgcggaacgactacaacatctccgacaaccagctccgcaagctgtaccaccacagcgccaccatctacgtggccgagctgctcgagaagctgcccgtcgggaaggaggccgacaaggagatccagtccatccggaacccgatcgtgatcacggccctgttcgagctccgcaagctggtcaacgagctgatcgacgacttcggcagcatcgacgagatcaaggtggagatggcgcgggacctcaagatctccaagagccagcgcaacaagatccggcgcgagcagaagcggctggagcgcgagaacgaccgggtgaaggcccgcctgctggaggagggccagcggatcacccacgacaacatcctcctgtacaagctgtgggaggagtgcaagaagacctgcccctacaccgggaaccccatccccctctacaagctgttcacgggcgagatccagatcgagcacatccacccgtggtcccgcagcctgaacgactccttcgccaacaagaccctctgctacgccgacgagaaccggaagaagggggacaagaccccctacgagttctacggcaacgacgagagcaactggtccgccatcaaggagcgcgcgctgaagctgttcagcgacaccaaggagtaccccaacgcctaccagaagttcaagcggttcgtccagcacaagttcgacgacgacttcagctcccgccagctcaacgacacgcgctacatcagcaaggaggccaagaactacctgtccaagatctgcaagaaggtggccgtgagccccggccaggccacctccaacctgcggcagaagtgggggatgaacaacatcctcaacgacgagaacgagaagacccgcgaggaccaccggcaccacgcgatcgacgccctggtcatggcctgcaccaagatcagctacgtgcaggagctgtccaagtggaaccgctacaaccggaacgccgagctcaagaagttcccgctgccctgggagacgttctggagcgacgcgaaccgcgccgtggacaagatcctgatctcccacaagaaggtcagcaacgacatcaccggccggacccacatctccgagaagaacgggaagaagtacaagaacgtgggcgtggccgcccgcgggcagctccacaaggagaccgtctacggcaagcggacgttcaacggcgaggaggccttccacgtgcgcaagaccatcgacagcctgaccaccgagaagcagctggagaaggtggtcgacgagtccatcaagctcctgatcaagaagcgggtgcaggagctcgggggcttcgtgaagggggcgatccccgccaacaccttcttcgtcgtggacgagaacggcatcaagcagccccagatcttcctgccgaacaagaacggggcccccgtgcccgtcctgaaggtgcgcatgaaggagaacatcggcggcgccgagaagctgaaggagaacgtgaaccagtgggtcaacccccggaacaaccaccacgtgctcatctacaaggacgagaaggggaacctgaaggaggaggtggtcacgttctggaccgtggtggagcgcaagcggaccggccagagcgcctaccagctgccgttcgacgggaaggagatcgtcaccacgctccacatcaacgacatgttcctgctgggcctcaacgaggaggagatcaactgggagaaccccgactacgaggtgctgaaggagcacctgtaccgcgtgcagaagttcacctccggggactactacttccggatcgcgaagaccagctccatccagaacgccatcgagaagcagcagatcaacagcttcggcttcggcaagaacgggtggagcacccacaaccccatcaaggtcaagatctccgtgagcggcaagatctccaaggtgtga

SEQ ID NO: 1639 - RNA, 3372 nt, synthetic construct
  misc_feature 1..3372: note = Cas9 variant
  source 1..3372: mol_type = other RNA
atgaacggcctggtgctcgggctggacatcggcatcgggagcgtcggcgtggggatcctgaacaaggacaccggcgagatcatccacaccaactcccgcatcttccccgccgccacggcggacaacaacgtggagcggcgcaacagccggcaggcccgccggctcaaccgccggaagaagcaccgcggcgcccggctgcacgacctgttcgaggactacgacctcctgatcgacttctccaaggtcagcatcaacctgaacccgtaccgcctccgggtgcaggggctggacaaccccctgaccaccgaggagctgttcatcgccctcaagaacatcgtgaagcgccggggcatctcctacctggacgacgccagcgagaacgggggcgcggtctccagcgactacgggaaggccgtggaggagaaccgcaagctcctggccgagcagacccccggccagatccagctggagcggttcgagaagtacggccaggtgcgcggggacttcacggtcgaggagaagggcgacaagcaccggctcatcaacgtgttctccaccagcgcctaccgcaaggaggcggagcggatcctgcgcaagcagcaggagttcaacaaccagatcaccgacaagttcatcgaggactacctgaagatcctcaccgagaagcggaagtactaccacgggcccggcaacgagaagtcccgcacggactacggccgcttccggaccgacgggaccaccctggacaacatcttcggcatcctgatcgggaagtgcacgttctacccgaacgagtaccgcgccagcaaggcctcctacaccgcccaggagttcaacctcctgaacgacctgaacaacctcaccgtgcccaccgagacgaagaagctgagcgaggagcagaagaagaccatcgtcgagtacgccaagtccgcgaagaccctgggcgccagcaccctcctgaagtacatcgccaagatgatcgacgcctccgtggaccagatccgggggtaccgcgtggacgtcaacaacaagcccgagatgcacacgttcgaggtgtaccggaagatgcagagcctggagaccatccccgtgggcgagttctcccgcgaggtcctcgacgagctggcccacatcctgaccctcaacaccgagcgggagggcatcgaggaggcgatcaacacgaagctgatggacgtgttcagccaggaccagatcctggagctcgtgcagttccgcaagaacaacagctccctgttcagcaaggggtggcacaacttctccctgaagctcatgatggagctgatcccggagctgtacgagaccagcgaggagcagatggccatcctcacccggctgggcaagcagaagttcaaggagacctccaagcgcacgaagtacatcgacgagaaggaggtcaccgaggagatctacaaccccgtggtggccaagagcgtccggcaggccatcaagatcatcaacgaggccaccaagaagtacgggatcttcgacaacatcgtgatcgagatggcgcgcgagaacaacgaggaggacgccaagaaggactacatcaagcggcagaaggccaaccacgacgagaagaacgccgccatggagaaggcggccttccagtacaacggcaagaaggagctgcccgactccatcttccacgggcacaaggagctcgccaccaagatccgcctgtggcaccagcagggcgagaagtgcctgtacacgggcaagaacatccccatcagcgacctgatccacaaccagtacaagtacgagatcgaccacatcctcccgctgtccctgagcttcgacgactccctcagcaacaaggtcctggtgctggccaccgcgaaccaggagaaggggcagcggacccccttccaggccctcgactccatggacgacgcctggagctaccgcgagttcaagtcctacgtgaaggacagcaagctgctgggcaacaagaagaaggactacctcctgaccgaggaggacatctccaagatcgaggtcaagcagaagttcatcgagcggaacctggtggacacgcgctacagctcccgggtggtcctcaacaccctgcaggacttctacaaggcccacaagttcgacaccaccatcagcgtggtgcgcgggcagttcaccagccagctgcgccggaagtggggcctcgagaagtcccgcgagacgtaccaccaccacgccgtcgacgcgctgatcatcgccgccagctcccagctgcggctctggaagaagcaggccaaccccctgatcagctacaaggaggaccagttcgtggactccgagaccggggagatcatcagcctgaccgacgacaagtacaaggagctcgtgttcaaggccccctacgcgcacttcgtcgacaccctgtccagcaagaagttcgaggactccatcctgttcagctaccaggtggactccaagtacaaccgcaagatcagcgacgccacgatctacgccacccggaaggtgaagctcgacaaggacaagtccgaggagacctacgtcctgggcaagatcaaggacatctacagccaggccggctacgacgccttcatcaagatctacaacaaggacaagtccaagttcctgatgtaccacaaggacccgcagaccttcgagaaggtgatcgaggagatcctccgcacgtaccccagcaaggagttcaacgagaagaacaaggaggtgccctgcaaccccttcgagaagtaccggcaggagaacgggccgatccgcaagtactccaagaagggcaacgggcccgagatcaagagcctgaagtactacgacaagaacatccccgagagcttcatcaacatcaccccctccaacagcaagaacaaggtcatcctgcggcagctcaacccgtggcgcaccgacgtgtacttcaaccaccagaccgagaagtacgagctgctgggcctcaagtacgcggacctgcagttcgagaagaagacgggcacctactccatcaccatcgacaagtacaacgagatcaaggagaaggagggggtgggcgagcagagcgagttcaagttcaccctgtacaagaacgacctcctgctgatcaaggacacgaagaacaacgagaagcagatcttccggttcctctcccgcaccatgcccaacgtcaagcactacgtggagctgaagccctacgacaaggccaagttcgacgggaaccagcccctgatcaccatcttcggcaacgtggccaagggcgggcagtgcctcaagggcctgaacaagagcaacatctccatcttcaaggtcaagaccgacgtgctggggaacaagcacttcatcacgaaggagggcgagaagccgaagctcaagttctga

SEQ ID NO: 1640 - RNA, 3378 nt, synthetic construct
  misc_feature 1..3378: note = Cas9 variant
  source 1..3378: mol_type = other RNA
atgaacggcctggtgctcgggctggacatcggcatcgccagcgtcggggtgggcatcctgaacaaggagaccggggagatcatccacgtgaactcccgcatcttccccgccgcgaccgccgacagcaacgtcgagcggcgcggcttccggcagggccgccggctcgggcgccggaagaagcaccgctccgcccggctgaacgacctgttcgaggagttcggcttcatcacggacttcagcgccgtgccgctcaacctgaacccctacgccctgcgcgtgaaggggctctccgaggagctgaccaacgaggagctgttcatcgcgctcaagaacatcatcaagcggcgcggcatcagctacctggacgacgcctccgaggacggggagaccgccagcaacgagtacggcaaggccgtcgaggagaaccggaagctgctcgcggacaagacccccggccagatccagctggagcgcttcgagaagtacgggcaggtccggggcgacttcacggtggtggagaacggggagaaccaccgcctgatcaacgtgttctccaccagcgcctacaagaaggaggccgagcggatcctccgccggcagcaggagttcaacgtgcgcatctccgacgagttcatcgaggcctacctgaccatcctgaccggcaagcggaagtactaccacggccccgggaacgagaagtcccgcacggactacggccgcttccggaccgacgggaccaccctcgacaacatcttcggcatcctgatcgggaagtgcacgttctacccggacgagtaccgcgccgcgaaggccagctacaccgcccaggagttcaacctgctcaacgacctgaacaacctgaccgtccccaccgagacgaagaagctccggcccgagcagaagcgccagatcgtggagtacgcccggaccgccaagaccctgggcacccccacgctgctcaagtacatcgcgaagctggtggacggcagcatcgacgacatcaaggggtaccgcatcgacaagtccgacaagccggagatgcacaccttcgacgcctaccggaagatgcgcaccctggagctcgtcgacgtggacatcctgagccgggagaccctggacgacctcgcctacatcctgacgctgaacaccgagtccgagggcatcctcgaggccctgaacagcaagatgcccgggaccttcaccaaggagcagatcgacgagctgatccagttccgcaagaagaactccgccgtgttcggcaaggggtggcacaacttcagcctcaagctgatgaacgagctgatccccgagctctacgagacgagcgaggagcagatgaccatcctgacccggctgggcaagcagcgctcccgggagatcagcaagcgcaccaagtacatcgacgagaaggagctcacggacgagatctacaaccccgtcgtggcgaagtccgtgcggcaggccatcaagatcatcaacctggccaccaagaagtacggcatcttcgacaacatcgtcatcgagatggcccgcgagagcaacgaggacgacgagaagaaggccatccagaacgtgcagaaggcgaacgaggacgagaagaaggccgccatggagaaggccgcggacctgtacaacgggaagaaggagctgccggactccatcttccacggccacaaggagctcgccaccaagatccggctgtggcaccagcagggggagcgctgcctgtacaccggcaagaacatcagcatccacgacctcatccacaacccccaccagtacgagatcgaccacatcctgcccctgtccctcagcttcgacgacgggctggccaacaaggtgctggtcctcgccacggccaaccaggagaagggccagcggacccccttccaggcgctggactccatggacgacgcctggagctacatcgagttcaagcagtacgtgcgcaactccaagagcctgtccaacaagaagaaggactacctcctgaccgaggaggacatcagcaagatcgaggtcaagcagaagttcatcgagcgcaacctggtggacacccggtactccagccgcgtggtcctcaacaccctgcaggagttctacaagacgaacgacttcgacaccaagatctccgtggtgcggggccagttcaccagccagctgcgccggaagtggaagatcgagaagtcccgcgacacctaccaccaccacgccgtcgacgccctcatcatcgccgcgagcagccagctgcggctgtggaagaagcagaacaacccgctcatctcctaccgcgaggggcagctggtggaccccgagacgggcgagatcctgagcctcaccgacgacgagtacaaggagctggtgctgcggccgccctacgactacttcgtcgacaccctcaagtccaagagcttcgaggactccatcctgttcagctaccaggtggactccaagtacaaccgcaagatcagcgacgccaccatctacgggacgcggaaggcccagctgggcaaggacaagcaggaggagacctacgtgctcggcaagatcaaggacatctactcccagaaggggtacgaggacttcatcaagcgctacaagaaggacaccacccagttcctgatgtaccacaaggacccccagacgttcgccaaggtcatcgaggagatcctgaagacctaccccgacaaggagctcaacgagaagggcaaggagatcccctgcaaccccttcgagaagtaccggcaggagaacgggccgatccgcaagtacagcaagaagggcaaggggcccgagatcaagtccctgaagtactacgacaacaagctgggcaaccacatcgacatcacccccgtgaacagccagaaccaggtggtcctccagtccctgaagccctggcggaccgacgtgtacttcaacccgcagacgagcaagtacgagctgatgggcctcaagtactccgacctgcgcttcgagaaggggagcggctcctacgggatcagccccgagaagtacaacaaggtgaaggccaaggagggcgtcgacgaggacagcgagttcaagttcaccctgtacaagaacgacctcatcctgatcaaggacaccgagaccggggagcagcagctgttccggtacggctcccgcaacgacacgagcaagcactacgtggagctcaagccctacgagaaggcgaagttcgagggcaaccagcagctgatgaacctgctcgggaccgtggccaagggcgggcagtgcctgaagggcatcaacaagccgaacctgtccatctacaaggtcaagaccgacgtgctcgggaacaagtacttcatcaagaaggagggcgaccagccccagctgaacttcaagaagaagatctga

SEQ ID NO: 1641 - RNA, 3378 nt, synthetic construct
  misc_feature 1..3378: note = Cas9 variant
  source 1..3378: mol_type = other RNA
atgaccagcaagcaggagaacctgggcgccctcaccttcgggctggacatcggcatcgcctccgtggggtgggcggtcctgggcgagaaccgcatcatcgacctcggggtgcggtgcttcgacaaggccgagacggccaaggagggcgagagcctgaacctggcccgccggatggcccgcctcctgcggcgccggctgcgccggcgcgcgtggcggctcaccaagctggcccgcctgctcaagcgggagggcctgatcgccgacgccaacctgttcaagaacaagatcgagaagaacacccccgtgcccaagtccagctggcagctccgcgtcgacgcgctggaccggaagctgaacgccgaggagtgggcccgcgtgatctaccacctctgcaagcaccgggggttccactggatctcccgcgccgaggagaaggccgcggagagcgactccaagggcgagagcgggaaggtgaagcagggcctggccgggaccaagaagctgatgcaggagaagaactaccggacggccgccgagatggtcctcgccgagttccccgaggcgcagcgcaacaagcagggcgactactccaaggccctgagccggatcctgctcggcgacgagctgaagaccctgttcgagcaccagcgcaagctcgactcccccttcgccaccgagaagctggaggccgccatcctggggaacggcgaccgcaagagcggcctcttctgggcgcagaaccccgccctggccgggtccgacctgctcaagatgctgggctactgcaccttcgagaagacggagtaccgggccccgaaggccagcttcaccgcggagcgccacgtgtggctgacccggctcaacaacctgcgcatcgtggtcgacgggaccacgcggcccctgaacgaggccgagcgccggatcgccctcctgatgccctaccagcaggccggcgacttcacctacaagcagctgcgcaccgcgctcaccaaggccgggttcctgcccgagtccttccggtacacgggcctgagctacgcctccgggcagaaggccggcgagaagaccaaggacccggagagcgccgcgctcgtgaagttccccgcctggcaggagctgcgcaagaccctggagaagaaggagctcgcctccgagtggcagaagatcagcaccgacgccctggacggcaagccccagctgctggaccagatcgcctgggtgctcagcgtctacaaggacgacgacgaggtgaaggcggagctgtccaagctgaacctccccaacgccgagaagatgatcgacgccctgctggacatccggttcgacaagttcagcaacctctccctgaaggccctgtgcaagatcgtgccgctcatggagcaggggcagcgctacgacgaggccatcgcgaacatccccgagtacggccaccacagccagctgcacaaggtcggggccggcgagcacaagtacctgccgcccttctacaaggagcgggacaagacggggcgcatggtgttcaacgacgacatggacatcccccggaaccccgtggtcctccgcgccctgaaccaggcccggaaggtggtgaacgcgctgatcaagaagtacgacagcccccacgaggtccacatcgagatggcccgcgacctctcccggcccctggacgagcgccgcgaggtggagaagctgcagaaggagttccgggacaacaacgagaagggcaaggcccagttcgcccaggacttcaacatcgtgggcgccgtcaaggggaaggagttcgagaagtaccagctctaccgcgagcagcagggcaagtgcgcgtactccatcgagccgatggacatccaccggctgttcgagcaggggtacgtggagatcgaccacgccctgccctacagccgctccttcgacgacagcaagaacaaccgggtcctcgtgctggccaaggagaaccgcgacaagggcaaccggacccccttcgagtacctcgggggcaaggacaactccgagccctggcgccagttcgtggccttcgtcgagggcaacaaggcctaccggctggcgaagcgcagccggctgctgcgcaaggacttcggggacaaggaggccaaggagttccgggagcgcaacctcaacgacacccggtacatctgcaagttcttcaagaactacgtggagcagtacctgcagctgcacgaggactccgaggccaagcgctgcgtggtcctcagcggccagatgacctccttcctgcgggcccgctgggggctggtgaaggtgcggggcgacagcgaccgccaccacgccctcgacgcggccgtcgtggccgcctgctcccacggcatggtgaagcggctgagcgactactcccgccgcaaggagctggagcaggtccgggaggggttcgtggacgtggacacgggcgagatcgtcaacccggcgatgttccagcaggtccaggagcacttccccaacccctggccccacttccgcgacgaggtgaagctccggctgagcatggacgacccggccctgctccgcagcgagatggagaagttcgggacctacacccccgaggccctgcaggccctgcaccccctcttcgtgtcccgggccccgcagcgccggaacagcggcgcggcccacaaggacaccatctacgcccagcccaagcgcctggtggcccagggcggggtgacgcagaaggtcgccctgacctccctcaccctgaaggacctggacaagctcatcgacccccaccggaacgacaagctgtacaccgcgatccgcgcccggctggagcagcacggcgggaagggcgacaaggccttccccagctccaacccgctccgcaagcccgacagcgaggggaaccccacgggccccatcgtgcgcggggtgaccatggtcatcgacaagctgtccggcatcccgatccggggcgggatcgccaagaacgacagcatggtgcgggtggacgtcttcaccaaggccaacaagttccacctggtgcccgtgtacgtccaccacaccgtggcgaaggccctccccaaccgcgccgtggtcgccttcaaggacgaggacgagtggacgctgatcgacgactccttcgacttctgcttcagcctgcaccccaacgacctcgtccaggtgcagcagaagggcaaggccgggatgatcggctactactccagctgccaccgggggaccggcaacatcaacctgtgggcgcacgaccgcaacctccaggtgggcaaggacgggatgatcgagggcatcggggtgaagaccgccctgtccctggagaagttcaacgtggacgtcctgggcaaccggtacccggccccgcccgagaagcgccgcgacctcgcctga

SEQ ID NO: 1642 - RNA, 3378 nt, synthetic construct
  misc_feature 1..3378: note = Cas9 variant
  source 1..3378: mol_type = other RNA
atgaccgaccgcatcagcctgggcctcgacatcggggtggcctccgtcggcttcagcgtgctggacatcgacaaggggaaggtgatcgagctgggcgcccgcctcttcaacgcgaccgtcgccgccgggaaccaggaccggcgggacatgcgcggctcccggcgcctgctgaaccggaacaagcagcgccggaaggacgtgagcaagctgttccaggagtacggcctcctggacaacttcgaccgcgacaacttccacacggccttcaacaacaactggaacccctacgagctccgggtgaaggggctgaccaagcagctgaacaaggaggagctcgccgactccctgtaccagatcatcaagcgccggggcatcagctacgcgctgaaggacgccgacgccaacgaggacgggaccgactactccagctccctcaagatcaacagccaggagctgatcgagaagaccccggcccagatccagctgcagcgcctcaacgactacggcaaggtccgggggaaggtgatcgtgggcgacgacatcgacgaccagaaggtcctgctgaacgtgttccccacgaacgcgtacgagaaggaggcccgccagatcatcgccacccagcagcagttctaccccgagatcctcaccggcgagttcgtgaaggagtactgccagatcctgacccggaagcgcgactacttcgtcgggcccggcaacgagaagtcccggacggactacgggatctacaagaccgacggccgcaccctggacaacctcttcgaggagctgatcggccacgacaagatctacccggacgagctgcgggccagcgccgcgtcctacaccgcccagctgttcaacgtgctcaacgacctgaacaacctccgcatcctgagctacgaggacgggaagctgacgcagatcgacaaggagaagatcatcgccgagatcaagaacaacaccaccgtggtcaacatgctcaacgtgatcaagaaggtgaccggctgccagaaggacgacatcaaggggttccgcctgaacgagaaggacaagcccgagatctccagcatgcccatctaccggaaggcccacaaggacttcctgaaggtcggcatcgacatcacggactggcccatcgacttcatcgaccgcctctccttcatcctgaccctgaacaccgagaacggggagatccggaagcagatcaacaagcgcctcgtgccggacttcgacttcctgaacgacgacctggtgcagctcatcatcgacaacaaggacagcttcgacatcaagaccaacaacaagtggcaccggttctccctgaagacgatgaacaagctgatccccaccatgatcgagcgccccgtcgagcagatgaccctcctgaccgagatgggcctgatcaagaaggacacgaagcggttcgagggcaacaagtacctcccctacaaggagatcgccaacgacatcttcaacccggtggcgagcaagagcgtgcgcgaggccctgaagatcgtcaacgccgtgctgaagaagtacgggcacatcgagtacatcgtcatcgagatgccccgggacaagaacctggacgaggagcgcaagcagatcgccgacttccagaagaagaacaagaagatcaaggacgccgcgttcaacgccttcgtgaaggccgtgggctccaagaagaacgtcaagatcgccctcagcaagaaccggaagctgcagatggggatccgcctgtggcaccagcagcagggcatcgacccctacaacggggaggagatcaacgccaacgacctcatctccaaccccgacaagttcgagatcgaccacatcatcccgcagagcatctccttcgacgacggcatcaacaacaagaccctgtgcttcgcgagcatgaaccaggtgaagggccagaagaccccctacgagttcctgaacgaggggcacggccaggggtacgccaagttcaaggccatcgtgtccaagaacaagaacttcagcaaggccaagcgggacaactacctcttcgaggagaacgtctccaacatcgagacccgcaagcggttcctgagccgcaacctggtggacacgcggtactccagccgcgtggtcctcaactccctgcaggagttcttccacgagaagtccgacgacaccaaggtgaccgtgatccggggcaagttcaccagcaacatgcgcaagcactggcacatcgacaagacgcgcgacaccttccaccaccacgcgatcgacgccagcatcatcgccgccacccccttcctgcggatgtggaagaaggggtccaccatcttccccacgaagatcaacgagaccagcatcgacatcgagaccggcgagatcctcgacgacaagaacttcgacaaggtcatgtacgaggagccgtactccggcttcatcagcgagatcatgaacgccgacgaccgcatcaagttcagccaccaggtggacaagaagatgaaccggaaggtgtccgacgcgaccatctacagcacccgcatcgggaagctgtccaaggacaagaaggacgccgagtacgtcgtggccaaggtgaaggacatctacagcgtcgacggctacgagaacttcaagaaggtgtacaagaaggacaagacgaagttcctgctctacaagtacgacccccggaccttctccgagctggagaagatcgtgatcgactaccccgacaagatcgagaaggtccagaccaacgggaagatcaaggccgtggacatcagccccttcgagctgtaccgccgggacaacggcatggtgcgcaagtactccaagaagaccggcccggccatcaagcagctcaagtacctggacaagaagctggggagccacatcgacatcacgcccaagaacgcgaacaacaagcacgtcgtgctccagtccctgaagccctggcggaccgacgtgtacctgaaccacgagaccggcgagtacgagatcatggggatcaagtacagcgacctcaagttcaacaagaacgagggctacgggatcaagaaggacaagtacctgaagatcaagaacatcgagggcgtctccgagaacagcgagttcatgttctccctgtaccgcaaggaccggatcaaggtgcaggacatggagaccaacgagagcgtggagctcctgttctggtcccgcaacttcagcaacaagaagtacgccgagctgaagcccatctcccagatcgacaacgacaaggtcctcccgatctacggccgggggcgcctgatcaagcggctgatccccaagaactgcaagatctggaaggtgaacacgagcatcctcggcgacacctactacctggagaaggagagcaactacccccagaagatcctggactga

SEQ ID NO: 1643 - RNA, 3381 nt, synthetic construct
  misc_feature 1..3381: note = Cas9 variant
  source 1..3381: mol_type = other RNA
atgaacggcctggtgctcgggctggacatcggcatcgccagcgtcggggtgggcatcctgaacaaggagaccggggagatcatccacgccaactcccgcatcttccccgcggccaccgccgacagcaacgtggagcggcgcggcttccggcagggccgccggctcgggcgccggaagaagcaccgctccgcccggctgaacaacctgttcgaggagttcggcttcatcacggacttcagcgccatcccgctcaacctgaacccctacgcgctgcgcgtcaaggggctctccgaggagctgaccaacgaggagctgttcatcgccctcaagaacatcatcaagcggcgcggcatcagctacctggacgacgcctccgaggacggggagaccgccagcaacgagtacggcaaggcggtggaggagaaccggaagctgctcgccgacaagacccccggccagatccagctggagcgcttcgagaagtacgggcaggtccggggcgacttcacggtggtggagaacggggagaaccaccgcctgatcaacgtgttctccaccagcgcctacaagaaggaggccgagcggatcctccgccggcagcaggagttcaacgtccgcatctccgacgagttcatcgaggcctacctgaccatcctgaccggcaagcggaagtactaccacggccccgggaacgagaagtcccgcacggactacggccgcttccggaccgacgggaccaccctcgacaacatcttcggcatcctgatcgggaagtgcacgttctacccggacgagtaccgcgcggccaaggccagctacaccgcccaggagttcaacctgctcaacgacctgaacaacctgaccgtgcccaccgagacgaagaagctcagccccgagcagaagcggcagatcgtggagtacgcccgcaccgcgaagaccctgggcacccccacgctgctcaagtacatcgccaagctggtcgacggctccatcgacgacatcaaggggtaccggatcgacaagagcgacaagccggagatgatgcacaccttcgacgcctaccgcaagatgcggaccctggacctcgtgaacatcgacgccctgtcccgcgagaccctggacgacctcgcccacatcctgacgctgaacaccgagagcgagggcatcctcgaggcgctgaactccaagatgcccagcaccttcaccaaggagcagatcgacgagctgatccagttccggaagaagaacagcgccgtgttcgggaagggctggcacaacttctccctcaagctgatgaacgagctgatcagcgagctctacgagacgtccgaggagcagatgaccatcctgacccgcctggggaagcagcggagccgcgagatctccaagcggaccaagtacatcgacgagaaggagctcacggaggagatctacaaccccgtcgtggccaagagcgtgcgccaggccatcaagatcatcaacgaggccaccaagcggtacggcatcttcgacaacatcgtcatcgagatggcgcgcgagaacaacgaggaggacgccaagaaggactacatcaagcggcagaaggccaaccaggacgagaagaacgcctccatggagaaggcggccttccagtacaacggcaagaaggagctgcccgacagcatcttccacgggcacaaggagctggccaccaagatccgcctgtggcaccagcagggcgagcggtgcctctacaccgggaagaacatctccatccgcgacctgatccacaacccgcaccagtacgagatcgaccacatcctgcccctcagcctgtccttcgacgacggcctggccaacaaggtgctcgtgctggccacggcgaaccaggagaaggggcagcgcacccccttccaggccatcgacagcatggacgacgcctggtcctaccgggagttcaagcagtacgtccgcaacagcaagtccctgagcaacaagaagaaggactacctcctgaccgaggaggacatctccaagatcgaggtgaagcagaagttcatcgagcggaacctggtggacacccgctacagctcccgggtcgtgctcaacaccctgcaggagttctacaagacgaacgacttcgacaccaagatcagcgtcgtgcgcggccagttcaccagccagctgcggcgcaagtggaagatcgagaagtcccgggacacctaccaccaccacgccgtggacgccctcatcatcgcggccagctcccagctgcgcctgtggaagaagcagaacaaccccctcatcagctacaaggagggccagttcgtcgacccggagacgggggagatcctgtccctgaccgacgacgagtacaaggagctcgtgttccggccgccctacgactacttcgtggacaccctcaagagcaagtccttcgaggacagcatcctgttctcctaccaggtcgacagcaagtacaaccgcaagatctccgacgccaccatctacggcacgcggaaggcccagctcgggaaggacaagcaggaggagacctacgtgctgggcaagatcaaggacatctacagccagaagggctacgaggacttcatcaagcgctacaacaaggacgagacccagttcctgatctaccacaaggacccccagaccttcgagaaggtgatcgaggagatcctcaagacgtaccccgacaaggagctgaacgagaaggggaaggagatcccctgcaaccccttcgagaagtaccggcaggagaacggccccatccgcaagtactccaagaaggggaagggcccggagatcaagatcctgaagtactacgacaacaagctcgggaaccacatcgacatcacccccgtcaacagccagaaccaggtggtgctgcagtccctgaagccctggcggaccgacgtctacttcaacccccgcaccagcaagtacgagctcatgggcctgaagtactccgacctgcggttcgagaagggcagcgggagctacggcatctccccggagaagtacaacaaggtgaaggccaaggagggggtgaacgaggacagcgagttcaagttcacgctctacaagaacgacctgatcctgatcaaggacaccgagaccggcgagcagcagctgttccgctacgggtcccggaacgacaccagcaagcactacgtcgagctgaagccctacgagaaggcgaagttcgagggcaaccagcagctgatgaacctcctgggcacggtggccaagggcgggcagtgcctgaaggggatcaacaagcccaacctctccatctacaaggtgaagaccgacgtcctgggcaacaagtacttcatcaagaaggagggggaccagccgcagctgaacttcaagaagaagttctga

SEQ ID NO: 1644 - RNA, 3381 nt, synthetic construct
  misc_feature 1..3381: note = Cas9 variant
  source 1..3381: mol_type = other RNA
atggccagcaagcacgagaacctgggcgccctcaccttcgggctggacatcggcatcgcgtccgtggggtgggccgtcctgggcgagaaccgcatcatcgacctcggggtgcggtgcttcgacaaggccgagaccgccaaggagggcgagagcctgaacctggcccgccggacggcgcgcctcctgcggcgccggctgcgccggcgcgcctggcggctcaccaagctggcccgcctgctcaagcgggagggcctgatcgccgacaccaacgtgttccagaagcccttcaacctgaaggacgcgaacgagaaggggctctccttctggcagctgcgcgtcgacgccctggaccggaagctcagcgccgaggagtgggcccgcgtgatctaccacctgtgcaagcaccggggcttccactggatctcccgcgccgaggagaaggcggccgagggggacagcaagtccgagggcgggaaggtgaagcagggcctggccggcaccaagaagctcatgcaggagaagaactaccggacggccgccgagatggtcctgaccgagttccccgaggcgcagcgcaacaagcagggggactacagcaaggccctgtcccggatcctcctgggcgacgagatgacccagctgttcaagcaccagcgcgagctcgggaacccccacgccaccgagaagctggaggccgccatcctgggcaacggcgaccacaagagcggcctcttctgggcgcagaaccccgccctggccgggaacgacctgctcaagatgctggggcactgcacgttcgagaaggccgagtaccgcgtgcccaaggcctccttcaccgcggagcggcacgtgtggctgacccgcctcaacaacctgcggatcgtcgtggacggcaccacgcgcccgctgaacgaggccgagcggcacctcgccctgctgatgccctaccagcaggccggggacctcacctacaagcagctgcgcaccgcgctgaccaaggccggctacctccccgagagcttccggtacacgggcctggcctacgcctccgggcagaaggccgacgagaaggcgaaggaccccgagagcgccccgctggtgaagctccccgcctggcacgagctgcgcaagaccctggagaagaaggagctggcctccgagtggcagaagatcagctccgacgccctcgacggcaagccccagctgctggaccagatcgcgtgggtcctcagcgtgtacaaggacgacaccgaggtggaggccgagctgtgcaagctgaacctccccaacgccgagaagatgatcgacgccctgctggacatccggttcgacaagttctccaacctcagcctgaaggccctgcgccagatcgtcccgctcatggagcaggggcagcggtacgacgaggcggtggccaacatccccgagtacggccaccacagccagctgcacgaggtgggggccggcgagcacaagtacctgccgcccttctacaaggagcgcgacaagaccggccggatggtcttcaacgacgacatggacatcccccgcaaccccgtggtgctccgggccctgaaccaggcgcgcaaggtcgtgaacgccctgatcaaggagtacgggagcccccacgaggtgcacatcgagatggcccgggacctctcccgccccctggacgagcggcgcgacgtcgagaagctgcagaaggagttccgcgaccggaacgagaaggacaaggccctcttcgcccaggacttcaacatcgtgggcgcggtcaaggggaaggagttcgagaagtaccagctgtaccgcgagcagcagggcaagtgcgcctactccatcgagccgatggacatccaccggctgttcgagcaggggtacgtggagatcgaccacgccctcccctacagccgctccttcgacgacagcaagaacaaccgggtgctggtcctggccaaggagaaccgcgacaagggcaaccggacgcccttcgagtacctcggcgggaaggacaactccgagcgctggcggcagttcgtggccttcgtggagggcaacaagagctaccgcctggcgaagcggtcccgcctgctccggaaggacttcgggaaggacgaggccaagggcttccgcgagcggaacctgaacgacacccgctacatctgccggttcttcaagaactacgtcgagcagtacctgcagctccacgaggacagcgacgccaagcgctgcgtggtgctgtccggccagatgaccagcttcctgcgggcccgctgggggctcgtcaaggtgcggggcgactccgaccgccaccacgccctggacggggcgatcgtggccgcctgcagccactccatggtcaagcgcctgagcgactactcccggcgcaaggagctcgagcaggtccgggccggcttcgtggacgtggacaccggggagatcgtgaaccccgcgatgttccagcaggtccaggagcacttcccgaacccctggccccacttccgcgacgaggtgaagctgcggctgaacgtggacgaccccgccctcctgcacagcgagatgaaccgcttcggcacgtactccccggaggccctgaaggccctccggcccctgttcatcagccgcgcgccccagcggcgcaacagcggcgccgcccacaaggacaccatctacgcccagccggagcggctggtggcccagggcggggtcacccagaaggtgcccctcacctccctgacgctgaaggacctcgacaagctgatcgacccccaccgcaacgagaagctgtacagcgccatccggatccgcctcgagcagcacgggggcaagggggacaaggcgttccccgcctccaacccgctgcggaagcccgacagcgagggcaaccccaccggccccatcgtgcgcggggtcaccatggtgatcgacaagctgtccggcatcccgatccgcgggggcatcgccaagaacgacagcatggtgcgggtcgacgtgttcaccaaggccgggaagttccacctcgtgcccgtctacgtgcaccacgccgtggcgaaggtcctgcccaaccgggccgtggtggcctacaaggacgagacggagtggaccctgatcgacgacggcttcgacttctgcttctccatgtaccccaacgacctcctgcgcatcaagctgcgcaacgccagccacctcggctactacgcctcctgcaaccggagcaccggggcgatcaacctgtggtcccacgaccgcaaccagcaggtcggcaaggacgggatgatcgagagcatcggcgtgaagaccgccctgaacgtggagaagctcaacatcgacgtcctggggaaccggtacccggccccgcccgagaagcgccgggacctggcctga

SEQ ID NO: 1645 - RNA, 3384 nt, synthetic construct
  misc_feature 1..3384: note = Cas9 variant
  source 1..3384: mol_type = other RNA
atgagcgacctggtgctcggcctggacatcgggatcggctccgtcggggtgggcatcctgaacaaggtgaccggggagatcatccacaagaacagccgcatcttccccgccgcccaggcggagaacaacgtcgagcggcgcatcaaccggcagggccgccggctcacccgccggaagaagcaccgccgggtgcgcctgaaccacctgttcgaggagtccggcctcatcacggacttcaccaacgtgagcatcaacctgaacccgtaccagctgcgggtcaaggggctcaccgacgagctgtccaacgaggagctgttcatcgccctcaagaacatggtgaagcaccgcggcatcagctacctggacgacgcctccgacgacgggaacagctccgtgggcgactacgcccagatcgtcaaggagaacagcaagcagctggagaccaagacgcccgggcagatccagctcgagcggtaccagaagtacggccagctgcgcggcgacttcaccgtggaggaggacgggaagaagcaccggctgatcaacgtgttccccacctccgcctaccgcgcggaggccctccggatcctgcagacccagcaggagttcaacccccagatcacggacgagttcatcaacagctacctgcagatcctcaccggcaagcgcaagtactaccacgggccgggcaacgagaagtcccggaccgactacggccgctacaccacgaagaaggacagcgaggacgagtacatcaccctggacaacatcttcgggatcctgatcggcaagtgcaccttctaccccgaggagtaccgggccgccaaggcgtcctacaccgcccaggagttcaacctcctgaacgacctgaacaacctcacggtccccaccgagaccaagaagctgagcgaggagcagaagaaccagatcatcaccaacgtgaagaacgagaaggccatggggcccgccaagctgttcaagtacatcgccaagctcctgtcctgcgacgtggcggacatcaagggctaccgcatcgacaagagcgacaaggccgagatccacacgttcgaggcctaccgcaagatgaagaccctggccaccatcgacatcgagcagatggagcgggagaacctcgacaagctggcctacgtcctgaccctcaacacggagaaggaggggatccaggaggcgctggagcacgagttcgccgacggcaccttctcccaggagcagatcgacgagctggtgcagttccgcaaggccaacagcagcatcttcggcaaggggtggcactccttcagcgtgaagctcatgatggagctgatcccggagctgtacgccacctccgaggagcagatgaccatcctcacgcggctgggcaagcagaagaccaccagctccagcaacaagaccaagtacatcgacgagaagcagctgacggaggagatctacaaccccgtcgccgcgaagtccgtgcgccaggccatcaagatcgtgaacgccgccatcaaggagtacggggacttcgacaacatcgtcatcgagatggcccgggagaccaacgaggacgacgagaagaaggcgatccagaagatccagaaggccaacaaggacgagaaggacgccgccatgctcaaggcggccaaccagtacaacggcaaggccgagctgccccacagcgtgttccacgggcacaagcagctggccaccaagatccgcctctggcaccagcagggcgagcggtgcctgtacaccggcaagacgatctccatccacgacctgatcaacaacagcaaccagttcgagatcgaccacatcctgcccctctccatcaccttcgacgacagcctggccaacaaggtgctggtctacgcgaccgccaaccaggagaaggggcagcgcaccccgtaccaggccctcgactccatggacgacgcctggagcttccgggagctgaaggccttcgtgcgcgactccaaggcgctgagcaacaagaagaaggagtacctcctgaccgaggaggacatctccaagttcgacgtccggaagaagttcatcgagcgcaacctggtggacacgcggtacgccagccgcgtggtcctcaacgccctgcaggagcacttccgggtgcacaagaccgacaccaaggtgtccgtcgtgcgcggccagttcaccagccagctgcggcgccactgggggatcgagaagacgcgggacacctaccaccaccacgccgtggacgccctcatcatcgcggccagctcccagctgaacctgtggaagaagcagaagaacaccctcgtcagctactccgaggaccagctgctggacatcgagaccggcgagctcatcagcgacgacgagtacaaggagtccgtgttcaaggccccctaccagcacttcgtggacacgctcaagagcaaggagttcgaggactccatcctgttcagctaccaggtcgactccaagttcaaccgcaagatcagcgacgccaccatctacgcgacccgccaggccaaggtggggaaggacaagaaggacgagacctacgtgctcggcaagatcaaggacatctactcccagacgggctacgacgccttcatcaagatctacaagaaggacaagagcaagttcctgatgtaccggcacgacccccagaccttcgagaaggtcatcgagcccatcctggagaactacccgaacaaggagctcaacgagaaggggaaggaggtgccctgcaaccccttcctgaagtacaaggaggaccacggctacatccgcaagtactccaagaaggggaacggccccgagatcaagagcctgaagtactacgactccaagctcggcaaccacatcgacatcaccccgaagaacagcaacaacaaggtggtcctgcagtccgtgagcccctggcgggccgacgtgtacttcaacaagaccacggggaagtacgagatcctgggcctcaagtacgccgacctgaagttcgagaaggggaccggcacctacaagatcagcgaggagaagtacaacgacatcaagatcaaggagggggtcgactccgacagcgagttcaagttcaccctgtacaagaacgacctcctgctgatcaaggacacggagaccaaggagcagcagctgttccgcttcctgtcccggaccatgcccaacgtgaagcactacgtggagctgaagccctacgacaagcagaagttcgacgacaacgaggagctcatcaagatcctgggcatcgtcgcgaagggcgggcagtgcaagaagggcgtgagcaagccgaacatctccatctacaagatccgcaccgacgtgctggggaaccagcacatcatcaagaacgagggcgacaagcccaagctcgacttctga

SEQ ID NO: 1646 - RNA, 3384 nt, synthetic construct
  misc_feature 1..3384: note = Cas9 variant
  source 1..3384: mol_type = other RNA
atgaacggcctggtgctcgggctggacatcggcatcgccagcgtcggggtgggcatcctggagaaggactccgggaagatcatccacgccaacagccgcatcttccccgcggccaccgccgacaacaacgtggagcggcgcacctcccggcaggcccgccggctcaaccgccggaagaagcaccgcagcgtccggctgcacgacctgttcgaggagtacggcctcctgacggacttctccaaggtgagcatcaacctgaacccgtaccagatccgcgtgcagggcctcgacaagcggctgaccaacgaggagctgttcatcgccctcaagaacatcgtcaagcgccgggggatctcctacctggacgacgcgagcgaggacggcggggccgtgtccagcgactacggcaaggccgtggaggagaaccgcaagctgctcgcccagcagacccccgggcagatccagctggaccggttcgagaagtacggccaggtccgcggcgacttcaccgtggtggagaacggggagaagcggcgcctgatcaacgtcttctccacgagcgcgtaccggaaggaggccgagcgcatcctccggaagcagcaggagttcaacaacaagatcaccgagggcttcatcgaggactacctgaccatcctgaccgggaagcgcaagtactaccacggccccggcaacgagaagtcccgcacggactacgggcggtacaccaccaagaaggacagccagggcgagtacatcaccctcgacaacatcttcgggatcctgatcggcaagtgcacgttctaccccgacgagtaccgcgcctccaaggccagctacaccgcccaggagttcaacctgctcaacgacctgaacaacctgaccgtgccgaccgagacgaagaagctctccgtggagcagaagaagaccatcgtcgagtacgcgaagaccgccaagaccctgggggccagcacgctgctcaagtacatcgccaagctgatcggcgtgtccgtggaccagatccacggctaccggatcgaccccaacgagaagcccgagatgcacaccttcgaggtctaccgcaagatgcagagcctggagaccatccgggtggaggagctcccccgcaaggtgatcgacgagctggcccacatcctgaccctcaacacggagcgggaggggatcgaggaggcgatcaacgccaagctgaaggacatcttcagccaggaccaggtcctggagctcgtgcagttccgcaagaacaactccagcctgttctccaagggctggcacaacttcagcctgaagctcatgatggagctgatcccggagctgtacgagacctccgaggagcagatgaccatcctcacccggctggggaagcagaagtccaaggagacgagcaagcgcaccaagtacatcgacgagaaggagctgaccgaggagatctacaaccccgtggtcgccaagagcgtgcggcaggccatcaagatcatcaacgaggccaccaagcgctacggcatcttcgacaacatcgtcatcgagatggcgcgggagaacaacgaggaggacgccaagaaggagtacatcaagcgccagaaggccaacctcgacgagaagaacgccgccatggagaaggcggccttccagtacaacgggaagaaggagctgcccgacaacgtgttccacggccacaaggagctggccacgaagatccggctgtggcaccagcagggcgagaagtgcctctacaccgggaagaacatccccatctccgacctgatccagaaccgctacaagtacgagatcgaccacatcctgccgctcagcctgtccttcgacgacagcctgtccaacaaggtgctcgtcctggccaccgcgaaccaggagaagggccagcggacccccttccaggccctggacagcatggactacgcctggtcctaccgcgagttcaagagctacgtgaaggactccaagctcctgagcaacaagaagaaggactacctgctcacggaggaggacatctccaagatcgaggtgaagcagaagttcatcgagcggaacctggtcgacacccgctacagcagccgcgtggtgctgaacgccctccaggacttctacaaggagcaccagttcgacaccaccatctccgtcgtgcgggggcagttcaccagccagctgcgccggaagtggggcatcgagaagtcccgcgagacgtaccaccaccacgccgtggacgcgctgatcatcgccgccagctcccagctccggctgtggaagaagcacaacaaccccctgatcagctacaaggaggagcagttcgtcgactccgagaccggggagatcatcagcatgtccgacgacgagtacaaggagctcgtgttcaaggccccctacgaccacttcgtggacaccctcaagagcaagaagttcgaggactccatcctgttcagctaccaggtcgactccaagtacaaccgcaagatcagcgacgccaccatctacgcgacgcggaaggccaagctggacaaggacaagtccgaggagacctacgtgctgggcaagatcaaggacatctacagccaggccggctacgacaccttcatcaagatctacaacaaggacaagtcccgcttcctgatgtaccacaaggacccgcagaccttcgagaaggtgatcgaggagatcctccggacgtaccccagcaaggagctgaacgagaagaacaaggaggtcccctgcaaccccttcgagaagtaccgccaggagaacgggccgatccggaagtacagccgcaagggcaacgggcccgagatcaagtccctgaagtactacgacaacaagctcggcaaccacatcgacatcacccccaacgagagcatgaaccaggtggtgctgcagtccctgaagccctggcggaccgacgtcttcttcaaccaccagaccgagaagtacgagctcatgggcctgaagtacagcgacctgaacttcgagaaggggtccggcaagtacagcatctccctcgagaagtacaacagcatcaagatgaacgagggggtgtccgaggagagcgagttcaagttcacgctgtacaagaacgacctgatcctcatcaaggacgccctgaccaaggaggcccagatcttccgctacggctcccggaacgacaccagcaagcactacgtggagctgaagccgtacgacatgtccaagttcgagggggacgagcgcctcatcaaggtcctgggcaccgtggcgaagggcgggcggtgcatcaagggcctgaacaagaaggacatcagcatcttcaaggtgaagacggacgtcctcgggaacaagcacttcatcaagaaggagggcgaggagcccaagctgaagttctga

SEQ ID NO: 1647 - RNA, 3387 nt, synthetic construct
  misc_feature 1..3387: note = Cas9 variant
  source 1..3387: mol_type = other RNA
atgaccaagctgggcaagccctacgggatcggcgtggacatcgggagcaactccatcggcttcgccgccgtcgacgagaacagccacctcatccgcctgaaggggaagaccgtgatcggcgcgcggctgttcgaggagggcaaggccgccgccaagcgccgggccgggcgcacgacccggcgccggctctcccgcaaccggtggcgcctgagcttcctgcgggacttcttcgagtcccacatcaccccgaccgaccccaacttcttcatgcgccagaagtacagcgagatctcccccaaggacaaggcgcggtacaagtacgagaagcgcctcttcaacgaccggacggacgccgagttctaccagcagtacagcaccatgtaccacctccgcaaccggctgatgaccgacccctcccgcgccgacgtgcgggagatctacttcgccatccaccacatcctcaagagccgcggccacttcctgaccccgggggacgcgaaggacttcaacacgaacgacgtcgccctggacgagatcttccccgccctgcaggacgcctacgcccaggtgtaccccgacctgggcatcaccttcgacgaggacaaggcgaacgagttcaagaccatcctgctcaacgagatcgccacctccatcgacacgcagcgggccctggtgaagctgctcctggccgaggaggacgacaaggacatcctgaagcagcagaagcaggtcctcaccgagttcgccaaggcggtggtggggctgaagaccaagctgaacctcgccctgggcaccgaggtcgacagctccgaggccacggcctggaacttcagcctgggccagctcgacgacaagtgggccgggatcgagtccgcgatgaccgacgagggcaccgagatcctggaccagatccgcgacctgtaccgcgcccggctcctgaacgggatcgtgcccaccggcaagacgctgagccaggccaaggtggacgactacacccagcaccacgaggacctccagctgttcaaggcctacctgaagcagctcgaggacgacggcaccgccaaggcgatccgccagctgtacgaccggtacatcgacggggacgacgccgccccgttcctgcgcgagaacttcgtcaaggccctcaccaaggacgtgacggcgcaccccaacaccaagtcccccgagctgctggagcggctcgcccagcccgacttcatgctgaagcagcgcaacaaggccaacggcgccatcccggtgcagatgcagcagcgggagctggaccagatcatcaagaaccaggccgtctactacgactggctcgcggcccccaaccccgtggagaagcaccgcaagagcatgccctaccagctggacgagctgctcaacttccggatcccgtactacgtggggcccctggtcaccgccaaggagcagaaggccgcccagggcggggtgttcgcgtggatggtgcgcaaggaccccgagggcaacatcaccccctacaacttcgacgagaaggtcgaccgggaggcctccgccaacacgttcatccagcgcatgaagaccaccgacacctacctgatcggcgaggacgtgctgccgaagcagagcctcctgtaccagcggtacgaggtgctgaacgagctcaacaacgtccgcgtgaacaacgagaagctgagcatcgagcagaagcagcaggtcatccgggagctgttcgagcgccacaactccgtgacgatcaagcagttcgccgagaacctccgggcccacggggactacgcgcacatccccgagatccgcggcctggccgacgagaagcggttcctgagctccctcagcacctaccgccagctgaagtccctgctccccgaggccatcgacgaccccgccaagcaggcggacatcgagaacatcatcgcctggagcaccgtgttcgaggacgccgccatcttcaagaccaagctgaaggagatctcctggctggggagcgaggccatcacgaagctctccaacatccgctaccggggctgggggcagttcagccgcaagttcctgaacggcctgaccctcggcaacgggcacaccatcatccaggagctgctgctctccaccaacaacctgatgcagatcctgaccgacgagacgctccagaagaagatgaccgagctgaacgcggacaagctgaagaccgccaacatcaacgacgccatcgacaacgcctacaccagcccgtccaacaagaaggccctccggcaggtcctgcgcgtggtggacgacatcaagcgggcggccgacggccaggaccccagctggctgtacgtcgagacggccgacgggggcgggacccccggcaagcgcacccgggcccgccagcaccagctccaggagatctacgccaacgcggcccacgagctgatcgacaccgccgtgcggggcgagctggaggacaagatctccgacaaggccgacttcaacgaccgcctcgtgctgtacttcatgcagggcgggcgggacatctacacgggggcgcccctgaacatcgaccagctcagctcctacgacatcgaccacatcctgccgcagagcctgatcaaggacaactccctcgacaaccgcgtcctggtgcacgccatcatcaaccgggagaagaacgccaccttcgccagcaccatctacgcccagaagatgaacgcgacctggcgccagtggcacgaggccggcctgatcagcggccggaagctccgcaacctgcagatgcggcccgaccagatcgacaagtacgcctccgggttcgtggcccgccagctggtcgagacgcggcagatcatcaagctcaccgagcagatcgtggccgcgcagtaccccgacaccaagatcatcgccgtgaaggccggcctgagccaccagctgcgcgaggagctcgagttcccgaagaaccgggacgtcaaccactaccaccacgccttcgacgccttcctggcggcccgcatcgggacctacctgctcaagcgcttccccaacctgcaggccttcttcacgtacggcaagttcaccaaggccgacgtgaagaagctgcgggggttcaacttcatccgcgacatcacccacgccgaggacaagatcgtggcgaaggacaccggcgaggtcgtgtgggacaagcagcgggacgtggacgagctcgaccgcatctacaacttcaagcggatgctgatcacgcacgaggtccgcttcgagaccgccgacctgttcaagcagaccgtgtacggcgcccgggactccaaggaggccgggggcagcaagcagctcatccccaagaagaaggacatccagctgatcttcatgggggcgatctccgagcgcacccggcccatcctgccgctctga

SEQ ID NO: 1648 - RNA, 3387 nt, synthetic construct
  misc_feature 1..3387: note = Cas9 variant
  source 1..3387: mol_type = other RNA
atggacgagaagatggactaccgcatcggcctggacatcgggatcgccagcgtgggctgggccgtcctccagaacaactccgacgacgagcccgtgcggatcgtggacctgggggtccgcatcttcgacaccgcggagatcccgaagaccggcgagagcctggccgggccccggcgcgccgcccggacgacccgccggcgcctccggcgccggaagcaccgcctggaccggatcaagtggctgttcgagaaccagggcctcatcaacatcgacgacttcctgaagcgctacaacatggccggcctgcccgacgtgtaccagctccggtacgaggcgctggaccgcaagctgaccgacgaggagctcgcccaggtgctgctgcacatcgccaagcaccgggggttccgctccacccggaaggccgagacggcggccaaggagaacggcgccgtcctcaaggccaccgacgagaaccagaagcgcatgcaggagaaggggtaccggaccgtgggcgagatgatctacctggacgaggccttccgcatcgggtgcagctggtccgagaagggctacatcctgacgccccgcaacaaggcggagaactaccagcacaccatgctccgggccatgctggtggaggaggtcaaggagatcttcagctcccagcgccggctgggcaacaagaaggccaccgaggagctcgaggagaagtacctggagatcatgaccagccagcgctccttcgacctggggccgggcatgcagcccgacgggaagcccagcccctacgccatggagggcttctccgaccgggtgggcaagtgcaccttcctcggggaccagggcgagctgcgcggggccaagggcacgtacaccgcggagtacttcgtggccctgcagaagatcaaccacaccaagctcgtcaaccaggacggggagacccggaacttcacggaggaggagcgccgggccctgaccctgctcctgttcacccagaaggaggtgaagtacgccgccgtgcgcaagaagctgggcctcccggaggacatcctgttctacaacctgaactacaagaaggcggccaccaaggaggagcagcagaaggagaaccagaacacggagaaggccaagttcatcggcatgccctactaccacgactacaagaagtgcctcgaggagcgggtcaagtacctgaccgagaacgaggtgcgcgacctgttcgacgagatcgggatgatcctgacctgctacaagaacgacgacagccggaccgagcgcctcgccaagctgggcctcgtgcccatcgagatggaggggctgctggcctacacgcccaccaagttccagcacctctccatgaaggcgatgcggaacatcatcccgttcctggagaagggcatgacctacgacaaggcctgcgaggaggccgggtacgacttcaaggccgacagcaagggcaccaagcagaagctgctcacgggcgagaacgtcaaccagaccatcaacgagatcaccaaccccgtggtgaagcgctccgtcagccagaccgtgaaggtgatcaacgcgatcatccggacgtacgggagcccccaggccatcaacatcgagctggcccgcgagatgtccaagaccttcgaggagcggcgcaagatcaagggcgacatggagaagcgccagaagaacaacgaggacgtcaagaagcagatccaggagctggggaagctgtcccccaccggccaggacatcctcaagtaccggctgtggcaggagcagcaggggatctgcatgtacagcggcaagaccatcccgctggaggagctgttcaagcccggctacgacatcgaccacatcctcccctacagcatcacgttcgacgactccttccgcaacaaggtgctggtcaccagccaggagaaccggcagaaggggaaccgcaccccctacgagtacatgggcaacgacgagcagcggtggaacgagttcgagacccgcgtgaagaccacgatccgggactacaagaagcagcagaagctcctgaagaagcacttctccgaggaggagcgcagcgagttcaaggagcggaacctgaccgacaccaagtacatcaccacggtgatctacaacatgatccgccagaacctcgagatggccccgctgaaccggcccgagaagaagaagcaggtccgcgccgtgaacggggcgatcaccgcctacctgcggaagcgctggggcctcccccagaagaaccgggagaccgacacccaccacgccatggacgccgtggtcatcgcctgctgcacggacggcatgatccagaagatctcccgctacaccaaggtgcgggagcgctgctacagcaaggggaccgagttcgtggacgcggagaccggcgagatcttccggcccgaggactactcccgcgccgagtgggacgagatcttcggggtccacatcccgaagccctgggagacgttccgggccgagctggacgtgcgcatgggcgacgaccccaaggggttcctggacacccacagcgacgtggccctcgagctggactaccccgagtacatctacgagaacctgcgcccgatcttcgtctcccggatgcccaaccacaaggtgaccggcgccgcgcacgccgacaccatccgcagcccccggcacttcaaggacgagggcatcgtgctcacgaagaccgccctgaccgacctgaagctcgacaaggacggggagatcgacggctactacaacccgcagtccgacctgctgctctacgaggccctgaagaagcagctgctcctgtacgggaacgacgcgaagaaggccttcgcccaggacttccacaagcccaaggccgacggcaccgaggggcccgtcgtgcgcaaggtgaagatccagaagaagcagacgatgggcgtcttcgtggacagcggcaacgggatcgccgagaacggcgggatggtgcggatcgacgtcttccgcgtgaacggcaagtactacttcgtgcccgtctacaccgcggacgtggtgaagaaggtcctgccgaaccgggcctccaccgccaacaagccctacagcgagtggcgcaccatggaggacaaggacttcctcttctccctgtacagccgggacctggtgcacatcaagtccaagaaggggatccccatcaagaacgtggacggcagcctcggcgagtccaaggaggtctacgcctactacatcggggccgacatcagcggcgcgaagatcgaggggaaggcccacgacagccgctacacgttccggggcatcggggtgcagaagctggagctgatcgagaagtgccaggtggacatcctcggccacatctccaccgtcaagaacgagaagcgcatgggcttcagctga

SEQ ID NO: 1649 - RNA, 3387 nt, synthetic construct
  misc_feature 1..3387: note = Cas9 variant
  source 1..3387: mol_type = other RNA
atgaacgacaagaaccagaagtaccgcctgggcctcgacctggggaccaacagcatcggctggtgcatctactccctggacgtgaacaacaagcccgagaccctcatcgacatgggggtccggatcttcagcgacggccgcgacccgaagacgaaggagcccctggccgtggagcggcgcaccgcccgggggctgcgccggatcctccaccgccggaagctgcgccggcgccagatgttccggctgctccaggagcagggcctgatgcccaacgacgcgtccgaggccgccgccctcaagagcctcaacccctacgagctgcgcgtgaaggccctggacaccaagctcgagccgtacgagctgggccgggcgctgttcaacctctccgtccgccgggggttcaagagcaaccgcaaggaggccgtgcaggagaaggagaaggactcccagaacgacgccaagagccagaacgagaagtgcgagcacctggccaaggcgatcaaggactccggctgccggaccctgggggagttcctctggaagcacaagaacacggagacccagcagaccgagaacgacgcccgcaacatcggcatgcggttcgtgcccgggcgcagcaactactaccccacccgccggatgtacgtcgaggagttcgacgccatccgcaaggcccaggagccctactactccggcgtgaactgggacgccctgcacgagaagctgttctaccagcggccgctccgcgcgcaggagcggggcaagtgccgctacatgcccgacaaggagcggacgttcaaggccatgccctgcagccagaagatccgcatcctgcaggaggtgtacaacatggactacatcgacgagtacgggaagaccatccccctggaggaggcccagaccgactccctcatcagcctgctggacaagcgggagaagctctccttcaaggccatgaagaaggagctgggcatcgacgagagctgcaccttcaacctggagcgcgggggccgggagtacctccagggcaacgccgcggccgtcaagctgcgcaacaagaagcggttcggggagctgtgggactccctcagcctggccaagcaggacgccatcgtggagaagctgatcacggccgacgaggacgcggagatcatctccatgctcgcccagtacaacctgaccgacgagcagaagaagaacatcgccgtgaccgtcctgccgagcggcaccgccatgctctgcaaggaggtgacggagatgctggtgcagaagatggagcagaacaagatccccctgaccgtcgccgtgcagatgctcgggtacacctacgcggaccagagcgtgcgcgaggaggacaccctgccctactacggcgccatcctgacggggtccaccatgggcgcccaccccgaggccgacgagagcgagccggagctcaagtacggcaagatctccaaccccaccgtccacgtggcgctgaaccagacccggacggtggtcaacgccctgatcaaggcctacgggaagccccagcagatcgtggtggagctgagccgcgacctcaaggcctcccgggaggccaaggcgcgcatccagaagaccatcaccatgaaccagaagcggaacgagcgcgacaacaagaacatcaccgacatcacgaagatcccctacccgaaccgcaacgaccggctgaagtaccgcctgtgggaggagctcggcagcgggtccaacagcttctcccggaagtgcctgtactgcggcaagcccatcagcgggtccgagatcttcaccgagaacatcgagatcgagcacatcctgcccttcggccgcaccctcttcgacggcgagaccaacaagacggtcgcccacaccgactgcaaccgggacaagggggaccgcagccccttcgaggccttcggctccagcccgaacgggtacaactggcacgagatctgcgcccgggccaactccctgaagaaccccgcgaagcgcaccctgttcgccgagaacgccatggagaagttcgagaaggacaacagcttcatccagcggcagctcaccgacaacgcctacctgtcccgcagcgccctgcggtacctccgctgcatctgcaaggacgtgtggtccatcaacggcgggatgacgaagctgctgcgggacaagtggaacatcgacagcatcctcaagcgcaagatcgacgaccccgagatcgcgcacttcgagctgaagaacgaccagatcggccagtacaagaagaaccggtacgaccaccgccaccacgccctggacgccagcgtcatcgccctcatcgaccgggcgatggtgcaggagatctcccagctgaacaagatccgcctgaagaaccggatcgaggcgccccagatgccggtgctccgcagcgagctgatcgagaaggtcaagcacatcaccgtgtccttcaagcccgaccacggccggcaggggaagctgagcaaggagaccctcctgggcaagatcaagaagatcgagaaggtggacatcgactccatccagaccgacgacatcgccagcatcaaggacgacgccatccgcacccgcttcgagacgaagcggcgcgagctgggggacatcaccaaggccaaggccgccctcaagaccgagttccccaagctggacgtcttcaagacctactacgtgtcccggacgccgatcgtgagcctgaccgagaagaacatcaactccatcgtcgacgagaagatcaaggagaagctcaagaccttcatcaaggagcacgccgacctgagcttcgccgagcagctgcagaagttctccgagaccgagtggatcggcaagcccagcgccgcgggcaagcccgggaagaagtaccgcatcgagaaggtgcggtgcatcaactggggccagacgcccatcaccatcacctccagcgccgtgccgcgctacctctgccccgaggactacctggccgccgtcgtgtggcagatcccctccaagaagaaggacaccgagcccgagtacaaggccacgttcctgcggcgcgacgagttcgacgtgaacaacaagccgaagaagctcgagaagccccacgacgcggcccagtacatctgcatgctgtacaaggacgactacctggagttcaccgagagcggggccacccacctctgccggatcgccggcctgcccgcgtcccagaacaacaagatcgacatccgccccatctacgccgtcagcgactgcaaggactggatcatcgccaccaacgagaacatgctggagccgtgctggaagccccagaaggaggagaagcggatcagcgtgaacgtgctgttcgggaagcacaaggcccgctccgtcacggtgaaccccatcggccgggtgttccgcaagtga

SEQ ID NO: 1650 - RNA, 3387 nt, synthetic construct
  misc_feature 1..3387: note = Cas9 variant
  source 1..3387: mol_type = other RNA
atgagcgacctggtgctcggcctggacatcgggatcggctccgtcggggtgggcatcctgaacaaggtgaccggggagatcatccacaagaacagccgcatcttccccgccgcccaggcggagaacaacgtcgagcggcgcaccaaccggcagggccgccggctcacgcgccggaagaagcaccgccgggtgcgcctgaaccacctgttcgaggagtccggcctcatcaccgacttcaccaaggtgagcatcaacctgaacccgtaccagctgcgggtcaaggggctcatcgacgagctgtccaacgaggagctgttcatcgccctcaagaacatggtgaagcaccgcggcatcagctacctggacgacgcctccgacgacgggaacagctccgtgggcgactacgcccagatcgtcaaggagaacagcaagcagctggagaccaagacgcccgggcagatccagctcgagcggtaccagaagtacggccagctgcgcggcgacttcaccgtggaggaggacgggaagaagcaccggctgatcaacgtgttccccacctccgcctaccgcagcgaggcgctccggatcctgcagacccagaaggagttcaacccccagatcacggacgagttcatcaaccgctacctggagatcctcaccggcaagcggaagtactaccacgggccgggcaacgagaagtcccgcaccgactacggccggtacaccacgaagaaggacagcgagaacgagtacatcaccctggacaacatcttcgggatcctgatcggcaagtgcaccttctaccccgaggagtaccgcgccgccaaggcctcctacaccgcgcaggagttcaacctcctgaacgacctgaacaacctcacggtccccaccgagaccaagaagctgagcgaggagcagaagaaccagatcatcaactacgtgaagaacgagaaggccatggggcccgccaagctgttcaagtacatcgccaagctcctgtcctgcgacgtggccgacatcaagggctaccgcatcgacaagagcgacaaggcggagatccacaccttcgaggcctaccggaagatgaagacgctggagaccatcgacttcgagaagatgtcccgcgaccagctcgacaagctggcctacgtcctgaccctcaacaccgagcgggaggggatccaggaggccctggaccacgagttcgccgacggcaacttcagccaggagcagatcgacgagctggtgcagttccgcaaggcgaacagctccatcttcggcaaggggtggcacaacttcagcgtgaagctcatgatggagctgatcccggagctgtacgccacgtccgaggagcagatgaccatcctcacccggctgggcaagcagaagaccacgagctccagcaacaagaccaagtacatcgacgagaagctgctcaccgaggagatctacaaccccgtcgtggccaagtccgtgcgccaggccatcaagatcgtcaacgccgcgatcaaggagtacggggacttcgacaacatcgtgatcgagatggcccgggagaccaacgaggacgacgagaagaaggccatccagaagatccagaaggccaacaaggacgagaaggacgccgcgatgctgaaggccgccaaccagtacaacggccgcgccgagctgccccacagcgtgttccacgggcacaagcagctcgcgacgaagatccggctgtggcaccagcagggcgagcgctgcctgtacaccggcaagaccatctccatccacgacctgatcaacaaccccaaccagttcgagatcgaccacatcctcccgctgagcatcaccttcgacgactccctggccaacaaggtcctcgtgtacgccacggccaaccaggagaaggggcagcggaccccctaccaggccctggacagcatggacgacgcgtggtccttccgcgagctgaaggccttcgtccgggagagcaagtccctcagcaacaagaagaaggagtacctgctgaccgaggaggacatctcccgcttcgacgtgcggaagaagttcatcgagcgcaacctcgtggacacccggtacgccagccgcgtcgtgctgaacgccctgcaggagcacttccgggcccacaagaccgacacgaaggtgtccgtcgtgcgcggccagttcaccagccagctccgccggcactgggggatcgagaagacccgcgacacctaccaccaccacgcggtggacgccctgatcatcgccgccagctcccagctgaacctctggaagaagcagaagaacacgctggtcaactacagcgagaaccagctgctcgacatcgagaccggcgagctgatctccgacgacgagtacaaggagagcgtgttcaaggccccctaccagcacttcgtggacaccctgaagtccaaggagttcgaggacagcatcctcttctcctaccaggtcgacagcaagttcaaccggaagatctccgacgcgaccatctacgccacgcgccaggccaaggtggggaaggacaagaaggacgagacctacgtgctgggcaagatcaaggacatctacagccagaccggctacgacgccttcatcaagatctaccagaaggacaagtccaagttcctgatgtaccggcacgacccccagaccttcgagaaggtcatcgagccgatcctcgagaactaccccaacaaggagatgaacgagaaggggaaggaggtgccctgcaaccccttcctgaagtacaaggaggagcacggcgactacatccgcaagtacagcaagaaggggaacggcccggagatcaagtccctgaagtactacgacagcaagctcggcaaccacatcgacatcacgcccaaggactccaacaacaaggtggtcctgcagagcgtgtccccctggcgggcggacgtgtacttcaacaagaccaccgggaagtacgagatcctgggcctcaagtacgccgacctgcagttcgagaaggggaccggcacgtacaagatcagccaggagaagtacaacgtcatcaagaagaaggagggggtggacagcgactccgagttcaagttcaccctgtacaagaacgacctcctgctgatcaaggacaccgagaccaaggagcagcagctgttccgcttcctcagccggacgaagcccaacgtgaagcactacgtcgagctgaagccgtacgacaagcagaagttcgagggcaacgagtccctcatcaacgtgctgggcgccgtggccaagggcgggcagtgccagaaggggatcaacaagcccaacatcagcatctacaaggtccgcaccgacgtgctgggcaaccagcacatcatcaagaacgagggggacaagcccaagctcgacttctga

SEQ ID NO: 1651 - RNA, 3387 nt, synthetic construct
  misc_feature 1..3387: note = Cas9 variant
  source 1..3387: mol_type = other RNA
atggacgagaagatggactaccgcatcggcctggacatcgggatcgccagcgtgggctgggccgtcctccagaacaactccgacgacgagcccgtgcggatcgtggacctgggggtccgcatcttcgacaccgcggagatcccgaagaccggcgagagcctggccgggccccggcgcgccgcccggacgacccgccggcgcctccggcgccggaagcaccgcctggaccggatcaagtggctgttcgagaaccagggcctcatcaacatcgacgacttcctgaagcgctacaacatggccggcctgcccgacgtgtaccagctccggtacgaggcgctggaccgcaagctgaccgacgaggagctcgcccaggtgctgctgcacatcgccaagcaccgggggttccgctccacccggaaggccgagacggcggccaaggagaacggcgccgtcctcaaggccaccgacgagaaccagaagcgcatgcaggagaaggggtaccggaccgtgggcgagatgatctacctggacgaggccttccgcaccgggtgcagctggtccgagaagggctacatcctgacgccccgcaacaaggcggagaactaccagcacaccatgctccgggccatgctggtggaggaggtcaaggagatcttcagctcccagcgccggctgggcaacgagaaggccaccgaggagctcgaggagaagtacctggagatcatgaccagccagcgctccttcgacctggggccgggcatgcagcccgacgggaagcccagcccctacgccatggagggcttctccgaccgggtgggcaagtgcacgttcctcggggaccagggcgagctgcgcggggccaagggcacctacaccgcggagtacttcgtggccctgcagaagatcaaccacaccaagctcgtcaaccaggacggggagacgcggaacttcaccgaggaggagcgccgggccctgaccctgctcctgttcacccagaaggaggtgaagtacgccgccgtgcgcaagaagctgggcctcccggaggacatcctgttctacaacctgaactacaagaaggcggccacgaaggaggagcagcagaaggagaaccagaacaccgagaaggccaagttcatcggcatgccctactaccacgactacaagaagtgcctcgaggagcgggtcaagtacctgaccgagaacgaggtgcgcgacctgttcgacgagatcgggaccatcctcacgtgctacaagaacgacgacagccggaccgagcgcctggccaagctgggcctcgtgcccatcgagatggaggggctgctggcctacacccccaccaagttccagcacctctccatgaaggcgatgcggaacatcatcccgttcctggagaagggcatgacgtacgacaaggcctgcgaggaggccgggtacgacttcaaggccgacagcaagggcatcaagcagaagctgctcaccggcgagaaggtcaaccagaccatcaacgagatcaccaaccccgtggtgaagcgctccgtcagccagacggtgaaggtgatcaacgcgatcatccggacctacgggagcccccaggccatcaacatcgagctggcccgcgagatgtccaagaccttcgaggagcggcgcaagatcaagggcgacatggagaagcgccagaagaacaacgaggacgtcaagaagcagatccaggagctggggaagctgtcccccaccggccaggacatcctcaagtaccggctgtggcaggagcagcaggggatctgcatgtacagcggcaagacgatcccgctggaggagctgttcaagcccggctacgacatcgaccacatcctcccctacagcatcaccttcgacgactccttccgcaacaaggtgctggtcaccagccaggagaaccggcagaaggggaaccgcaccccctacgagtacatgggcaacgacgagcagcggtggaacgagttcgagacccgcgtgaagacgaccatccgggactacaagaagcagcagaagctcctgaagaagcacttctccgaggaggagcgcagcgagttcaaggagcggaacctgaccgacaccaagtacatcacgaccgtgatctacaacatgatccgccagaacctcgagatggccccgctgaaccggcccgagaagaagaagcaggtccgcgccgtgaacggggcgatcaccgcctacctgcggaagcgctggggcctcccccagaagaaccgggagaccgacacgcaccacgccatggacgccgtggtcatcgcctgctgcaccgacggcatgatccagaagatctcccgctacaccaaggtgcgggagcgctgctacagcaaggggaccgagttcgtggacgcggagacgggcgagatcttccggcccgaggactactcccgcgccgagtgggacgagatcttcggggtccacatcccgaagccctgggagaccttccgggccgagctggacgtgcgcatgggcgacgaccccaaggggttcctggacacccacagcgacgtggccctcgagctggactaccccgagtacatctacgagaacctgcgcccgatcttcgtctcccggatgcccaaccacaaggtgaccggcgccgcgcacgccgacacgatccgcagcccccggcacttcaaggacgagggcatcgtgctcaccaagaccgccctgaccgacctgaagctcgacaaggacggggagatcgacggctactacaacccgcagtccgacctgctgctctacgaggccctgaagaagcagctgctcctgtacgggaacgacgcgaagaaggccttcgcccaggacttccacaagcccaaggccgacggcacggaggggcccgtcgtgcgcaaggtgaagatccagaagaagcagaccatgggcgtcttcgtggacagcggcaacgggatcgccgagaacggcgggatggtgcggatcgacgtcttccacgtgaacggcaagtactacttcgtgcccgtctacaccgcggacgtggtgaagaaggtcctgccgaaccgcgccgccaccgcccacaagccctacggggagtggaaggtgatggaggacaaggacttcctcttctccctgtacagccgggacctgatccacatcaagtccaagaaggacatccccatcaagatggtgaacggcggcatggaggggatcaaggagacgtacgcctactacatcggcgcggacatcagcgccgccaacatccaggggatcgcccacgactcccgctacaagttccggggcctcgggatccagagcctggacgtcctggagaagtgccagatcgacgtgctcggccacgtgtccgtcgtgcgcagcgagaagcggatgggcttcagctga

SEQ ID NO: 1652 - RNA, 3387 nt, synthetic construct
  misc_feature 1..3387: note = Cas9 variant
  source 1..3387: mol_type = other RNA
atgagcgacctggtgctcggcctggacatcgggatcggctccgtcggggtgggcatcctgaacaaggtgaccggggagatcgtccacaagaacgcccgcatcttccccgccgcgcaggccgagaacaacgtggagcggcgcaccaaccggcagggccgccggctcacgcgccggaagaagcaccgccgggtgcgcctgaaccacatcttcgaggagagcggcctgatcaccgacttcaccaaggtctccatcaacctcaacccgtaccagctgcgggtgaaggggctgaccgacgagctcagcaacgaggagctgttcatcgccctgaagaacatggtgaagcaccgcggcatctcctacctcgacgacgccagcgacgacgggaactccagcgtcggcgactacgcccagatcgtgaaggagaactccaagcagctggagacgaagacccccgggcagatccagctggagcggtaccagaagtacggccagctccgcggcgacttcaccatcgaggaggacgggaagaagcaccggctgatcaacgtgttccccaccagcgcgtaccgcgccgaggccctgcggatcctccagacgcagcaggagttcaacccccagatcaccgacgagttcatcaactcctacctgcagatcctgaccggcaagcgcaagtactaccacgggccgggcaacgagaagtcccggaccgactacggccgctacacgaccaagaaggacagcgaggacgagtacatcaccctcgacaacatcttcgggatcctgatcggcaagtgcaccttctaccccgaggagtaccgggccgcgaaggccagctacacggcccaggagttcaacctgctcaacgacctgaacaacctgaccgtccccaccgagaccaagaagctctccgaggagcagaagaaccagatcatcacgtacgtgaagaacgagaaggccatggggcccgccaagctgttcaagtacatcgcgaagctgctcgcctgcgacgtggccgacatcaagggctaccgcatcgacaagagcgacaagccggagatccacaccttcgaggcctaccgcaagatgaagaccctggagaccatcgacgtcgagcagatggagcgggagaagctggacaagctcgcctacgtgctgacgctgaacaccgagcgcgaggggatccaggaggcgatcgagcacgagttctccgacggcaccttcagccaggagcaggtcgacgagctcgtgcagttccggaagtccaacagcagcatcttcggcaaggggtggcacaacttctccgtgaagctgatgatggagctgatccccgagctctacgccaccagcgaggagcagatgacgatcctgacccgcctgggcaagcagaagcggacctccagctccaacaagaccaagtacatcgacgagaagcgcctcacggaggagatctacaaccccgtggtcgccaagagcgtgcggcaggccatcaagatcgtgaacgccgcgatcaaggagtacggggacttcgacaacatcgtcatcgagatggcccgcgagatgaacgaggacgacgagaagaaggccatcaagaagatccaggaggccaacaagtccgagaaggacgccgcgatgcggaaggccgccaaccagtacaacggcaaggccgagctgccccacagcgtgttccacgggcacaagcagctggcgaccaagatccgcctctggcaccagcagggcgagcggtgcctgtacaccggcaagaccatctccatccacgacctgatcaacaacccgaaccagttcgagatcgaccacatcctccccctgagcatcacgttcgacgactccctggccaacaaggtcctggtgtacgccaccgccaaccaggagaaggggcagcgcaccccctaccaggccctcgacagcatggacgacgcgtggtccttccgggagctgaaggccttcgtgcgcgagagcaagaccctgtccaacaagaagaaggagtacctcctgaccgaggaggacatcagcaagttcgacgtccggaagaagttcatcgagcgcaacctggtggacacgcggtacgcctcccgcgtggtcctcaacgccctgcaggagcacttccgggcccgcaagatcgacaccaaggtgagcgtggtccgcggccagttcacctcccagctgcggcgccactgggggatcgacaagacccgggacacgtaccaccaccacgcggtggacgccctcatcatcgccgccagcagccagctgaacctgtggaagaagcagaagaacaccctcgtgtcctacagcgaggaccagctgctggacatcgagaccggcgagctcatctccgacgacgagtacaaggagagcgtcttcaaggccccctaccagcacttcgtggacaccctgaagtccaaggagttcgaggacagcatcctgttctcctaccaggtggacagcaagttcaaccgcaagatctccgacgcgacgatctacgccacccggcaggccaaggtcgggaaggacaagaaggacgagacctacgtgctcggcaagatcaaggacatctacagccaggccggctacgacgcgttcatcaagatctaccagaaggacaagtccaagttcctgatgtaccgccacgacccgcagaccttcgagaaggtgatcgagcccatcctggagaactaccccaacaaggagatgaacgagaaggggaaggaggtcccctgcaacccgttcctcaagtacaaggaggagcacggcgactacatccggaagtacagcaagaaggggaacggccccgagatcaagtccctgaagtactacgacagcaagctgggcaaccacatcgacatcacgcccaagaactccaacaacaaggtggtgctccagagcgtctccccctggcgcgccgacgtgtacttcaacaagaccaccgggaagtacgagatcctgggcctgaagtacgccgacctccagttcgagaaggggaccggcacgtacaagatcagccaggagaagtacaacgacatcaagaagaaggagggggtggacagcgactccgagttcaagttcaccctgtacaagaacgacctgctcctgatcaaggacaccgagaccaaggagcagcagctgttccggttcctcagccgctccatgccgaacaagaagcactacgtcgagctgaagccctacagcaaggacaagttcgagaagaacgagacgctgatcgagatcctcggccccaccgacaagtccggccggtgcatcaaggggctggccaagagcaacctgtccatcttcaaggtgcgcaccgacatcctcggcaaccagcacatcatcaagaacgagggggacaagcccaagctggacttctga

SEQ ID NO: 1653 - RNA, 3387 nt, synthetic construct
  misc_feature 1..3387: note = Cas9 variant
  source 1..3387: mol_type = other RNA
atgaccaagatcctgggcctcgacctggggaccaacagcatcggctgggccgtggtcgacgagaagaaggagaagatcctggggatgggctcccgcatcttccccgagggggtggtgaacatcggcgagggcgaggggcgggagacgagcaagaacgcctcccgcaccgacgcgcggggcacccgccggcagttcttccgccggcgcctccggaagcgctacctgctgcgggagctcgccaagaaggggctgtgcccgatcaactacaccctggtcaaggagtggaacgaggcccagatcttcaagaacaagcagctccaggagtggttcaagctgaacccctacgagctgcgcagcaaggccatccaggagaagatctccctcgaggagctgggccggatcttctaccacttcatccagcgccgggggttccagagcaactcccgcagcgccggcgtggacaacatcgagaagtccgtgatcttcaagggcgacacgaagaccgggaagatcggcatcagcgagaccctggagtccatcaagaacaccaagacgctcgggagctacctgcacaccatctaccccaagcagaacaagccctactccggccacaaggagcggatccgcaaccggtacaccacccgccagatgtacatctacgagttcgagacgatctgggagtaccagaagcagttctacagcgagctgtccaacgagctcaagaccgtcctgggcgggcggaagaaggacggctacaaggaggacgggatcctgttccaccagcgcccgctccgcagccagaagcacctggtgggctactgctccttcgagcccaagaagaccaagtgccagatcaacaccatccccttcgagctgttccggatctaccagtgggtgaacacggtcgactgcaacgagaaggtgaccagcgaggaccgcgggaagatggtggagctcctgctgtccaaggagaaggtcagcttcaaggagatccggaaggtgatcaacaagagcgacggctactaccagttcaactacaagaacgacgacaagatcgtgggctcctacaccatcagcaacctctccaacaagaagttcttcgggaagaagtggttcgacttcagcgacaaggagcaggaggacatctggcacgtcctgtccttcttcgacgaccgcgacaagctgaagcagtacgcgatcaagtactggggcttcaacgaggagaaggccgtgaagatcagcaagttcaacctcaaggaggggtactccaacctgagccggaaggccatccacaacatcctgcccttcctcaagctgggcttcatgtacgacgtggccgtcgggctgggcggcgtgaagaacgcgctcgccgacaagtggatcgagaacgagcagttcatcctggacaacgtgccgtccgtcgtgcgcagcaacttcaagggcgggtacatcgagcccctgaagcagatgctcaagtacgagttcgacgtgtccgacaagcagctgctgaagctctaccaccacagctccgccatcgagaccacggagctgctgaagaagctccccatcaacagcgaggccgacaaggagatccagtccatcaagaaccccgtcgtgatcaccgccctgttcgagatccggaagctggtcaacgagatcatcgacacctacgggaagttcgacgagatcaaggtggagctcgcgcgcgacctgaaggccagcaagtccaagcggtacgacacccgccgggagcagctgcgcctggagaaggagaacgaccggatcaagatcgagctcgagaacctgggccagcgcatcaaccacatcacgatcctgaagtacaagctctgggaggagtgcgacaagcggtgcccgttcaccgggaagaacatcgaggtgaacgagctgttcagcggcgaggtccagatcgagcacatcttcccctggtcccgcagcctgaacgacagcttcatgaacaagaccctctgcttcgccgacgagaaccgggccaagggcaacaagaccccctacgagttctactccgagcagggggagcagaagtgggaggagatcaagatccaggccctgagctgcttcaagaacaagcccaactacccgaacgcgtaccagaagttcaagcagttcgtgaagaagaagcacgacgaggacttcatctcccgccagctgaacgacacgcggtacatcagcaaggaggccaagaactacctctccaagatctgcaacaacgtgcaggtcgcccccggccagatgaccgccaccctgcgccacaagtgggggctgaacaccatcctcaacaaggacgacgacacgaagacccgcgacgaccaccggcaccacgccatcgacgcgctggtgatggcctgcagcacccgctcccacctccaggagctgagcaagcggaaccgctaccagaaggactacgagttcaaggacttccccatgccctggcagttcttccggcaggacgccgagaagtccgtggagcagatcctggtcagccacaagaagctgaacaccatcctcacggtgcgcacccacaagaccaagaagaacggcgtggtctacaagaacatcggcgtggccgcccgggggcagctgcacaaggagaccgtgttcggcaagcgcaccgcgccggacgggatcgaggcctaccacgtccggaagcccatcgagtccctgagcacgcacaagcacatcaacaaggtggtggacgagaccatccgcctcctgatcctgaagcaggtcaacaagctcggcgggttcgtgaagggcaagatccccgagggcaccttctacaacaccgacgagaacgggaacaagcagccccagatcttcctgccgaacaagaacggcaaccccgtgcccatcaagaagatccggctgcgcgagaacatcgggggcgccgagcagctcaagtccacggtcaaccagcacgtgaacccccggagcaaccaccacgtgctgatctacaaggacttcgacgacaacctgaaggagaaggtcgtgaccttctggaccgccgtggagcgcaagaagcagaagcaggcggtcttccagctcccggagaacgggaaggagatcgtgaccacgctgcagatcaacgacatgttcctgctcggcctgaaggacgacgagatcaactgggagcaccccaagttcaccctgctcaaggagcacctgtaccgggtgcagaagttcacctccggcgactactacttccgcaagcacatcgagagcaacctgaacggggagctcggcaaggcctaccagtacatcaaggggttcggcgaggggaagaccggctggaagacgttcaaccccatcaagatcaaggtctccgtgagcggcaagatcgagaaggtgtga

SEQ ID NO: 1654 - RNA, 3390 nt, synthetic construct
  misc_feature 1..3390: note = Cas9 variant
  source 1..3390: mol_type = other RNA
atgaacggcctggtgctcgggctggacatcggcatcgccagcgtcggggccggcatcctgaagaaggacaccggggagatcatccacgcgaactcccgcctcttccccgccgccaccgccgacaacaacgtgctgcggcgcagctcccggcaggcccgccggagcacgcgccggaagcgccaccgggcggtgcgcctgcacgacctcttcgaggactacggcctgctgaccgacttctccaaggtcagcatcaacctcaacccgtacaagctgcgggtggagggcatggacatccagctgaccaccgaggagctgttcatcgccctcaagaacatcatcaagcgccgggggatctcctacctggacgacgccagcgaggacggcgtgacggtctccagcgactacgggaaggccgtggaggagaaccgcaagctcctgtccgagcagacccccggccagatccagctggagcggttcgagaagtacggccaggtgcgcggggacttcaccgtcgaggagaacggcgagaagcggcgcctcatcaacgtgttcagcacctccacgtaccggaaggaggcggagcgcatcctgcggaagcagcaggagttcaacaacaagatcaccgacgacttcatcgacgactacctgaccatcctcaccgggaagcgcaagtactaccacggccccgggaacaagaagtcccgcacggactacggccggtacaccaccaagaaggacagcgagggcaagtacatcaccctggacaacatcttcggggtgctgatcggcaagtgcacgttctaccccgacgagtaccgcgccagcaaggcctcctacaccgcccaggagttcaacctcctgaacgacctgaacaacctcaccgtcccgaccgagacgaagaagctgagcgagaagcagaagaagaccatcgtggagtacgccaagaccgcgaagaccctgggggcctccacgctcctgaagtacatcgccaagatggtggacgccagcgtcgaccagatccacggctaccgggtggacgtgaacaagaagcccgagatgcacaccttcgacgtctaccgcaagatgcagagcctggagaccttcaacgtgaacgagatgccccgggaggtgctcgacgagctggcccacatcctgaccctcaacacggagcgcgaggggatcgaggaggcgatcaacaccaagctgaagggcaccttcaaccaggaccaggtcctggagctcgtgcagttccggaagaacaactccagcctgttctccaagggctggcacaacttcagcctgaagctcatgatggagctgatccccgagctgtacgccacctccgaggagcagatgacgatcctcacccgcctggggaagcagaagtccaaggagatcagcaagcggaccaagtacatcgacgagaaggagatcaccgaggagatctacaacccggtggtcgccaagagcgtgcgccaggccatcaagatcatcaacgaggccacgaagcagtacggcatcttcgaccacatcgtcatcgagatggcgcggctgaccaacgaggaggacgccaagaaggactacatcaagcgccagaaggccaacctcgacgagaagaacgccgccatggagaaggcggccttccagtacaacgggaagaaggagctgcccgactccatcttccacggccacaaggagctggccaccaagatccggctgtggcaccagcagggggagaagtgcctctacaccggcaagaacatccccatcagcgacctgatccagaaccagtacaagtacgagatcgaccacatcctgcccctctccctgagcttcgacgactccctgagcaacaaggtgctcgtgctggccaccgcgaaccaggagaagggccagcgcacgccgttccaggccctggaccggatggacgacgcctggtcctaccgcgagttcaagagctacgtcaaggactccaagctcctggggaacaagaagaaggactacctgctcaccgaggaggacatcagcaagatcgaggtgaagcagaagttcatcgagcggaacctggtggacacccgctactccagccgggtcgtgctgaacgccctccaggacttctacaagaaccaccacttcgacaccacgatcagcgtggtccgcggccagttcacctcccagctgcgccggaagtgggggctggagaagtcccgcgagacctaccaccaccacgccgtggacgcgctcatcatcgccgccagcagccagctgcggctgtggaagaagcagaacaaccccctcatcttctacaaggagggccagttcgtggactccgagaccggggagatcctgagcctgaacgacgacgagtacaaggagctcgtcttcaaggccccctacgaccacttcgtggacacgctgcgctccaagaccttcgaggacagcatcctgttctcctaccaggtggacagcaagtacaaccggaagatctccgacgccaccatctacgcgacccgcaaggccaagctcgacaaggacaagagcaaggagacgtacgtcctgtccaagatcaaggacatctacagccaggccggctacgacgccttcatcaagatctacaacaaggacaagtccaagttcctgatgtaccacaaggacagccagaccttcgagaaggtgatcgaggagatcctccggacctacccctccaaggagttcaacgacaagaacaaggaggtgccgtgcaaccccttcgagaagtaccgccaggagaacggccccatccggaagtacagcaagaaggggaacggccccgagatcaagagcctgaagtactacgacaagaacatcccggagtccttcatcaacatcacccccagcaactccaagaacaaggtcatcctgcgccagctcaacccctggcggacggacgtgtacttcaaccaccagaccgagaagtacgagctgctggggctcaagtacgccgacctgcagttcgagaagaagaccggcacctacagcatcacgatcgacaagtacaacgagatcaaggagaaggagggcgtgggggagcagtccgagttcaagttcaccctgtacaagaacgacctcctgctgatcaaggacaccaagaacaacgagaagcagatcttccgcttcctcagccggaccatgcccaacgtcaagcactacgtggagctgaagccgtacaacaaggcgaagttcgacggcaaccagcccctgatcacgatcttcgggaacgtggccaagggcgggcagtgcctcaagggcctgaacaagcccaacatctccatctacaagatcaagaccgacgtcctgggcaacaagtacttcatcaagaaggagggggacaagcccaagctcaagttctga

SEQ ID NO: 1655 - RNA, 3390 nt, synthetic construct
  misc_feature 1..3390: note = Cas9 variant
  source 1..3390: mol_type = other RNA
atggccgaccgcatcagcctgggcctcgacatcggggtggcctccgtcggcttcagcgtgctggacatcgacaaggggaaggtgatcgagctgggctcccgcctcttcaacgcgaccgtcgccgaggggaaccaggaccggcggagcatgcgcggcgcccggcgcctgctgaaccggaacaagcagcgccggcaggacaccggcaagctgttccagaagttcgggctcctggacaacttcaacaaggacaacttctacgacacgttcaaccagaactggaacccctacgagctccgcgtgaagggcctgaccgagcacctgaccaagaaggagctcgccgagtccctgtaccagatcgtgaagcaccgggggatcagctacgccctgaaggacgcggacgccgacgagggcgggaccgactactccgccagcctcaagatcaactcccaggagctggccgagaagacgccggcgcagatccagctgcagcgcctcaacgactacggcaaggtccggggccaggtggtgatcggggacgaccccgacaaccagaaggtcctgctgaacgtgttccccaccagcgcctacgagaaggaggccaagcagatcatcgccacccagaagcagttctaccccgagatcctcaccgacgagttcacgaaggagtactgcaagatcctgacccgcaagcgggactacttcgtgggcccggggaacgagaagtcccgcaccgactacggcatctacaagaccgacggccggacgctggacaacctcttcgaggagctgatcgggcacgacaagatctaccccgacgagctgcgcgccagcgcggcctcctacaccgcccagctgttcaacgtcctcaacgacctgaacaacctccggatcctgagctacgaggacggcaagctgaccaaggaggacaaggagaagatcatcgccgagatcaagtccaacaccacgaccatcaacatgctcaacgtgatcaagaaggtggccgggtgcagcaaggaggacatcaagggcttccgcgtcaacgagaaggacaagcccgagatctccagcatggcggtgtaccggaaggtgcacaaggacctgctgaaggtcggggtggacatctccgactggcccgtggagttcatcgacaagctcagcttcatcctgaccctgaacaccgagaacggcgagatccgcaagcagctcaacaaccgcctggtcccggagttcgacttcctgaacgacgacctcatccagctgatcatcgacaacaaggacagcttcgagatcaagacgaacaacaagtggcaccggttctccctgaagaccatgaacaagctcatgcccgagatgctggagcgccccgtggagcagatgaccctgctcaacgagatgggcctggtgaagaaggacaagaagcggttcgagaacaacaagtacctgccctacaaggagatcgccaaggacatcttcaacccggtcgccagcaagtccgtgcgcgaggccctgaagatcgtcaacgccgtgctcaagaagtacgggcacatcgactacctggtgatcgagatgccccgggacaagaacctgaaggaggagcaggacaacatcaaggagttccagaacaagaacaagaaggcgaaggacgccgccttcgaggccttcgtcaagagcgtgggctccgagcagcgcgtgaaggaggccctcagcaagaaccggaagctgcagatgaagatgcgcctgtggtaccagcagcaggagatcgacccctacaacggggagaccatcgacgcgacggacctcatcaacaaccccgacaagttcgagatcgaccacatcatcccgcagtccatcagcttcgacgactccatcaacaacaagaccctgtgcttcgccagcatgaaccaggtcaagggccagaagaccccctacgagttcatgctggaggggcacggccagggctacgacaagttcaaggccaccgtgctcgacaacaagaacttcgaccggaacaagcgcaagaactacctgttcgaggagaacgtgtccgacatcgagacgcggaagcgcttcctgagccggaacctcgtcgacacccgctactccagccgggtggtgctgaactccctgcaggacttcttccacgagaagtccgccgacaccaaggtcaccgtgatccgcgggaagttcacgagcaacatgcggaagcactggcacatcgacaagacccgcgagaccttccaccaccacgcgatcgacgccagcatcatcgccgccacccccttcctccggatgtggaagaagggcgggacgatcttccccgtgaaggtcggcgaggagtccatcgacatcgagaccggggagatcctggacgacaagaagttcgacaaggtgatgtacgaggagccgtacaacggcttcgtgagcgagatcatgaacgccgacgaccgcatcaagttcagccaccaggtcgacaagaagatgaaccgcaaggtgtccgacgcgaccatctacagcacccggaccggcaagctggccaaggacaagaaggacgccgagtacatcgtggccaaggtcaaggacatctactccgtggacgggttcaagaagttcaagaaggtgtacgacaaggacaagagcaagttcctcctgtacaagtacgacccccgcacgttctccgagctggagcggatcatcagcgactgccccgacaaggtcgagaaggtgcagaccaacggcaaggtgaaggccgtcgacgtgtcccccttcgagatgtaccgccggtaccacgggatgatcaagaagtacagcaagaagggcaacggcccggcgatcaagcagctcaagtacctggacaagaagctggggtcccacatcgacatcacccccgccaacgccaacggcaagcacgtgatcctccagagcctgaagccctggcgcaccgacgtctacctgaaccacgagacgggggagtacgagatcatgggcatcaagtactccgacctcaagttcaacaagaacgtggggtacggcatcaagaaggacaagtacctggagatcaagaagaacgaggaggtgagcgagaagtccgagttcatgttcagcctgtaccggaaggaccgcgtccggatccagaacatgaagaccggcgagtccgtggagctcctgttctggagccgcaacttctccaacaagaagtacgccgagctgaagcccatcttcaagttcgtgaccgaggacgacgactggccggtctacgggcacgccaagacccagatcctcaagcggctggtgcccaaggactgcaagatctggaaggtgaacacgaccatcctgggcgacccctactacctcgagaaggagagcgacaacccgaaggacatcctggactga

SEQ ID NO: 1656 - RNA, 3390 nt, synthetic construct
  misc_feature 1..3390: note = Cas9 variant
  source 1..3390: mol_type = other RNA
atgaccaacggcaagatcctggggctcgacatcggcatcgccagcgtgggggtcggcatcatcgaggccaagaccgggaaggtggtgcacgcgaactcccgcctgttcagcgccgccaacgccgagaacaacgccgagcggcgcggcttccggggctcccgccggctgaaccgccggaagaagcaccgcgtcaagcgggtgcgcgacctcttcgagaagtacgggatcgtgacggacttccggaacctgaacctgaacccctacgagctccgcgtcaagggcctgaccgagcagctgaccaacgaggagctgttcgcggccctccggaccatcagcaagcgccgggggatctcctacctggacgacgccgaggacgacagcacgggctccaccgactacgccaagagcatcgacgagaaccgccggctcctgaagaccaagaccccggggcagatccagctggagcgcctcgagaagtacggccagctgcggggcaacttcacggtgtacgacgagaacggggaggcgcaccgcctgatcaacgtgttctccaccagcgactacgagaaggaggcccggaagatcctcgagacccaggccgactacaacaagaagatcaccgccgagttcatcgacgactacgtcgagatcctgacgcagaagcgcaagtactaccacggccccgggaacgagaagtcccgcaccgactacggccggttccgcaccgacggcaccacgctggagaacatcttcgggatcctcatcggcaagtgcagcttctaccccgacgagtaccgggcctccaaggcgagctacaccgcccaggagtacaacttcctgaacgacctgaacaacctcaaggtgcccaccgagaccgggaagctgtccacggagcagaaggaggccctggtggagttcgccaagagcaccgccaccctcggcccggcgaagctgctgaaggagatcgccaagatcctcgactgcaaggtcgacgagatcaaggggtaccgcgaggacgacaagggcaagcccgacctgcacaccttcgagccctaccggaagctgaagttcaacctcgactccgtgaacatcgacgacctgagccgcgaggtgctggacaagctcgccgacatcctgacgctgaacaccgagcgggagggcatcgaggacgccatcaagcgcaacctccccaaccagttcaccgaggagcagatctccgagatcatcaacgtccgcaagagccagagcaccgccttcaacaaggggtggcactccttcagcgcgaagctgatgaacgagctgatcccggagctctacgccacgtccgacgagcagatgaccatcctgacccggctggagaagttcaaggtgaagaagaagtccagcaagaacatcaagaccatcgacgagaaggagatcacggacgagatctacaaccccgtggtcgccaagagcgtgcggcagaccatcaagatcatcaacgccgccgtgaagaagtacggcgacttcgacaagatcgtcatcgagatgccccgcgacaagaacgcggacgacgagaagaagttcatcgacaagcggaacaaggagaacaagaaggagaaggacgacgccctcaagcgcgccgcctacctgtacaacgggaccgacaagctgcccgacgaggtgttccacgagaacaagcagctcgagaccaagatccggctgtggtaccagcagggcgagcgctgcctgtactccgggaagccgatccccatccaggagctggtgcacaacagcaacaacttcgagatcgaccacatcctccccctgtccctgagcttcgacgactccctcgcgaacaaggtcctggtgtacagctggacgaaccaggagaagggccagcggaccccctaccaggtcatcgactccatggacgccgcctggagcttccgcgagatgaaggactacgtgctgaagcagaagggcctcgggaagaagaagcgggactacctgctgaccaccgagaacatcgacaagatcgaggtgaagaagaagttcatcgagcgcaacctcgtcgacacccgctacgcctcccgggtggtgctgaacagcctgcagtccgccctccgcgagctgggcaaggacacgaaggtcagcgtggtgcgggggcagttcacctcccagctgcgccggaagtggaagatcgacaagagccgcgagacctaccaccaccacgcggtcgacgccctcatcatcgccgccagctcccagctgaagctgtgggagaagcaggacaacccgatgttcgtggactacggcaacaaccaggtggtcgacaagcagaccggggagatcctcagcgtgtccgacgacgagtacaaggagctggtgttccagccgccctaccagggcttcgtcaacacgatcagctccaagggcttcgaggacgagatcctgttcagctaccaggtggactccaagtacaaccggaaggtgagcgacgccaccatctactccacccgcaaggcgaagatcgggaaggacaagaaggaggagacctacgtcctcggcaagatcaaggacatctacagccagaacgggttcgacacgttcgtgaagaagtacaacaaggacaagacccagttcctgatgtaccagaaggaccccctgacctgggagaacgtgatcgaggtcatcctccgggactaccccaccacgaagaagtccgaggacggcaagaacgacgtgaagtgcaaccccttcgaggagtaccgccgggagaacggcctgatctgcaagtacagcaagaaggggaagggcacccccatcaagtccctgaagtactacgacaagaagctcgggaactgcatcgacatcacgccccaggagagcaagaaccgcgtggtcctgcggcagatctccccgtggcgcgccgacatctacttcaaccccgagaccctgaagtacgagctcatgggcctgaagtacagcgacctgtccttcgagaaggggaccggcaagtaccacatcagccaggagaagtacgacgccatcaaggagaaggagggcgtggggaaggacagcgagttcaagttcaccctctaccggaacgacctgatcctgatcaaggacaccctcaacaactgcgagcgcatgctgcggttcggctccaagaacgacaccagcaagcactacgtggagctgaagcccctcgagaaggggacgttcgactccgaggaggagatcctgcccgtcctgggcaaggtggccaagagcgggcagttcatcaagggcctcaacaagccgaacatctccatctacaaggtgcgcaccgacgtcctgggcaacaagtacttcgtgaagaaggagggggacaagcccaagctggacttcaagaacaacaagaagtga

SEQ ID NO: 1657 - RNA, 3390 nt, synthetic construct
  misc_feature 1..3390: note = Cas9 variant
  source 1..3390: mol_type = other RNA
atgagcaacggcaagatcctggggctcgacatcggcgtggcctccgtcggggtgggcatcatcgacagcaagaccgggaacgtgatccacgccaactcccgcctgttcagcgcggccaacgccgagaacaacgccgagcggcgcggcttccggggcgcccgccggctgacccgccggaagaagcaccgcgtcaagcgggtgcgcgacctcttcgagaagtacgacatctccacggacttccggaacctgaacctgaacccctacgagctccgcgtgaaggggctgaccgagcagctgaccaacgaggagctgttcgcggccctccggaccatcgccaagcgccggggcatcagctacctggacgacgccgaggacgactccacggggagctccgactacgccaagagcatcgacgagaaccgccggctcctgaagaccaagaccccgggccagatccagctggagcgcctcgagaagtacgggcagctgcggggcaacttcaccgtctacgacgagaacggcgaggcgcaccgcctgatcaacgtgttctccacgagcgactacaagaacgaggcccggaagatcctcgagacccagtccaactacaacaagcagatcaccgacgagttcatcgaggactacatcgagatcctgacccagaagcgcaagtactaccacgggcccggcaacgagaagtcccgcacggactacgggcggttccgcaccgacggcaccaccctggagaacatcttcggcatcctcatcgggaagtgcagcttctaccccgaggagtaccgggccagcaaggcctcctacacggcgcaggagttcaacttcctgaacgacctgaacaacctcaaggtgcccaccgagaccggcaagctgagcaccgagcagaaggagtacctggtcgacttcgccaagaagtccaaggccctcggggccagcaagctgctgaaggagatcgccaagatcgtggactgcagcgtggacgacatcaagggctaccgcgtcgacaacaaggacaagccggacctccacacgttcgagccctaccggaagctgaagttcaacctgtccagcatcgacatcgacgagctctcccgcgagaccctggacaagctggcggacatcctcaccctgaacaccgagcgggaggggatcgaggacgccatcaagcgcaacctgcccagccagttcacggaggagcagatctccgagatcgtgcagatccggaagaaccagagctccgccttcaacaagggctggcacagcttctccgccaagctcatgaacgagctgatccccgagctgtacgtgaccagcgaggagcagatgaccatcctcacccgcctggagaagttcaaggtcaacaagaagtccagcaagaacacgaagaccatcgacgagaaggagatcaccgacgagatctacaacccggtggtggccaagtccgtccggcagaccatcaagatcatcaacgcggccgtgaagaagtacggcgacttcgacaagatcgtgatcgagatgccccgcgacaagaacgccgaggacgagaagaagttcatcgacaagaagcagaaggagaacaagaaggagaaggacgacagcctgaagcgggccgccttcctctacaacgggacggacaacctgcccgacggcgtcttccacgggaacaaggagctgaagaccaagatccgcctctggtaccagcagggcgagcggtgcctgtactccgggaagctgatcagcatccacgacctggtgcacaactccaacaagttcgagatcgaccacatcctccccctgagcctgtccttcgacgacagcctcgcgaacaaggtgctggtctacgcctggaccaaccaggagaagggccagaagaccccgtaccaggtgatcgacagcatggacacggcctggtccttccgcgagatgaaggactacgtcctgaagcagaagggcctcgggaagaagaagtgcgagtacctgctgaccaccgagaacatcgacaagatcgaggtgaagaagaagttcatcgagcggaacctcgtggacacccgctacgccagccgggtcgtgctgaactccctgcagaccgcgctcaaggagctgggcaaggacacgaaggtgagcgtcgtgcgcgggcagttcacctcccagctgcgccggaagtggaacatcgacaagagccgcgagacctaccaccaccacgccgtggacgccctcatcatcgccgcctccagccagctgaagctgtggcagaagcaggagaaccccatgttcgagtcctacggcgagaaccaggtcgtgaacaaggagaccggggagatcctcagcatctccgacgacaagtacaaggagctggtgttccagccgccctaccagggcttcgtcaacacgatcagctccaagggcttcgaggacgagatcctgttcagctaccaggtggactccaagttcaaccggaaggtgagcgacgcgaccatctactccacccgcaaggccaagctcgggaaggacaagaaggacgagacctacgtcctgggcaagatcaaggacatctacagccaggacgggttcgacacgttcatcaagcggtacaagaaggacaagacccagttcctgatgtaccagaaggaccccctcacctgggagaacgtgatcgaggtgatcctgcgcgactaccccagcgagaagctgtccgaggacggcaagaagaccgtcaagtgcaaccccttcgaggagtaccggcgcgagaacggcctcatctgcaagtacagcaagaaggggaacggcacgcccatcaagtccctgaagtactacgacaagaagctggggaactgcatcgacatcaccccggagaagtccaagaaccgggtggtgctccgccagatcagcccctggcgggccgacatctacttcaacctggagaccctgaagtacgagctcatgggcctgaagtacagcgacctgtccttcgagaaggggaccggcaagtaccacatcagccaggagaagtacgacgccatccgcgagaaggagggcatcgggaagaagtccgagttcaagttcacgctctaccggaacgacctgatcctgatcaaggacaccctcaacaactgcgagcgcatgctgcggttcggcagcaagaacgacacctccaagcactacgtcgagctgaagcccctcgagaaggggaccttcgacagcgaggaggagatcctgcccgtgctgggcaaggtggccaagtccgggcagttcatcaagggcctcaacaagccgaacatcagcatctacaaggtccgcacggacgtgctgggcaacaagttcttcatcaagaaggagggggacaagcccaagctggacttcaagaacaacaacaagtga

SEQ ID NO: 1658 - RNA, 3390 nt, synthetic construct
  misc_feature 1..3390: note = Cas9 variant
  source 1..3390: mol_type = other RNA
atgagcaacggcaagatcctggggctcgacatcggcgtggcctccgtcggggtgggcatcatcgacgccaagaccgggaacgtgatccacgcgaacagccgcctgttctccgccgccaacgccgagaacaacgccgagcggcgcggcttccggggcgcgcgccggctgacccgccggaagaagcaccgcgtcaagcgggtgcgcgacctcttcgagaagtacgacatcagcacggacttccggaacctgaacctgaacccctacgagctccgcgtgaaggggctgaccgagcagctgaccaacgaggagctgttcgccgccctccggaccatcgccaagcgccggggcatctcctacctggacgacgcggaggacgacagcacggggtccagcgactacgccaagtccatcgacgagaaccgccggctcctgaagaccaagaccccgggccagatccagctggagcgcctcgagaagtacgggcagctgcggggcaacttcaccgtctacgacgagaacggcgaggcccaccgcctgatcaacgtgttcagcacgtccgactacaagaacgaggcccggaagatcctcgagacccagagcaactacaacaagcagatcaccgacgagttcatcgaggactacatcgagatcctgacccagaagcgcaagtactaccacgggcccggcaacgagaagtcccgcacggactacgggcggttccgcaccgacggcaccaccctggagaacatcttcggcatcctcatcgggaagtgcagcttctaccccgaggagtaccgggcctccaaggcgagctacacggcccaggagttcaacttcctgaacgacctgaacaacctcaaggtgcccaccgagaccggcaagctgtccaccgagcagaaggagtacctggtcgacttcgccaagaagtccaaggccctcggggccagcaagctgctgaaggagatcgcgaagatcgtggactgcagcgtggacgacatcaagggctaccgcgtcgacaacaaggacaagccggacctccacacgttcgagccctaccggaagctgaagttcaacctgagctccatcgacatcgacgagctcagccgcgagaccctggacaagctggccgacatcctcaccctgaacaccgagcgggaggggatcgaggacacgatcaagcgcaacctgccctcccagttcaccgaggagcagatcagcgagatcgtgcagatccggaagaaccagtccagcgccttcaacaagggctggcactccttcagcgccaagctcatgaacgagctgatccccgagctgtacgtgacctccgaggagcagatgaccatcctcacgcgcctggagaagttcaaggtcaacaagaagtccagcaagaacaccaagaccatcgacgagaaggagatcaccgacgagatctacaacccggtggtggccaagagcgtccggcagacgatcaagatcatcaacgcggccgtgaagaagtacggcgacttcgacaagatcgtgatcgagatgccccgcgacaagaacgccgaggacgagaagaagttcatcgacaagaaggagaaggagaacaagaaggagaaggacgactccctgaagcgggccgccttcctctacaacgggaccgacaacctgcccgacggcgtcttccacgggaacaaggagctgaagaccaagatccgcctctggtaccagcagggcgagcggtgcctgtacagcgggaagctgatctccatccacgacctggtgcacaacagcaacaagttcgagatcgaccacatcctccccctgtccctgagcttcgacgactccctcgcgaacaaggtgctggtctacgcctggaccaaccaggagaagggccagaagacgccgtaccaggtgatcgacagcatggacgccgcctggagcttccgcgagatgaaggactacgtcctgaagcagaagggcatcgggaagaagaagcgggagtacctcctgaccaccgagaacatcgacaagatcgaggtgaagaagaagttcatcgagcgcaacctggtggacacccggtacgcgtcccgcgtcgtgctcaacagcctgcagaccgccctgaaggagctcggcaaggacacgaaggtgtccgtcgtgcgcgggcagttcaccagccagctgcggcgcaagtggaagatcgacaagtcccgggagacctaccaccaccacgccgtggacgccctgatcatcgccgcgagcggccagctcaagctgtggcagaagcacgagaacctgatgttcgagaactacggggagaaccaggtcgtgaacaaggagaccggcgagatcctctccatcagcgacgacgagtacaaggagctggtgttccagccgccctaccagggcttcgtcaacacgatctccagcaagaccttcgaggacgagatcctgttctcctaccaggtggacagcaagttcaaccgcaaggtgtccgacgccaccatctacagcacccggaaggccaagctcgggaaggacaagaaggaggagacgtacgtcctgggcaagatcaaggacatctacacccaggacgggttcgacaccttcatcaagcgctacaagaaggacaagacccagttcctgatgtaccagaaggaccccctcacgtgggagaacgtgatcgaggtgatcctgcgggactacccctccgagaagctgagcgaggacggcaagaagaccgtcaagtgcaaccccttcgaggagtaccgccgggagaacggcctcatctgcaagtactccaagaaggggaacggcacccccatcaagagcctgaagtactacgacaagaagctggggaactgcatcgacatcacccccgagaagtccaagaaccgcgtggtgctccggcagatcagcccgtggcgcgccgacatctacttcaacctggagacgctgaagtacgagctcatgggcctgaagtacagcgacctgtccttcgagaaggggaccggcaagtaccacatcagccaggagaagtacgacgccatccgggagaaggagggcatcgggaagaagtccgagttcaagttcaccctctaccgcaacgacctgatcctgatcaaggacaccctcaacaactgcgagcggatgctgcgcttcggcagcaagaacgacacgtccaagcactacgtcgagctgaagcccctcgagaaggggaccttcgacagcgaggaggagatcctgcccgtgctgggcaaggtggcgaagtccgggcagttcatcaagggcctcaacaagcccaacatcagcatctacaaggtccggaccgacgtgctgggcaacaagttcttcatcaagaaggagggggacaagccgaagctggacttcaagaacaacaacaagtga

SEQ ID NO: 1659 - RNA, 3393 nt, synthetic construct
  misc_feature 1..3393: note = Cas9 variant
  source 1..3393: mol_type = other RNA
atgaacaagatcctgggcctcgacctggggaccaacagcatcggctgggccctgatcgagaacaacatcatcctcgggatgggctcccgcgtgttccccgagggggtcgtgaacctgggcgagggcgaggggcgggagaccagcaagaacgcctcccgcacggaggcgcggggcgtgcgccggcagatcttccgccggcgcctgcggaagcgctacctcctgaaggagctggccaagcacaacctctgcccgatcagccccaccctgatcaaggactggaacgggaccgacatcttcaagaacgagctgatcatccagtggttccagctcaacccctacgagctgcgggccaaggccatccaggaggagatcaccctgatcgagctcggccgcatcttctaccacatgatccagcggcgcgggttcctgtccaacagccggtccgccggcgcggacgtcaaggagacgagcaccatcttcaagggcgacgccaagatcgggaagatcggcatctccgacaccctcaagagcatcgagcagaacaagaccctcgggtccttcctgcacagcatccagcccaaggagaacgagccgttctccggcgagctggagcgcatccggaaccgctacacgacccggcagatgtacatcgacgagttcgagaccatctgggagttccagaagcagtaccacagcgagctcaactccaacctgaagaccatcctgggcgggcgcaagaaggacaactacaaggaggacggcgtgctgttccaccagcggcccctgcgcagccagaagcacctggtggggttctgctccttcgagcccaagaagacgaagtgcaagctcagcgccatccccttcgagctgttccgcatctaccagtgggtcaacaccctgtcctacgacgtgaacggcgtgcggcagaagatcacccaggaggagcgcaagaagatcatcgacctcctgctgagcaaggagaagccgagcttcaaggagatccggaaggccatcgggaagctcgacggctcctaccagttcaactacaaggacgacgacaagatcgtcggcagccacaccatctccaacctgagcaacaagaagttcttcgggaacaagtggttcgacttctccgagaaggagcaggagaacatctggcacatcctgagcttcttcgacgaccgcgagaagctcaaggagtacgcgatcaagaactggtccttcgacgaggagcgggccgtgaagatcagcaagttcaacctgaaggacggctactccaacctgagccgcaaggccatcctcaacatcctgcccttcctgcagaaggggttcatgtacgacgtggccgtcggcctcgccggggtgaagaacacgctgtccgtgaactgggaggagcacgagcagttcgtcctggacaacgtgcccgagatcgtgcggagcaacctcaagggcggctacatcgagcccctgaagaacatgctgaagaacgagttcaactgcaacgacaagcagctcgagaagctgtaccaccactccagcgcgatcgagaccgagaacatcctggaccgcctgccggtcaacctccacgccgaccgggagatccagaagatcaagaaccccgtggtgatcaccgccctgttcgagatccgcaagctggtcaacgaggtgatcgacacctacgggaagcccaacgagatcaaggtggagctcgcccgggacctgaaggcctccaagagcaaccgcctggaggcgcggaagcgccagaaggacctcgagaagcagaacgaccgggtcaagctggagctggagaacctcaaccagcgctccaaccacatcaacatcctgaagtacaagctgtgggaggagtgcaaccacacgtgccccttcaccggccagatcatcaccatcagccagctgttcaccggggaggtgcagatcgagcacatcttcccgtggtcccggagcctgaacgacagcttcaacaacaagacgctgtgcttcgccgacgagaaccgcgccaagggcaacaagaccccctacgagctctactccgagcagggggaccagaagtgggaggccatcaagctgcaggccctgagctgcttcaagaccaaggcgaactaccccaactgctacaacaagttcaagcacttcgtcaagaagaagcacgacgaggacttcatctcccggcagctcaacgacacccgctacatcagcaaggaggccaagaactacctgtccaagatctgcagcaacgtgctggtggcccccggccagatgacggccaccctccgccaccactggggcctgaactccatcctgaacctcgaggacgacaccaagacccgggacgaccaccgccaccacgccatcgacgcgctggtcatggcctgcagcacgcggtcccacctccaggagctcagcaagcgcaaccggtacaacaagaactacgacctgaaggacttcccggacccctggcagaacttccgccaggacgccgagaacgccgtggcgcagatcctggtgtcccacaagaagtccaagagcctcctgaccgtccggacccacaagaccatcaagaagggggtggagcacaagaacatcggcgtggccgcccgcgggcagctgcacaaggagagcgtctacggcctccggaaggcccccaactccaacaaggccttccacatccgcaagcccctggagagcctgacgaccgagaagcagctcgagaagatcgtggacgactccatccggctgctgatcctcaagcgcatcaacatcatcggcgggttcatcaagggcaagatcccgaaggagaccttcttcgtggtcgacgagaacgggatcaagcagccccagatcttcctgcccaaccggaacggcaaccccgtgccgatcaagaaggtgcgcatccgggagaacatcgggggcgcggagaagctgaaggagaacaccaaccagtacgtcaacccccgcagcaaccaccacgtgatcgtgtacgaggacagcaacggcgggctcaaggacgacgtcgtgaccttctggacggccgtggagcggaagcgccagggccaggacgtcttcaagctgcccaacgacggggagaagatcgtgtccaccctgcagatcaacgacatgttcctcctgggcctgaacgacgacgacatcatcaccctcaccagcaaggagctgaagaagcacctgttcaaggtgcagacgctctccagctccttctacgagttccggctgagcaccgactccacccagaacaagaacaccaacagcacggtcttccgccggatccagtccttcgggatgggcaagaccggctggaaggccttcaacccgatcaaggtgaagctgaacagcatcggggaggtgaagatcatctga

SEQ ID NO: 1660 - RNA, 3393 nt, synthetic construct
  misc_feature 1..3393: note = Cas9 variant
  source 1..3393: mol_type = other RNA
atgaccaacggcaagatcctggggctcgacatcggcatcgccagcgtgggggtcggcatcatcgaggccaagaccgggaaggtggtgcacgcgaactcccgcctgttcagcgccgccaacgccgagaacaacgccgagcggcgcggcttccggggctcccgccggctgaaccgccggaagaagcaccgcgtcaagcgggtgcgcgacctcttcgagaagtacgggatcgtgacggacttccggaacctgaacctgaacccctacgagctccgcgtcaagggcctgaccgagcagctgaccaacgaggagctgttcgcggccctccggaccatcagcaagcgccgggggatctcctacctggacgacgccgaggacgacagcacgggctccaccgactacgccaagagcatcgacgagaaccgccggctcctgaagaccaagaccccggggcagatccagctggagcgcctcgagaagtacggccagctgcggggcaacttcacggtgtacgacgagaacggggaggcgcaccgcctgatcaacgtgttctccaccagcgactacgagaaggaggcccggaagatcctcgagacccaggccgactacaacaagaagatcaccgccgagttcatcgacgactacgtcgagatcctgacgcagaagcgcaagtactaccacggccccgggaacgagaagtcccgcaccgactacggccggttccgcaccgacggcaccacgctggagaacatcttcgggatcctcatcggcaagtgcagcttctaccccgacgagtaccgggcctccaaggcgagctacaccgcccaggagtacaacttcctgaacgacctgaacaacctcaaggtgcccaccgagaccgggaagctgtccacggagcagaaggaggccctggtggagttcgccaagagcaccgccaccctcggcccggcgaagctgctgaaggagatcgccaagatcctcgactgcaaggtcgacgagatcaaggggtaccgcgaggacgacaagggcaagcccgacctgcacaccttcgagccctaccggaagctgaagttcaacctcgactccgtgaacatcgacgacctgagccgcgaggtgctggacaagctcgccgacatcctgacgctgaacaccgagcgggagggcatcgaggacgccatcaagcgcaacctccccaaccagttcaccgaggagcagatctccgagatcatcaacgtccgcaagagccagagcaccgccttcaacaaggggtggcactccttcagcgcgaagctgatgaacgagctgatcccggagctctacgccacgtccgacgagcagatgaccatcctgacccggctggagaagttcaaggtgaagaagaagtccagcaagaacatcaagaccatcgacgagaaggagatcacggacgagatctacaaccccgtggtcgccaagagcgtgcggcagaccatcaagatcatcaacgccgccgtgaagaagtacggcgacttcgacaagatcgtcatcgagatgccccgcgacaagaacgcggacgacgagaagaagttcatcgacaagcggaacaaggagaacaagaaggagaaggacgacgccctcaagcgcgccgcctacctgtacaacgggaccgacaagctgcccgacgaggtgttccacggcaacaagcagctcgagaccaagatccggctgtggtaccagcagggggagcgctgcctgtactccggcaagccgatccccatccaggagctggtgcacaacagcaacaacttcgagatcgaccacatcctccccctgtccctgagcttcgacgactccctcgcgaacaaggtcctggtgtacagctggacgaaccaggagaagggccagcggaccccctaccaggtcatcgactccatggacgccgcctggagcttccgcgagatgaaggactacgtgctgaagcagaaggggctcggcaagaagaagcgggactacctgctgaccaccgagaacatcgacaagatcgaggtgaagaagaagttcatcgagcgcaacctcgtcgacacccgctacgcctcccgggtggtgctgaacagcctgcagtccgccctccgcgagctggggaaggacacgaaggtcagcgtggtgcggggccagttcacctcccagctgcgccggaagtggaagatcgacaagagccgcgagacctaccaccaccacgcggtcgacgccctcatcatcgccgccagctcccagctgaagctgtgggagaagcaggacaacccgatgttcgtggactacgggaacaaccaggtggtcgacaagcagaccggcgagatcctcagcgtgtccgacaacgagtacaaggagctggtgttccagccgccctaccagggcttcgtcaacacgatcagctccaaggggttcgaggacgagatcctgttcagctaccaggtggactccaagtacaaccggaaggtgagcgacgccaccatctactccacccgcaaggcgaagatcggcaaggacaagaaggaggagacctacgtcctcgggaagatcaaggacatctacagccagaacggcttcgacacgttcgtgaagaagtacaacaaggacaagacccagttcctgatgtaccagaaggaccccctgacctgggagaacgtgatcgaggtcatcctcggcgactaccccaccacgaagaagtccgaggacgggaagaacgacgtgaagtgcaaccccttcgaggagtaccggcgcgagaacggcctgatctgcaagtacagcaagaaggggaagggcacccccatcaagtccctgaagtactacgacaagaagctcgggaactgcatcgacatcacccccgaggagagccggaacaaggtgatcctgcagtccatcaacccgtggcgcgccgacgtctacttcaaccccgagaccctgaagtacgagctcatgggcctgaagtacagcgacctgtccttcgagaagggcacggggaactaccacatcagccaggagaagtacgacgccatcaaggagaaggagggcatcgggaagaagtccgagttcaagttcaccctctaccggaacgacctgatcctgatcaaggacatcgccagcggcgagcaggagatctaccgcttcctcagccggaccatgcccaacgtgaaccactacgtggagctgaagccctacgacaaggagaagttcgacaacgtccaggagctggtggaggccctcggggaggcggacaaggtgggccgctgcatcaagggcctgaacaagccgaacatctccatctacaaggtccggaccgacgtgctggggaacaagtacttcgtgaagaaggagggcgacaagcccaagctcgacttcaagaacaacaagaagtga

SEQ ID NO: 1661 - RNA, 3393 nt, synthetic construct
  misc_feature 1..3393: note = Cas9 variant
  source 1..3393: mol_type = other RNA
atgaccaacggcaagatcctggggctcgacatcggcatcgccagcgtgggggtcggcatcatcgaggccaagaccgggaaggtggtgcacgcgaactcccgcctgttcagcgccgccaacgccgagaacaacgccgagcggcgcggcttccggggctcccgccggctgaaccgccggaagaagcaccgcgtcaagcgggtgcgcgacctcttcgagaagtacgagatcgtgacggacttccggaacctgaacctgaacccctacgagctccgcgtcaaggggctgaccgagcagctgaccaacgaggagctgttcgcggccctccggaccatcagcaagcgccggggcatctcctacctggacgacgccgaggacgacagcacggggtccaccgactacgccaagagcatcgacgagaaccgccggctcctgaagaccaagaccccgggccagatccagctggagcgcctcgagaagtacgggcagctgcggggcaacttcacggtgtacgacgagaacggcgaggcgcaccgcctgatcaacgtgttctccaccagcgactacgagaaggaggcccggaagatcctcgagacccaggccgactacaacaagaagatcaccgccgagttcatcgacgactacgtcgagatcctgacgcagaagcgcaagtactaccacgggcccggcaacgagaagtcccgcaccgactacgggcggttccgcaccgacggcaccacgctggagaacatcttcggcatcctcatcgggaagtgcagcttctaccccgacgagtaccgggcctccaaggcgagctacaccgcccaggagtacaacttcctgaacgacctgaacaacctcaaggtgcccaccgagaccggcaagctgtccacggagcagaaggaggccctggtggagttcgccaagagcaccgccaccctcgggccggcgaagctgctgaaggagatcgccaagatcctcgactgcaaggtcgacgagatcaagggctaccgcgaggacgacaaggggaagcccgacctgcacaccttcgagccctaccggaagctgaagttcaacctcgactccgtgaacatcgacgacctgagccgcgaggtgctggacaagctcgccgacatcctgacgctgaacaccgagcgggagggcatcgaggacgccatccgccacaacctccccaaccagttcaccgagggccagatctccgagatcatcaaggtccgcaagagccagagcaccgccttcaacaaggggtggcactccttcagcgcgaagctgatgaacgagctgatcccggagctctacgccacgtccgacgagcagatgaccatcctgacccggctggagaagttcaaggtgaacaagaagtccagcaagaacaccaagacgatcgacgagaaggaggtgaccgacgagatctacaaccccgtcgtggccaagagcgtgcggcagaccatcaagatcatcaacgccgccgtcaagaagtacggcgacttcgacaagatcgtgatcgagatgccccgcgacaagaacgcggacgacgagaagaagttcatcgacaagcggaacaaggagaacaagaaggagaaggacgacgccctcaagcgcgccgcctacctgtacaacgggaccgacaagctgcccgacgaggtgttccacggcaacaagcagctcgagacgaagatccggctgtggtaccagcagggggagcgctgcctgtactccggcaagccgatccccatccaggagctggtccacaacagcaacaacttcgagatcgaccacatcctccccctgtccctgagcttcgacgactccctcgcgaacaaggtgctggtctacgcctggaccaaccaggagaagggccagaagaccccctaccaggtgatcgacagcatggacgccgcctggtccttccgggagatgaaggactacgtgctgaagcagaaggggctcggcaagaagaagcgcgactacctgctgaccaccgagaacatcgacaagatcgaggtcaagaagaagttcatcgagcggaacctcgtggacacgcgctacgccagccgcgtggtcctgaactccctgcagagcgcgctccgggagctggggaaggacaccaagatctccgtgatccgcggccagttcaccagccagctgcggcgcaagtggaagatcgacaagtcccgggagacctaccaccaccacgccgtggacgccctcatcatcgccgccagcagccagctgaagctgtgggagaagcaggacaacccgatgttcgtcgactacgggaacaaccaggtggtggacaagcagacgggcgagatcctctccgtcagcgacgacgagtacaaggagctggtgttccagccgccctaccagggcttcgtgaacatgatctccagcaaggggttcgaggacgagatcctgttctcctaccaggtcgacagcaagtacaaccgcaaggtgtccgacgcgaccatctacagcacccggaaggccaagatcggcaaggacaagaaggaggagacctacgtgctcgggaagatcaaggacatctactcccagaacggcttcgacacgttcatcaagaagtacaacaaggacaagacccagttcctgatgtaccagaaggaccccctgacctgggagaacgtcatcgaggtgatcctccgcgactaccccaccacgaagaagtccgaggacggcaagaacgacgtgaagtgcaaccccttcgaggagtaccggcgcgagaacgggctggtctgcaagtacagcaagaagggcaaggggacccccatcaagagcctgaagtactacgacaagaagctcggcaactgcatcgacatcacccccgaggggtccaagaacgaggtggtgctgcagagcctgaacccgtggcgggccgacgtctacttcaaccccgagaccctcaagtacgagctgctgggcctcaagtactccgacctgagcttcgagaagggcacggggaagtaccacatctcccaggagaagtacgacgtgatcaaggagaaggagggcatcgggaagaagtccgagttcaagttcaccctgtaccgcaacgacctcatcctgatcaaggacaccgccagcggcgagcaggagatctaccggttcctgagccgcaccatgcccaacgtgaagcactacgccgagctcaagccctacgacaaggagaagttcgacaacgtccaggagctggtggaggcgctgggggaggccgacaaggtgggccggtgcatcaagggcctcaacaagagcaacctgtccatctacaaggtccgcacggacgtgctggggaacaagtacttcgtgaagaaggagggcgacaagccgaagctcgacttcaagaacaacaagaagtga

SEQ ID NO: 1662 - RNA, 3393 nt, synthetic construct
  misc_feature 1..3393: note = Cas9 variant
  source 1..3393: mol_type = other RNA
atgaccaacggcaagatcctggggctcgacatcggcatcgccagcgtgggggtcggcatcatcgaggccaagaccgggaaggtggtgcacgcgaactcccgcctgttcagcgccgccaacgccgagaacaacgccgagcggcgcggcttccggggctcccgccggctgaaccgccggaagaagcaccgcgtcaagcgggtgcgcgacctcttcgagaagtacgggatcgtgacggacttccggaacctgaacctgaacccctacgagctccgcgtcaagggcctgaccgagcagctgaccaacgaggagctgttcgcggccctccggaccatcagcaagcgccgggggatctcctacctggacgacgccgaggacgacagcacgggctccaccgactacgccaagagcatcgacgagaaccgccggctcctgaagaccaagaccccggggcagatccagctggagcgcctcgagaagtacggccagctgcggggcaacttcacggtgtacgacgagaacggggaggcgcaccgcctgatcaacgtgttctccaccagcgactacgagaaggaggcccggaagatcctcgagacccaggccgactacaacaagaagatcaccgccgagttcatcgacgactacgtcgagatcctgacgcagaagcgcaagtactaccacggccccgggaacgagaagtcccgcaccgactacggccggttccgcaccgacggcaccacgctggagaacatcttcgggatcctcatcggcaagtgcaacttctaccccgacgagtaccgggccagcaaggcgtcctacaccgcccaggagtacaacttcctgaacgacctgaacaacctcaaggtgcccaccgagaccgggaagctgagcacggagcagaaggagtccctggtggagttcgccaagaacaccgccatcctcggcccggccaagctgctgaaggagatcgcgaagatcctcgactgcaaggtcgacgagatcaaggggtaccgcgaggacgacaagggcaagcccgacctgcacaccttcgagccctaccggaagctgaagttcaacctcgacagcgtgaacatcgactacctgtcccgcgaggtgctggacaagctcgccgacatcctgaccctgaacacggagcgggagggcatcgaggacgccatcaagcgcaacctccccaaccagttcaccgaggagcagatcagcgagatcatcaacgtccggaagtcccagagcaccgccttcaacaaggggtggcacagcttctccgccaagctgatgaacgagctgatcccggagctctacgcgaccagcgacgagcagatgacgatcctgacccgcctggagaagttcaaggtgaagaagaagtccagcaagaacatcaagaccatcgacgagaaggagatcaccgacgagatctacaaccccgtggtcgccaagtccgtgcggcagacgatcaagatcatcaacgccgccgtgaagaagtacggcgacttcgacaagatcgtcatcgagatgccccgcgacaagaacgccgacgacgagaagaagttcatcaacaagcggaacaaggagaacaagaaggagaaggacgacgcgctcaagcgcgccgcctacctgtacaacgggaccgacaagctgcccgacgaggtgttccacggcaacaagcagctcgagaccaagatccggctgtggtaccagcagggggagcgctgcctgtacagcggcaagccgatccccatccaggagctggtgcacaactccaacaacttcgagatcgaccacatcctccccctgagcctgtccttcgacgacagcctcgccaacaaggtcctggtgtactcctggaccaaccaggagaagggccagaagacgccctaccaggtcatcgacagcatggacgcggcctggtccttccgggagatgaaggagtacgtgctgaagcagaaggggctcggcaagaagaagcgcgactacctgctgaccaccgagaacatcgacaagatcgaggtgaagaagaagttcatcgagcggaacctcgtcgacacccgctacgccagccgcgtggtgctgaactccctgcagagcgccctccgggagctggggaaggacaccaaggtctccgtggtgcgcggccagttcacgagccagctgcggcgcaagtggaagatcgacaagtcccgggagacctaccaccaccacgccgtcgacgcgctcatcatcgccgccagcagccagctgaagctgtgggagaagcaggacaacccgatgttcgtggactacgggaacaaccaggtggtcgacaagcagaccggcgagatcctctccgtgagcgacaacgagtacaaggagctggtgttccagccgccctaccagggcttcgtcaacaccatctccagcaaggggttcgaggacgagatcctgttctcctaccaggtggacagcaagtacaaccgcaaggtgtccgacgccacgatctacagcacccggaaggccaagatcggcaaggacaagaaggaggagacctacgtcctcgggaagatcaaggacatctactcccagaacggcttcgacaccttcgtgaagaagtacaacaaggacaagacgcagttcctgatgtaccagaaggaccccctgacctgggagaacgtgatcgaggtcatcctcggcgactaccccaccaccaagaagtccgaggacgggaagaacgacgtgaagtgcaaccccttcgaggagtaccgccgggagaacggcctgatctgcaagtacagcaagaaggggaagggcacgcccatcaagagcctgaagtactacgacaagaagctcgggaactgcatcgacatcacccccgaggagtcccgcaacaaggtgatcctgcagagcatcaacccgtggcgggcggacgtctacttcaaccccgagaccctgaagtacgagctcatgggcctgaagtactccgacctgagcttcgagaagggcaccgggaactaccacatctcccaggagaagtacgacgccatcaaggagaaggagggcatcgggaagaagtccgagttcaagttcacgctctaccgcaacgacctgatcctgatcaaggacatcgccagcggcgagcaggagatctaccggttcctcagccgcaccatgcccaacgtgaaccactacgtggagctgaagccctacgacaaggagaagttcgacaacgtccaggagctggtggaggccctcggggaggccgacaaggtgggccggtgcatcaagagcctgaacaagccgaacatctccatctacaaggtccgcaccgacgtgctgggcaacaagtacttcgtgaagaaggagggggacaagcccaagctcgacttcaagaacaacaagaagtga

SEQ ID NO: 1663 - RNA, 3393 nt, synthetic construct
  misc_feature 1..3393: note = Cas9 variant
  source 1..3393: mol_type = other RNA
atgagcaacggcaagatcctggggctcgacatcggcgtggcctccgtcggggtgggcatcatcgacgccaagaccgggaaggtgatccacgcgagctcccgcctgttcagcgccgccaacgccgagaacaacgccgagcggcgcggcttccggggcgcgcgccggctgacccgccggaagaagcaccgcatcaagcgggtccgcgacctcttcgagaagtacgagatcgtgacggacttctccaacctgaacctgaacccctacgagctccgggtgaaggggctgaccgagcagctgaccaacgaggagctgttcgccgccctccgcaccatcgccaagcggcgcggcatcagctacctggacgacgcggaggacgactccacggggagctccgactacgccaagagcatcgaggagaaccggcgcctcctgaagaacatgaccccgggccagatccagctggagcggctcgagaagtacgggcagctgcgcggcaacttcaccgtctacgacgagaacggcgaggcccaccggctgatcaacgtgttctccaccagcgactacaagaacgaggcccgcaagatcctcgagacgcagtccaactacaacaagcagatcaccgacgagttcatcgaggactacatcgagatcctgacccagaagcggaagtactaccacgggcccggcaacgagaagtcccgcaccgactacgggcgctaccggacggacggcaccaccctggagaacatcttcggcatcctcatcgggaagtgcaccttctaccccgacgagtaccgcacgagcaaggccagctacaccgcgcaggagtacaacttcctgaacgacctgaacaacctcaaggtgcccaccgagaccggcaagctgtccacggagcagaagcactacctggtcgacttcgccaagagctccaaggccctcggggtggccaagctgctgaaggagatcgccaagatcgtggagtgcagcgtcgacgacatcaagggctaccgggaggacaacaaggggaagccggacctccacaccttcgagccctaccgcaagctgaagttcaacctgagcctcatcgacatcgacgagctgtcccgggagaccctggacaagctcgcggacatcctgaccctgaacacggagcgcgagggcatcgaggacgccatcaagcggaacctccccaaccagttcaccgaggagcagatcgtggagctggtgaacgtccgcaagaaccagagctccgccttcaacaagggctggcacagcttctccgtgaagctgatgaacgagctcatccccgagctgtacgccagctccgaggagcagatgaccatcctgacccggctcgagaagttcaaggtgaacaagaagtccagcgagaacacgaagaccatcaacgagaaggagatcaccgacgagatctacaacccggtcgtggccaagagcgtgtcccagaccgtcaagatcatcaacgcggccgtgaagaagtacggggacttcgacaagatcgtgatcgagatgccccgcgacaagaacgccgacgacgagaagaagttcatcgacaagaagcagaaggagaacgccaaggaggtcgaggacgccctgaagcgggcggcctacctgtacaacggcacggacaagctccccgacggggtgttccacggcaacaagcagctgaagaccaagatccgcctgtggtaccagcagggggagcggtgcctgtacagcggcaagcccatctccatccaggacctcgtccacaacagcaacaacttcgagatcgaccacatcctgccgctgtccctcagcttcgacgactccctggccaacaaggtgctggtgtacgcctggaccaaccaggagaagggccagaagaccccctaccaggtcatcgacagcatggacgcggcctggtccttccgcgagatgaaggactacgtgctcaaccagaaggggatcggcaagaagaagcgggagtacctgctgacgaccgagaacatcgacaagatcgaggtgaagaagaagttcatcgagcgcaacctcgtcgacacccggtacgccagccgcgtggtgctgaacagcatccaggccgccctgaaggagctcgacaaggacaccaaggtctccgtgatccgggggcagttcaccagccagctgcgccgcaagtggaagatcgacaagtcccgggagacgtaccaccaccacgcggtggacgccctgatcatcgccgccagctcccagctcaagctgtggcagaagcaggagaaccccatgttcgtcgactacggcgagaaccaggtggtgaacaaggagaccggggagatcctgagcgtctccgacgacgactacaaggagctcgtgttccagcccccgtaccagggcttcgtgaacaccatcagctccaaggccttcgaggacgagatcctgttcagctaccaggtcgactccaagtacaaccgcaaggtgagcgacgcgaccatctactccacgcggaaggccaagctgggcaaggacaagaaggaggagacctacgtgctcgggaagatcaaggacatctacagccaggacggcttcgacgccttcatcaagcgctacaagaaggacaagacccagttcctgatgtaccagaaggaccccgtcacctgggagaacgtgatcgaggtgatcctgcgggactacccctccgagaagctcagcgaggacgggaagaagaacgtcaagtgcaaccccttcgaggagtaccgccgggagaacggcctgatctgcaagtactccaagaagggcaaggggacgccgatcaagagcctgaagtactacgacaagaagctcggcaactgcatcgacatcacccccaaggggagcaagaacgaggtggtgctgcagtccctgaacccctggcgcgccgacctctacttcaaccccgacaccctgaagtacgagctgatgggcctcaagtacagcgacctgtccttcgagaaggggaccggcaagtaccacatcagccaggagcggtacgacgagatcaaggtcaaggagggcatcgggaagaactccgagttcaagttcacgctgtaccgcaacgacctcatcctgatcaaggacaccgagagcggcgaggaggagctgtaccggttcctctcccgcaccatgccgaacgtgaagcactacgtggagctgaagccctacgacaaggagcggtacgacgggggccaggagctgatgaaggtcttcgggaacgtggccaacggcggccagtgcctcaagagcctgaacaagtccaacctgagcatctacaaggtgcgcaccgacgtcctcgggaacaagttcttcatcaagaaggagggcgacaagcccaagctggacttcaagaacaacaagaagtga

SEQ ID NO: 1664 - RNA, 3393 nt, synthetic construct
  misc_feature 1..3393: note = Cas9 variant
  source 1..3393: mol_type = other RNA
atgaccaacggcaagatcctggggctcgacatcggcatcgccagcgtgggggtcggcatcatcgaggccaagaccgggaaggtggtgcacgcgaactcccgcctgttcagcgccgccaacgccgagaacaacgccgagcggcgcggcttccggggctcccgccggctgaaccgccggaagaagcaccgcgtcaagcgggtgcgcgacctcttcgagaagtacgggatcgtgacggacttccggaacctgaacctgaacccctacgagctccgcgtcaagggcctgaccgagcagctgaagaacgaggagctgttcgcggccctccggaccatcagcaagcgccgggggatctcctacctggacgacgccgaggacgacagcaccggctccacggactacgccaagagcatcgacgagaaccgccggctcctgaagaacaagaccccggggcagatccagctggagcgcctcgagaagtacggccagctgcggggcaacttcaccgtgtacgacgagaacggggaggcgcaccgcctgatcaacgtgttctccaccagcgactacgagaaggaggcccggaagatcctcgagacgcaggccgactacaacaagaagatcaccgccgagttcatcgacgactacgtcgagatcctgacccagaagcgcaagtactaccacggccccgggaacgagaagtcccgcaccgactacggccggttccgcacggacggcaccaccctggagaacatcttcgggatcctcatcggcaagtgcaacttctaccccgacgagtaccgggccagcaaggcgtcctacaccgcccaggagtacaacttcctgaacgacctgaacaacctcaaggtgagcacggagaccgggaagctgtccaccgagcagaaggagagcctggtggagttcgccaagaacaccgccacgctcggccccgccaagctgctgaaggagatcgcgaagatcctcgactgcaaggtcgacgagatcaaggggtaccgcgaggacgacaagggcaagccggacctgcacaccttcgagccctaccggaagctgaagttcaacctcgagtccatcaacatcgacgacctgagccgcgaggtgatcgacaagctggccgacatcctcaccctgaacaccgagcgggagggcatcgaggacgccatcaagcgcaacctgcccaaccagttcacggaggagcagatctccgagatcatcaaggtgcgcaagagccagagcaccgccttcaacaaggggtggcactccttcagcgccaagctcatgaacgagctgatccccgagctgtacgcgacctccgacgagcagatgaccatcctcacgcggctggagaagttcaaggtcaacaagaagtccagcaagaacaccaagaccatcgacgagaaggaggtgaccgacgagatctacaacccggtggtcgccaagagcgtgcggcagacgatcaagatcatcaacgccgccgtgaagaagtacggcgacttcgacaagatcgtcatcgagatgccccgcgacaagaacgccgacgacgagaagaagttcatcgacaagcggaacaaggagaacaagaaggagaaggacgacgcgctgaagcgcgccgcctacctctacaactccagcgacaagctgcccgacgaggtgttccacgggaacaagcagctggagaccaagatccggctctggtaccagcagggcgagcgctgcctgtactccgggaagcccatcagcatccaggagctggtgcacaactccaacaacttcgagatcgaccacatcctgccgctcagcctgtccttcgacgacagcctggccaacaaggtcctcgtgtacgcgtggaccaaccaggagaagggccagaagaccccctaccaggtcatcgactccatggacgccgcctggagcttccgggagatgaaggactacgtgctgaagcagaagggcctggggaagaagaagcgcgactacctcctgacgaccgagaacatcgacaagatcgaggtgaagaagaagttcatcgagcggaacctggtcgacacccgctacgcctcccgcgtggtgctcaacagcctgcagtccgccctgcgggagctcggcaaggacaccaaggtcagcgtggtgcgcgggcagttcaccagccagctgcggcgcaagtggaagatcgacaagtcccgggagacgtaccaccaccacgcggtcgacgccctgatcatcgccgccagctcccagctcaagctgtgggagaagcaggacaaccccatgttcgtggactacggcaagaaccaggtggtcgacaagcagaccggggagatcctgagcgtgtccgacgacgagtacaaggagctcgtgttccagcccccgtaccagggcttcgtcaacaccatcagctccaagggcttcgaggacgagatcctgttcagctaccaggtggactccaagtacaaccgcaaggtgagcgacgccaccatctactccacgcggaaggcgaagatcgggaaggacaagaaggaggagacctacgtcctgggcaagatcaaggacatctacagccagaacgggttcgacaccttcatcaagaagtacaacaaggacaagacccagttcctcatgtaccagaaggactccctgacgtgggagaacgtgatcgaggtgatcctgcgcgactaccccaccaccaagaagtccgaggacggcaagaacgacgtcaagtgcaaccccttcgaggagtaccggcgcgagaacggcctcatctgcaagtacagcaagaaggggaagggcacccccatcaagagcctgaagtactacgacaagaagctggggaactgcatcgacatcacgccggaggagtcccggaacaaggtgatcctccagagcatcaacccctggcgcgccgacgtgtacttcaaccccgagaccctgaagtacgagctgatgggcctcaagtacagcgacctgtccttcgagaaggggaccggcaactaccacatcagccaggagaagtacgacgccatcaaggagaaggagggcatcgggaagaagtccgagttcaagttcaccctgtaccggaacgacctcatcctgatcaaggacatcgccagcggcgagcaggagatctaccgcttcctgtcccggacgatgcccaacgtcaaccactacgtggagctcaagccgtacgacaaggagaagttcgacaacgtgcaggagctggtcgaggccctgggggaggcggacaaggtgggccgctgcatcaaggggctcaacaagcccaacatcagcatctacaaggtgcggaccgacgtcctgggcaacaagtacttcgtgaagaagaagggcgacaagcccaagctggacttcaagaacaacaagaagtga

SEQ ID NO: 1665 - RNA, 3393 nt, synthetic construct
  misc_feature 1..3393: note = Cas9 variant
  source 1..3393: mol_type = other RNA
atgaccaacggcaagatcctggggctcgacatcggcatcgccagcgtgggggtcggcatcatcgaggccaagaccgggaaggtggtgcacgcgaactcccgcctgttcagcgccgccaacgccgagaacaacgccgagcggcgcggcttccggggctcccgccggctgaaccgccggaagaagcaccgcgtcaagcgggtgcgcgacctcttcgagaagtacgggatcgtgacggacttccggaacctgaacctgaacccctacgagctccgcgtcaagggcctgaccgagcagctgaccaacgaggagctgttcgcggccctccggaccatcagcaagcgccgggggatctcctacctggacgacgccgaggacgacagcacgggctccaccgactacgccaagagcatcgacgagaaccgccggctcctgaagaccaagaccccggggcagatccagctggagcgcctcgagaagtacggccagctgcggggcaacttcacggtgtacgacgagaacggggaggcgcaccgcctgatcaacgtgttctccaccagcgactacgagaaggaggcccggaagatcctcgagacccaggccgactacaacaagaagatcaccgccgagttcatcgacgactacgtcgagatcctgacgcagaagcgcaagtactaccacggccccgggaacgagaagtcccgcaccgactacggccggttccgcaccgacggcaccacgctggagaacatcttcgggatcctcatcggcaagtgcagcttctaccccgacgagtaccgggcctccaaggcgagctacaccgcccaggagtacaacttcctgaacgacctgaacaacctcaaggtgcccaccgagaccgggaagctgtccacggagcagaaggaggccctggtggagttcgccaagagcaccgccaccctcggcccggcgaagctgctgaaggagatcgccaagatcctcgactgcaaggtcgacgagatcaaggggtaccgcgaggacgacaagggcaagcccgacctgcacaccttcgagccctaccggaagctgaagttcaacctcgactccgtgaacatcgactacctgagccgcgaggtgctggacaagctcgccggcatcctgacgctgaacaccgagcgggaggggatcgaggacgccatcaagcgcaacctccccaaccagttcaccgaggagcagatctccgagatcatcaacgtccgcaagagccagagcaccgccttcaacaagggctggcactccttcagcgcgaagctgatgaacgagctgatcccggagctctacgccacgtccgacgagcagatgaccatcctgacccggctggagaagttcaaggtgaagaagaagtccagcaagaacatcaagaccatcgacgagaaggagatcacggacgagatctacaaccccgtggtcgccaagagcgtgcggcagaccatcaagatcatcaacgccgccgtgaagaagtacggggacttcgacaagatcgtcatcgagatgccccgcgacaagaacgcggacgacgagaagaagttcatcaacaagcggaacaaggagaacaagaaggagaaggacgacgccctcaagcgcgccgcctacctgtacaacggcaccgacaagctgcccgacgaggtgttccacgggaacaagcagctcgagaccaagatccggctgtggtaccagcagggcgagcgctgcctgtactccggcaagccgatccccatccaggagctggtgcacaacagcaacaacttcgagatcgaccacatcctccccctgtccctgagcttcgacgactccctcgcgaacaaggtcctggtgtacagctggacgaaccaggagaaggggcagaagaccccctaccaggtcatcgactccatggacgccgcctggagcttccgggagatgaaggagtacgtgctgaagcagaagggcctcgggaagaagaagcgcgactacctgctgaccaccgagaacatcgacaagatcgaggtgaagaagaagttcatcgagcggaacctcgtcgacacccgctacgcctcccgcgtggtgctgaacagcctgcagtccgccctccgggagctgggcaaggacacgaaggtcagcgtggtgcgcgggcagttcacctcccagctgcggcgcaagtggaagatcgacaagagccgggagacctaccaccaccacgcggtcgacgccctcatcatcgccgccagctcccagctgaagctgtgggagaagcaggacaacccgatgttcgtggactacggcaacaaccaggtggtcgacaagcagaccggcgagatcctcagcgtgtccgacaacgagtacaaggagctggtgttccagccgccctaccaggggttcgtcaacacgatcagctccaagggcttcgaggacgagatcctgttcagctaccaggtggactccaagtacaaccgcaaggtgagcgacgccaccatctactccacccggaaggcgaagatcgggaaggacaagaaggaggagacctacgtcctcggcaagatcaaggacatctacagccagaacggcttcgacacgttcgtgaagaagtacaacaaggacaagacccagttcctgatgtaccagaaggaccccctgacctgggagaacgtgatcgaggtcatcctcggggactaccccaccacgaagaagtccgaggacggcaagaacgacgtgaagtgcaaccccttcgaggagtaccgccgggagaacgggctgatctgcaagtacagcaagaagggcaaggggacccccatcaagtccctgaagtactacgacaagaagctcggcaactgcatcgacatcacccccgaggagagccgcaacaaggtgatcctgcagtccatcaacccgtggcgggccgacgtctacttcaaccccgagaccctgaagtacgagctcatgggcctgaagtacagcgacctgtccttcgagaaggggacgggcaactaccacatcagccaggagaagtacgacgccatcaaggagaaggaggggatcggcaagaagtccgagttcaagttcaccctctaccgcaacgacctgatcctgatcaaggacatcgccagcggggagcaggagatctaccggttcctcagccgcaccatgcccaacgtgaaccactacgtggagctgaagccctacgacaaggagaagttcgacaacgtccaggagctggtggaggccctcggcgaggcggacaaggtgggccggtgcatcaaggggctgaacaagccgaacatctccatctacaaggtccgcaccgacgtgctgggcaacaagtacttcgtgaagaaggagggggacaagcccaagctcgacttcaagaacaacaagaagtga

SEQ ID NO: 1666 - RNA, 3396 nt, synthetic construct
  misc_feature 1..3396: note = Cas9 variant
  source 1..3396: mol_type = other RNA
atggcccagcacgtgttcggcctggacatcgggatcgccagcgtcggctgggcgatcctcggggagcagcgcatcatcgacctgggcgtgcggtgcttcgacaaggccgagaccgccaaggagggggaccccctgaacctcacccgccggcaggcccgcctgctgcggcgccggctctaccgccgggcctggcgcctgacgcagctgtcccggctcctgaagcgcaagggcctgatcgcggacgccaagctgttcgccaaggcccccagctacggcgactccgcgtgggagctgcggcgccaggggctggaccggctcctgacgcccctggagtgggcccgcgtgatctaccaccagtgcaagcaccggggcttccactggaccagcaaggccgaggaggccaaggccgactccgacgcggagggcgggcgcgtcaagcaggggctcgcccacaccaaggccctgatgcaggccaagaactaccggagcgccgcggagatggtgctggccgagttccccgacgcccagcgcaacaagcggggccagtacgacaaggccctctcccgcgtgctgctgggcgaggagctcgccctgctgttcgcgacccagcgccggctcgggaacccccacgccagcgacttcttcgagaagctgatcctgggcgacggggaccgcaagtccggcctcttctggcagcagaagccggccctgagcggcgccgacctgctcaagatgctggggaagtgcaccttcgagaagggcgagtaccgggcccccaaggcgtccttcagcgtcgagcgccacgtgtggctgacccggctcaacaacctgcgcatcgtggtcgacgggcggtcccgccccctgaacgaggccgagcggcaggccgccctcctgctgccctaccagaccgagacgagcaagtacaagaccctcaagaacgcgttcatcaaggccggcctgtggggcgacggggtgcgcttcggcgggctggcctacccgtcccaggcccagatcgacgccgagaagaccaaggaccccgaggaccagttcctcgtgaagctgcccgcgtggcacgagctgcggaaggccttcaaggccgccggccacgaggccctctggcagcagatcagcacccccgcgctggacggggacccgacgctgctggaccagatcgccaccgtcctctccgtgtacaaggacggcgccgaggtggtccagcagctgcgccagctggccctccccgagcccgccgcgagcatcgccgtgctggagaagatctccttcgacaagttcagcagcctgtccctcaaggccctgcggcgcatcgtgcccctgatgcagagcgggctccggtacgacgaggccgtcgcgcagatcccggagtacggccaccactcccagcgcatcgagcccggcgccgccaagcacctgtacctgccgcccttctacgaggcccagcggaagtacgccgggaagggcgaccacatcgggagcatgcagttccgcgacgacgcggacatcccccggaaccccgtggtgctccgcgccctgaaccaggcccgcaaggtcgtgaacgccctgatccgggagtacggctcccccatcgccgtgaacatcgagatggcgcgcgacctcagccggcccctggacgagcgcaacaaggtcaagcgggcccaggaggagttccgcgaccggaacgaccgcgcccggtccgagttcgagcgcgacttcgggtacaagccgaaggccgccgcgttcgagaagtggatgctgtaccgggagcagctcggccagtgcgcctacagccagcagcccctggacatccagcgcgtgctggacgaccacaactacgcccaggtcgaccacgccctcccctactcccggagctacgacgactccaagaacaacaaggtgctggtgctgacccacgagaaccagaacaagggcaaccgcaccgcgttcgagtacctcacgagcttccccgacggggaggacggcgagcggtggcgcaccttcgtcgcctgggtgcaggggaacaaggcctaccggatggccaagcgcaaccggctgctgcgcaagaactacggcgtggacgagtccaagggcttcatcgaccggaacctcaacgacacccgctacatctgcaagttcttcaagaactacgtcgaggagcacctccagctggccgcgcgcgccgacggggacaccgcccggcgctgcgtggtggtcaacggccagctcacggccttcctgcgggcccgctgggggctgaccaaggtgcggggcgacagcgaccgccaccacgcgctcgacgccgccgtggtcgccgcctgcacccacgggatggtgaaggcgctggccgactactcccggcgcaaggagatcagcttcctgcaggagggcttcccggaccccgagaccggcgagatcctcaaccccgccgccttcgaccgggcccgccagcacttcccggagccctggacgcacttcgcgcacgagctgaaggcccggctgttcaccgacgacctcgccgccctgcgcgaggacatgcagcggctggggtcctacaccaccgaggacctcggccgcctgcggacgctgttcgtgagccgcgcgccccagcggcgctccgggggcgccgtccacaaggagaccatctacgcccagcccgagagcctcaagcagcagggcggggtgatcgagaagatcctgctgaccagcctcaagctgcaggacttcgacaagctgctcaacccggagtccaacgaccacttcgtggagccccaccggaacgagcgcctgtacgccgccatccgccagcggctggagcagttcggcgggcgcgcggacaaggccttcggccccgacaacctcttccacaagcccgacaagaacaaccagccgaccgggcccgtcgtgcggagcatcaagctggtgcgcggcaagcagacggggatccccatccggggcggcctggccaagaacgactccatgctccgcgtcgacatcttcaccaaggccgggaagttccacctggtgcccgtgtacgtccaccaccgggtgaccggcctgccgaaccgcgccatcgtggcgttcaaggacgaggacgagtggaccctcatcgacgagagcttcgccttcctgttctccgtctaccccaacgactacgtgaaggtgacgctgaagaaggagcagcagagcgggtactactccggcgccgaccggagcaccggggccatgaacctctgggcccacgaccgcgcggcctccgtcggcaaggacggcctgatccgggggatcggcgtgaagaccgccctgagcgtggagaagttcaacgtcgacgtgctcgggcgcatctacctggccccgcccgagacccggtccggcctggcgtga

SEQ ID NO: 1667 - RNA, 3399 nt, synthetic construct
  misc_feature 1..3399: note = Cas9 variant
  source 1..3399: mol_type = other RNA
atggcccagtacgtgttcggcctggacatcgggatcgccagcgtcggctgggcggtgctcgacgcccagcgcatcgtggacctgggggtccggtgcttcgacaaggccgagaccgccaaggagggcgaccccctgaacctcacccgccggcaggcccgcctgctgcggcgccggctctaccgccgggcgtggcgcctgacgcagctggcccggctgttcaagcgcgaggggctgatcgacgacgccaagctgttcgccaaggcgccgtcctggaccgagaacgcctgggagctccggctgcgcggcctggaccacctcctgacgcccctggagtgggcccgggtgatctaccacctctgcaagcaccgcggcttccactggaccagcaaggccgaggaggccaaggcggagtccgacgccgagggcgggcgggtgaagcaggggctggcccacaccaaggccctgatgcaggtcaagaactaccgcagcaccgccgagatggtgctcgcggagttccccggcgcccagcggaacaagcgcgggcagtacgacaaggccctgtcccgggtgctgctcggcgaggagctggccctcctcttcgccacccagcgccgcctgggcaacccccacgcgagcgagcacttcgagcagctgatcctcgggcacggcgaccggaagtccgggctgttctggcagcagaagccggccctgagcggcgccgacctcctgaagatgctgggcaagtgcaccttcgagaagacggagtaccgcgcccccaaggcctccttcagcgcggagcggcacgtctggctcacccgcctgaacaacctgcggatcgtggtggacgggcgcgcccggcccctcaacgacgccgagcgccaggccgcgctgctgctcccctaccagaccgagaccttcaagtacaagacgctgaaggccgccttcgtcaaggtgggcctgtggggcgacggggtgcggttcgggggcctcgcctacccgtcccaggcccaggcggaggccgagaaggccaaggaccccgaggaccagttcctggtcaagctgcccgcctggcacgagctccgcaaggccttcaaggcggccggccacgaggccctgtggcagcagatcagcatgcccgccctggaggaggacccgaccctgctcgaccagatcgccaccgtgctgtccgtgtacaaggacgggaccgaggtcgtgcagcagctgcggcagctcgcgctgcccgagcccgacgccagcatcgccgtgctggagaagatccgcttcgacaagttctccagcctctccctgaaggccctgcggcgcatcgtccccctcatgcagggcgggctgcggtacgacgaggcggtggcccagatcccggagtacggccaccacagccagcgcatcgaccccggggccacgcggcacctgtacctcccgcccttctacgaggcccagcgcaagtacgccggcaagggcgaccggatcgggtccatgcagttccgcgaggacgcggacgtgccccgcaaccccgtcgtgctgcgggccctgaaccaggcccgcaaggtcgtgaacgccctcatccgggagtacggcagccccgtggccgtcaacatcgagatggcgcgcgacctgagccggcccctggacgagcgcaacaaggtgaagcgggcccaggaggagttccgcgaccggaacgacaaggcccgctccgagttcgagcgggacttcgggtacaagccgaagggcgccgtgttcgagaagtggatgctctaccgcgagcagctggggcagtgcgcctacagccagcagcccctggacatccagcgggtcctcgacgaccccaactacgcccaggtggaccacgccctgccctactcccgcagctacgacgactccaagaacaacaaggtgctggtcctcacccgggagaaccagaacaagggcaaccgcaccccgttcgagtacctgaccagcttccccggcggggaggacggcgagcggtggcgcgccttcgtggcctgggtgcaggggaacaaggcgtaccggatggccaagcgcaaccggctgctccgcaagaactacggcacggacgagtcccgcggcttcatcgaccggaacctgaacgacacccgctacatctgcaagttcttcaagaactacgtcgaggagcacctccagctggccgcccggaccgacggggacaccgcccgccggtgcgtggtggtcaacggccagctgacggcgttcctgcgcgcccggtgggggctcgccaaggtgcgcggcgacagcgaccggcaccacgccctggacgccgcggtggtcgccgcctgcacccacgggatggtgaaggccctggccgactactcccgccggaaggagatcgcgttcctccaggagggcttccccgacccggagaccggcgagatcctgaacctggccgccttcgaccgcgcccgggagcacttccccgagccctggccccacttcgcccacgagctcaaggcgcgcctgttcatcgacgacctggtggccctccgggaggacatgcagcacctggggagctacgcccaggacgacctggaccgcctccggaccctgttcgtctcccgcgccccgcagcggcgcaacggcggggcggtgcacaagggcacgatctacgcccagcccgagaacctgaagcagcaggggagcaccatcgagaagatcctcctgaccggcctgaagctccaggacttcgacaagctgctgaaccccgagtccagcgaccacttcgtggagccccaccgcaacgagcggctctacgccgccatccgccggcgcctggaggagttcggcgggaaggccgacaaggcgttcggcccggacaagcccttctacaagcccgacaagaacgggcagcccaccggcccgatcgtccggtccatcaagctggtgcgcgggaagcagacgggcatccccatccggggcgggctcgccaagaacgacagcatgctgcgcgtggacgtcttcaccaaggccggcaagttccacctggtgcccgtgtacgtccaccaccgggtgaccgggctccccgaccgcgccatcgtggccttcaaggacgaggaggagtggaccctgatcgacgagtcctacgcgttcctgttcagcgtctacccgaacgacttcgtgtgcgtgcagcagcggggcaagcccctcatcgaggggtactacgccggcctggaccgcgccaacggcaacatcaacgtctgggcccacgaccgggccgcgtccgtggggaaggacggcctgatccgcgggatcggcgtgaagacggccctcagcctggagaagctgaacgtcgacgtgctcggccggatctaccccgcgcccccggagacccgccgggggctggcctga

SEQ ID NO: 1668 - RNA, 3399 nt, synthetic construct
  misc_feature 1..3399: note = Cas9 variant
  source 1..3399: mol_type = other RNA
atgaagaagatcctgggcgtggacctcgggatcaccagcttcggctacgccatcctgcaggagaccgggaaggacctgtaccgctgcctcgacaactccgtcgtgatgcggaacaacccctacgacgagaagtccggcgagtccagccagtccatccgcagcacgcagaagtccatgcggcgcctgatcgagaagcggaagaagcgcatccggtgcgtggcccagaccatggagcgctacgggatcctggactacagcgagaccatgaagatcaacgacccgaagaacaaccccatcaagaaccggtggcagctccgcgcggtcgacgcctggaagcggcccctgagcccccaggagctgttcgccatcttcgcccacatggccaagcaccgcggctacaagagcatcgcgaccgaggacctcatctacgagctggagctggagctcggcctgaacgacccggagaaggagtccgagaagaaggccgacgagcggcgccaggtgtacaacgccctgcggcacctcgaggagctgcgcaagaagtacgggggcgagacgatcgcccagaccatccaccgggcggtggaggccggggacctgcgcagctaccggaaccacgacgactacgagaagatgatccgccgggaggacatcgaggaggagatcgagaaggtcctcctgcgccaggccgagctgggcgccctcgggctgcccgaggagcaggtctccgagctgatcgacgagctcaaggcctgcatcaccgaccaggagatgcccaccatcgacgagagcctgttcggcaagtgcacgttctacaaggacgagctggcggcccccgcctactcctacctctacgacctgtaccgcctgtacaagaagctcgccgacctgaacatcgacggctacgaggtgacccaggaggaccgggagaaggtgatcgagtgggtggagaagaagatcgcccaggggaagaacctgaagaagatcacccacaaggacctccgcaagatcctgggcctggcgccggagcagaagatcttcggggtggaggacgagcggatcgtcaagggcaagaaggagccccgcaccttcgtgcccttcttcttcctcgccgacatcgccaagttcaaggagctgttcgccagcatccagaagcaccccgacgccctgcagatcttccgggagctcgcggagatcctgcagcgctccaagacgccgcaggaggccctggaccggctccgcgccctgatggccggcaaggggatcgacaccgacgaccgggagctgctcgagctgttcaagaacaagcgcagcggcacccgggagctgtcccaccgctacatcctcgaggccctgcccctgttcctggaggggtacgacgagaaggaggtgcagcggatcctcggcttcgacgaccgcgaggactacagccggtaccccaagagcctgcgccacctccacctccgggaggggaacctgttcgagaaggaggagaaccccatcaacaaccacgcggtcaagtccctggccagctgggccctgggcctgatcgccgacctgtcctggcgctacggcccgttcgacgagatcatcctcgagaccacgcgggacgcgctgcccgagaagatccgcaaggagatcgacaaggccatgcgcgagcgggagaaggccctggacaagatcatcgggaagtacaagaaggagttccccagcatcgacaagcgcctcgcccggaagatccagctgtgggagcgccagaagggcctggacctctactccgggaaggtgatcaacctgagccagctgctcgacggctccgccgacatcgagcacatcgtgccccagagcctgggcgggctgtccaccgactacaacaccatcgtcaccctcaagagcgtgaacgcggccaagggcaaccggctgccgggggactggctggccggcaaccccgactaccgcgagcggatcgggatgctctccgagaagggcctgatcgactggaagaagcgcaagaacctgctcgcccagagcctggacgagatctacacggagaacacccactccaaggggatccgggccaccagctacctggaggcgctcgtggcccaggtcctgaagcgctactaccccttccccgacccggagctgcggaagaacggcatcggcgtgcgcatgatccccgggaaggtgacctccaagacgcggagcctcctgggcatcaagtccaagagccgcgagaccaacttccaccacgccgaggacgccctgatcctctccaccctgacccgggggtggcagaaccgcctgcaccggatgctccgcgacaactacggcaagagcgaggccgagctgaaggagctgtggaagaagtacatgccccacatcgagggcctcacgctggcggactacatcgacgaggccttccggcgcttcatgagcaagggggaggagtccctgttctaccgggacatgttcgacaccatccgcagcatctcctactgggtcgacaagaagcccctcagcgcctccagccacaaggagaccgtgtactccagccgccacgaggtcccgaccctgcggaagaacatcctggaggccttcgactccctcaacgtgatcaaggaccgccacaagctgacgaccgaggagttcatgaagcggtacgacaaggagatccgccagaagctgtggctccaccggatcggcaacaccaacgacgagagctaccgcgcggtggaggagcgggccacccagatcgcccagatcctgacgcgctaccagctgatggacgcccagaacgacaaggagatcgacgagaagttccagcaggccctcaaggagctgatcacctcccccatcgaggtcaccgggaagctgctccggaagatgcgcttcgtgtacgacaagctgaacgcgatgcagatcgaccggggcctggtggagaccgacaagaacatgctcgggatccacatcagcaagggccccaacgagaagctgatcttccgccggatggacgtcaacaacgcccacgagctgcagaaggagcgctccggcatcctctgctacctgaacgagatgctgttcatcttcaacaagaaggggctcatccactacggctgcctgcggagctacctggagaaggggcagggctccaagtacatcgccctcttcaacccgcgcttccccgccaaccccaaggcccagcccagcaagttcacctccgacagcaagatcaagcaggtcgggatcggcagcgcgacgggcatcatcaaggcccacctggacctggacgggcacgtgcggtcctacgaggtgttcggcaccctcccggaggggagcatcgagtggttcaaggaggagtccggctacgggcgcgtggaggacgacccccaccactga

SEQ ID NO: 1669 - RNA, 3402 nt, synthetic construct
  misc_feature 1..3402: note = Cas9 variant
  source 1..3402: mol_type = other RNA
atggacctgaactaccgcatcggcctcgacatcgggatcgccagcgtgggctgggccgtcctggagaacaactccaaggacgagcccgtgcggatcgtggacctgggggtccgcctcttcgaggcggccgaggtgccgaagaccggcgccgccctggccgagccccggcgcgaggcgcggaccacgcgccggcgcctgcggcgccggaagcaccgcctcgagcggatgaagtggctgctgcaggagtacgggctcatccagaccgaggagttcatgaagcgctaccacagcgccggcctgcccgacgtgtaccggctgcgctacgagggcctcgagcggaagctgaaggacgaggagctggcccagatcctcatccacatcgggaagcaccgcggcttccggtccacccgcaaggccgagctgaaggacaagaacgacaaggagaccggggcggtcctgagcgccacgcgggagaacgagaagctcatggaggagcacggctaccgcaccgccggggagatgatctacaaggacgacaagttccgcaccggctgcacctggaaggaggagggctaccggctgacgccccgcaacaaggagggggactacaagaacaccatgctgcgggccctcctggaggacgaggtgaaggtgatcttcgactgccagcgcaagttcggcaaccagaaggcctccgaggagctggagaaggcgtacctcgccatcatgaccagccagcggtccttcgacatggggccgggcaagcagcccgacggcagcgcctccccctacgccatggaggggttcggcgaccgcgtcgggctgtgcgccctggagccccgggagaagcaggagccgcgcgcgcccaaggccgcctacaccagcgagctgttcgtggccctgcagaagatcaaccacctccggatcacggagaagaacggcaaggggcgcggcctcacctccgaggagcgggagcgcctgagcgacctgctccacaagaagaaggagctgacctacggcgccgtgcggaaggagctgcagctcgacctgcgctaccggttcaacaccctgaactactccagcaagaagatgacggaggaggagaagatcaaggacgcggagaaggccaagttcgtctccatggtgagccactacgagtaccgcaagcggatgtccgggatgctcgagcagctgagccccgaggagcaggccgacctgatggacgaggtgggcaagatcctcaccctgtacaagaacgacgacacccgctcccgggagttccagaagctggggctcgacagcgagatcaccgaggagctgctggagctcaacccccgcggcttccagcacgtcagcctgaaggccatgaagaagctgatgccgtacctgaaggaggggctcacgtacgacaaggcctgcgcggaggccggctacgacttccagggctccgtgcagaaggagcgcagccggctgctgaaggggaaggagatcaccgacatcatcaacgacatcaacaaccccgtggtcaagcgctccgtgagccagaccgtgaaggtcatcaacgccatcatccagaagtacggcagcccccaggccgtgaacatcgagctcgcgcgggagatgtcccgcaactacgacgagcggcgcaagatggagaagcagatgaaggaccggcagtccgagaacgagcgcgccaagaaggagatccaggagctggggaacgccttccccaccggccaggacatcctgaagtaccggctctggcacgaccaggacgggatctgcatgtacagcgccaagcgcatcccgctggccgagctgttcacgggcgcgtacgacatcgaccacatcctcccctactccatcaccttcgacgacagctaccggaacaaggtgctggtcacctccgaggagaaccgccagaagggcaaccggatcccctacgagtacttcgggagcgactccgagcgctggagcaagttcgagaccctggtgaactcccggatccgcgactaccggaagcagcagaacctcctgaagcagagcttcacggaggaggagcgcaaggagttcaagcagcggaacctgaacgacaccaagtacatcacccgcgtcatctacaacatgatccgggagaacctcgccctggccccctacaactccccgggcaagaagaagcaggtcttcgccgtgaacgggggcgtgaccgcctacctgcgcaagcgctggggcatgagcgcgaaggaccggtccatcgacacgcaccacgcccgcgacgccgtggtgatcgcctgctgcaccgacgggatgatccagaagatcagccggaacatccagggccgcgagctcctgtacgcccgggggttcaccgcggtcgacgtggagaccggcgagaagttcacgcgcgacgacttcacccgggaccagtgggacgagatcttcggggtgcaggtccccaagccctgggagtacttcaacgaggagctggacatccgcctcggcgagaaccccgtggagttcatcgagacccacagcgacgtgtcccggaagctggactacccggcctggttctacgagaacaacatcatccgccccgtcttcgtgagccggatgcccaaccgcaaggtgaccggcgccgcccacgcggacaccatccggagcccccgccactaccaggagacggggtccgtcctgaccaagaccgccctcatcgacctgaagctgaacaagaagaccggcgagatcgagaactactacaagccggagtccgacacgctcctgtacaacgccctgaaggagcggctcgagctgtacgggggcgacgggaagaaggccttcgaggagcccttctacaagcccaaggccgacggcagccgcggcaacctggtgcggaaggtgaagacctacgacaagctcaccctgggggtctacgtgaactcccagcacggcatcgcggccaacgccaacgggagcatggtgcgcgtcgacgtgttccgggtgtccggcaagtactacttcgtcccggtgtacatcgccgacgtggtccgcaagcgcctgcccatgaaggccgtggtgcaggggaagcagtacatcgactggaaggagatggaggacaaggacttcatcttcagcctctacacccgggacctgatctccttcaagagcaagaacggcaagaaggtcacgtgcgtggacggcacctccaaggcggtgaacgaggagatcgtctactactacggggccaacatcagcaccgcctccttcagcggcaagtcccacaacgggagcttcgagttcaccagcctgggcatccaggggctcgagtacctgaagaagtaccaggtggacgtgctgggcaacgtctccgaggtgaagcgcgagaagcggatgggcttccgctga

SEQ ID NO: 1670 - RNA, 3402 nt, synthetic construct
  misc_feature 1..3402: note = Cas9 variant
  source 1..3402: mol_type = other RNA
atgggcgggttcgaggtggaccgcaagatcagcctgggcctcgacatcggggtctccagcgtgggctactccgtgatcgacgtcgacaccgggaaggtgctggagctgggcagccggctcatcaacggcaagatcgggaccgagaaccaggcccgccgggagatgcgcggcacgcggcgcctgatcaaccggaagaagcagcgccggaaggacaccgtgaagctgttcaacgagttcaagctcatcgactccaagaaggacgagcactacttcgaccacttcgccaacaacagcgacccctacgagctgcgcgtcaaggggctgtccgagaagctcagcctgtccgagatcgcggacggcctgtaccacatcgtgaagcggcgcgggatcagctacgacctcaaggacgccgacgaggagtccgagggcagcgagtacgagaacggcctgaagatcaacaactccgagctgaagaaccagaccccggcccagatccagctcaagcggctgaacgagtacggggccatccgcggcaaggtggtcatcgacgaggagaagatcctgctcaacgtgttccccaccaaggcctacctggacgaggcgaagcggatcatcgagaagcagcgcgagttctaccccgggatcctgacggaggagttcgaggagaagtactgccagatcctcacccggaagcgcgactacttcgtgggccccggcagcgagaagtcccggaccgactacgggatctacaaggaggacggccgcaccctgaacaacctgttcgaggagctcatcgggcacgacaagatctacccggaggagctgcgggccagcggcgcctccttcacggcccagctgttcaacgtcctcaacgacctgaacaacctgcacatcagctcctacgaggaccagaagctcaccaccgagaacaaggagcagatcatcagcgagctcaagagcaccacgtccaacgtgaacatgatgaagctgatccagaagatcgcggggtgcgaggagagcgacatctccggctaccgcaccgacaagaactacaagcccgagatcagctccatgcgcatctaccggaaggtgcacaagaagctcctggagagcgagatcgacatcaccaactggcccgacgacttcatcaacaagctgtccttcatcctcaccctgaacacggagaacggcgagatccgcaaccagctgaagaaccggctccagcccgagtacgacttcctgaccgacgagctgatccagaccatcatcgacaacaaggagagcttcgacatcaagtccaacaacaagtggcaccgcttcagcatcaagaccatggagctcctgatcccggagatgatcaagcggcccgtcgagcagatgacgctgatcaacgagatggggctcatcaagaactccggcaagaagttcagcaactacaagtacctgccctacaagaagatcgccgaggacatctacaaccccgtggcctccaagagcgtgcgcgaggccctgaagatcgtcaacgccatcctcaaggagtacgggcacatcgagtacatcgtggtggagatgccgcgggacaagaacgaggacgaggcgaaggaccagatcgagaagttccagaaggccaacggccgcctgaaggacgccgccctggaggagttcaccgaggccatcggggacaagtccaccgtcgacaagaagctgggcgtgcaccggagcaagctcctgttcaagatccgcctgtggtaccagcagcggggcatggacctctacgaggggaagcccatctccgcggtggacctgctgaacaaccccgacagcttccagatcgaccacatcatcccccagtccgtcagcttcgacgacagcttcaacaacaagaccctctgcaactccggcctgaaccagatcaaggacaagaagacgccgttcgagtacatgaacgaggggtacggccaggggttcgacagcatgaaggccatggtgatgaagaacccccgcatcgaccacaacaagcggaagaactacctgttctccgagaacgtcagcgacatcgagacccgcaagcggttcatctcccgcaacctcgtggacacccggtacgccagccgcgtggtcctgaacaacctgcaggagttcttcaaggagaaggagtccgacaccaagatcagcatcatccggggcaagttcacgtccaacctccgcaagcactggaagatcaacaagaaccgcgacacctaccaccaccacgccatcgacgccaccatcatcgcggccacccccttcctgaacatctggaagaagggcagctccatcttccccagcaacgtggagtccgaggacttcttcgacatcaagacggggaagatcatcggcaacgacgagttcaacaagtacgcctacgacgagccgtacaacgggttctacaacgagctgcggaacgccaccgaccgcatcaagttcagccaccagatcgacaagaagatgaaccggaaggtgtccgacagcaccatctactccacccgcgtcgccaagagccccaagaacaagaaggagagcgagtacatcgtggcgaagatcaagaacatctacgacgccgacgagtacgccaagttcaagcggatctacgacaaggacaagacgaagttcctcctgaacaagtacgacccccgctccttcaaccacctggagaagatcatgaacacctaccccgacagcatcgagcggaccatgtccaacaacaaggtgaaggtcgtgcgcatcagcccgttcgagctctaccggcaggaccacggccccgtgaagaagtactccaagaagaacaacggccccgagatcaagcagctgaagtacctggacaagaaggtcgggagctccatcgacgtgacccccgacaacgccaagaacaagcacgtgatcctcaagagcctgaagccgtggcgcaccgacatctacctgaaccacgagacgggcgagtacgagatcatggggatcaagtactccgacctcaagttcaacaagggcgaggggtacggcatcaagaaggcgaagtacctggagatcaagcaccgggagaaggtcagcgacgactccgagttcatgttcaccctgtacaagaagaaccgcatcaaggtggagaacatggagaccgacgagagcgtggagatgctgttctggtcccggaccatggacagccagaagggctacgccgagctgaagcccatctacaagtacaagacggaggacgacaactggcccatctacgggaacgccaagaagcagatcatcaagaagctgatcccgaagaactgcaagatctggaaggtcaacaccgacgtgctcggcaaccccttctacgtggagaaggagggggagtaccccaaggacgtcctggactga

SEQ ID NO: 1671 - RNA, 3405 nt, synthetic construct
  misc_feature 1..3405: note = Cas9 variant
  source 1..3405: mol_type = other RNA
atgaacggcctggtgctcgggctggacatcggcatcgccagcgtcggggtgggcatcctggagaagaactccgggaagatcgtgcacgccagctcccgcatcttccccgcggccaccgccgacaacaacgtcgagcggcgcaagaaccggcaggcccgccggctccaccgccggaagaagcaccgcggcgcccggctgaaggacctgttcgagtactacggcctcctgaccgacttcagcaaggtgtccatcaacctgaacccgtaccgcctccgggtggacgggctggaccagcagctgacgaacgaggagctgttcatcgcgctcaagaacatcgtcaagcgccggggcatcagctacctggacgacgcctccgaggacgggggcaccgtgagctccgactacgggaaggccgtggaggagaaccgcaagctcctggccgagcagacccccggccagatccagctggagcggttcgagaagtacggccagctccgcggggacttcaccgtcgtggagaacagcgagaagtgccggctgatcaacgtgttctccacgagcgcgtacaagaaggaggccgagcgcatcctgcggaagcagcaggagttcaacaaccagatcaccgacgagttcatcgaggactacctcaagatcctgaccggcaagcgcaagtactaccacgggcccggcaacgagaagtcccggaccgactacggccgcttccgcacggacggggccaccctggacaacatcttcggcatcctcatcgggaagtgcaccttctaccccaacgagtaccgggccagcaaggcctcctacaccgcgcaggagttcaacctgctgaacgacctcaacaacctgacggtcccgaccgagaccaagaagctgagcgaggagcagaagaagaccatcatcgagtacgccaagtccgccaagacgctcggcgccagcaccctgctgaagtacatcgccaagatgatcgacgcgtccgtggaccagatccgcgggtaccgggtggacgtcaacaacaagcccgagatgcacaccttcgaggtgtaccgcaagatgcagagcctcgagaccatcagcgtgggcgagctgtcccggaacatcctggacgagctcgcccacatcctgacgctgaacaccgagcgcgagggcatcgaggaggccatcaacaccaagctccgggacagcttctcccaggaccaggtcctggagctggtgcagttccgcaagaacaacagctccctcttcagcaaggggtggcacaacttctccctgaagctgatgatggagctcatccccgagctgtacgagaccagcgaggagcagatgacgatcctgacccggctcggcaagcagaagtccaaggagaccagcaagcgcaccaagtacatcgacgagaaggaggtgacggaggagatctacaaccccgtcgtggccaagtccgtgcggcaggccatcaagatcatcaacgaggcgaccaagaagcacgggatcttcgacaacatcgtcatcgagatggcccgcgagaacaacgaggaggacgccaagaaggactacatcaagcggcagaaggccaaccaggacgagaagtacgccgcgatggagaaggccgccttccagtacaacggcaagaaggagctgccggacaacatcttccacgggcacaaggagctggccaccaagatccgcctgtggcaccagcagggcgagaagtgcctctacaccggcaagagcatccccatctccgacctgatccacaaccagtacaagtacgagatcgaccacatcctgcccctcagcctgtccttcgacgacagcctgtccaacaaggtgctcgtcctggcgacggccaaccaggagaaggggcagcggacccccttccaggccctggacagcatggacgacgcctggtcctaccgcgagttcaagagctacgtgaaggagagcaagctcctgggcaacaagaagaaggagtacctgctcaccgaggaggacatctccaagatcgaggtgaagcagaagttcatcgagcggaacctggtcgacacccgctacagctcccgggtggtgctgaacgccctccaggacttctacaagaaccacaacttcgacacgaccatcagcgtcgtgcgcgggcagttcacctcccagctgcgccggaagtggggcctggagaagtcccgcgagacctaccaccaccacgcggtggacgccctcatcatcgccgccagcagccagctgcggctgtggaagaagcagaacaacccgctcatcgcctacaaggaggggcagttcgtcgactcccagaccggcgagatcatcagcctgacggacgacgagtacaaggagctggtgttcaaggcgccctacgaccacttcgtggacaccctctccagcaagaccttcgaggactccatcctgttcagctaccaggtcgactccaagttcaaccgcaagatcagcgacgccaccatctacgccacgcggaaggccaagctggacaaggagaagaaggagtacacctacaccctcggcaagatcaaggacatctactccctggggaccaagacgcccagcaagaccggcttctacaagttcctggacctctacaacaaggacaagagccagttcctgatgttccagaaggaccgcaagacctgggacgaggtgatcgagaagatcatggagcagtaccggcccttcaaggagtacgacaaggccgggaagctggtggacttcaacccgttcgagaagtaccgccaggagaacggccccatccggaagtactccaagaagggcaacgggcccgagatcaagagcctcaagtactacgacatcctgctgggcaagcacaagaacatcacccccgaggggtcccgcaacacggtcgcgctcctgagcctgaacccgtggcggaccgacgtgtactacaacatggagaccaagaagtacgagttcctcggcctgaagtacgccgacctgcccttcgaggagggcggggcctacggcatctccaccgagacgtacaacgagctccgcgagaaggaggggatcggcaagaacagcgagttcaagttcaccctgtacaagaacgacctgatcctcatcaaggacaccgagaccaactgccagcagttcttccggttctggtcccgcacggggaaggacaaccccaagagcttcgagaagcacaagatcgagctgaagccctacgagaaggccaagttcgagaagggcgaggagctggaggtgctcgggaaggtcccgccctccagcaaccagttccagaagaacatgcagatcgagaacctgtccatctacaaggtgaagaccgacgtgctgggcaacaagcacttcatcaagaaggagggcgacaagcccaagctcaagttctga

SEQ ID NO: 1672 - RNA, 3405 nt, synthetic construct
  misc_feature 1..3405: note = Cas9 variant
  source 1..3405: mol_type = other RNA
atgaacggcctggtgctcgggctggacatcggcatcgccagcgtcggggtgggcatcctggagaagaactccgggaagatcatccacgccaacagccgcctcttccccgcggccaccgccgacaacaacgtggagcggcgcaagaaccggcaggcccgccggctgaaccgccggaagaagcaccgcggcgtccggttccaggacctgttcgaggactacggcctcctgaccgacttctccaaggtgagcatcaacctgaacccgtaccgcctccgggtggacgggctgaaccagcagctgacgaacgaggagctgttcatcgccctcaagaacatcgtcaagcgccggggcatctcctacctggacgacgcgagcgaggacgggggcgccgtgtccagcgactacgggaaggccgtggaggagaaccgcaagctcctggccgagcagacccccggccagatccagctggagcggttcgagaagtacggccaggtccgcggggacttcaccgtggtggagaacggcgagaagctccggctgatcaacgtcttctccaccagcgcgtacaagaaggaggccgagcgcatcctgcggaagcagcaggagttcaacaaccagatcacggacgagttcatcgaggactacctcaagatcctgaccgggaagcgcaagtactaccacggccccggcaacgagaagtcccggaccgactacgggcgcttccgcaccgacggcacgaccctggacaacatcttcgggatcctcatcggcaagtgcaccttctaccccgaggagtaccgggccagcaaggcctcctacaccgcccaggagttcaacctgctgaacgacctcaacaacctgacggtgccgaccgagaccaagaagctgagcgaggagcagaagaaggtgatcgtcgagtacgcgaaggaggccaagaccctcggggcctccacgctgctgaagtacatcgccaagatgatcgacgccagcgtggaccagatccgcggctaccgggtggacgtcaacaacaagcccgagatgcacaccttcgaggtgtaccgcaagatgcagtccctcgagaccatcagcgtgggcgagctgtcccggaacgtcctggacgagctcgcgcacatcctgaccctgaacacggagcgcgaggggatggaggaggccatcaacaccaagctcaaggacagcttcagccaggaccaggtgctggagctggtgcagttccggaagaacaactccagcctcttctccaagggctggcacaacttcagcctgaagctgatgatggagctcatccccgagctgtacgagacctccgaggagcagatgaccatcctgacgcgcctcgggaagcagaagtccaaggagaccagcaagcggaccaagtacatcgacgagaaggagctgaccgaggagatctacaaccccgtcgtggccaagagcgtccgccaggccatcaagatcatcaacgaggccacgaagaagcacggcatcttcgacaacatcgtgatcgagatggcgcgggagaacaacgaggaggacgccaagaaggactacatcaagcgccagaaggccaaccaggacgagaagaacgccgccatggagaaggcggccttccagtacaacgggaagaaggagctgccggacaacatcttccacggccacaaggagctggccaccaagatccggctctggcaccagcagggcgagaagtgcctgtacaccgggaagaccatccccatctccgacctgatccacaaccagtacaagtacgagatcgaccacatcctccccctgagcctgtccttcgacgacagcctctccaacaaggtgctggtcctggccacggcgaaccaggagaagggccagcgcacccccttccaggccctcgacagcatggacgacgcctggtcctaccgggagttcaagagctacgtgaaggagtccaagctgctggggaacaagaagaaggagtacctcctgaccgaggaggacatcagcaagatcgaggtgaagcagaagttcatcgagcgcaacctgatcgacacccggtactccagccgcgtcgtgctcaacgccctgcaggacttctacaaggcccacaagttcgacacgaccatcagcgtggtccggggccagttcacctcccagctgcgccgcaagtgggggctcgagaagtcccgggagacctaccaccaccacgcggtggacgccctgatcatcgccgccagcagccagctgcgcctctggaagaagcagaacaactccctgatcagctacaaggagggccagttcgtggactccgagaccggcgagatcatcagcctgacggacgacgagtacaaggagctcgtcttcaaggccccgtacgaccacttcgtggacaccctgcggtccaagaagttcgaggacagcatcctgttctcctaccaggtggacagcaagttcaaccgcaagatctccgacgcgaccatctacgccacccggaaggccaagctcgacaaggagaagaaggagtacacgtacaccctggggaagatcaaggacatctacagcctgggcaccaaggccccctccaagaccgggttctacaagttcctcgacctgtacaacaaggacaagagccagttcctgatgttccagaaggaccgcaagacgtgggacgaggtcatcgagaagatcatggagcagtaccggcccttcaaggagtacgacaagaccggcaagctcgtggacttcaaccccttcgagaagtaccgccaggagaacggcccgatccggaagtactccaagaaggggaacggccccgagatcaagagcctgaagtactacgacatcctgctcgggaagcacaagaacatcacccccgagggcagccgcaacaccgtggccctgctgtccctcaacccctggcggacggacgtctactacaacatggagaccaagaagtacgagttcctggggctgaagtacgcggacctcccgttcgaggagggcggcgcctacgggatcagcaccgagacctacaacgagctgcgcgagaaggagggcatcgggaagaactccgagttcaagttcacgctgtacaagaacgacctcatcctgatcaaggacaccgagaccaactgccagcagatcttccggttctggagccgcaccggcaaggacaaccccaagtccttcgagaagcacaagatcgagctgaagccctacgagaaggcccggttcgagaagggggaggagctcaaggtgctgggcaaggtgcccccgagctccaaccagctgcagaagaacatgcagatcgagaacctcagcatctacaaggtcaagacggacgtgctgggcaacaagcacttcatcaagaaggagggggacgagcccaagctgaagttctga

SEQ ID NO: 1673 - RNA, 3405 nt, synthetic construct
  misc_feature 1..3405: note = Cas9 variant
  source 1..3405: mol_type = other RNA
atgaacggcctggtgctcgggctggacatcggcatcgccagcgtcggggtgggcatcctggagaagaactccgggaagatcatccacgagaacagccgcctcttccccgccgcgaccgccgacaacaacgtggagcggcgcaagaaccggcaggcccgccggctgaaccgccggaagaagcaccgcggcgtccggttccaggacctgttcgaggactacggcctcctgaccgacttctccaaggtgagcatcaacctgaacccctaccgcctccgggtggacgggctgaaccagcagctgacgaacgaggagctgttcatcgccctcaagaacatcgtcaagcgccggggcatctcctacctggacgacgccagcgaggacgggggcaccgtgccctccgactacgggaaggcggtgaaggagaaccgcaagctcctggccgagaagacccccggccagatccagctggagcggttcgagaagtacggccagctccgcggggacttcaccgtcgaggagaacggcgagaagtgccggctgatcaacgtgttcagcacgtccgcctacaagaaggaggccgagcgcatcctgcggaagcagcaggagttcaacaaccagatcaccaacgagttcatcgaggactacctcaagatcctgaccgggaagcgcaagtactaccacggccccggcaacgagaagtcccggaccgactacgggcgcttccgcacggacggcaccaccctggacaacatcttcgggatcctcatcggcaagtgcaccttctacccggaggagtaccgggtgagcaaggcgagctacacggcccaggagttcaacatcctgaacgacctgaacaacctcaccgtccccaccgagaccaagaagctgtccgaggagcagaagaaggacatcgtggagtacgccaaggagacgaagaccctgggggccagcaccctcctgaagtacatcgccaagatgatcgacgcgtccgtggaccagatccgcggctaccgggtcgacgtgaacaacaagcccgagatgcacaccttcgaggtgtaccgcaagatgcagagcctggagacgatctccgtcggcgagctcagccggaacgtgctggacgagctggcccacatcctcaccctgaacaccgagcgcgaggggatcgaggaggccatcaacaccaagctgatgggcgtgttctcccaggaccaggtcctcgagctggtgcagttccggaagaacaacagcagcctgttctccaaggggtggcacaacttcagcctcaagctgatgatggagctgatccccgagctctacgagacgtccgaggagcagatgaccatcctgacccgcctgggcaagcagaagtccaaggagaccagcaagcggacgaagtacatcgacgagaaggaggtgaccgaggagatctacaacccggtcgtggccaagagcgtccgccaggccatcaagatcatcaacgaggcgaccaagaagtacgggatcttcgacaacatcgtgatcgagatggcccgggagaacaacgaggaggacgccaagaaggactacatcaagcgccagaaggccaaccaggacgagaagaacgccgcgatggagaaggccgccttccagtacaacggcaagaaggagctccccgactccatcttccacggccacaaggagctggccaccaagatccggctgtggcaccagcagggggagaagtgcctgtacacgggcaagaacatccccatcagcgacctcatccacaaccagtacaagtacgagatcgaccacatcctgcccctgtccctcagcttcgacgactccctgagcaacaaggtgctggtcctcgccaccgcgaaccaggagaaggggcagcgcaccccgttccaggccctggactccatggacgacgcctggagctaccgggagttcaagtcctacgtgaaggacagcaagctgctctccaacaagaagaaggactacctgctgaccgaggaggacatcagcaagatcgaggtgaagcagaagttcatcgagcgcaacctcgtcgacacgcggtactccagccgcgtggtgctgaacgccctgcaggacttctacaaggcgcacaagttcgacaccaccatcagcgtcgtgcggggccagttcacctcccagctccgccgcaagtgggggctggagaagtcccgggagacctaccaccaccacgccgtggacgccctgatcatcgccgccagcagccagctccgcctgtggaagaagcagaacaaccccctgatcacgtacaaggagggccagttcgtcgactccgagaccggcgagatcatcagcctcaccgacgacgagtacaaggagctggtgttcaaggcgccctacgaccacttcgtggacaccctgcggtccaagacgttcgaggacagcatcctcttctcctaccaggtcgacagcaagttcaaccgcaagatctccgacgccaccatctacgccacccggaaggccaagctggacaaggagaagaaggagtacacctacacgctggggaagatcaaggacatctacagcctcggcaccaagaccccctccaagaccgggttctacaagttcctggacctgtacaacaaggacaagagccagttcctcatgttccagaaggaccgcaagacgtgggacgaggtgatcgagaagatcatggagcagtaccggccgttcaaggagtacgacaagaccggcaagctggtggacttcaaccccttcgagaagtaccgccaggagaacggccccatctgcaagtactccaagaaggggaacggccccgagatcaagagcctgaagtactacgacatcctcctggggaagcacaagaacatcaccccggagggctcccggaacaccgtcgccctgctcagcctgaacccctggcgcacggacgtgtactacaacatggagaccaagaagtacgagttcctggggctcaagtacgcggacctgcccttcgagaagggcggcgcctacgggatcagcaccgagacctacaacaagctgcgggagaaggagggcatcgggaagaactccgagttcaagttcacgctctacaagaacgacctgatcctgatcaaggacaccgagaccaactgccagcagatcttccgcttctggagccggaccggcaaggacaaccccaagtccttcgagaagcacaagatcgagctcaagccgtacgagaaggcccgcttcgagaagggggaggagctggaggtgctgggcaaggtcccgcccagctccaaccagttccagaagaacatgcagatcgagaacctcagcatctacaaggtgaagacggacgtgctgggcaagaagcacatcatcaagaaggagggggacgagcccaagctgaagttctga

SEQ ID NO: 1674 - RNA, 3405 nt, synthetic construct
  misc_feature 1..3405: note = Cas9 variant
  source 1..3405: mol_type = other RNA
atgaagtacatcgagagcgtgtccatcggcttcgacatcggggtcggcagcgtggggtacgccgtgatcaactccaagaccaagcagatcctggagagcggcgtctccatcttccccgccgcggtggcccagaagaacgtggagcgccgggagagccgccagtcccggcgcctccggcgccggcgcgtcaaccggctgaacgacctgaagaagctcctgaagaagaacgggttcatcccgagccccaacaagaacccctacgagatccgcgtgcggggcctggagcaccagctctcccgcgacgagatcgccatcgccgtgctgcacatcgccaagcggcgcggcatcagctactccctggacgacgtcgtggacgagaacgtgaccgacttcaaggggaagatcgcgaagaaccaggaggccctcaagaacaagacgcccggcgagatccagtacgagcggctgctgaagtacgggaaggtccgcggcaccgtgaccaactacgtggagtacgacgagcagccggagtacttcctcaacgtcttccccaacagcgcctacgtggacgaggccaagcggatcctgacctgccagaagcagtactaccccgagatcacggacgacctgatcgagaacatcgtgaagatcatctcccgcaagcgggcgtactacatcgggcccggcaacgagaagtcccgcaccgactacggcatctaccggaccaacggggagaccctcgagaacatcttcgagatcctgatcggcaaggacagcgtcaacccggacgagctgcgcgcccccgccaacagcctcacggcccaggtgtacaacctgctgaacgacctcaccaacatccgctacaacgggtccgagcggctgacccccgagcagaagcaggacatcctgagcgagctcctgaccacggagaagaccgtgcagatgctgaacgtcatcgccaagaaggtgaacgtgaagaaggaggagatctccggcttccgcaccaagaaggacgacaagcccgacttccacaccctcgaggtctaccggaaggtgcgcaagcacatgctgaacaagggcatcgacatcaacgagtggccgacggagtgcttcgacgagctggcgttcatcttcaacctcaacaccgagatcggggagatccggaaccgcatcagcgagaaggtcgtgcccaagtacgacttcatcaccaaccagatcgtggacgacctgctggaggaccccaagatcttcgccatcagcacctcccagaagtggcaccggttcagcatcaagacgatgaacgtcctcatccccgagctgctgaacggctacaacgagcagatgaccatcctcacccgcatggggctgctggaggactccaagaacgactacagcaacatcgacaagatcgacatcaagaacgtgaccgagaacatctacaacccggtggtccggaagtccatcaagaagtgcctcaagatcttcaacgagctgtacaagaagtaccccaacatcagcgacgtggtgatcgagctgccccgcgaggacaaccccgaggacgcccggaagctcatcaagaagatgcagaaggagaacctggtcgagaaggacacgtccctggaggccttccgcaaggaggccaacctcagcgagaacggcctgatcgacttcctgcggaaggggaagaaccgcgcgctcaagatccggctgtggtaccagcaggagggcaagtgcctgtacaccggcgagccgatcctggccgaggacctctgcaagaacgaggccaactacgacatcgaccacatcatccccatctccgtgagcttcgacgactccatcaacaacaaggtgctgtgcagctcccacttcaaccgcttcgagaaggagaagaagacccccttcgagtacttcagcaacaagtccagccacctggggcggtactccaacttcgacgagttccgcgccagcgtcaacgccaacaagcggatctccgacgtgaagcgcaagaacctcctgagcaaggagctgctcagcgacctggacacccgcaagaagttcatcgcgcggaacctggtggacacgcgctacgcctcccgggtcgtgttcaacgagctcacccagttcttcgccagcaagaaggccgacaccaaggtggccgtcatccgcggcaagttcacctcccagctgcggcgcgcgtggcagctgaacaagagccgggacacgtaccaccaccacgccgtggacgccgccctcatcggggtgacccccttcctgaagatctggcgctccggcaagaccatctacccgcggaagatgaccgaggcgcagacggacttcgagctgaacgagatcaccaccaacgacgagttcaaggagagctactaccagctcccctgcccccagttcctggactacctgacccagatgcaggagaacctcaagatcaacttcgaggtcgacaagaagatgaaccgcaagatctccgacgccatgatctacagctcccggaagaagaagctgagcaaggacaagaaggagaaggagtactccctggggaccatcaacgacatctacagcgacgccggctactccaagttcaagaacatctacaagaaggacaaggagaagttcctcatgtaccacctggaccacaagagcttcgagatcctggaggacatcatctcccagtaccccgacaaggaggagtacatcgacagcgagggcaaggtgaagcagcgcgccgtgtccccgttcgagatctaccggcgcaagtacgggtacatccggaagtacagcaagaagaacaacggccccatcatcaagaacatgaagtactacaacgagaacctccccaagatctacatcgacatcacgccgaagcagagcatcgacaagaaggtctacctgaccaacatctccccctggcgcaccgacgtgtactacaaccggagccagaactcctaccacatcatggggatcaagtacagcgacctgcgctacatcgacggcaagtacgggatccccaagaacgtgtacgagaagatcaagctccgggagaagatcccctccgagagcgagttctgcttctccctgtacaagaacgaccgcgtcaagatcatcgacccgaacaagaacgaggagatcgagctgcggttcaacagccgcaccctcccctccgtgctgaactacgtggagttcaagcccctgttccaggagagctacaactccctcacgctgctgcccgtcttcagcaagaccacctccgagggccgcatcatcaagaagttcacccgggaggacaacatcgtgtacaaggtgaacacggacgagctcggcaacccgtactacatcctgaaggagagccagaaccccaagaacatcatcgacaactccaacaagaccgagtga

SEQ ID NO: 1675 - RNA, 3405 nt, synthetic construct
  misc_feature 1..3405: note = Cas9 variant
  source 1..3405: mol_type = other RNA
atgaacggcctggtgctcgggctggacatcggcatcgccagcgagggggtcggcatcctggagaagaactccgggaagatcatccacgccaacagccgcctcttccccgcggccaccgccgacaacaacgtggagcggcgcaagaaccggcaggcccgccggctgaaccgccggaagaagcaccgcggcgtgcggttccaggacctgttcgaggactacggcctcctgaccgacttctccaaggtcagcatcaacctgaacccgtaccgcctccgggtggacgggctgaaccagcagctgacgaacgaggagctgttcatcgccctcaagaacatcgtgaagcgccggggcatctcctacctggacgacgcgagcgaggacgggggcgccgtctccagcgactacgggaaggccgtggaggagaaccgcaagctcctggccgagcagacccccggccagatccagctggagcggttcgagaagtacggccaggtgcgcggggacttcaccgtcgtggagaacggcgagaagctccggctgatcaacgtgttctccaccagcgcgtacaagaaggaggccgagcgcatcctgcggaagcagcaggagttcaacaaccagatcacggacgagttcatcgaggactacctcaagatcctgaccgggaagcgcaagtactaccacggccccggcaacgagaagtcccggaccgactacgggcgcttccgcaccgacggcacgaccctggacaacatcttcgggatcctcatcggcaagtgcaccttctaccccgaggagtaccgggccagcaaggcctcctacaccgcccaggagttcaacctgctgaacgacctcaacaacctgacggtcccgaccgagaccaagaagctgagcgaggagcagaagaaggtgatcgtggagtacgcgaaggaggccaagaccctcggggcctccacgctgctgaagtacatcgccaagatgatcgacgccagcgtcgaccagatccgcggctaccgggtggacgtgaacaacaagcccgagatgcacaccttcgaggtctaccgcaagatgcagtccctcgagaccatcagcgtgggcgagctgtcccggaacgtgctggacgagctcgcgcacatcctgaccctgaacacggagcgcgaggggatggaggaggccatcaacaccaagctcaaggacagcttcagccaggaccaggtcctggagctggtgcagttccggaagaacaactccagcctcttctccaagggctggcacaacttcagcctgaagctgatgatggagctcatccccgagctgtacgagacctccgaggagcagatgaccatcctgacgcgcctcgggaagcagaagtccaaggagaccagcaagcggaccaagtacatcgacgagaaggagctgaccgaggagatctacaaccccgtggtcgccaagagcgtgcgccaggccatcaagatcatcaacgaggccacgaagaagcacggcatcttcgacaacatcgtcatcgagatggcgcgggagaacaacgaggaggacgccaagaaggactacatcaagcgccagaaggccaaccaggacgagaagaacgccgccatggagaaggcggccttccagtacaacgggaagaaggagctgccggacaacatcttccacggccacaaggagctggccaccaagatccggctctggcaccagcagggcgagaagtgcctgtacaccgggaagaccatccccatctccgacctgatctacaaccagtacaagtacgagatcgaccacatcctccccctgagcctgtccttcgacgacagcctctccaacaaggtgctggccctggcgacggccaaccaggagaagggccagcgcacccccttccaggccctcgacagcatggacgacgcctggtcctaccgggagttcaagagctacgtgaaggacctgaagtccctgagcaacaagaagaaggactacctcctgaccgaggaggacatctccaagatcgaggtcaagcagaagttcatcgagcgcaacctggtggacacccggtacagcagccgcgtggtcctcaacgccctgcaggacttctacaagtcccaccagttcgacacgaccatcagcgtggtgcgggggcagttcacctcccagctgcgccgcaagtggggcctcgagaagtcccgggagacctaccaccaccacgcggtcgacgccctgatcatcgccgccagcagccagctgcgcctctggaagaagcagaacaacccgctgatcacctacaaggaggggcagttcgtggactcccagacgggcgagatcatcagcctgaccgacgacgagtacaaggagctcgtgttcaaggccccctacgaccacttcgtcgacaccctgtccagcaagaccttcgaggactccatcctgttcagctaccaggtggactccaagttcaaccggaagatcagcgacgcgacgatctacgccacccgcaaggccaagctcgacaaggagaagaaggagtacacctacaccctgggcaagatcaaggacatctactccctggggacgaagacccccagcaagaccggcttctacaagttcctcgacctgtacaacaaggacaagtcccagttcctgatgttccagaaggaccggaagacctgggacgaggtgatcgagaagatcatggagcagtaccgccccttcaaggagtacgacaagacggggaagctcgtcgacttcaacccgttcgagaagtaccggcaggagaacgagcccatccgcaagtacagcaagaagggcaacggccccgagatcaagagcctgaagtactacgacatcctgctcgggaagcacaagaacatcacccccgagggctcccggaacaccgtggccctgctgagcctcaacccgtggcgcaccgacgtgtactacaacatggagacgaagaagtacgagttcctggggctgaagtacgccgacctccccttcgaggagggcggggcgtacggcatctccaccgagacctacaacgagctgcgggagaaggagggcatcgggaagaacagcgagttcaagttcaccctgtacaagaacgacctcatcctgatcaaggacacggagaccaactgccagcagatcttccgcttctggtcccggaccggcaaggacaaccccaagagcttcgagaagcacaagatcgagctgaagccctacgagaaggcccgcttcgagaagggggaggagctcgaggtcctgggcaaggtgccgccctccagcaaccagctgcagaagaacatgcagatcgagaacctctccatctacaaggtgaagaccgacgtcctggggaacaagcacttcatcaagaaggagggcgacaagcccaagctgaagttctga

SEQ ID NO: 1676 - RNA, 3408 nt, synthetic construct
  misc_feature 1..3408: note = Cas9 variant
  source 1..3408: mol_type = other RNA
atgagcgacctggtgctcggcctggacatcgggatcggctccgtcggggtgggcatcctgaacaaggtgaccggggagatcatccacaagaacagccgcatcttccccgcggcccaggcggagaacaacctcgagcggcgcaccaaccggcagggccgccggctgacgcgccggaagaagcaccgccgggtccgcctgaaccacctcttcgaggagtccggcctgatcaccgacttcaccaaggtgagcatcaacctgaacccgtaccagctccgggtgaaggggctgaccgccgagctgtccaacgaggagctgttcatcgccctcaagaacatggtcaagcaccgcggcatcagctacctggacgacgcctccgacgacgggaacagctccgtgggcgactacgcccagatcgtgaaggagaacagcaagcagctcgagacgaagacccccgggcagatccagctggagcggtaccagaagtacggccagctgcgcggcgacttcaccgtcgaggaggacgggcggaagcaccgcctcatcaacgtgttccccacctccgcgtaccacgccgaggccctgcggatcctgcagacgcagcaggagttcaacccccagatcaccgacgagttcatcaacagctacctcgagatcctgaccggcaagcgcaagtactaccacgggccgggcaacgagaagtcccggaccgactacggcaagtacacgaccaagaaggacgcccaggggcagtacatcaccctgaacaacatcttcggcatcctcatcgggaagtgcaccttctaccccgaggagtaccgcgcggccaaggccagctacacggcccaggagttcaacctgctgaacgacctcaacaacctgaccgtgcccaccgagaccaagaagctgtccgaggagcagaagtaccagatcatcacgtacgtcaagaacgagaaggccatgggccccgcgaagctgttcaagtacatcgccaagctcctggcctgcgacatcgccgacatcaaggggtaccggatcgacaagagcgacaaggccgagatccacaccttcgaggcgtaccgcaagatgaagaccctcgagaccatcgacatcgagcagatcgagcgcgagaagctggacaagctggcctacgtgctcacgctgaacaccgagcgggagggcatccaggaggccctggaccacgagttcgccgacggcaccttctcccaggagcaggtcgacgagctcgtgcagttccgcaaggccaacagctccatcttcgggaagggctggcacagcttcagcgtgaagctgatgatggagctgatcccggagctctacgcgacctccgaggagcagatgacgatcctgacccggctggggaagcagaagaccaccagctccagcaacaagacgaagtacatcgacgagaagcagctcaccgaggagatctacaaccccgtggtcgccaagtccgtgcgccaggccatcaagatcgtgaacgccgccatcaagaagtacggcgacttcgacaacatcgtcatcgagatggcgcgggagaccaacgaggacgacgagaagaaggccatccagaagatccagaaggccaacaaggccgagaaggacgcggccatgcgcaaggccgccaaccagtacaacgggaaggccgagctgccccacagcgtgttccacggccacaagcagctggcgaccaagatccggctctggcaccagcagggcgagcgctgcctgtacacggggaagaccatctccatccacgacctgatcaacaaccccaaccagttcgagatcgaccacatcctgccgctcagcatcaccttcgacgactccctggccaacaaggtgctggtctacgccaccgccaaccaggagaagggccagcggaccccctaccaggccctcgacagcatggacgacgcgtggtccttccgcgagctgaaggccttcgtgcgggagagcaaggccctgtccaacaagaagaaggagtacctcctgacggaggaggacatcagcaagttcgacgtccgcaagaagttcatcgagcggaacctggtggacacccgctacgcctcccgggtggtcctcaacgccctgcaggagcacttcaaggcgcacaagatcgacaccaaggtgagcgtggtccgcgggcagttcacctcccagctgcggcgccactggggcatcgacaagacgcgggacacctaccaccaccacgccgtggacgccctcatcatcgccgcgagctcccagctgaacctgtggaagaagcagaagaacaccctcgtgagctacagcgaggaccagctgctggacatcgagaccggggagctcatctccgacgacgagtacaaggagagcgtcttcaaggccccctaccagcacttcgtggacacgctgaagtccaaggagttcgaggacagcatcctgttctcctaccaggtggacagcaagttcaaccgcaagatctccgacgccaccatctacgccacccgccaggccaaggtcggcaaggacaagaaggacgagacctacgtgctcggcaagatcaaggacatctacgcgctggggacgaagacccccagcaagaccggcttctacaagttcctggacctctacaacaaggacaagtcccagttcctggtgtaccagaaggaccggaagacctgggacgaggtcatcgagaagatcatggagcagtaccgcccgttcaaggagagcgacaagaacgggaaggaggtggacttcaaccccttcgagaagtaccggatcgagaacggccccatccgcaagtactcccggaagggcaacgggcccgagatcaagagcctgaagtactacgcctccaagctcggcaaccacatcgacatcacgccgaaggacagcaacaacaaggtggtcctgcagtccgtgagcccctggcgcgccgacgtgtacttcaacaagaccaccgggtcctacgagatcctgggcctcaagtacgccgacctgcagttcgagaaggggaccggcacgtaccggatcagcgaggagaagtacaacgacatcaagaagaaggagggcgtcgacagcgactccgagttcaagttcaccctgtacaagaacgacctcctgctgatcaaggacaccgagaccaaggagcagcgcctcttccggttcctgagccgctccatgcccaacaagaagcactacgtggagctgaagccctacagcaaggacaagttcgagaagaacgagtccctcatcgagatcctggggagcgccgacaagtccggccggtgcatcaaggggctggccaagagcaacctctccatcttcaaggtgcgcacggacgtcctgggcaaccagcacatcatcaagaacgagggggacaagccgaagctggacttctga

SEQ ID NO: 1677 - RNA, 3408 nt, synthetic construct
  misc_feature 1..3408: note = Cas9 variant
  source 1..3408: mol_type = other RNA
atgggcgtgatcttcctgtacgagaacatcgtcaagcccttcccgagccgctacgacaaggccatcatgaagcggctcaaggggcgccagaccatgggctacatcctgtccctggacatcgggatcgccagctgcggctactccgtgctcgagaccgacgcgctgggggtgccctacaagatcaagacgctgaacagcatcatcttcacccgggccgagaaccccaagaccggcgcctccctcgccgagccccgccggaagtaccgcggcgcccggcgccggaagcgccggaccagcttccgcaagcaccggacgcgccagctgttcatcacctccgggctgctcagcaagcaggacatcgcgcggtacctgaaccagcaggagccgcacgacgacatctgggagctgcgcgtcaagggcctcgacgagcccctgaccaacctgcagctgttccaggtgctctactacttcgtgacccaccgggggttcaagtccaaccgcaaggccgagctgaaggacaaggacatcggccccgtcctcaacagcatcaacgccttcaaggaggagatgcagtcccacgactaccggacgatcggggagctgtacgccaacgacccccgcttccgggaccgcaagcacaacaaggactacaccaacggcttcctgggcaccatccagcgcagctggctcgtggacgagatcaagatgctgctgaccaaccagcagtccttcgggaacacgcagctcaccagcgagttcatcgagctgtacctgaacatcttcacctcccagcggaacttcgacgacggcccggcgagcgggccctactccggcgacctcatcgacaagatggtgggccccgacaccttcaaccgcagccggaagcgcgcgccccgggccacgtacaccttccagtacttctccttcctgagcaagctgaacagcctccgcatcgccccgtccatcagcgcccccttcgagaccctgaccgtcgaccagcgggccctgatcacgaagcgcctctgggggcccgacgtgaagtccgccgacctgaagttcaagcagatccggatggtgctgagcctccccgagaccgcccgcttcaacctggtcaactacggcaacaccccggagaaggccctggagatcgaggacaagaccacgttcatctccatcaagcccctccgggagatcgagaaggccctgaccgggaccaccctgcccgtgagccacgaccagctcgacgcgatcgcccgcatcctgacggtgtacaagtccgacagcaaccggaagaccgccttccacaaccagaccgtcctgtccgacgaggtgatcgagcagctcctgcccctgaacttcagcaagttcggccacctctccgtggagaccatgcaggagatcatcccgtacctggagcaggggatggtctacagcgacgccgccacggcggccggctacgacttccgcaacaaccagatcgacatggagtacatccgggacaacgtgaccaaccccgtggtccgccgggccgtgtccgtggccaacaagctggtcaaggccgtggtccgccggtacggcaagcccgacagcatccacatcgagctggcgcgcgacctctcccagaacttccaggagcgccggcaggacgaggtgcgccagcagaagaacgcccgggacaacgagaagatcgccaagcgcctggaggagctggggatccccgtgaacggcgtcaacatcaccaagatgaagctctacgacgagcagcacgggatcgacctgtacgacctgagcaccaacgcctccatggcggtgacggacatcttcagcgacgaccggtacgagatcgaccacatcatcccgtactccgtgagcttcgacgacagctacaccaacaaggtcctcgtgtccgccaaggccaaccgcgagaagcgggaccgcatccccatggaggtgttcggcaacgacagcgagcggcgccggcagttcgagaaccgcgtcaacaccaacatcaccaacctgcggaagaagcgcaacctgctcaaggagaccttctccgacgaggacaaggccaagtggaagtcccggaacatcaacgacacgcgctacctgaaccggatcctgatgaactacctcagccagaacgtggagttcaccgacgtgctgagcgacgccaagcacgtcatcgcgctgaacggggccgtgaccgccaagatccgctcccggtggggcatcaccaaggtgcgcgccgccggcgacctccaccacgcggtcgacgccgtggtgatcgggtgcgtcacggacgccctgatccaggccgtgacccggtacgccaagtaccaggagcgccgcgacaacaaggcggccgccgagcaggacctggccgagaacaaccccgaggagctcgacgcgaagcagttccggaaggtgttcaacgactaccccctgccgtggcccgagttccgcgaggagctgatgggccgggtcagctccgaccccagccagatcatggccgggcgccagtggtcccactacaccgccgaggagatcagcgagctcaagcagccgttcgtggtgcgggtccccaaccaccgcatcgtgggccccgccaccctggacacggtgtacgggcagcccaacccggacgacggcctgatcacccagcgggtccgcatcaccgacctcaagccccagaagaacaaggacggcgaggacatcatcaaggccggggcgaacgtgtacgagctggccgccgacggcgggaacaagctggtgtacgagtccatcctcgacgccctgcaggtcgccggcggcgacgggaagaaggcgttccccaccggccggctgctcgtgcgcagccccatccaggacatcccggtggagcgggtccgcgtgacgtccaaggccaccctggtggtccccgtggggcccaagagcgtggccgccaacggctccatggtccggatcgacgtgtacaagacccccaagaagtacgtgttcgtcccgatctacgtgcgcgacaccgtgaaggccgagctgcccgaccgggcggtcgcccccgtgaagccctacagccagtggtaccagctccagccgaaggaccagttcctgttcagcctgttcgccaacgacctcatccgcttcaagcacccccgcggggtgtccacgaaggagatcctgaccgacggcagccaggagaagggcaagcggaccgacgtcgtggggtacttcaccggcgccgacatcgcgacggcctccatcgccatcgaggggcccgaccggagcttctccgcccgcggcatcgggttcgccagcctgaagaacgtggagaagctcaccgtcaactacttcggcgagctgcactccgtgcacgagacccagcccatgcagttccgcggccagcgggggtga

SEQ ID NO: 1678 - RNA, 3411 nt, synthetic construct
  misc_feature 1..3411: note = Cas9 variant
  source 1..3411: mol_type = other RNA
atgaacggcctggtgctcgggctggacatcggcatcgccagcgtcggggtgggcatcctggagaaggacaccgggaagatcatccacgcctccagccgcctcttccccgcggccaccgccgacaacaacgtggagcggcgctccaaccggcagggccgccggctgaaccgccggaagaagcaccgcagcgtccggctgcaggacctcttcgagtcctacggcctgctgacggacttcagcaagctctccatcaacctgaacccgtaccagctgcgcgtgcaggggatggagaaccagctcaccaacgaggagctgttcatcgccctgaagaacatcgtgaagcggcgcggcatcagctacctcgacgacgcctccgaggacgggggcaccgtcagctccgactacgggaaggcggtggaggagaaccggcgcctgctgaccgagaagacgcccggccagatccagctcgagcggttcgagaagtacggccagctgcgcggggacttcaccgtggaggagaacggcgagaagcggcgcctgatcaacgtcttcagcacctccgcctaccggaaggaggccgagcgcatcctccggaagcagcaggagttcaacaacaagatcaccgacgagttcatcgaggactacctgacgatcctgaccgggaagcgcaagtactaccacggccccggcaacgagaagtcccgcaccgactacgggcggttccgcaccgacggcacgaccctcgacaacatcttcgggatcctgatcggcaagtgcaccttctaccccgaggagtaccgggccagcaaggcgagctacaccgcccaggagttcaacctgctcaacgacctgaacaacctgacggtgccgaccgagaccaagaagctctccgaggagcagaagaagaccatcatcgagtacgccaagagcgccaagacgctgggggcctccaccctgctcaagtacatcgcgaagatgatcgacgccagcgtggaccagatccgcggctaccgggtcgacgtgaacaacaagcccgagatgcacaccttcgaggtgtaccgcaagatgcagagcctggagaccatcaaggtcgaggagctgccccggaaggtgctcgacgagctggcccacatcctgacgctcaacaccgagcgcgagggcatcgaggaggccatcaactccaagctgaaggacaccttcaaccgggaccaggtgctggagctcgtccagttccgcaagaacaacagctccctgttcagcaaggggtggcacaacttctccctgaagctcatgatggagctgatccccgagctgtacgagaccagcgaggagcagatgacgatcctcacccggctgggcaagcagcgctccaaggagaccagcaagcggaccaagtacatcgacgagaaggagctgacggaggagatctacaacccggtggtggccaagtccgtccgccaggcgatcaagatcatcaacgaggccaccaagaagtacgggatcttcgacaacatcgtgatcgagatggcccgggagaacaacgaggaggacgccaagaagaactacatcaagcagcagaaggccaaccaggacgagaagaacgcggccatggagaaggccgccttccagtacaacggcaagaaggagctgcccgacaacatcttccacgggcacatggagctcgccaccaagatccgcctgtggcaccagcagggcgagaagtgcctgtacaccggcaagaacatccagatcagcgacctcatccacaaccagtacaagtacgagatcgaccacatcctgcccctgtccctcagcttcgacgactccctgagcaacaaggtgctggtcctcgcgacggccaaccaggagaaggggcagcggacccccttccaggccctggactccatggacgacgcctggagctaccgcgagttcaagtcctacgtgaaggagagcaagctgctcggcaacaagaagaaggactacctgctgaccgaggaggacatctccaagatcgaggtcaagcagaagttcatcgagaagaacctcgtggacacccggtacagcagccgcgtggtcctgaacgcgctgcaggacttctacaagaagcaccagttcgacaccacgatctccgtggtgcgcgggcagttcaccagccagctccggcgcaagtggaagctggagaagtcccgggacacctaccaccaccacgccgtcgacgccctgatcatcgccgccagctcccagctccgcctgtggaagaagcacaacaacccgctgatcagctacaaggacggccagttcgtggactccgagaccggggagatcgtgagcctctccaacgaggagtacaaggagctggtcttcaaggcgccctacgaccacttcgtggacacgctgcggagcaagaagttcgaggactccatcctcttcagctaccaggtggactccaagtacaaccgcaagatcagcgacgccaccatctacgccacccggaaggccaagctggacaaggacaagaaggagtacacctacacgctgggcaagatcaaggacatctacgccctcggcaccaagaccccctccaagaccgggttctacaagttcctggacctgtacaagacggacaagagccagttcctcatgtaccagaaggaccgcaagacctgggacgaggtcatcgagaagatcatcgagcagtaccggcccttcaaggagtacgacaagaacggcaaggaggtggacttcaacccgttcgagaagtaccgcatcgagaacgggcccatccggaagtactcccgcaagggcaacggcagcgtgatcaagagcatgaagtactacgacaacctgctggggaagttcgtcgacatcaccccctccgagagcaagaaccccgtggcgctcctgtccctgaacccgtggcggaccgacgtgtactacaaccccgagacgcgcaagtacgagttcctcggcctgaagtacgccgacctgtgcttcgggaagggcgggagctacggcatctccgaggtcaagtacaacaagatccgggagaaggagggcatcgggaaggagagcgagttcaagttcaccctctacaagaacgacctgatcctgatcaaggacaccgagaccaactgccagcagttcttccgcttctggtcccggacgggcaaggacaaccccaagagcttcgagaagcacaagatcgagctcaagccctacgagaaggccaagttcgagaagggggaggagctggaggtgctgggcaaggtgccgccctccagcaaccagttccagaagaacatgcagatcgagaacctctccatctacaaggtcaagaccgacgtgctggggaacaagcacttcatcaagaaggagggcgacgagcccaagctgaagttcaagaagtga

SEQ ID NO: 1679 - RNA, 3411 nt, synthetic construct
  misc_feature 1..3411: note = Cas9 variant
  source 1..3411: mol_type = other RNA
atgaacggcctggtgctcgggctggacatcggcatcgccagcgtcggggtgggcatcctgaagaaggacaccggggagatcatccacaccaactcccgcctcttcagcgccgcgacggccgactccaacatcgagcggcgccggcaccgcggcggcaagcggctgacccgccggaagaagcaccgcagcatccggctgcacgacctcttcgaggactccgggctgctgaccgacttcagcaaggtgtccatcaacctcaacccctaccagctgcgcgtccagggcctggacaaccagctcaccaacgaggagctgttcatcgccctgaagaacatcgtgaagcggcgcgggatcagctacctcgacgacgcctccgaggacggcgggacggtgagctccgactacggcaaggccgtcgaggagaaccggaagctgctggcggagcagaccccgggccagatccagctcgaccgcttcgagaagtacgggcaggtccggggcgacttcaccgtggtggagaacggggagaagcgccggctgatcaacgtgttcaccacgagcgcctactccaaggaggccgagcgcatcctgcggaagcagcaggagttcaacaagaagatcaccgacgagttcatcgagaactacctcaccatcctgaccggcaagcgcaagtactaccacggccccgggaacgagaagtcccggacggactacggccgctacaccaccaagaaggaccccgaggggaagtacatcaccctggacaacatcttcggcatcctcatcgggaagtgcacgttctaccccgacgagtaccgcgccagcaaggcgagctacaccgcccaggagttcaacctgctgaacgacctcaacaacctgaccgtgccgaccgagacgaagaagctgtccgaggagcagaagaagaccatcatcaagtacgccaagaccgccaagaccctcggcgccagcacgctgctgaagtacatcgcgaagctcatcggcgcctccgtcgaccagatccacgggtaccggatcgaccccaacaagaagcccgagatgcacaccttcgagacctaccgcaagatgcagagcctggagaccatcagcgtggaggagatcccccggaaggtgctggacgagctcgcccacatcctgacgctgaacaccgagcgcgagggcatcgaggaggccatcaacgccaccctcaaggacaccttctcccaggaccaggtcctggagctggtgcagttccggaagaacaacagctccctcttcagcaaggggtggcacaacttctccctgaagctgatgatggagctcatcccggagctgtacgagacgagcgaggagcagatgaccatcctgacccgcctcggcaagcagaagtccaaggagaccagcaagcggacgaagtacatcgacgagaaggagctgaccgaggagatctacaaccccgtggtcgcgaagtccgtgcgccaggccatcaagatcatcaacgaggccaccaagaagtacgggatcttcgacaacatcgtgatcgagatggcccgggagaacaacgaggaggacgccaagaagggctacaacgagcgccagaaggcgaacctggacgagaagaagtccgccatggagaaggccgccttccagtacaacggcaagaaggagctgcccgacaacgtcttccacgggcacaaggagctcgccaccaagatccggctgtggcaccagcagggcgagaagtgcctgtacaccgggaagaacatccccatcagcgacctcatccagaaccagtacaagtacgagatcgaccacatcctgccgctgagcctctccttcgacgacagcctgtccaacaaggtgctggtgctcgcgacggccaaccaggagaagggccagcgcacccccttccaggccctggacagcatggacgacgcctggtcctaccgggagttcaagagctacgtcaaggacctgaagctcctgtccaacaagaagaaggactacctgctcaccgaggaggacatcagcaagatcgaggtgaagcagaagttcatcgagcgcaacctggtcgacacccggtacagctcccgcgtggtgctgaacgcgctccaggacttctacaaggagcaccagttcgacacgaccatcagcgtcgtgcgggggcagttcacctcccagctgcgccggaagtggggcctggagaagtcccgcgagacctaccaccaccacgccgtggacgccctcatcatcgccgccagcagccagctgcgcctgtggaagaagcagaacaaccccctcatctcctacaaggagggccagttcgtcgaccaggagacgggggagatcatcagcctgtccgacgacgagtacaaggagctggtgttcaaggcgccctacgaccacttcgtggacaccctcaagagcaagaagttcgaggactccatcctgttcagctaccaggtcgactccaagtacaaccggaagatcagcgacgccaccatctacgccacccgcaaggccaagctggacaaggagaagaaggagtacacgtacaccctcggcaagatcaaggacatctacgccctggggtccgagaagctgaagaccggcttctacaagttcctccacctgtacaagaaggacaagagccagttcctgatgtaccagaaggaccggaagacctgggacgaggtgatcgagaagatcctcgagcagtaccgcccgttcaaggagaaggacaagaacggcaaggaggtggacttcaaccccttcgagaagtaccggatcgagaacgggcccatccacaagtactcccgcaagggcaacgggcccgtcatcaagagcctgaagtactacgacaagaacatcccggagagcttcatcaacatcacgccctccaacagcaagaacaaggtgatcctgcggcagctcaacccctggcgcaccgacgtgtacttcaaccaccagaccgagaagtacgagctgctgggcctcaagtacgcgcacctccagttcgagaagaagaccgggaactactccatcacgatcgacaagtacaacgagatcaaggagaaggagggcgtcagcgagcagtccgagttcaagttcaccctgcacaagaacgacctcctgctgatcaaggacaccgagaccaaggagcagcagctgttccggttcctgagccgcacgaagcccaacgtgaagcactacgtggagctgaagccgtactcccgggacgagttcgagaagaacgagcgcctcatcgagatcctgggcagcgtcgacaagtccgggcggttcgtgaagggcctgggcaagagcaacctctccatctacaaggtgcgcaccgacgtcctggggaaccagcacatcatcaagaaggagggggaggagcccaagctgaagttctga

SEQ ID NO: 1680 - RNA, 3411 nt, synthetic construct
  misc_feature 1..3411: note = Cas9 variant
  source 1..3411: mol_type = other RNA
atgaacggcctggtgctcgggctggacatcggcatcgccagcgtcggggtgggcatcctggagaaggacaccgggaagatcatccacgcctccagccgcctcttccccgcggccaccgccgacaacaacgtggagcggcgctccaaccggcagggccgccggctgaaccgccggaagaagcaccgcagcgtccggctgcaggacctcttcgagggctacgggctgctgacggacttctccaaggtgagcatgaacctcaacccgtaccagctgcgcgtgcagggcatggagaaccagctgaccaacgaggagctgttcgtcgccctcaagaacatcgtgaagcggcgcgggatctcctacctggacgacgccagcgaggacggcgggaccgtgtccagcgactacggcaaggcggtcgaggagaaccggaagctcctggccgagaagacccccggccagatccagctggagcgcttcgagaagtacgggcagctccggggcgacttcacggtggaggagaacggggagaagcaccgcctgatcaacgtgttctccaccagcgcctaccggaaggaggccgagcgcatcctgcggaagcagcaggagttcaactccaagatcaccgacgagttcatcgaggactacctcatcatcctgaccggcaagcgcaagtactaccacggccccgggaacgagaagtcccggacggactacggccgcttccgcaccgacgggaccaccctggacaacatcttcggcatcctcatcgggaagtgcacgttctacaccgaggagtaccgggcgagcaaggccagctacaccgcccaggagttcaacctgctgaacgacctcaacaacctgaccgtccccacggagaccaagaagctgtccgaggagcagaagaagctcatcatcgagtacgccaagagcgccaagaccctgggcgcgtccaccctgctcaagtacatcgccaagatgatcgacgccagcgtggaccagatccgcggctaccgggtggacgtcaacaacaagccggagatgcacacgttcgaggtgtaccgcaagatgcagagcctggagaccatcaaggtggaggagctgccccggaaggtcctcgacgagctggcccacatcctgaccctcaacaccgagcgcgaggggatcgaggaggccatcaactccaagctgaaggacatcttcaaccgggaccaggtgctggagctcgtgcagttccgcaagaacaacagctccctgttcagcaagggctggcacaacttctccatcaagctgatgatggagctcatccccgagctgtacgagacgagcgaggagcagatgaccatcctgacccggctcgggaagcagcgctccaaggagaccagcaagcggacgaagtacatcgacgagaaggagctgaccgaggagatctacaaccccgtcgtggcgaagtccgtgcgccaggccatcaagatcatcaacgaggccaccaagaagtacggcatcttcgacaacatcgtcatcgagatggcccgggagaacaacgaggaggacgccaagaaggactacatcaagcgccagaaggcgaaccaggacgagaagaacgccgccatggagaaggccgccttccagtacaacgggaagaaggagctgccggacaacatcttccacggccacaaggagctgaccacgaagatccggctctggcaccagcagggcgagaagtgcctgtacaccgggaagaacatccccatcagcgacctgatccacaaccagtacaagtacgagatcgaccacatcctccccctgtccctgagcttcgacgactccctcagcaacaaggtgctggtcctggcgaccgccaaccaggagaagggccagcgcacccccttccaggccctcgactccatggacgacgcctggagctaccgggagttcaagtcctacgtgaaggacagcaagctgctgtccaacaagaagaaggactacctcctgacggaggaggacatcagcaagatcgaggtgaagcagaagttcatcgagcgcaacctggtcgacacccggtacagctcccgcgtggtgctcaacgcgctgcaggacttctacaagagccaccagctggacaccaccatctccgtcgtgcgcgggcagttcaccagccagctccggcgcaagtggggcatcgagaagtcccgggagacgtaccaccaccacgccgtggacgccctgatcatcgccgccagctcccagctgcgcctctggaagaagcacagcaacccgctgatcgcgtacaaggaggggcagttcgtcgactccgagaccggcgagatcgtgagcctgtccgacgaggagtacaaggagctcgtgttcaaggccccctacgaccacttcgtcgacaccctgcggagcaagaagttcgaggactccatcctgttcagctaccaggtggactccaagtacaaccgcaagatcagcgacgccaccatctacgccacgcggaaggccaagctcgacaaggagaagaaggagtacacctacaccctgggcaagatcaaggacatctacgcgctggggaccaagacgccctccaagaccggcttctacaagttcctcgacctgtacaagaccgacaagagccagttcctgatgtaccagaaggaccgcaagacctgggacgaggtgatcgagaagatcatcgagcagtaccggcccttcaaggagtacgacaagaacgggaaggaggtcgacttcaacccgttcgagaagtaccgcatcggcaacggccccatccggaagtacagcaagaaggggaacggccccgagatcaagtccctcaagtactacgacatcctgctggggaagcacaagaacatcacgcccgacggcagccgcaacaccgtggccctcctgtccctgaacccgtggcggaccgacgtgtactacaacagcgagaccaagaagtacgagttcctcgggctgaagtacgccgacctgtgcttcgaggagggcggcgcctacgggatctccgaggtcaagtacaagaagatccgcgagaaggagggcatcgggaagaacagcgagttcaagttcacgctctacaagaacgacctgatcctgatcaaggacaccgagaccaactgccagcagttcttccggttctggtcccgcaccggcaaggacaaccccaagagcttcgagaagcacaagatcgagctcaagccctacgagaaggccaagttcgagaagggggaggagctgaaggtgctgggcaaggtgcccccgtccagcaaccagttccagaagaacatgcagatcgagaacctctccatctacaaggtcaagacggacatcctgggcaacaagcacttcatcaagaaggagggggacgagcccaagctgaagttcaagaagtga

SEQ ID NO: 1681 - RNA, 3420 nt, synthetic construct
  misc_feature 1..3420: note = Cas9 variant
  source 1..3420: mol_type = other RNA
atgagcgacctggtgctcggcctggacatcgggatcggctccgtcggggtgggcatcctgaacaaggtgaccggggagatcatccacaagaacagccgcatcttccccgccgcccaggcggagaacaacctcgagcggcgcaccaaccggcagggccgccggctgacgcgccggaagaagcaccgccgggtccgcctgaaccacctcttcgaggagtccggcctgatcaccgacttcaccaaggtgagcatcaacctgaacccctaccagctccgggtgaaggggctgaccgccgagctgtccaacgaggagctgttcatcgccctgaagaacatggtcaagcaccgcggcatcagctacctggacgacgcctccgacgacgggaacagctccgtgggcgactacgcccagatcgtgaaggagaacagcaagcagctcgagacgaagacccccgggcagatccagctggagcggtaccagaagtacggccagctgcgcggcgacttcaccgtcgaggaggacgggcggaagcaccgcctcatcaacgtgttccccacctccgcgtaccacgccgaggccctgcggatcctgcagacgcagcaggagttcaacccccagatcaccgacgagttcatcaacagctacctcgagatcctgaccggcaagcgcaagtactaccacgggccgggcaacgagaagtcccggaccgactacggcaagtacacgaccaagaaggacgcccaggggcagtacatcaccctgaacaacatcttcggcatcctcatcgggaagtgcaccttctaccccgaggagtaccgcgcggccaaggccagctacacggcccaggagttcaacctgctgaacgacctcaacaacctgaccgtgcccaccgagaccaagaagctgtccgaggagcagaagtaccagatcatcacgtacgtcaagaacgagaaggccatgggccccgcgaagctgttcaagtacatcgccaagctcctgagctgcgacgtggccgacatcaaggggtaccggatcgacaagtccgacaaggccgagatccacaccttcgaggcctaccgcaagatgaagaccctcgagaccctggacgtgaagaagatggcgcgcgaggagctggacaagctcgcctacgtcctgacgctgaacaccgagcgggagggcatccaggaggccctcgaccacgagttcgccgacggcaccttcagccaggagcaggtcgacgagctggtgcagttccgcaaggccaactccagcatcttcgggaagggctggcacagcttctccgtgaagctgatgatggagctcatcccggagctgtacgcgaccagcgaggagcagatgacgatcctgacccggctcgggaagcagaagaccacctccagctccaacaagacgaagtacatcgacgagaagcagctgaccgaggagatctacaaccccgtggtggccaagagcgtccgccaggccatcaagatcgtgaacgccgccatcaagaagtacggcgacttcgacaacatcgtgatcgagatggcgcgggagaccaacgaggacgacgagaagaaggccatccagaagatccagaaggccaacaaggccgagaaggacgcggccatgcgcaaggccgccaaccagtacaacgggaaggccgagctgccccactccgtcttccacggccacaagcagctcgcgaccaagatccggctgtggcaccagcagggcgagcgctgcctgtacacggggaagaccatcagcatccacgacctgatcaacaaccccaaccagttcgagatcgaccacatcctcccgctgtccatcaccttcgacgacagcctggccaacaaggtgctcgtctacgccaccgccaaccaggagaagggccagcggaccccctaccaggccctggactccatggacgacgcgtggagcttccgcgagctgaaggccttcgtgcgggagtccaaggccctcagcaacaagaagaaggagtacctgctgacggaggaggacatctccaagttcgacgtgcgcaagaagttcatcgagcggaacctcgtcgacacccgctacgccagccgggtggtgctgaacgccctgcaggagcacttccgcacccacaagatcgacaccaaggtctccgtggtgcgggggcagttcacgagccagctccgccggcactggggcatcgagaagacccgcgacacctaccaccaccacgcggtcgacgccctgatcatcgccgcctccagccagctgaacctctggaagaagcagaagaacaccctggtgagctactccgaggaccagctgctcgacatcgagacgggggagctgatcagcgacgacgagtacaaggagtccgtgttcaaggcgccctaccagcacttcgtcgacaccctcaagagcaaggagttcgaggactccatcctcttcagctaccaggtggactccaagttcaaccgcaagatcagcgacgccaccatctacgccacccggaaggccaagctggacaaggagaagaaggagtacacgtacaccctgggcaagatcaaggacatctacgccctcggcaccaagaccccctccaagacggggttctacaagttcctggacctgtacaagaaggacaagagccagttcctcatgtaccagaaggaccgccggacctgggacgaggtgatcgagaagatcctggagcagtaccgcccgttcaaggagaaggacaagaacggcaaggaggtcgacttcaaccccttcgagaagtaccggatcgagaacgggcccatccgcaagtactcccggaagggcaacggccccgagatcaagagcctgaagtactacgacaacctcctggggcgcttcgtggacatcaccccgtccgagagcaagaaccccgtggcgctgctctccctgaacccctggcggaccgacgtctactacaacacggagacccgcaagtacgagttcctgggcctcaagtacgccgacctgtgcttcgagaagggcgggagctacgggatctccaaggtgaagtacaacaagatccgggagaaggagggcatcggcaagaacagcgagttcaagttcaccctgtacaagaacgacctcatcctgatcaaggacaccgagacgaaccgccagcagatcttccggttctggagccgcaccgggaaggacaaccccaagtccttcgagaagcacaagctggagctcaagccgtacgagaagacccggttcgagaagggcgaggagctgaaggtgctggggaaggtcccgcccagctccaaccgcctccagaagaacatgcagatcgagaacctgagcatctacaaggtgcggaccgacgtgctgggcaaccagcacatcatcaagaacgagggggacaagcccaagctcgacttctga

SEQ ID NO: 1682 - RNA, 3420 nt, synthetic construct
  misc_feature 1..3420: note = Cas9 variant
  source 1..3420: mol_type = other RNA
atgaactactacaacggcttcatcatcaccgagaacgccatggccagcaagcacgagaacctgggggcgctcaccttcggcctggacatcgggatcgcctccgtgggctgggccgtcctgggggagaaccgcatcatcgacctcggcgtgcggtgcttcgacaaggccgagacggccaaggagggcgagagcctgaacctggcgcgccggaccgcccgcctcctgcggcgccggctgcgccggcgcgcctggcggctcaccaagctggcccgcctgctcaagcgggaggggctgatcgcggacaccaacgtgttccagaagcccttcaacctgaaggacgccaacgagaagggcctctccttctggcagctgcgcgtcgacgccctggaccggaagctcagcgccgaggagtgggcccgcgtgatctaccacctgtgcaagcaccgggggttccactggatctcccgcgcggaggagaaggccgccgagggcgacagcaagtccgagggcgggaaggtgaagcagggcctggccgggacgaagaagctcatgcaggagaagaactaccggaccgccgcggagatggtcctgaccgagttccccgaggcccagcgcaacaagcagggcgactacagcaaggccctgtcccggatcctcctgggggacgagatgacccagctgttcaagcaccagcgcgagctcggcaacccccacgccacggagaagctggaggccgcgatcctgggcaacggggaccacaagagcggcctcttctgggcccagaaccccgccctggccgggaacgacctgctcaagatgctgggccactgcaccttcgagaaggccgagtaccgcgtgcccaaggcgtccttcaccgccgagcggcacgtgtggctgacccgcctcaacaacctgcggatcgtcgtggacgggacgacccgcccgctgaacgaggccgagcggcacctcgccctgctgatgccctaccagcaggcgggcgacctcacctacaagcagctgcgcaccgccctgacgaaggccggctacctccccgagagcttccggtacaccgggctggcctacgcctccggccagaaggcggacgagaaggccaaggaccccgagagcgccccgctggtgaagctccccgcctggcacgagctgcgcaagaccctggagaagaaggagctggcctccgagtggcagaagatcagctccgacgcgctcgacgggaagccccagctgctggaccagatcgcctgggtcctcagcgtgtacaaggacgacaccgaggtggaggccgagctgtgcaagctgaacctccccaacgccgagaagatgatcgacgccctgctggacatccggttcgacaagttctccaacctcagcctgaaggcgctgcgccagatcgtcccgctcatggagcagggccagcggtacgacgaggccgtggccaacatccccgagtacgggcaccacagccagctgcacgaggtgggcgccggcgagcacaagtacctgccgcccttctacaaggagcgcgacaagacggggcggatggtcttcaacgacgacatggacatcccccgcaaccccgtggtgctccgggcgctgaaccaggcccgcaaggtcgtgaacgccctgatcaaggagtacggcagcccccacgaggtgcacatcgagatggcccgggacctctcccgccccctggacgagcggcgcgacgtcgagaagctgcagaaggagttccgcgaccggaacgagaaggacaaggccctcttcgcgcaggacttcaacatcgtgggggccgtcaagggcaaggagttcgagaagtaccagctgtaccgcgagcagcaggggaagtgcgcctactccatcgagccgatggacatccaccggctgttcgagcagggctacgtggagatcgaccacgccctcccctacagccgctccttcgacgacagcaagaacaaccgggtgctggtcctggccaaggagaaccgcgacaagggcaaccggacccccttcgagtacctcgggggcaaggacaactccgagcgctggcggcagttcgtggcgttcgtggaggggaacaagagctaccgcctggccaagcggtcccgcctgctccggaaggacttcggcaaggacgaggccaagggcttccgcgagcggaacctgaacgacacccgctacatctgccggttcttcaagaactacgtcgagcagtacctgcagctccacgaggacagcgacgccaagcgctgcgtggtgctgtccgggcagatgaccagcttcctgcgggcccgctggggcctcgtcaaggtgcgcggggactccgaccggcaccacgcgctggacggcgccatcgtggccgcctgcagccactccatggtcaagcgcctgagcgactactcccggcgcaaggagctcgagcaggtccgggcggggttcgtggacgtggacacgggcgagatcgtgaaccccgccatgttccagcaggtccaggagcacttcccgaacccctggccccacttccgcgacgaggtgaagctgcggctgaacgtggacgaccccgccctcctgcacagcgagatgaaccgcttcggcacctactccccggaggccctgaaggccctccggcccctgttcatcagccgcgcgccccagcggcgcaacagcggggccgcccacaaggacaccatctacgcccagccggagcggctggtggcccagggcggggtcacccagaaggtgcccctcacgtccctgaccctgaaggacctcgacaagctgatcgacccccaccgcaacgagaagctgtacagcgcgatccggatccgcctcgagcagcacggcgggaagggcgacaaggccttccccgcctccaacccgctgcggaagcccgacagcgagggcaaccccaccgggcccatcgtgcgcggcgtcaccatggtgatcgacaagctgtccgggatcccgatccggggcgggatcgccaagaacgacagcatggtgcgcgtcgacgtgttcacgaaggccggcaagttccacctcgtgcccgtctacgtgcaccacgcggtggccaaggtcctgcccaaccgggccgtggtggcctacaaggacgagaccgagtggaccctgatcgacgacggcttcgacttctgcttctccatgtaccccaacgacctcctgcgcatcaagctgcgcaacgccagccacctcgggtactacgcgtcctgcaaccggagcaccggcgccatcaacctgtggtcccacgaccgcaaccagcaggtcgggaaggacggcatgatcgagagcatcggggtgaagacggccctgaacgtggagaagctcaacatcgacgtcctgggcaaccggtacccggccccgcccgagaagcgccgggacctggcgtga

SEQ ID NO: 1683 - RNA, 3423 nt, synthetic construct
  misc_feature 1..3423: note = Cas9 variant
  source 1..3423: mol_type = other RNA
atgaagaacatgaccaaggtgaacgtcggcctggacgtggggatcagctccgccggctggagcgtgatcaacgccgagaccaaccagatcctcgagtccggggtccgcctgttcagcggctccgacgcggacgagaacgtgaaccggcgcaaccagcggcaggggcgccggctgttccgccggcgcaagctccggatccaggaggccaagaagtacctggagaacgtgttccagctgaaggacatcgagcccaaggacgagtggaacccgtacgagatccgcgtccgggccctcaacgagaaggtgagcaaggaggagctgtccatcgccctgctcaacatcgtgaagcaccgcggcatcagctacgagctggaggacgtcacggacgaggagggcaccaacacccagtccttccagagcgggctggactacaaccggcgcctcctgaagaccaagacggtgggcgagatccagtacgaccggctgcagaagtacggccaggtgcgcgggcagatccagaccgaggacgggctcctgatcaacatcttccccaccaagaactacgtcgaggaggtggagcggatcctggagacccagaagaagtaccaccccgagatcgacgacgtgttcatcgagaagatcatctccttcgtcacgcgcaagcgggagtacttcgtgggccccggcaacgagaagtcccgcaccgactacgggatctaccgggagaacggcgagaccctcgacaacctgttcgagatcctgatcgggaaggacaagttctacccggaggagtaccgcgccgcgggcagcagctacaccgcccagatcttcaacctcctgaacgacctgaacaacctccgcatccccacgaccgaggaccaccacctgaccaaggcccagaaggaggagatcatcaccgagctgaagaacacgtcccggctcagcggcgggatgctgaagctgatctccaaggtgaccaaggcccccaaggaggagatcagcggctaccgcaaggacgagaaggacaagcccgacctccactccctggcgtactaccggaagcagaagaacatgctggagaaggaggggatccagatcgccgacttcagcgaggagctcctggacgagctggccaccatgatgaccctcaacacggagccgggcgagatccgcaagcagctgaacaagatcaccaaccagtacgacatcctgacccccgaggtcatcgaggtgctcgtgaagaaccacaccgccttcgtcgccacgagcaaccacaagtggcaccggttctccctgaagctgatgaaggagttcatccccgagctcctggagaccagcaaggagcagtccaccatcctgtgcgagcgcgggttcatccagaaccgggcgagctacctcgacgagaaccaccacttcaactacgccgagctgcgcgagaacctgtacaaccccgtggtgcggaagtccacgtgcgagatgctcaaggtcttcaccgccatccaggagaagtacccgaacatccagaacgtgatcgtcgagctgccccgcgagaccaacgaggacgagcagaagcggaagatcaagaagatcaacgacaacaacgccaagcgcaagaaggagatcctgaaggaggcccaggcgcagagcggcctgtccgaggaggccctcgaggagaagctgctgaagaccaagggcctctacctgaagctgatgctctggtacgagcaggaggggaagtgcgtgtacagcggccaggagatccccctgtccgacctgctccagaacaagggcgggtacgaggtggaccacatcatccccatcagcatctccttcgacgaccggctgtgcaacaaggtcctggtgcgccagcagctcaacagccagaagtccaaccagaccccgttcgagtacatgacgacccacaccgacgggcacctgagcttccacgagctgaaggagctcgtgggcaagaacaagcggttctccaaggagaagcgcgagctgctgctcgccgagatctacagcaacgacatcgagacccggaagcgcttcatcaaccggaacctggtcgacacgtcctacaccgcccgcatcgtgctgaacgccctccagcagtacaagaaggagaaccagctgagcatgaacgtgtccgtcgtgcgcggcgcgatgaccaacatcctgcggaagaaggtgaagctcgacaagacccgcgagaccttccaccaccacgccatcgacgccagcctgatggccgtcatccccaacatcgagttcttcaaggagcggaaggagtggctgcccaagagcgccaacgaggaggtggtggaggtcgaggtgtccgaggaggagacgatgcccgagaaggagttcaaggtgaagatgcgcctcccggagagcttcatccaggacgtccagatcctgcagcggaactccttcgcgaaggaggaggtgagcgggccccagacccgcgagcggaacctgaagatcaagttctcccaccaggtggaccagaagatgaaccgcaaggtcgccgacgacaccatctacggcacccggcaggcccagctcgggaaggacaagaaggaggagacgtacgtgatcggcaagatcaaggacatctacaactacgacgagtacgtgcgcttcaagaagcggtacgacaagaacaaggagagcttcctgatgtaccaccacgacccccagaccttcgagaagctggaggagatcctcgcccagtaccccgagtacatcgaggacgagaaggggaagaagaagaaggtctccccgttcgcgctgtaccgcgaggagaacggccccgtgaccaagtacgccaagaagaacaacggccccgtgatcaagcagctgaagtactacgacagcaagctcaaccggaagatcgacatctcccacaagtacagcaccaagaaccgccaggtcgtgctgcagtccctgaagccctaccggacggacgtgtaccgcaaccaggacaccggggagtacaccctcgtcggcatcgaccagaacgacgggaagttcgtgaacggccactacggcatccccaagagccggtacgaggagatcaaggccaacaacaagctgtccgagcacgacgagttcgtgttcagcctgtacaagaactccatggtcaaggtgatcgacgagaacggggagagcatcgtggtccgctacctctcccggagcatgccgaaccgcaagaacaacgccgagatcaagcccgtggagaagtaccagttcgaggacggcgaggtggtcccggtgtacgggaagtgccggaagcagatgcagaccgtgttcgtcaagaagggctggacgctgctgaaggggaacaccgacatcctcggcaacacctacttcgtggagaaggagagcgagaaccccaagaagatgatcgacgacaagtga

SEQ ID NO: 1684 - RNA, 3423 nt, synthetic construct
  misc_feature 1..3423: note = Cas9 variant
  source 1..3423: mol_type = other RNA
atgcgcgagaacggcagcgacgagcggcgccggaacatggacgagaagatggactaccgcatcgggctggacatcggcatcgcctccgtggggtgggccgtcctccagaacaacagcgacgacgagcccgtgcggatcgtggacctgggcgtccgcatcttcgacaccgcggagatcccgaagaccggggagtccctggccggcccccggcgcgccgcccggacgacccgccggcgcctccggcgccggaagcaccgcctggaccggatcaagtggctgttcgagaaccagggcctcatcaacatcgacgacttcctgaagcgctacaacatggccgggctgcccgacgtgtaccagctccggtacgaggcgctggaccgcaagctgaccgacgaggagctcgcccaggtgctgctgcacatcgccaagcaccggggcttccgcagcacccgcaaggccgagacggcggccaaggagaacggggccgtcctcaaggccaccgacgagaaccagaagcggatgcaggagaagggctaccgcaccgtgggggagatgatctacctggacgaggccttccggaccggctgctcctggagcgagaagggctacatcctgacgccccgcaacaaggcggagaactaccagcacaccatgctccgggccatgctggtggaggaggtcaaggagatcttctccagccagcgccggctggggaacgagaaggccaccgaggagctcgaggagaagtacctggagatcatgacctcccagcgcagcttcgacctgggcccggggatgcagcccgacggcaagccctccccctacgccatggagggcttcagcgaccgggtggggaagtgcacgttcctcggcgaccagggggagctgcgcggcgccaaggggacctacaccgcggagtacttcgtggccctgcagaagatcaaccacaccaagctcgtcaaccaggacggcgagacgcggaacttcaccgaggaggagcgccgggccctgaccctgctcctgttcacccagaaggaggtgaagtacgccgccgtgcgcaagaagctgggcctcccggaggacatcctgttctacaacctgaactacaagaaggcggccacgaaggaggagcagcagaaggagaaccagaacaccgagaaggccaagttcatcgggatgccctactaccacgactacaagaagtgcctcgaggagcgggtcaagtacctgaccgagaacgaggtgcgcgacctgttcgacgagatcggcatgatcctgacctgctacaagaacgacgactcccggacggagcgcctcgccaagctggggctcgtgcccatcgagatggagggcctgctggcctacacccccaccaagttccagcacctcagcatgaaggcgatgcggaacatcatcccgttcctggagaaggggatgacctacgacaaggcctgcgaggaggccggctacgacttcaaggccgactccaagggcacgaagcagaagctgctcaccggggagaacgtcaaccagaccatcaacgagatcaccaaccccgtggtgaagcgcagcgtctcccagacggtgaaggtgatcaacgcgatcatccgcacctacggcagcccccaggccatcaacatcgagctggcccgggagatgtccaagaccttcgaggagcgccggaagatcaagggggacatggagaagcgccagaagaacaacgaggacgtcaagaagcagatccaggagctgggcaagctgagccccaccgggcaggacatcctcaagtaccggctgtggcaggagcagcagggcatctgcatgtacagcggcaagacgatcccgctggaggagctgttcaagcccgggtacgacatcgaccacatcctcccctactccatcaccttcgacgacagcttccgcaacaaggtgctggtcacctcccaggagaaccggcagaagggcaaccgcaccccctacgagtacatggggaacgacgagcagcggtggaacgagttcgagacccgcgtgaagacgaccatccgggactacaagaagcagcagaagctcctgaagaagcacttcagcgaggaggagcgctccgagttcaaggagcggaacctgaccgacaccaagtacatcacgaccgtgatctacaacatgatccgccagaacctcgagatggccccgctgaaccggcccgagaagaagaagcaggtccgcgccgtgaacggcgcgatcaccgcctacctgcggaagcgctggggcctcccccagaagaaccgggagaccgacacgcaccacgccatggacgccgtggtcatcgcctgctgcaccgacgggatgatccagaagatcagccgctacaccaaggtgcgggagcgctgctactccaagggcaccgagttcgtggacgcggagacgggggagatcttccgccccgaggactacagccgggccgagtgggacgagatcttcggcgtccacatcccgaagccctgggagaccttccgcgccgagctggacgtgcggatgggggacgaccccaagggcttcctggacacccactccgacgtggccctcgagctggactaccccgagtacatctacgagaacctgcgcccgatcttcgtcagccggatgcccaaccacaaggtgaccggcgccgcgcacgccgacacgatccgcagcccccggcacttcaaggacgaggggatcgtgctcaccaagaccgccctgaccgacctgaagctcgacaaggacggcgagatcgacgggtactacaacccgcagtccgacctgctgctctacgaggccctgaagaagcagctgctcctgtacggcaacgacgcgaagaaggccttcgcccaggacttccacaagcccaaggccgacgggacggagggccccgtcgtgcgcaaggtgaagatccagaagaagcagaccatgggcgtcttcgtggactccgggaacggcatcgccgagaacgggggcatggtgcggatcgacgtcttccgcgtgaacgggaagtactacttcgtgcccgtctacaccgcggacgtggtgaagaaggtcctgccgaaccgggccagcaccgcccacaagccctacggcgagtggaaggtgatggaggacaaggacttcctcttctccctgtacagccgcgacctgatccacatcaagtccaagaaggacatccccatcaagatggtgaacggcgggatggagggcatcaaggagacgtacgcctactacatcggggccgacatcagcgcggccaacatccagggcatcgcccacgactcccggtacaagttccgcgggctcggcatccagagcctggacgtcctggagaagtgccagatcgacgtgctcggccacgtgagcgtcgtgcggtccgagaagcgcatggggttcagctga

SEQ ID NO: 1685 - RNA, 3423 nt, synthetic construct
  misc_feature 1..3423: note = Cas9 variant
  source 1..3423: mol_type = other RNA
atgaacggcctggtgctcgggctggacatcggcatcgccagcgtcggggtgggcatcctggagaagaactccgggaagatcgtgcacgccagctcccgcatcttccccgcggccaccgccgacaacaacgtcgagcggcgcaagaaccggcaggcccgccggctcaaccgccggaagaagcaccgcggcgtgcggttccaggacctgttcgaggactacggcctgctcaccgacttcagcaaggtgtccatcaacctgaacccgtaccgcctgcgggtcgacgggctcaaccagcagctgacgaacgaggagctgttcatcgccctcaagaacatcgtgaagcgccggggcatcagctacctggacgacgcgtccgaggacgggggcaccgtgagctccgactacgggaaggccgtcgaggagaaccgcaagctgctcgccgagaagacccccggccagatccagctggagcggttcgagaagtacggccagctgcgcggggacttcaccgtggtggagaacggcgagaagtgccggctcatcaacgtcttcagcacgtccgcctacaagaaggaggcggagcgcatcctgcggaagcagcaggacttcaacaaccagatcaccgacgagttcatcgaggactacctgaagatcctcaccgggaagcgcaagtactaccacggccccggcaacgagaagtcccggaccgactacgggcgctacacgacccacaaggacagcaagggcgagtacgtgaccctggacaacatcttcggggtgctgatcggcaagtgcaccttctaccccaacgagtaccgcgccagcaaggcctcctacacggcccaggagttcaacctcctgaacgacctgaacaacctcaccgtcccgaccgagaccaagaagctgagcgaggagcagaagaagacgatcatcgagtacgccaagtccgcgaagaccctgggggccagcaccctcctgaagtacatcgccaagatgatcgacacctccgtggaccagatccggggctaccgcgtggacgtcaacaacaagcccgagatccacacgttcgaggtgtaccggaagatgcagagcctggagaccatcagcgtgggcgagctctcccgcaacgtcctggacgagctggcccacatcctcaccctgaacaccgagcgggaggggatcgaggaggccatcaacacgaagctgaaggacagcttctcccaggaccaggtgctcgagctggtgcagttccgcaagaacaacagctccctgttcagcaagggctggcacaacttctccctcaagctgatgatggagctgatccccgagctctacgagaccagcgaggagcagatgaccatcctgacccggctggggaagcagaagtccaaggagacgagcaagcgcaccaagtacatcgacgagaaggagctcaccgaggagatctacaaccccgtcgtggcgaagtccgtccggcaggccatcaagatcatcaacgaggccaccaagaagcacggcatcttcgacaacatcgtgatcgagatggcccgcgagaacaacgaggaggacgccaagaaggactacatcaagcggcagaaggcgaaccaggacgagaagtacgccgccatggagaaggccgccttccagtacaacgggaagaaggagctgccggacaacatcttccacggccacaaggagctggcgacgaagatccgcctgtggcaccagcagggcgagaagtgcctctacaccggcaagagcatccccatctccgacctgatccacaaccagtacaagtacgagatcgaccacatcctgcccctcagcctgtccttcgacgacagcctgtccaacaaggtgctcgtcctggccaccgccaaccaggagaaggggcagcggacccccttccaggccctggacagcatggacgacgcgtggtcctaccgcgagttcaagagctacgtgaaggagagcaagctcctggggaacaagaagaaggagtacctgctcacggaggaggacatctccaagatcgaggtgaagcagaagttcatcgagcggaacctggtcgacacccgctacagctcccgggtggtgctgaacgccctccaggacttctacaagaaccacaacttcgacaccaccatcagcgtcgtgcgcggccagttcacctcccagctgcggcgcaagtgggggctggagaagtcccgcgagacgtaccaccaccacgccgtggacgccctcatcatcgccgcgagcagccagctgcggctgtggaagaagcagaacaacccgctcatcgcctacaaggagggccagttcgtcgactcccagaccggcgagatcatcagcctgaccgacgacgagtacaaggagctggtgttcaaggccccctacgaccacttcgtggacaccctctccagcaagacgttcgaggactccatcctgttcagctaccaggtcgactccaagttcaaccgcaagatcagcgacgccaccatctacgccacccggaaggcgaagctggacaaggagaagaaggagtacacctacacgctcgggaagatcaaggacatctactccctgggcaccaagacccccagcaagaccgggttctacaagttcctggacctctacaacaaggacaagagccagttcctgatgttccagaaggaccgcaagacgtgggacgaggtgatcgagaagatcatggagcagtaccggcccttcaaggagtacgacaaggccggcaagctggtggacttcaacccgttcgagaagtaccgccaggagaacggccccatccggaagtactccaagaaggggaacggccccgagatcaagagcctcaagtactacgacatcctgctggggaagcacaagaacatcacccccgagggctcccgcaacaccgtcgccctcctgagcctgaacccgtggcggaccgacgtgtactacaacatggagacgaagaagtacgagttcctcgggctgaagtacgccgacctgcccttcgaggagggcggcgcctacgggatctccaccgagacctacaacgagctccgcgagaaggagggcatcgggaagaacagcgagttcaagttcaccctgtacaagaacgacctgatcctcatcaaggacacggagaccaactgccagcagttcttccggttctggtcccgcaccggcaaggacaaccccaagagcttcgagaagcacaagatcgagctgaagccctacgagaaggcgaagttcgagaagggggaggagctggaggtgctcggcaaggtcccgccctccagcaaccagttccagaagaacatgcagatcgagaacctgtccatctacaaggtgaagaccgacgtgctgggcaacaagcacttcatcaagaaggagggggacaagcccaagctcaagttctga

SEQ ID NO: 1686 - RNA, 3423 nt, synthetic construct
  misc_feature 1..3423: note = Cas9 variant
  source 1..3423: mol_type = other RNA
atgaacggcctggtgctcgggctggacatcggcatcgccagcgtcggggtgggcatcctgaagaaggacatcggggagatcatccacaccaactcccgcctcttcagcgccgcgaccgccgactccaacatcgagcggcgcggccaccggggcgggaagcgcctgacgcggcgcaagaagcaccggagcatccgcctgcacgacctcttcgaggacttcggcctgctgaccgacttctccaaggtgagcatcaacctcaacccctaccagctgcgggtccaggggctggacaaccagctcaccaacgaggagctgttcatcgccctgaagaacatcgtgaagcgccggggcatctcctacctcgacgacgccagcgaggacgggggcaccgtgtccagcgactacggcaaggccgtcgaggagaaccgcaagctgctggcggagcagacgccggggcagatccagctcgaccggttcgagaagtacggccaggtgcgcggggacttcaacgtggtcgagaacggcgagaagcggcgcctgatcaacgtgttcaccacctccgcctacagcaaggaggccgagcggatcctgcgcaagcagcaggagttcaacaagaagatcaccgacgagttcatcgaggactacctcacgatcctgaccggcaagcggaagtactaccacgggcccggcaacgagaagtcccgcaccgactacgggcggtacaccacgaagaaggaccccgagggcaagtacatcaccctggacaacatcttcgggatcctcatcggcaagtgcaccttctaccccgacgagtaccgcgccagcaaggcgtcctacaccgcccaggagttcaacctgctgaacgacctcaacaacctgacggtgccgaccgagaccaagaagctgagcgaggagcagaagaagaccatcatcaagtacgccaagacggccaagaccctcggcgcctccaccctgctgaagtacatcgcgaagctcatcggggccagcgtcgaccagatccacggctaccgcatcgaccccaacaagaagcccgagatgcacaccttcgagacgtaccggaagatgcagtccctggagaccatcagcgtggaggagctgccccgcaaggtgctcgacgagctggcccacatcctgaccctcaacaccgagcgggaggggatcgaggaggccatcaacgccacgctgaaggacaccttcagccaggaccaggtcctggagctcgtgcagttccgcaagaacaactccagcctgttctccaagggctggcacagcttctccctgaagctcatgatggagctgatcccggagctgtacgagaccagcgaggagcagatgaccatcctcacgcggctggggaagcagaagtccaaggagaccagcaagcgcaccaagtacatcgacgagaaggagctgaccgaggagatctacaaccccgtggtcgcgaagtccgtgcggcaggccatcaagatcatcaacgaggccacgaagaagtacggcatcttcgacaacatcgtgatcgagatggcccgcgagaacaacgaggaggacgccaagaaggagtacatcaagcggcagaaggcgaacctggacgagaagaacgccgccatggagaaggccgccttccagtacaacggcaagaaggagctccccgacaacgtcttccacgggcacaaggagctggcgaccaagatccgcctgtggcaccagcagggcgagaagtgcctctacaccgggaagaacatccccatcagcgacctgatccagaaccagtacaagtacgagatcgaccacatcctgccgctctccctgagcttcgacgactccctgagcaacaaggtgctcgtgctggccaccgccaaccaggagaagggccagcggacccccttccaggccctggactccatggacgacgcgtggagctaccgcgagttcaagtcctacgtcaaggacagcaagctcctggggaacaagaagaaggagtacctgctcacggaggaggacatctccaagatcgaggtgaagcagaagttcatcgagcggaacctggtcgacacccgctacagcagccgggtggtgctgaacgccctccaggacttctacaaggagcaccagttcgacaccaccatctccgtcgtgcgcggccagttcacgagccagctgcggcgcaagtggggcctggagaagtcccgggagacctaccaccaccacgccgtggacgccctcatcatcgccgcgagctcccagctgcgcctgtggaagaagcagaacaaccccctcatcagctacaccgaggggcagttcgtcgaccaggtgaccggcgagatcatctccctgagcgacgacgagtacaaggagctggtgttcaaggccccctacgaccacttcgtcgacacgctcaagtccaagaagttcgaggacagcatcctgttctcctaccaggtggacagcaagtacaaccgcaagatctccgacgccaccatctacgccacccggaaggccaagctggacaaggagaacaaggagtacacctacacgctcgggaagatcaaggacatctacgcgctgggcaccaagagcccgtccaagaccggcttctacaagttcctggacctctacaacaaggacaagagccagttcctgatgttccagaaggaccgcaagacctgggacgaggtgatcgagaagatcatcgagcagtaccggcccttcaaggagtacgacgagaacgggaaggaggtcgacttcaaccccttcgagaagtaccgcatcgagaacggccccatccggaagtactccaagaaggggaacggcccggagatcaagagcctgaagtactacgacaacctcctggggaagttcgtggacatcacgcccagcgagtccaagaaccccgtggccctgctcagcctgaacccctggcgcaccgacgtctactacaacaccgagacctccaagtacgagttcctgggcctcaagtacgccgacctgtgcttcgagaagggcggggcctacggcatcagcgaggtgaagtacaacaagatccgggagaaggaggggatcggcaaggagtccgagttcaagttcacgctgtacaagaacgacctcatcctgatcaaggacaccgagaccaactgccagcagatcttccgcttctggagccggaccgggaaggacaacccgaagtccttcgagaagcacaagatcgagctgaagccctacgagaaggcccgcttcgagaagggcgaggagctcgaggtgctgggcaaggtcccgcccagctccaaccagctgcagaagaacatgcagatcgagaacctcagcatctacaaggtgaagacggacgtgctggggaacaagcacttcatcaagaaggagggcgaggagcccaagctgaagttctga

SEQ ID NO: 1687 - RNA, 3423 nt, synthetic construct
  misc_feature 1..3423: note = Cas9 variant
  source 1..3423: mol_type = other RNA
atggaggagaacttccagtaccgcatcggcctggacatcgggatcaccagcgtgggctgggccgtcctccagaacaactcccaggacgagcccgtgcggatcaccgacctgggggtgcgcatcttcgacgtcgccgagaacccgaagaacggcgacgcgctggccgcgccccggcgcgacgcccggacgacccgccggcgcctccggcgccggcgccaccggctggagcgcatcaagttcctgctccaggagaacgggctgatcgagatggacagcttcatggagcggtactacaagggcaacctgcccgacgtgtaccagctccgctacgagggcctggaccggaagctgaaggacgaggagctcgcccaggtgctgatccacatcgccaagcaccgcgggttccggtccacccgcaaggccgagaccaagggcaaggagggcggggccgtcctgaaggccacgaccgagaaccagaagatcatgcaggagaaggggtaccggaccgtgggcgagatgctctacctggacgaggcgttccacaccgagtgcctgtggaacgagaagggctacgtgctcacgccccgcaaccgcccggacgactacaagcacaccatcctgcggagcatgctggtcgaggaggtgcacgccatcttcgccgcccagcgcgccctcgggaacgagaaggcgaccgaggagctggagaacgcctacgtggagatcatgacctcccagcggagcttcgacatgggccccgggctgcagcccgacggcaagccctccccgtacgccatggagggcttcggggaccgcgtcggcaagtgcacgttcgagaaggacgagtaccgggcccccaaggccacctacaccgcggagctgttcgtggccctccagaagatcaaccacaccaagctgatcgacgagttcgggacgggccgcttcttcaccgaggaggagcggaagaccatcatcgacctcctgctgagcgggaaggagctcaagtacggcaccatccgcaagaagctgaacatcgacccctccctgaagttcaacagcctcaactactccgccaagaaggagggcgagacggaggaggagcgggtgcgcgacaccgagaaggccaagttcgccagcatgttctggacctacgagtactccaagtgcctgaaggaccggaacgaggagatgaccgtcgggcagaaggcggacctgctcgaccgcatcggcgagatcctgacggcctacaagaacgacgacagccggtccagccgcctggaggacctcgggctgtcccgggaggagatcgacggcctgctcgagctgagccccgccaagtaccagcgcgtgtccctgaaggccatgcggaagatgcagccgtacctcgaggacgggctgatctacgacaaggcctgcgaggcggccggctacgacttccgcgccctgaacgacggcaacaagaagcacctcctgaagggggaggagatcaacgccatcgtgaacgacatcaccaaccccgtcgtgaagcggagcgtgagccagaccatcaaggtcatcaacgcgatcatccagaagtacggcagcccccaggccgtgaacatcgagctggcccgcgagatgtccaagaacttccaggaccgcaccaacctggagaaggagatgaagaagcggcagcaggagaacgagcgcgccaagcagcagatcatcgagctcgggaagcagaaccccacgggccaggacatcctgaagtaccggctgtggaacgaccagggcgggtactgcctctactccggcaagaagatcccgctggaggagctgttcgggggcgggtacgacatcgaccacatcctcccctacagcatcaccttcgacgactcctaccgcaacaaggtgctggtcaccgcccaggagaaccggcagaagggcaaccgcaccccctacgagtacttcggcgcggacgagaagcactgggaggactacgaggcccgggtgcgcctgctcgtccgggactacaagaagcagcagaagctgctgaagaagaacttcacggaggaggagcgcaaggagttcaaggagcggaacctcaacgacaccaagtacatcacccgcgtggtgtacaacatgatccggcagaacctggagctggagcccttcaaccacccggagaagaagaagcaggtctgggccgtgaacggggccgtgaccagctacctccgcaagcggtggggcctgatgcagaaggaccgctccacggaccggcaccacgccatggacgcggtcgtgatcgcctgctgcaccgacgggatgatccacaagatcagccgctacatgcagggccgggagctggcctactcccgcaacttcaagttccccgacgaggagaccggggagatcctcaaccgggacaacttcacccgcgagcagtgggacgagaagttcggcgtgaaggtccccctgccctggaacagcttccgcgacgagctggacatccggctcctgaacgaggacccgaagaacttcctgctcacccacgccgacgtgcagcgcgagctggactaccccggctggatgtacggggaggaggagtcccccatcgaggagggccggtacatcaactacatccgccccctgttcgtgagccggatgccgaaccacaaggtcacggggtccgcccacgacgcgaccatccgcagcgcccgggactacgagacccgcggcgtggtgatcaccaaggtccccctcacggacctgaagctgaacaaggacaacgagatcgaggggtactacgacaaggactccgaccggctcctgtaccaggccctggtgcgccagctcctgctgcacggcaacgacggcaagaaggccttcgcggaggacttccacaagcccaaggccgacgggaccgagggcccggtggtccggaaggtgaagatcgagaagaagcagaccagcggggtgatggtccgcggcgggaccggcatcgccgccaacggcgagatggtgcggatcgacgtgttccgcgagaacgggaagtactacttcgtccccgtgtacacggccgacgtggtccggaaggtgctccccaaccgcgcggccatgaacggcaagatcgcctccgactggaagaccatggaggacaacaacttcgtgttcagcctgtactcccgggacctgatccacgtcaagcgcaagaaggccatccccaccatcctcagcagcggggccaccttcgagcaggaggagttctacgcgtacttcacgggcgccgacatctccaccgtgagcatcgccgggatctccaacgacaacagcttcaagttccggggcctgggcatccaggggctggagatcttcgagaagtgccaggtggacatcctcggcaacatctccgtcgtgcgccacgagaaccgccaggggttccactga

SEQ ID NO: 1688 - RNA, 3426 nt, synthetic construct
  misc_feature 1..3426: note = Cas9 variant
  source 1..3426: mol_type = other RNA
atgtacagcatcggcctggacatcgggatcgcctccgtgggctacagcgtcatcgagaccaactccgggcgcatcgtggagctcggcgcccggatcttcgaggcgcgcaacagcgacaacaacaaggaccggcgcgacttccgcgggggccggcggctgatccgccggcgcaagacccggctggacgacgccaagcgctacctcgacgaccagggcttcaagaacgacaagtccctgatcaacgtgtgcccctacagcctgcgggtcaaggggctcacggaggagctgtccaagagcgagatccgcaaggtgatcctgcacatcctcaagaagcggggcgtgtcctacctgagctccgaggacctggacaccagctccgtcgacaacaaggacagcttcaagcaggccgtgaccaagaacctccgccagctggacgacaagaccccggggcagatccagtacgagcggctgcaggagtccggccgcgtgcggacggggatcaaccagaacggccagtaccagctcaacgtcttcgacgtggccagctacgccaaggagctgaagctgatcctcgagacccagcagcagtaccaccaggagatcgacgaccacttcctggacttcttcaccaaggacggctaccgcgaggacgcggggctgatctaccggaagcgcccctactacgacggccccgggaacgccgcccagaactccagctacggccgctgggccaactaccaggtggacggcaagcccgcggagaacatcttcgaccagctcatcgggaaggacttcaccggcaagatccgggcctccaacctggggccgagcgcccagaagttcaacctgctcaacgacctgaacaacctgcgcatcacgacccgggaggaggagaagctcaccttcgaggagaagcaggagatcctggaggtcctggagaacgaccgccccaagaccttcggcccccggaacatcgccaagatgctcaaggtggacatggacgacatcaaggggtggcgcctgaacagctccgacaagcccgagatccacacgatgaaggagtacaacgacatgcggctggtgctcgaggccggcggcttcgacatcaaggcgatcgacctggaccacatcgaggagatcgccagcctgatcaccctcaacaccgagcgcgaggccttcgagctgtccctgagcaacgagatcgacaacaacctcaagcagttcctggtcgagaacttcaacgccctgcggaagtgcaagccgaacaactcctggcacagcttctccaaggagaacctccagcgcctgatcaccgagctggagcacacgagcgacgagcagaacaccatcctcgagcggctggggctgaagttcgacctccgctccaagtacagcgaccgggacaccctgcccatccacgaggtgctggaggagatctacaaccccaccgtgtccaagagcgtccgccagacgttccgggtgctgaacgccctcgtgaagaagtacggcaaggagaacatcgactacgtcaccatcgagatgccccgcgacaagaacgaggacgaccagaagaagaccatccgggagatccagaaggtgaacaagaaccgcaaggacaagtccaaggagtacttcctgaagaagtccgggtggagcgaggagaagttcgaggagaagctgcggaccagccgccgcttcgcgtccaagctctactacttctacgagcaggacggcctgtgcgcctacacggggcagcagatccagccggaggacctgctcaccgagcgggtggaggtcgaccacatcatccccctgagcgtgtccctggacgacagcatcaacaacaaggtcctcgtgaccagcgaggccaaccagaagaagggccagcgctccccctacgacgccttcatgagcggcgacttctccaagtaccggacctacgacgagtacaaggcctgggtgctgagcaacaagtacaagaagtacaagaaggcgctgctcctggaggagcgcaacatcttcgaccccgagctggccaagaagttccggcagcgcaacctcaacgacacgcggtacgcctcccgcatcgtcctgaacgccgtgcagagcttcttctacaagaccgacaccaagacccgggtggtcaacggggccttcacgcacaccctgcgcaagaagtggaacctcgcggacaaggaccgggagacccaccaccaccacgccatcgacgccaccctggtggccgtgacgccgttcgtcaaggcggagcgctacgagtactacaaggactccgagggcaaggccagcatggtggacaccgtgaccgggaccatcatcccctactccgagtacaagaagaagaacctgtacgaccggagcaactacctcctgatgttcggcaacgagtccaccatcaaccaggagaaggaggacaagagcgccgagttcatccgcaacctgatccccgccaagatctaccccgagatcaagttctcccaccaggtcgaccgcaagagcaaccggcggctctccgacgccacgatctacagcacccgctcctacaccgtggagaaggggcggggcaagaacaagcgcgaggtgatcgagcgggacatcatcggcaagatcaaggacatctacaccgcggacgggtacgccgagtacgtcaagtacaaggacagcctgctggtgaaggagatcgacgagaagacgttcgagaagctcgaggccatcatcgaggagttcagcgacaccgtggaggtcaccgaccagcagggcaaggtgaagaaggtgtccaagagcccgttcctgcagtactgcgagaagtacgacgtccccggggtgaccaagtactccaagaagaacaacggccccgtgatccgcagcctgaagtaccgctacacgaagctccggtcccacatcgacatcagccccaagaactccaagaacaccgtcgccctgctgaccctcgccccgtggcgcaccgacgtgtactacagccaggagacggcgtcctaccacctcctgggcctgaagtacatcgacctgagcttccgggacgggggctacggggtgtcccgcaagcggtacgaggagatcaagaagaacgagcgcatccccgaggacggcgagttcaagttcagcctgtacaagaaggactacatcgagatcgagttcgacaagaagatcctccccgggctgtaccagtcccgggacgtcagcgcccgcaacaagttctccatgaagcccatcgacaaggcccagtggaccagcaaggaggacgtgctgatgttcggcaacgtgaaggcctccggcgtcttcgagaagaccctcaagaagaactacgtgctgcggaagtaccacgtggacgtcctggggaacaagttcgaggtgaaggacgagatcctcaaggacatcctggagtga

SEQ ID NO: 1689 - RNA, 3429 nt, synthetic construct
  misc_feature 1..3429: note = Cas9 variant
  source 1..3429: mol_type = other RNA
atgtacagcgtgggcctggacatcgggatcgcctcctgcggctacagcatcatcaacgacgtcaacgggaacatcgtggagctcggcaccctgctgttcaagtcccgcaacagcgacaacaacgaggagcggcgcaccaaccgggggtcccgccggctcatcaaccgccggcgcacgcggctggacgacggcaagaagctgctcgccgagaagggcttcaagcaggacagcaagctgaagcacgtgtgcccctacgagctgcgcgtcaaggggctccacgagaagctgacccagggcgagatctacaaggtggtgctgcacatcctcaagaagcgggggatctcctacctggacgagagcgacgagaactccagcggcatcgacggggcgtcctacaaggaccaggtcaacctgaacctcaacctgcagaaggagctgaccccgggccagatccagctcaagcgcctgaaggagaacggccggatcaagagcggggtgaccttcgagaacggctaccagctgaacgtgttctccgtcagcgcctacgccaacgagctcaacaagatcctgacgaagcagtccgagtactacagcgagatcgaccagatctggatcgaccgcttcaccaagaacgggtaccggaaggaggccggcctggtgtaccgcaagcggccctactacgacggccccgggaacgagaagaacaactccatctacggccgctgggccaacttcaaggaggacgggcaccccaaggagaacatcttcgaccagctcatcggcctggacagcgtggactccacccaggtccgggcgagcgccagcaccctgacggcccagaagtacaacctcctgaacgacctgaacaacctcaccatcatcgaggacgaccgcaagttcaccaccgacgagaaggtgtccatcatcaactacctgatgacgcaggacatcacccggttcgggccgaaggagctggccaagttctaccagctcgaggtggaccagatccgcggctggcgcatcgacaacaagggcaaccccgagatccacagcctgaaggtctaccgggactggaagaagatcttcaacacctccagcatcgacctgacctccatccagacgtgggtggtggacgagctcgcgaacgtcatcaccctgaacaccgagatccccagcaccctggccacgctcaagatcaagatccccgacatcgaccagcagatcctgaacttcgtggagaacaacttctacgagctgaagaagaagacctccaagaacagctggcactccttcagcctcaagaccctgaacatcctgatcccggagctcctgaacacctccgaggagcagaacacgatcctggagcgcctcaacctgaagttcgacctgaagaacaagtacgccgagaagaaccagatccccgtgaaggagctgctcgagcagatctacaaccccaccgtcaccaagagcgtgcaccagtccatcaagctgttcaacgagatcatcgagaagtacgggaagaacaacatcagctacgtgaccatcgagatgccccgggacaagaacgaccaggaccagaaggacacgatcaagcgcatcaacaagctgaactccgagcggaagaacgacagcgagaagtacttcctcgagcgctccggctgggacaccatccggttcgagagcgccctgaagaagccgcgcttcgccgagaagctcctgttctactacgagcagaaggggaagtgcgcgtactccggccaggacatcctggccgagagcctgctcaacgagagctgcgaggtcgaccacatcatccccctgtccatcagcttcgacgactccatccacaacaaggtgctggtcaccgccagctccaaccaggagaaggggcagcggaccccctacatggccttcatcgacggcgccaagctcggccagagctgggacgacttcgtggcgtgggtgaactcctgcgggttccaccgcaagaaggtccagaacctgctgtacgaggagaacatcttcaaccccgacgtgcagcggggcttcgtgagccgcaacctcaacgacacgcggtacgcctcccgcatcgtcctgaacgccatccagagcttcttctacaagcagaaggacctgaccaaggtgaaggtggtcaacgggtccttcacccacaccctccggaagaagtggggcagctccctggacaagaaccgcgacacgtaccaccaccacgccgtggacgccaccctgtgcgcggtgaccccgttcatcaacatcgtcaagtacgagttcttcgaggaggacgggatcaagtacatggtggacctcaccaccggcgagaaggtggcctacagcgactacaagaagatgaagttctacgacaagcgggcctacgtccccatctgggacggcttcatcaagcagctgacgcccgccaacctgtaccccaagatcaagttctcccaccaggtggacagcaagtggaaccgcaagatctccgacgccaccatctacagcacccggaagatcgtggagaccaagatcaacaagaagggggtcgcgaaggagacggtgaaggacatcgtgatcgacaagatcaaggacatctacaccccggagggctggcgcaagttcaaggagaagcaggacaagctcctgatgaagaacttcgacgagaagacctacaacaagctgatcaagatcgccaaggagtaccccgagaagaaggaggtccagaccagcaacgggaaggtgtccctcgtggaggtcagccccttcaagatgtactgcgaggagcagaacgtgcccgccatccgcaagtactccaagaagggcaacggcccgtacatccggagcctgaagttctacgacaaggagctggggaagcacatcaacatcacgaaggactcctacggcaacgacatcgagcgcaccatccggaacaagaagatcatcctcaagaaccagaacagctggcgcaccgacgtgtactacaactccgtcaacaactgctacgagctgctggggatcaagtactgccacctcaagttctaccggggcaagtacgggatccccaagagcatctacgacgagctgaagaaggaggacgagatctccagcgagtccgtgttcaagttcagcctgtaccgccacgaccgggtgcgcttcgagaaggacggcgagtacatcgaggccctcttcggctccaagaacgagagcaacaagaactacctggagctgtcccccatcgacaagaacaagtggctcagcaaggagaacgtcaagttcttcggggaggtggcggcctccggccggttcatcaaggggctgaagcccggcatcaaggtgatcaagcagagcaccgactacatggggcacgtctacgccatccaccaggagaagctgaagttcgtgctctccgacgcctga

SEQ ID NO: 1690 - RNA, 3435 nt, synthetic construct
  misc_feature 1..3435: note = Cas9 variant
  source 1..3435: mol_type = other RNA
atgaccagcaagcaggagaagcacggcgccctgaccttcgggctcgacatcggcatcgcctccgtggggtgggcggtcctgggcgagagccgcatcgtggacctgggggtgcggtgcttcgacaaggccgagacggccaaggagggcgagtccctcaacctgacccgccggatggcccgcctgctccggcgccggctgcgccggcgcgcctggcggctgaccaagctcgcgcgcctgctgaagcgggagggcctcatcgccgacgccaacctgttcaagcacaagatcgagaagaacacccccgtccccaagagctcctggcagctgcgcgtggacgggctcgaccggcagctgaacgccgaggagtgggcgcgcgtgatctaccacctgtgcaagcaccggggcttccactggatcagccgcgccgaggagaaggccgccgagggggactccaagggcgagggcgggaaggtcaagcagggcctcgccgggacgaagaagctgatgcaggagaagtcctaccggaccgcggccgagatggtgctggccgagttccccgacgcccagcgcaacaagcagggcgactacagcaaggccctcagccggatcctgctgggggacgagctcaaggcgctgttcgagcaccagcgcaagctgggcaaccccgtggccaccgagaagctcgaggccgccatcctgggcaacggggacaagaagtgcggcctgttctgggcccagaaccccgcgctcgccgggaacaagctgctggagatgctcggccgctgcaccttcgagaagaccgggggcgacgacggcaagggggagtaccgggccccgaaggcctccttcagcgccgagcgccacgtctggctgacgcacctgaacaacctccggatcgtggtggacggcaccacccgccccctgaacgaggcggagcggcgcgtcgccctgcccatgccctaccagcaggccggggacctctcctacaagcagctgggcggggccctgatcaaggagggcttcctccagaaggacggcttcaagttcgcggggctgccgtaccccacgaagcaggccagcgaggagaaggccaaggaccccgagacctccgtgctgtgcaagctccccgcctggcacaccctgcggaagaccctggagaagcacggcctcgagagcgagtggcagaagctgtccacggacgccctggacgggaagccgcagctgctcgacaacatcgcgtgggtgctgagcgtctacaaggacgacgacgaggtgaagaccgagctgggcaagctcaacctgcccaacaccgagaagatgatcgacgccctgctcgacatccgcttcgacaagttctccaacctgagcctgaaggccctcagcaagatcgtgcccttcatggagcaggggcagcggtacgacgaggccgtcgccaacatccccgagtacggccaccactcccagctgcacaaggtgggcgcgggggagcacaagtacctgccgcccttctacaaggagcgcgacaagaccggccggatggtgttcaacgacgacatggacatcccccgcaaccccgtcgtgctccgggccctgaaccaggcccgcaaggtggtcaacgccctgatcaaggagtacgggagcccgcacgaggtgcacatcgagatggcccgggacctctcccgccccctggacgagcggcgcgacatcgagaagctgcagaaggagttcggcgagcggaacaagaaggacaaggagctgttcgcgcaggacttcaacatcgtcggcacggtgaaggggaagcagttcgagaagtaccagctctaccgcgagcagcagggcaagtgcatctaccccagcatggacgagaagcaggggatctgctgctactccctgaagcccctcgacctgcaccgcgtgctgtacgaggagggctacgccgagatcgaccacgccctcccgtacagccggtccttcgacgacagcaagaacaaccgcgtcctggtgctggccaaggagaaccgggacaaggggaaccgcacccccttcgagtacctcggcgacaaggacaactccgagccctggcggcagttcgtggcgttcgtcgagggcaacaaggcctaccgcctggccaagcggagccgcctgctccggaaggacttcggggacaaggaggccaaggagttccgcgagcggaacctgaacgacacccgctacatctgcaagttcttcaagaactacgtggagcagtacctgcagctccacgaggactccgaggccaagcggtgcgtggtcctgagcggccagatgacctccttcctgcgcgcgcggtgggggctcgtgaaggtgcgcggcgacagcgaccggcaccacgccctggacgccgccgtcgtggccgcgtgctcccacgggatggtgaagcgcctgagcgactactcccggcgcaaggagctcgagcaggtccgggagggcttcgtggacgtggacacgggcgagatcgtcaaccccgccatgttccagcaggtccaggagcacttcccgaacccctggccccacttccgcgacgaggtgaagctgcgcctgagcatcgacgacccgaccctcctgcggtccgagatggagaagttcgggacctacacccccgagagcctggaggccctccgccccctgttcgtgagccgggccccgcagcgccggaactccggcgccgcgcacaaggacacgatctacgcccagccgaagcgcctggtggcccagggcggggtgacccagaaggtcgccctcagctccctgaccctgaaggacctcgacaagctgatcgacccccaccggaacgagcgcctgtacgcggccatccgggcccgcctcgagcagcacgggggcaagggcgacaaggccttccccgccagcaaccccctgcggaagccggactccgaggggaaccccaccggccccatcgtgcgcggggtgacgatggtcatcgacaagctgagcggcatccccatccgcgggggcatcgcgaagaacgactccatggtgcgggtggacgtcttcaccaaggccaacaagttccacctcgtgccggtgtacgtccaccacagcgtgctgggcctgcccaaccaggccatcgtcgggggcaaggaggagtccgagtggacccagatcgacgacagcttcgactggcacttctccatctaccccaacgacctcatccgggtgaccctgaagcaggaggggcgcttcggctactacgccggctgcgaccggagcacggccgcgatccacctgtgggcccacgaccgcaaccagcaggtcgggaaggacggcctcatccggtccatcggggtgaagaccgccctgagcatcgagaagttcaacgtggacgtgctgggcaaccgctaccccgccccgcccgagaagcgccgggacctcgcctga

SEQ ID NO: 1691 - RNA, 3435 nt, synthetic construct
  misc_feature 1..3435: note = Cas9 variant
  source 1..3435: mol_type = other RNA
atgaccagcaagcaggagaacctgggcgccctcaccttcgggctggacatcggcatcgcctccgtggggtgggcggtcctgggcgagaaccgcatcatcgacctcggggtgcggtgcttcgacaaggccgagacggccaaggagggcgagagcctgaacctgacccgccggatggcccgcctcctgcggcgccggctgcgccggcgcgcctggcggctcaccaagctggcgcgcctgctcaagcgggagggcctgatcgccgacgccaacctgttcaagcacaagatcgagaagaacacccccgtgccgaagtccagctggcagctccgcgtcgacgggctggaccggcagctgaacgccgaggagtgggcgcgcgtgatctaccacctctgcaagcaccggggcttccactggatctcccgcgccgaggagaaggccgccgagggggacagcaagggcgagggcgggaaggtgaagcagggcctggccgggacgaagaagctgatgcaggagaagtcctaccggaccgcggccgagatggtcctcgccgagttccccgacgcccagcgcaacaagcagggcgactacagcaaggccctgtcccggatcctgctcggggacgagctgaaggcgctgttcgagcaccagcgcaagctcggcaaccccgtggccaccgagaagctggaggccgccatcctgggcaacggggacaagaagtgcggcctcttctgggcccagaaccccgcgctggccgggaacaagctgctcgagatgctgggccgctgcaccttcgagaagaccgggggcgacgacggcaagggggagtaccgggccccgaaggccagcttctccgccgagcgccacgtgtggctgacgcacctcaacaacctgcggatcgtcgtggacggcaccacccgccccctgaacgaggcggagcggcgcgtggccctccccatgccctaccagcaggccggggacctgagctacaagcagctgggcggggccctcatcaaggagggcttcctgcagaaggacggcttcaagttcgcggggctgccgtaccccacgaagcaggcctccgaggagaaggccaaggaccccgagaccagcgtcctctgcaagctgcccgcctggcacaccctgcggaagaccctcgagaagcacggcctggagtccgagtggcagaagctgagcacggacgccctggacgggaagccgcagctcctggacaacatcgcgtgggtgctgtccgtgtacaaggacgacgacgaggtcaagaccgagctcggcaagctgaacctgcccaacaccgagaagatgatcgacgccctcctggacatccgcttcgacaagttcagcaacctgtccctcaaggccctgagcaagatcgtgcccttcatggagcaggggcagcggtacgacgaggccgtggccaacatccccgagtacggccaccacagccagctgcacaaggtcggcgcgggggagcacaagtacctcccgcccttctacaaggagcgcgacaagaccggccggatggtgttcaacgacgacatggacatcccccgcaaccccgtggtcctgcgggccctgaaccaggcccgcaaggtggtgaacgccctcatcaaggagtacgggtccccgcacgaggtccacatcgagatggcccgggacctgagccgccccctggacgagcggcgcgacatcgagaagctccagaaggagttcggcgagcggaacaagaaggacaaggagctgttcgcgcaggacttcaacatcgtgggcacggtcaaggggaagcagttcgagaagtaccagctgtaccgcgagcagcagggcaagtgcatctacccctccatggacgagaagcaggggatctgctgctacagcctcaagcccctggacctgcaccgcgtgctctacgaggagggctacgccgagatcgaccacgccctgccgtactcccggagcttcgacgactccaagaacaaccgcgtgctggtcctcgccaaggagaaccgggacaaggggaaccgcacccccttcgagtacctgggcgacaaggacaacagcgagccctggcggcagttcgtggcgttcgtggagggcaacaaggcctaccgcctggccaagcggtcccgcctcctgcggaaggacttcggggacaaggaggccaaggagttccgcgagcggaacctgaacgacacccgctacatctgcaagttcttcaagaactacgtcgagcagtacctccagctgcacgaggacagcgaggccaagcggtgcgtggtgctgtccggccagatgaccagcttcctccgcgcgcggtgggggctggtcaaggtgcgcggcgactccgaccggcaccacgccctggacgccgccgtggtcgccgcgtgcagccacgggatggtgaagcgcctctccgactacagccggcgcaaggagctggagcaggtccgggagggcttcgtggacgtggacacgggcgagatcgtgaaccccgccatgttccagcaggtccaggagcacttcccgaacccctggccccacttccgcgacgaggtgaagctgcgcctctccatcgacgacccgaccctgctgcggagcgagatggagaagttcgggacctacacccccgagtccctcgaggccctgcgccccctgttcgtgagccgggcgccccagcgccggaacagcggcgccgcccacaaggacacgatctacgcccagccgaagcgcctcgtcgcccagggcggggtgacccagaaggtggccctgtccagcctgaccctcaaggacctggacaagctgatcgacccccaccggaacgagcgcctctacgcggccatccgggcccgcctggagcagcacgggggcaagggcgacaaggccttccccgcctccaaccccctgcggaagccggacagcgaggggaaccccaccggccccatcgtccgcggggtgacgatggtgatcgacaagctctccggcatccccatccgcgggggcatcgcgaagaacgacagcatggtccgggtggacgtgttcaccaaggccaacaagttccacctggtcccggtgtacgtgcaccactccgtcctgggcctccccaaccaggccatcgtgggcgggaaggaggagagcgagtggacccagatcgacgactccttcgactggcacttcagcatctaccccaacgacctgatccgggtgaccctgaagcaggaggggcgcttcggctactacgccggctgcgaccggtccacggccgcgatccacctctgggcccacgaccgcaaccagcaggtcgggaaggacggcctgatccggagcatcggggtgaagaccgccctgtccatcgagaagttcaacgtggacgtcctcggcaaccgctaccccgccccgcccgagaagcgccgggacctggcctga

SEQ ID NO: 1692 - RNA, 3438 nt, synthetic construct
  misc_feature 1..3438: note = Cas9 variant
  source 1..3438: mol_type = other RNA
atgaagaccatcctggggctcgacctggggaccaacagcatcggctgggccctggtgaaggagacggagaactccaacgagaagtccgagatcatcaagctcggggtccgcgtgaaccccctgaccgtggacgagaagaccaacttcgaggccggccggccgctgagcaccaacgcggaccgcacggccaagcggagcgcccgccggaacctccagcgctacaagctgcggcgcaagaacctgatcgacctcctgatcaagcaccggctgatcgacaaggacacgcccctcaccgagatcgggaagaacaccacccaccagaccctggagctgcgcgccaaggccgcgcgggagcgcatcgagctcgaggacctggcccgggtcttcctggccatcaacaagaagcgcggctaccggtccagccgcaaggtgaacaacgaggaggagggccaggtggtcgacgggatggccgtggcgaagaagctctacgacgagaacctgacccccggccagtacgcctacgagctgctctccaaggggaagaagtacgtgcccgacttctaccggagcgacctgcaggccgagttcgactccatctgggagtaccagaagcagttctacgccgacatcctggacgacgagctctacaacgccctgaagggccaggggcagcagaacagccgcaagcggttcctggcgatcaagggcgtctacaccgccgagaacaagggcaagcgcgacgaggtgaagctccagcactacaagtggcggtccgaggccatcacgcagaagctgagcatcgaggaggtggcctacgtcctggtggagatcaacaacgacctcaacaagtccagcgggtacctgggcgccatctccgaccgcagcaaggagctgtacttcaacaaggagaccgtgggggagaacctctggaagcagatccagaagaacccgcacacctccctgaagaaccaggtcttctaccgccaggactacctggacgagttcgagcagatctgggagacccaggcgcagttccacccccagctcacgctggccctgaaggagcagatccgggacgtggtgatcttctaccagcgcaagctcaagagccagaagggcctgctgtccttctgccagttcgagagctgggagatcgagcggaaggacgagaacggcaacgtcatcctcaacaagaccacccagctgcccaagcgccagaccgtggggcggcgcgtggcccccaagagctccccgctgttccaggagttcaagatctggcagaacatcaacaacctcgagatcgccaagatcagcgacggcaactccaagaacaagaaggagacggaggccctgagcgacgacgagcggaagctcctgttcgaggagctgaacctgcgcgggaacctgtcccagaaggaggtcctccagatcctgggcctgaaggacaaggagtacaagaccaacttccccgaggggctcgagggcaaccggaccaacgcggccctgttcaacatctaccagcagatcgccgagaacgagggctacggggactggaccaagaagtccgcccaggagatcaaggaggagctgaaggccgtgttcccccagatcggcatccaggcggacatcctcgacttcaacgccgagctggacgggaaggagttcgagaaccaggccagctaccagctgtggcacctcctgtacagcgccgaggaggacgacaagatcaacgaggaggaccagatcatctacggcaactccgcggtgagcctgaagaagaagctctgcgagaagttcgggttcacgcccgagtacgccaagtggatcgccaacgtctccctgcaggacgactacggcaacctgagcaccaaggccatgcgcaagatcatcccgtacctcatcgacggcaacgactactccgaggcctgcgcgctggccgggtacaaccacagcaactccctgaccaaggaggagaacgacaaccgggagcgcctcaacaagctggagctgctccccaagaacagcctgcggaaccccgtggtcgagaagatcctgaaccagatggtgaacgtggtcaaccaggtgatcgagacctacggcaagcccgacgaggtgcgcatcgagctcgcccgggagctgaagaagtccgccgaggagcgcgccgagatgacgaaggggatcaacgaggcgacccggcgcaacgaggacatcaagaagctgatcaccaagaacttcggcatcccgaaccccaccaagaacgacgtcgtgcggtaccgcctctgggaggagctggcgcccctggcctacaaggacgtgttcacggggcgccagatcaagaaggaggacctcttcagctccaagatcgacatcgagcacatcatccccaaggccctgctgttcgacgacagcttcagcaacaagaccctcgccttccgggagaccaacctgaagaaggccgaccgcaccgcctacggcttcatcgagtccgactacaacgccacgctggacgactacatccagcgggtcgagaccctctacaacaacgccaagggcaccatcagcaaggggaagcgcaacaagctgctgatggcgcagaagaacctcccggacggcttcatcgagcgggacctgcgcaactcccagtacatcgccaagaaggccaagagcatgatcgagaaggtgttcaacgacgtgaacgtcacctccgggagcatcaccgaccggctgcgcgaggactgggacctcatcaacgtgatgaaggagctgaacttccccaagtacaaggccctgggcctcacggagatcgaggagcggtacgacatcggccaggagaagaccaagaaggtggaggtcatcaccgactggaccaagcgcaacgaccaccggcaccacgccatggacgcgctgacggtggccttcaccaccaagtcccacgtgcagtacctgaacaacctcaacaccatccacagcctgaagggggacgaggtcgacctggagctctccaagctgtacggcctgaagaacacgatcaccgaggtggtgaacaagaagcgcaagttcatcccgcccatgcccaacttccgggaggaggccaagaagcacatcgagaccatcctcgtcagcatcaagaacaagaacaaggtgtacaccaagaacatcaacaagacgaagaaggagtccgggtaccacaccaaggagcagctgacgccccgcggccagctgcacaaggagaccgtgtacggcaagagcaagcggcccatgaacaagcccaccaagatcaacaagaacttctccctcgagcaggcccagctgatcatcaacgtccaggagaaggagctggtgctccgccacctggcccagttcgacaacaacccggcggtggccttcgacaccaagaccctgaagaagtgccactacctcaagatggtcaacctgtga

SEQ ID NO: 1693 - RNA, 3441 nt, synthetic construct
  misc_feature 1..3441: note = Cas9 variant
  source 1..3441: mol_type = other RNA
atgagcggcaacacccacgggcccctgaccttcggcttcgacatcgggatcgcctccgtgggctggtgcgtcctcggggagaaccgcatcgtgaacctgggcgtgcggtgcttcgacaaggccgagacggcgaaggagggcgagagcctgaacctcgcccgccggaccgcccgcctgatgcggcgccggctgcgccggcgcgcctggcggctcaccaagctggcccgcctgctcaagcgggaggggctgatcgcggaggcctcccgcatccacatccccagccccgtctccccctggcggctgcgcgtggagggcatcgaccggcgcctcaccgacgacgagtgggcccgggtgatctaccacctgtgcaagcaccgcgggttccactggatcagccgggccgaggagcgcaaggcggagtccgacgccaaggagggcgggcgcgtcaagaagggcctgagcgacacgcagcggcgcatgaccgagaagggctaccggtccgccgccgagatggtgctcgccgagttccccgacgcgcagcgcaacaagcagggggactacggcaaggccctgagccggatcctgctctccgacgagctggccctcctcttccgccggcagcgcgagctggggaacccgaacgccggcaacgagctggaggccaccatcctcggcaacgggaaccgcaagagcggcctgttctgggagcagaagccgcccctggcgggggccgacctcctgaagatgctgggccggtgcaccttcgagaagaacgagtaccgggcccccaaggcctccttcacggccgagcgccacgtgtggctcacccggctgaacaacctgcgcgtcgtggtggacgggaccacccggagcctcgacgacgcggagcaccgcctggtcctgccgctcccctacaagcaggccggcgacttcacgtacaagcagctgcggaccgccctgaccaaggccggcctcctgcccgaggggttcaagttcgccggcctgtcctaccccaccgggcgccagctcgacgacccgaaggcgaaggaccccgagagcgagaagctggtgcggctgcccgcctggcaggagctccgcaagacgctgaaggacaagaacctggagaccgagtgggagggcatggccggggccgcgaccggcggcaaccccgagctcctggacgagatcgcccgcgtgctgtccgtcttcaaggacggggacgaggtgaccgccgagctgtggaagctcccgctgcccggcgggaaggccatgatcgacgccctgagcgagatctccttcgacaagttccacgcgctcagcctgaaggccctgcggaagatcgtgccccacatggagagcggcctccgctacgacgaggcctgcgccgtcgccgggtaccaccactcccagctgcacgcggccggcgccggcgagcacaagttcctgcccccgttctacagccggcgcgacaaggacgggcggatggtgttcaacgaggagctcgacgtgccccgcaaccccgtcgtgctgcgggccctgaaccaggcccgcaaggtgctcaacgcgctggtccggacgtacggctcccccaccgccgtgcacatcgagatggcccgcgacctgagccggccgctcgacgagcgcaacaaggtcaagaaggcccaggacgagtaccgggagcgcaacgagaaggacaaggcggccttcgccgccgagtacgggatcgcccccaagtcccgggagttcgagaagttccagctgtaccgcgagcagcagggcaagtgcgcgtacagcctgaagtccctcgacctgcaccgggtgctgcacgacatcggctacgccgaggtggaccacgccctcccctacagccgctcctacgacgacagcaagaacaacaaggtcctggccctgaccgaggagaaccggaacaaggggaaccgcaccgcctacgagtacctcacgtccttccccggcggggagaacggcgagcggtggcgcaacttcagcgtggcggtggagaccaacaaggcctaccgcctggccaagcggacccgcctgctccggaaggacttctccgggcgcgccgccgaggagttccgggagcgcaacctgaacgacacccggtacatctgccgcttcttcaagaacacggtcgagcggttcctgaagctcgacgcgaaggtgggcgccggcgacaccgccgagatcagcgccaagcgctgcgtggtcctgtccgggcagaccaccgcgttcctgcgggcccgctggggcctcctgaaggtgcgggggaacagcgaccgccaccacgccctggacgccgccgtggtcgcggcctgctcccacggcatggtgaagcggctcggggactacagccgcacgaaggagctggccaaggtgcacgacggcttcccggaccccgagaccggcgagatcatcgaccccgtcatgttccagcagctgcacgcccacttcccggacccctggccccacttccgggccgagctcgaggcgcgcctgaacgtggacgacaccgccgacctgcgggcccgcatggagctgttcgggacctacgcccccgaggccctggagacgctgcgccccctcttcgtgtcccgggcgccccagcgccggaacagcggcgccgcccacaaggacaccatctacgcccagcccgagcgcctgaaggagcagggcggggtcacccagaaggtgcccctgaccagcctcaccctgaaggacctggacaagctcatcgacccgcaccggaacgagaagctgtacgccgcgatccgcgcccggctggaggcccacgggggcaaggccgacaaggcgttccccgccggcaaccccctccgcaagcccgaccgggaggggaacccgacgggccccgtggtccgcaccgtgaccatggtgatcgacaagctgtccgggatccccgtccggggcgggatcgccaagaacgacaccatgctgcgcgtggacatcttccggcacaagaaggacggcaagttccacctcgtgcccgtctacgtgtaccacgccgtggccaaggagttcccgaaccgcgcgatcgtccaggccaaggacgaggacgagtggacgctgatcgacgacaagttcgacttctgcttcagcgcccaccccaacgacctgctcaagatcacccagaagtccggcgagaccatcttcgggtactaccggggctgccacagcgggaccgccgccatcaacatcgcgctgcacgaccgctacgcctacgccgagaagacgacctccctggccttcagcaagaagaaccccggcaagcccatcccgaacgacaagctcggcctgatcgaggggatcggcgtgaagatggccgcgaacatggagaagttccacgtggacaccctggggaacatctaccccgccccgcccgagcagcggcgcggcctcgcctga

SEQ ID NO: 1694 - RNA, 3441 nt, synthetic construct
  misc_feature 1..3441: note = Cas9 variant
  source 1..3441: mol_type = other RNA
atggcctaccgcctgggcctcgacatcgggatcaccagcgtgggctgggccgtcgtggcgctggagaaggacgagtccgggctgaagcccgtgcggatccaggacctcggcgtccgcatcttcgacaaggccgaggacagcaagaccggggcctccctggccctgccgcggcgcgaggcccggagcgcgcgccggcgcacgcggcgccggcgccaccggctctggcgcgtgaagcggctgctggagcagcacggcatcctctccatggagcagatcgaggccctgtacgcccagcgcaccagctcccccgacgtgtacgccctgcgggtcgcgggcctcgaccgctgcctgatcgccgaggagatcgcccgggtgctgatccacatcgcccaccgccgggggttccagagcaaccgcaagtccgagatcaaggacagcgacgccggcaagctcctgaaggcggtgcaggagaacgagaacctgatgcagtccaaggggtaccgcaccgtcgccgagatgctcgtgagcgaggccaccaagacggacgccgagggcaagctggtgcacgggaagaagcacggctacgtctccaacgtgcggaacaaggccggcgagtaccgccacaccgtgagccggcaggcgatcgtcgacgaggtgcgcaagatcttcgccgcccagcgggccctggggaacgacgtgatgtccgaggagctcgaggacagctacctgaagatcctgtgctcccagcgcaacttcgacgacggccccgggggcgacagcccctacggccacgggtccgtcagcccggacggcgtgcggcagagcatctacgagcgcatggtggggtcctgcaccttcgagaccggcgagaagcgggcgccccgcagctcctacagcttcgagcggttccagctcctgacgaaggtcgtgaacctgcgcatctaccggcagcaggaggacgggggccgctacccctgcgagctcacccagaccgagcgggcccgcgtgatcgactgcgcctacgagcagaccaagatcacgtacggcaagctgcggaagctgctcgacatgaaggacaccgagtccttcgccgggctgacctacggcctgaaccgcagccggaacaagaccgaggacacggtcttcgtggagatgaagttctaccacgaggtccgcaaggccctccagcgcgccggggtgttcatccaggacctgtccatcgagaccctggaccagatcggctggatcctcagcgtgtggaagtccgacgacaaccggcgcaagaagctgagcaccctggggctctccgacaacgtcatcgaggagctgctgcccctcaacggcagcaagttcggccacctgtccctgaaggcgatccggaagatcctcccgttcctggaggacgggtacagctacgacgtggcctgcgagctggccggctaccagttccaggggaagaccgagtacgtgaagcagcgcctcctgccgcccctgggcgagggggaggtcacgaaccccgtggtgcggcgcgccctgtcccaggcgatcaaggtcgtgaacgccgtgatccggaagcacggcagccccgagtccatccacatcgagctcgcccgcgagctgagcaagaacctggacgagcggcgcaagatcgagaaggcccagaaggagaaccagaagaacaacgagcagatcaaggacgagatccgggagatcctcggctccgcccacgtcaccgggcgcgacatcgtgaagtacaagctgttcaagcagcagcaggagttctgcatgtacagcggcgagaagctggacgtgacccggctgttcgagcccgggtacgcggaggtcgaccacatcatcccctacggcatcagcttcgacgactcctacgacaacaaggtgctggtgaagaccgagcagaaccgccagaagggcaaccggacgcccctggagtacctccgcgacaagccggagcagaaggccaagttcatcgccctggtcgagagcatccccctgtcccagaagaagaagaaccacctcctgatggacaagcgggccatcgacctggagcaggaggggttccgcgagcggaacctcagcgacacccgctacatcacccgggccctgatgaaccacatccaggcgtggctcctcttcgacgagaccgcctccacgcgcagcaagcgcgtggtgtgcgtcaacggcgccgtgaccgcctacatgcgggcccgctgggggctgaccaaggaccgggacgcgggcgacaagcaccacgccgccgacgccgtggtcgtggcgtgcatcggggactccctgatccagcgcgtgaccaagtacgacaagttcaagcggaacgccctcgccgaccgcaaccggtacgtccagcaggtcagcaagtccgagggcatcacgcagtacgtggacaaggagaccggcgaggtgttcacctgggagagcttcgacgagcgcaagttcctgcccaacgagcccctggagccgtggcccttcttccgggacgagctcctggcccgcctgtccgacgaccccagcaagaacatccgggccatcgggctcctgacctactccgagacggagcagatcgaccccatcttcgtgagccgcatgccgacccggaaggtgaccggcgcggcccacaaggagaccatccgcagcccccggatcgtcaaggtggacgacaacaaggggaccgagatccaggtggtcgtgtccaaggtggccctgacggagctcaagctgaccaaggacggcgagatcaaggactacttccgccccgaggacgacccccggctgtacaacaccctccgcgagcggctggtccagttcgggggcgacgccaaggccgcgttcaaggagccggtgtacaagatctccaaggacggcagcgtgcgcacccccgtccgcaaggtgaagatccaggagaagctgacgctcggggtgcccgtccacggcgggcggggcatcgccgagaacgggggcatggtgcgcatcgacgtgttcgccaagggcgggaagtactacttcgtcccgatctacgtggccgacgtgctgaagcgggagctgcccaaccgcctcgccaccgcgcacaagccctacagcgagtggcgggtcgtggacgactcctaccagttcaagttcagcctgtaccccaacgacgccgtcatgatcaagccgtcccgcgaggtggacatcacctacaaggaccggaaggagcccgtgggctgccgcatcatgtacttcgtcagcgccaacatcgcctccgcgagcatctccctgcggacccacgacaacagcggggagctcgagggcctggggatccagggcctggaggtgttcgagaagtacgtggtcggccccctcggggacacgcaccccgtgtacaaggagcgccggatgccgttccgcgtggagcggaagatgaactga

SEQ ID NO: 1695 - RNA, 3441 nt, synthetic construct
  misc_feature 1..3441: note = Cas9 variant
  source 1..3441: mol_type = other RNA
atggcctaccgcctgggcctcgacatcgggatcaccagcgtgggctgggccgtcgtggcgctggagaaggacgagtccgggctgaagcccgtgcggatccaggacctcggcgtccgcatcttcgacaaggccgaggacagcaagaccggggcctccctggccctgccgcggcgcgaggcccggagcgcgcgccggcgcacgcggcgccggcgccaccggctctggcgcgtgaagcggctgctggagcagcacggcatcctctccatggagcagatcgaggccctgtacgcccagcgcaccagctcccccgacgtgtacgccctgcgggtcgcgggcctcgaccgctgcctgatcgccgaggagatcgcccgggtgctgatccacatcgcccaccgccgggggttccagagcaaccgcaagtccgagatcaaggacagcgacgccggcaagctcctgaaggcggtgcaggagaacgagaacctgatgcagtccaaggggtaccgcaccgtcgccgagatgctcgtgagcgaggccaccaagacggacgccgagggcaagctggtgcacgggaagaagcacggctacgtctccaacgtgcggaacaaggccggcgagtaccgccacaccgtgagccggcaggcgatcgtcgacgaggtgcgcaagatcttcgccgcccagcgggccctggggaacgacgtgatgtccgaggagctcgaggacagctacctgaagatcctgtgctcccagcgcaacttcgacgacggccccgggggcgacagcccctacggccacgggtccgtcagcccggacggcgtgcggcagagcatctacgagcgcatggtggggtcctgcaccttcgagaccggcgagaagcgggcgccccgcagctcctacagcttcgagcggttccagctcctgacgaaggtcgtgaacctgcgcatctaccggcagcaggaggacgggggccgctacccctgcgagctcacccagaccgagcgggcccgcgtgatcgactgcgcctacgagcagaccaagatcacgtacggcaagctgcggaagctgctcgacatgaaggacaccgagtccttcgccgggctgacctacggcctgaaccgcagccggaacaagaccgaggacacggtcttcgtggagatgaagttctaccacgaggtccgcaaggccctccagcgcgccggggtgttcatccaggacctgtccatcgagaccctggaccagatcggctggatcctcagcgtgtggaagtccgacgacaaccggcgcaagaagctgagcaccctggggctctccgacaacgtcatcgaggagctgctgcccctcaacggcagcaagttcggccacctgtccctgaaggcgatccggaagatcctcccgttcctggaggacgggtacagctacgacgtggcctgcgagctggccggctaccagttccaggggaagaccgagtacgtgaagcagcgcctcctgccgcccctgggcgagggggaggtcacgaaccccgtggtgcggcgcgccctgtcccaggcgatcaaggtcgtgaacgccgtgatccggaagcacggcagccccgagtccatccacatcgagctcgcccgcgagctgagcaagaacctggacgagcggcgcaagatcgagaaggcccagaaggagaaccagaagaacaacgagcagatcaaggacgagatccgggagatcctcggctccgcccacgtcaccgggcgcgacatcgtgaagtacaagctgttcaagcagcagcaggagttctgcatgtacagcggcgagaagctggacgtgacccggctgttcgagcccgggtacgcggaggtcgaccacatcatcccctacggcatcagcttcgacgactcctacgacaacaaggtgctggtgaagaccgagcagaaccgccagaagggcaaccggacgcccctggagtacctccgcgacaagccggagcagaaggccaagttcatcgccctggtcgagagcatccccctgtcccagaagaagaagaaccacctcctgatggacaagcgggccatcgacctggagcaggaggggttccgcgagcggaacctcagcgacacccgctacatcacccgggccctgatgaaccacatccaggcgtggctcctcttcgacgagaccgcctccacgcgcagcaagcgcgtggtgtgcgtcaacggcgccgtgaccgcctacatgcgggcccgctgggggctgaccaaggaccggaacgcgggcgacaagcaccacgccgccgacgccgtggtcgtggcgtgcatcggggactccctgatccagcgcgtgaccaagtacgacaagttcaagcggaacgccctcgccgaccgcaaccggtacgtccagcaggtcagcaagtccgagggcatcacgcagtacgtggacaaggagaccggcgaggtgttcacctgggagagcttcgacgagcgcaagttcctgcccaacgagcccctggagccgtggcccttcttccgggacgagctcctggcccgcctgtccgacgaccccagcaagaacatccgggccatcgggctcctgacctactccgagacggagcagatcgaccccatcttcgtgagccgcatgccgacccggaaggtgaccggcgcggcccacaaggagaccatccgcagcccccggatcgtcaaggtggacgacaacaaggggaccgagatccaggtggtcgtgtccaaggtggccctgacggagctcaagctgaccaaggacggcgagatcaaggactacttccgccccgaggacgacccccggctgtacaacaccctccgcgagcggctggtccagttcgggggcgacgccaaggccgcgttcaaggagccggtgtacaagatctccaaggacggcagcgtgcgcacccccgtccgcaaggtgaagatccaggagaagctgacgctcggggtgcccgtccacggcgggcggggcatcgccgagaacgggggcatggtgcgcatcgacgtgttcgccaaggacggcaagtactacttcgtcccgatctacgtggccgacgtgctgaagcgggagctgcccaaccgcctcgccaccgcgcacaagccctacagcgagtggcgggtcgtggacgactcctaccagttcaagttcagcctgtaccccaacgacgccgtcatgatcaagccgtcccgcgaggtggacatcacctacaaggaccggaaggagcccgtggggctgcgcctcatgtacttcgccggcgccgacatcagcggggcgaccctgacgctgcggacccacgacaactccggcgagctcaaggggctgggcatccagggcctggaggtcttcgagaagtacgtggtggggcccctcggcgacacccaccccgtctacaaggagcgccggatgccgttccgcgtggagcggaagatgaactga

SEQ ID NO: 1696 - RNA, 3447 nt, synthetic construct
  misc_feature 1..3447: note = Cas9 variant
  source 1..3447: mol_type = other RNA
atgaccaagctgaaccagccctacggcatcgggctcgacatcggcagcaactccatcgggttcgccgtggtcgacgccaacagccacctcctgcgcctcaagggcgagaccgcgatcggggcccggctgttccgcgagggccagtccgccgccgaccggcgcggcagccggacgacccgccggcgcctgtcccggacccgctggcggctcagcttcctgcgcgacttcttcgccccgcacatcaccaagatcgaccccgacttcttcctgcggcagaagtactccgagatcagccccaaggacaaggaccgcttcaagtacgagaagcggctgttcaacgaccgcacggacgcggagttctacgaggcctacccctccatgtaccacctccggctgcgcctgatgaccgacgccagccaggccgacccgcgggagatcttcctggcgatccaccacatcctgaagtcccgcgggcacttcctcacccccggcgccgccaaggacttcaacaccgacaaggtggacctggaggacatcttccccgccctgacggaggcctacgcccaggtgtaccccgacctcgagctgaccttcgacctggccaaggccgacgacttcaaggccaagctcctggacgagcaggccaccccgagcgacacccagaaggcgctggtcaacctcctgctgtccagcgacggggagaaggagatcgtgaagaagcggaagcaggtcctcacggagttcgccaaggccatcaccggcctgaagaccaagttcaacctggccctcgggaccgaggtggacgaggccgacgcgtccaactggcagttcagcatgggccagctggacgacaagtggtccaacatcgagacgagcatgaccgaccagggcaccgagatcttcgagcagatccaggagctgtaccgcgcccgcctcctgaacgggatcgtgcccgccggcatgtccctgagccaggccaaggtggccgactacgggcagcacaacgaggacctcgagctgttcaagacctacctgaagaagctcaacgaccacgagctggcgaagacgatccgggtcatctacgaccgctacatcaacggcgacgacgccaagcccttcctgcgggaggacttcgtgaaggccctcaccaaggaggtgaccgcccaccccaacgaggtcagcgagcagctgctgaaccgcatgggccaggcgaacttcatgctcaagcagcggaccaaggccaacggggccatcccggtgcagctgcagcagcgcgagctggaccagatcatcgccaaccagtccaagtactacgactggctcgccaagcccaaccccgtggagaagcaccgggcgagcaagccctaccagctggacgagctgctgacgttccgcatcccgtactacgtcggccccctcatcacccccaaggagcaggccaagtccggggagaacgtgttcgcctggatggtgcggaaggaccccagcggcaacatcaccccgtacaacttcgacgagaaggtcgaccgcgaggcctccgccaacgtgttcatccagcggatgaagaccacggacacctacctgatcggggaggacgtgctgcccaagcagagcctcctgtaccagaagtacgaggtcctgaacgagctcaacaacgtgcgcgtgaacaacgaggcgctgggcaccgaccagaagcagcggctgatccgcgaggtcttcgagcggcactccagcgtgaccatcaagcaggtcgccgacaacctcgtggcccacggcgacttcgcccagcgccccgagatccgggggctggccgacgagaagcgcttcctgtccagcctctccacgtaccaccagctgaaggagatcctgcacggcgcgatcgacgacagcaccaagctccacgacatcgagaacatcatcacctggtccaccgtgttcgaggacgccgccatcttcaagacgaagctggccgagatcgactggctggacgcggccaccatcaagaagctcagcaacatccggtaccgcgggtggggccagttctcccgcaagctgctggacgggctcaagctgggcaacggccagaccgtcatccaggagctgatgctcagcaaccacaacctgatgcagatcctgaccgacgagaccctcaagacgaccatggccgagctgaaccaggacaagctgaaggccgacgacatcgaggacgtgatcaacgacgcctacacctcccccagcaacaagaaggcgctccgccaggtgctgcgggtcgtggaggacatcaagcacgccgccaacgggcaggacccgtcctggctgtacatcgagaccgccgacggccccgggacggccggcaagcggacccagagccgccagaagcagatccagaccgtgtacgcgaacgccgcccaggagctcatcgacagcgccgtccgcggggagctggaggacaagatcgccgacaaggcgtccttcaccgaccggctggtgctctacttcatgcagggcggccgggacatctacacgggggcgcccctgaacatcgaccagctgagccactacgacatcgaccacatcctcccccagtccctgatcaaggacgacagcctggacaaccgcgtgctcgtcaacgccaccatcaaccgggagaagaacaacgtgttcacctccaccctgttcgccagcaagatggcggccacgtggcgcaagtggcacgaggccggcctgatctccgggcggaagctccgcaacctgatgctgcggccggacgagatcgacaagttcgcccacggcttcgtggcccgccagctcgtcgagacccggcagatcatcaagctgaccgagcagatcgcggccgcccagtaccccaacaccaagatcatcgccgtgaaggccggcctgagccaccagctccgcgaggagctggacttccccaagaaccgggacgtgaaccactaccaccacgcgttcgacgccttcctggccgcccgcatcgggacgtacctcctgaagcggtacgccaagctggcgccgttcttcacctacggcgagttcgccaaggtcgacgtgaagaagttccgcgagttcaacttcatcggggccctcaagcacgccaagaagaacatcgtggccaaggacaccggcgagatcgtctgggacaaggagcgggacatccaggagctggaccgcatctacaacttcaagcgcatgctgatcacccacgaggtgtacttcgagacggcggacctcttcaagcagaccatctacgccgccaaggactccaaggagcgcgggggcagcaagcagctgatccccaagaagcggggctaccccacccaggtgtacgggggcatccacgggaagatccggctgacctggcgctggctcaagctgctgcggcgcaagaagatgtccatcgagctcagcgagctgcagctgctcaagtga

SEQ ID NO: 1697 - RNA, 3450 nt, synthetic construct
  misc_feature 1..3450: note = Cas9 variant
  source 1..3450: mol_type = other RNA
atggagcgctaccacatcggcctggacatcgggaccagctccatcggctgggccgtgatcggggacgacttcaagatcaagcggaagaagggcaagaacctcatcggggtccgcctgttcaaggagggcgacaccgccgcggagcggcgcggcttccggacgcagcgccggcgcctgaaccggcgcaagtggcggctcaagctgctggaggagatcttcgacccctacatggccgaggtggacaagtacttcttcgcccgcctcaaggagagcaacctgtccccgaaggacagcaacaagaagtacctggggtccctcctgttccccgacatcagcgactccaacttctacgacaagtaccccaccatctaccacctccggcgcgacctgatggagaaggacaagaagttcgacctgcgggagatctacctggccatccaccacatcgtgaagtaccgcggcaacttcctcgagaaggtccccgccaagaactacaagaacagcggggcgtccatcggcttcctgctggaggaggtgaacgacctctacgggaacatcatcggcaacgaggacgtggccatcctggacaacgacaagttcgaggacgtcgagaagatcatcctgaacgacgagatccggaacatcgacaagcagaagaacgtgggccgcctcctggtgaaggacaagaaggagaagaacatcgtcaccgccttcagcaaggccatcttcgggtacaagttcaacctggaggacctcctgctgatcgagtccgacgagaagaacaagctcaccttcaacgacgagaacatcgacgacatcttcaacgagctgagccactccctgaacgacaaccagatggacctcctgacgaagacccgggagatctacttcaagttcaagctgaacatgatcgtgccgaccggctacaccatcagcgagtccatgatcgagaagtacgagatgcacaaggcgcacctcaagatgtacaaggagttcatcaacacgctgaacgccaaggaccgcaagatcctgaagaacgcctacagcgactacatcaacaacgagaaggccaaggccgcgaacgcccaggagaacttctacaagaccgtgaagaagaccatcaaggagaacgactccgacaccgccaagaagatcatcgggctcatcgacgagggcaacttcatgcccaagcagcggacgggcgagaacggggtcatcccccaccagctgcaccagatcgagctggaccgcatcatcgagaaccaggccaagtactacccctggctcgccgaggagaacccggtggagaagaaccgcaagttcgcgaagtacaagctggacgagctggtgaccttccgggtcccctactacgtgggccccctcatcgacaagaccgagagcaacaagaacgagaaggagaccaagttcgcctggatggtgcgcaaggccaaggggacgatcaccccctggaacttcgagaacctggtcgaccggaccgagtccgccaaccgcttcatcaagcggatgaccagcaaggacacgtacatcatcggcgaggacgtgctgccggccagctccctcctgtacgagaagtacaaggtgctgaacgagctcaacaacatcaaggtcaacaagaagaagctggacgtggagcagaagcagcacgtgtacctggacctgttcaccacccgcaagaacgtcaccaaggacgacctcgcgacgagcctgaactgcgacgtggagtccatcaccgggctgaccgacaacaagaagttcaacagctccctcagctcctacatcgacctgaaggccatcctgggcaacatcgtcgacgactacagcaagaacgaggacctcgagaagatcatcgagtactccaccatcttcgaggacggcaacatctacaaggagaagctgagcgagatctcctggctgacggacgagcagatcgagaagctcagcaacatccacttcaaggggtggggccggctgtccaagaagctgctcacccagatcaccaacgagaacggggagcgcatcatcgacaccctgtggaacacgagcaacaacttcatccaggtgatctccgacgagagcatccaggccaagctggccgagatcaacggcgagtacgccaacaagtacaacctcgaggacatcctggacgaggcgtacaccagcccccagaacaagaaggccatccgccaggtgatgaaggtcgtggaggacatcgagaaggccatgaagtgcgagcccacctccatcgccatcgagttcacccgggagaagcggaagtccaagctgacgaacacccgctacaagaagatcagcgagacctacgagaagatcaccgacgagctcatcagcgagtacgagctggggaagctgcagtccgagctcgacagcaaggtgaacaacatgcgggaccgctactacctgtacttcatgcagctgggccgggacatgtacaccggcgagaagatgaacatcgacgagctccaccagaagtacgacatcgaccacatcctgccccagtccttcatcaaggacgacagcctgaacaaccgcgtcctcacgtccaagagcgtgaacatcaaggagaagtccgacaagaccgcggccgacctgtacgccgccaagatgggggacttctggcggaagctgcgcaagcagggcctcatgaccgagcagaagtacaagaacctgctgacccggacggacagcatcaacaagtacaccaagcagtccttcatcaagcgccagctcgtggagaccagccaggtcgtgaagctggccgcgaacatcctgcaggacaagtaccgcaacaccaagatcatcgagatccgggcccgcctcaactccgacctgcggaagaagtacgagctgatcaagaaccgcgaggtgaacgactaccaccacgccatcgacgggtacctcacgaccttcgtcggccagtacctgtacaaggtgtacccgaagctgcggagctacttcgtgtacgacgacttcaagaagctcgactccaactacctgaagcacatggacaagttcaacttcatctggaagctggaggacaagaaggccgaggacgtctacgacaaggtgaacgacgagttcgtgctcaacgtccccgagatgaaggagtacatccgcaagatctacaactacaagtacatgctggtgagcaaggaggtgaccaccaagaacggggccttctacgaccagacgaagtacaacgcgaagaccatcaacctgatccccatcaagaaggacaagcccaccaacatctacggcggctacaaggggaaggtctccagctacatgatgctcgtgaagatccagaagaagaaggaggtgatctacaagttcgtcggcgtgccgcggctgtggaccgacgagctggaccgcctcatcgacacggacgagaagaaggccctgctgaagaagtga

SEQ ID NO: 1698 - RNA, 3459 nt, synthetic construct
  misc_feature 1..3459: note = Cas9 variant
  source 1..3459: mol_type = other RNA
atgaacgccgagcacggcaaggaggggctgctcatcatggaggagaacttccagtaccgcatcggcctggacatcgggatcaccagcgtgggctgggccgtcctgcagaacaactcccaggacgagcccgtgcggatcaccgacctcggggtgcgcatcttcgacgtcgcggagaacccgaagaacggcgacgccctggccgcgccccggcgcgacgcccggacgacccgccggcgcctgcggcgccggcgccaccggctcgagcgcatcaagttcctgctgcaggagaacggcctcatcgagatggacagcttcatggagcggtactacaaggggaacctgcccgacgtgtaccagctgcgctacgagggcctcgaccggaagctgaaggacgaggagctggcccaggtgctcatccacatcgccaagcaccgcgggttccggtccacccgcaaggccgagaccaaggagaaggagggcggggccgtcctgaaggcgacgaccgagaaccagaagatcatgcaggagaagggctaccggaccgtgggcgagatgctgtacctcgacgaggccttccacaccgagtgcctgtggaacgagaaggggtacgtgctgacgccccgcaaccgcccggacgactacaagcacaccatcctccggagcatgctggtcgaggaggtgcacgccatcttcgccgcccagcgcgcgcacggcaaccagaaggccaccgaggggctggaggaggcctacgtggagatcatgacctcccagcggagcttcgacatgggccccggcctccagcccgacgggaagccctccccgtacgccatggagggcttcggggaccgcgtcggcaagtgcacgttcgagaaggacgagtaccgggcccccaaggcgacctacaccgccgagctgttcgtggccctgcagaagatcaaccacaccaagctcatcgacgagttcgggacgggccgcttcttcagcgaggaggagcggaagaccatcatcggcctgctgctctccagcaaggagctgaagtacgggaccatccgcaagaagctgaacatcgacccctccctcaagttcaacagcctgaactactccgccaagaaggagggcgagaccgaggaggagcgggtgctggacacggagaaggccaagttcgcgagcatgttctggacctacgagtactccaagtgcctcaaggaccgcaccgaggagatgcccgtcggggagaaggccgacctgttcgaccggatcggcgagatcctgaccgcctacaagaacgacgacagccgctccagccggctcaaggagctggggctgtccggcgaggagatcgacggcctcctggacctgagcccggccaagtaccagcgcgtgagcctcaaggccatgcggaagatgcagccctacctggaggacgggctgatctacgacaaggcgtgcgaggccgccggctacgacttccgcgccctcaacgacgggaacaagaagcacctcctgaagggcgaggagatcaacgcgatcgtgaacgacatcacgaaccccgtcgtgaagcggtccgtgagccagaccatcaaggtcatcaacgccatcatccagaagtacgggtccccgcaggccgtgaacatcgagctggcccgcgagatgagcaagaacttccaggaccggaccaacctcgagaaggagatgaagaagcgccagcaggagaacgagcgcgccaagcagcagatcatcgagctgggcaagcagaacccgaccggccaggacatcctgaagtaccggctctggaacgaccagggcgggtactgcctgtactccgggaagaagatccccctggaggagctgttcgacggcggctacgacatcgaccacatcctgccctacagcatcacgttcgacgactcctaccgcaacaaggtgctggtcaccgcgcaggagaaccggcagaaggggaaccgcaccccctacgagtacttcggcgccgacgagaagcggtgggaggactacgaggccagcgtgcgcctcctggtccgggactacaagaagcagcagaagctgctcaagaagaacttcaccgaggaggagcgcaaggagttcaaggagcggaacctgaacgacacgaagtacatcacccgcgtggtgtacaacatgatccggcagaacctggagctcgagccgttcaaccaccccgagaagaagaagcaggtctgggccgtgaacggggccgtgacctcctacctgcgcaagcggtggggcctgatgcagaaggaccgcagcaccgaccggcaccacgcgatggacgccgtcgtgatcgcctgctgcacggacgggatgatccacaagatctcccgctacatgcagggccgggagctcgcctacagccgcaacttcaagttccccgacgaggagaccggcgagatcctgaaccgggacaacttcacccgcgagcagtgggacgagaagttcggggtgaaggtccccctgccgtggaactccttccgggacgagctcgacatccgcctgctgaacgaggaccccaagaacttcctcctgacccacgccgacgtgcagcgcgagctggactaccccggctggatgtacggggaggaggagagccccatcgaggagggccggtacatcaactacatccgccccctcttcgtgtcccggatgcccaaccacaaggtcaccgggagcgcgcacgacgccacgatccgctccgcccgggactacgagacccgcggcgtggtgatcaccaaggtccccctgaccgacctgaagctcaacaaggacaacgagatcgagggctactacgacaaggacagcgaccggctgctgtaccaggccctcgtgcgccagctgctgctccacgggaacgacggcaagaaggcgttcgccgaggacttccacaagccgaaggccgacgggacggagggccccgtggtccggaaggtgaagatcgagaagaagcagacctccggggtgatggtccgcggcggcaccgggatcgccgccaacggcgagatggtgcggatcgacgtgttccgcgagaacgggaagtactacttcgtccccgtgtacaccgcggacgtggtccggaaggtgctgcccaaccgcgccgccacgcacaccaagccgtacagcgagtggcgggtgatggacgacgccaacttcgtcttcagcctgtactcccgcgacctcatccacgtcaagagcaagaaggacatcaagaccaacctggtgaacggcgggctgctcctgcagaaggagatcttcgcctactacaccggcgcggacatcgccacggcctccatcgccggcttcgccaacgacagcaacttcaagttccgggggctgggcatccagtccctcgagatcttcgagaagtgccaggtggacatcctggggaacatcagcgtggtgcgccacgagaaccggcaggagttccactga

SEQ ID NO: 1699 - RNA, 3462 nt, synthetic construct
  misc_feature 1..3462: note = Cas9 variant
  source 1..3462: mol_type = other RNA
atgaagaacatcctgggcctcgacctggggctgagctccatcggctggagcgtgatccgcgagaactccgaggagcaggagctcgtcgccatggggagccgggtggtgtccctgaccgccgcggagctgagctccttcacccagggcaacggggtcagcatcaactcccagcgcacgcagaagcggacccagcgcaagggctacgaccggtaccagctccgccggaccctgctgcgcaacaagctcgacaccctgggcatgctgcccgacgacagcctctcctacctgccgaagctgcagctctgggggctgcgggccaaggccgtgacgcagcgcatcgagctgaacgagctcggccgggtgctgctgcacctcaaccagaagcgcgggtacaagagcatcaagtccgacttcagcggcgacaagaagatcaccgactacgtcaagaccgtgaagacccggtacgacgagctgaaggagatgcgcctgacgatcggggagctgttcttccggcgcctcaccgagaacgccttcttccggtgcaaggagcaggtctacccccgccaggcctacgtggaggagttcgactgcatcatgaactgccagcggaagttctaccccgacatcctgaccgacgagaccatccgctgcatccgggacgagatcatctactaccagcgccccctcaagtcctgcaagtacctggtgagccgctgcgagttcgagaagcggttctacctgaacgcggccggcaagaagacggaggccggcccgaaggtgtccccgcgcaccagccccctcttccaggtctgccggctgtgggagtccatcaacaacatcgtggtgaaggaccgccggaacgagatcgtcttcatcagcgccgagcagcgcgcggccctgttcgacttcctcaacacccacgagaagctgaaggggagcgacctgctcaagctgctgggcctctccaagacctacgggtaccggctgggcgagcagttcaagacgggcatccaggggaacaagacccgcgtggagatcgagcgggccctgggcaactaccccgacaagaagcgcctcctgcagttcaacctgcaggaggagagctccagcatggtgaacaccgagaccggggagatcatccccatgatctccctcagcttcgagcaggagcccctgtaccggctgtggcacgtcctctactccatcgacgaccgcgagcagctgcagagcgtgctgcggcagaagttcggcatcgacgacgacgaggtgctggagcgcctctccgccatcgacctggtcaaggccgggttcggcaacaagagctccaaggcgatccggcgcatcctgcccttcctccagctgggcatgaactacgccgaggcctgcgaggccgccgggtacaaccacagcaacaactacacgaaggcggagaacgaggcccgggccctgctcgaccgcctgcccgccatcaagaagaacgagctgcggcagccggtggtggagaagatcctcaaccagatggtcaacgtggtcaacgccctgatggagaagtacggccgcttcgacgagatccgcgtggagctggcgcgggagctcaagcagtccaaggaggagcgcagcaacacctacaagtccatcaacaagaaccagcgggagaacgagcagatcgccaagcgcatcgtggagtacggggtccccacccggagccgcatccagaagtacaagatgtgggaggagtccaagcactgctgcatctactgcggccagcccgtggacgtgggggacttcctgcggggcttcgacgtcgaggtggagcacatcatccccaagagcctgtacttcgacgactccttcgccaacaaggtgtgcagctgccgcagctgcaacaaggagaagaacaaccggaccgcctacgactacatgaagtccaagggcgagaaggccctcagcgactacgtcgagcgcgtgaacacgatgtacaccaacaaccagatctccaagaccaagtggcagaacctgctgaccccggtggacaagatcagcatcgacttcatcgaccggcagctccgcgagtcccagtacatcgcgcggaaggccaaggagatcctgacgagcatctgctacaacgtcaccgccacctccgggagcgtgacctccttcctgcgccacgtgtggggctgggacacggtcctccacgacctgaacttcgaccggtacaagaaggtggggctgaccgaggtgatcgaggtcaaccaccgcggcagcgtgatccggcgcgagcagatcaaggactggtccaagcggttcgaccaccgccaccacgccatcgacgcgctcaccatcgcctgcaccaagcaggcctacatccagcggctgaacaacctgcgcgccgaggaggggcccgacttcaacaagatgagcctcgagcgctacatccagtcccagccccacttcagcgtggcccaggtccgggaggcggtggaccgcatcctggtgtccttccgggccggcaagcgcgccgtcacgcccggcaagcggtacatccgcaagaaccggaagcgcatcagcgtgcagtccgtgctgatcccgcgcggggccctcagcgaggagagcgtctacggcgtgatccacgtgtgggagaaggacgagcaggggcacgtcatccagaagcagcgggccgtgatgaagtaccccatcacctccatcaaccgggagatgctggacaaggagaaggtggtcgacaagcgcatccaccggatcctgagcggccgcctcgcgcagtacaacgacaaccccaaggaggccttcgccaagcccgtgtacatcgacaaggagtgccggatcccgatccgcaccgtgcggtgcttcgccaagcccgccatcaacaccctggtccccctgaagaaggacgacaagggcaaccccgtggcgtgggtgaacccggggaacaaccaccacgtcgccatctaccgcgacgaggacggcaagtacaaggagcggaccgtgacgttctgggaggccgtggaccgctgccgcgtcgggatccccgccatcgtgacccagcccgacaccatctgggacaacatcctccagcggaacgacatctccgagaacgtgctggagagcctgccggacgtcaagtggcagttcgtgctctccctgcagcagaacgagatgttcatcctgggcatgaacgaggaggactaccgctacgcgatggaccagcaggactacgccctcctgaacaagtacctgtaccgggtgcagaagctcagcaagtccgactacagcttccgctaccacaccgagacgtccgtcgaggacaagtacgacgggaagcccaacctgaagctgagcatgcagatgggcaagctcaagcgggtgtccatcaagagcctgctgggcctcaacccccacaaggtgcacatctccgtcctgggggagatcaaggagatcagctga

SEQ ID NO: 1700 - RNA, 3474 nt, synthetic construct
  misc_feature 1..3474: note = Cas9 variant
  source 1..3474: mol_type = other RNA
atgaactactacaacggcttcatcatcaccgagaacgccatgaccagcaagcaggagaagcacggggccctgacgttcggcctcgacatcgggatcgcgtccgtgggctgggccgtcctgggggagagccgcatcgtggacctgggcgtgcggtgcttcgacaaggccgagaccgccaaggagggcgagtccctcaacctgacccgccggatggcccgcctgctccggcgccggctgcgccggcgcgcgtggcggctgaccaagctcgcccgcctgctgaagcgggaggggctcatcgccgacgccaacctgttcaagcacaagatcgagaagaacacgcccgtccccaagagctcctggcagctgcgcgtggacggcctcgaccggcagctgaacgcggaggagtgggcccgcgtgatctaccacctgtgcaagcaccgggggttccactggatcagccgcgccgaggagaaggccgccgagggcgactccaagggggagggcggcaaggtcaagcaggggctcgcgggcaccaagaagctgatgcaggagaagtcctaccggaccgccgccgagatggtgctggccgagttccccgacgcccagcgcaacaagcagggggactacagcaaggcgctcagccggatcctgctgggcgacgagctcaaggccctgttcgagcaccagcgcaagctgggcaaccccgtggccaccgagaagctcgaggccgccatcctggggaacggcgacaagaagtgcgggctgttctgggcgcagaaccccgccctcgccggcaacaagctgctggagatgctcgggcgctgcacgttcgagaagaccggcggcgacgacgggaagggcgagtaccgggccccgaaggcctccttcagcgcggagcgccacgtctggctgacccacctgaacaacctccggatcgtggtggacgggaccacgcgccccctgaacgaggccgagcggcgcgtcgccctgcccatgccctaccagcaggccggcgacctctcctacaagcagctcgggggcgcgctgatcaaggagggcttcctccagaaggacgggttcaagttcgccggcctgccgtaccccaccaagcaggccagcgaggagaaggccaaggaccccgagacctccgtgctgtgcaagctccccgcctggcacaccctgcggaagacgctggagaagcacgggctcgagagcgagtggcagaagctgtccaccgacgcgctggacggcaagccgcagctgctcgacaacatcgcctgggtgctgagcgtctacaaggacgacgacgaggtgaagaccgagctggggaagctcaacctgcccaacaccgagaagatgatcgacgccctgctcgacatccgcttcgacaagttctccaacctgagcctgaaggccctcagcaagatcgtgcccttcatggagcagggccagcggtacgacgaggccgtcgcgaacatccccgagtacggccaccactcccagctgcacaaggtgggggccggcgagcacaagtacctgccgcccttctacaaggagcgcgacaagacggggcggatggtgttcaacgacgacatggacatcccccgcaaccccgtcgtgctccgggccctgaaccaggcccgcaaggtggtcaacgccctgatcaaggagtacggcagcccgcacgaggtgcacatcgagatggcgcgggacctctcccgccccctggacgagcggcgcgacatcgagaagctgcagaaggagttcggcgagcggaacaagaaggacaaggagctgttcgcccaggacttcaacatcgtcgggaccgtgaagggcaagcagttcgagaagtaccagctgtaccgcgagcagcaggggaagtgcatctaccccagcatggacgagaagcagggcatctgctgctactccctgaagcccctcgacctgcaccgcgtgctgtacgaggaggggtacgccgagatcgaccacgccctcccgtacagccggtccttcgacgacagcaagaacaaccgcgtcctggtgctggcgaaggagaaccgggacaagggcaaccgcacccccttcgagtacctcggcgacaaggacaactccgagccctggcggcagttcgtggccttcgtcgaggggaacaaggcctaccgcctggccaagcggagccgcctgctccggaaggacttcggcgacaaggaggccaaggagttccgcgagcggaacctgaacgacacccgctacatctgcaagttcttcaagaactacgtggagcagtacctgcagctccacgaggactccgaggcgaagcggtgcgtggtcctgagcgggcagatgacgtccttcctgcgcgcccggtggggcctcgtgaaggtgcgcggggacagcgaccggcaccacgccctggacgccgccgtcgtggcggcctgctcccacggcatggtgaagcgcctgagcgactactcccggcgcaaggagctcgagcaggtccgggagggcttcgtggacgtggacaccggggagatcgtcaaccccgccatgttccagcaggtccaggagcacttcccgaacccctggccccacttccgcgacgaggtgaagctgcgcctgagcatcgacgacccgaccctcctgcggtccgagatggagaagttcggcacctacacgcccgagagcctggaggccctccgccccctgttcgtgagccgggccccgcagcgccggaactccggggcggcccacaaggacaccatctacgcccagccgaagcgcctggtggcccagggcggggtgacccagaaggtcgcgctcagctccctgaccctgaaggacctcgacaagctgatcgacccccaccggaacgagcgcctgtacgccgccatccgggcccgcctcgagcagcacggcggcaagggggacaaggccttccccgcgagcaaccccctgcggaagccggactccgagggcaaccccacggggcccatcgtgcgcggcgtgaccatggtcatcgacaagctgagcgggatccccatccggggcggcatcgccaagaacgactccatggtgcgcgtggacgtcttcaccaaggccaacaagttccacctcgtgccggtgtacgtccaccacagcgtgctggggctgcccaaccaggccatcgtgggcgggaaggaggagtccgagtggacccagatcgacgacagcttcgactggcacttctccatctaccccaacgacctcatccgggtcacgctgaagcaggagggccgcttcggctactacgccgggtgcgaccggagcaccgcggccatccacctgtgggcccacgaccgcaaccagcaggtcggcaaggacgggctcatccggtccatcggcgtgaagaccgccctgagcatcgagaagttcaacgtggacgtgctggggaaccgctaccccgccccgcccgagaagcgccgggacctcgcgtga

SEQ ID NO: 1701 - RNA, 3486 nt, synthetic construct
  misc_feature 1..3486: note = Cas9 variant
  source 1..3486: mol_type = other RNA
atgaagaagatcctgggcctcgacctggggagcgcctccatcggctgggccctggtggaggagaccgagcagatgcagtacaacatcgtcagcctcgggtcccgcatcatcccctacaacggcaccgaggggcaggagttcgagaagggcacgggcgagagccggaactccctgcgcaccaaggcgcggaccgcccgcaaggggtacgaccggtaccagctgcgccggaagaacctcgagaagatcctgctgcagaacggcatgtacccgaacgagcaggtccgcgccctccagaagctggagctgtggaagctccgggccgacgcccccaacgtgcagatcagcctgcccgagctggggcgcctcctgttctggctgaaccagaagcggggctacaagtccagccgctccgacgcgaacctcgacaagaaggacaccgagtacgtggccacggtcaagagccggcaccagaagatcaaggacgccgggcagaccgtgggccagtacttctacggccagatcctggagaacgagtaccaccgcatcaaggagcaggtcttcccccgggaggcctacatcgaggagttcgacgcgatcgtggcccgccagaaggagtactacccgaccatcctgaagcaggagctcatcgacaagatccggaacgaggtgatctacttccagcgcgggctgaagtcccagaagggcctggtgagcgtgtgcgagttcgaggggcgggagttcaacggccacttcggcgggcccaaggtggcccccaagtccagccccatcttccagctcggcaagatctgggagaacatcaacaacatcaagatcgccgacatcgagctgaccgccgagcagaagctggtcttcttcaactacctcaactgccacgagcgcatcacggaggcgaagatccgggagctgctgaagctctccaaggacagccgcctgaacgggcagctgaagaacggcctcaccgggaacaagacctactcccagatcgccagctgcttcggcaacaagatcggcgagtacgagcgcctgttcaagttcgagctggaggtgatcgagtccgagaagctcgagtacacctaccaccccaagagccacatcccggtgggggagaagcggcgcaagtacatcagcgagaacgtcgagaaggagccctactaccggctgtggcacacgatctactccatcaaggacaaggacgagtgccgcgccgccctgatcaagaacttcggcatcgaggaggagatcgccgagaagctcgcgagcctggacttctccgccgggggcttcgggaacaagtgcgccaaggtgatccggaagatcctgccctacctcatggagggcgacaagtacaacgtggccatggactacgccggctacaaccacagcttctcccagaccaaggacgagaacctgcagcgcgtcctgctcgacagcatcaaccacctcccgaagaactccctgcggcagcccatcgtggagaagatcctcaaccagatgatcaacctggtgaacgaggtcatcaagcagtgggggcgccccgacgagatccgggtggagctggcgcgcaagctgaagcagagcaagaccgagcggaacgacgacgacaacttcatgcgcaagcgggagcgcgagaacgagatcatcaaggccgacctcgccaagtacggcctgaaggccacccggaacaacgtgatcaagtggcgcctgtaccacgagatcgacgacaaggacaagaagctcaacgcccggtgcatctactgcgggcagcccatctccctgacggaggcgatcctgggcaacaacgtcgacgtggagcacatcatcccgaaggacaagctgttcgacgacagccagtccaacaagaccctggcccaccgcagctgcaactccgggaagggcaacaagaccgcctacgacttcatgaaggacaagccccagttcgaggagtacgtcgcccgggtggaggagctgtacaagaagcacctcatcagcctgaccaagaagcgcaagttcctgatgtccgaggacaagatccccagcgacttcatcgaccgccagctccgggagtcccagtacatcgcgcgcaagagccgggagatcctgcagacggtgtgccgcaacgtctggtccaccgacggcggggtgaccgcccacctccggaagctgtggggctgggacgacgtgaccatgaacctgcagatgcccaagtacaaggggatcggcatgacggagatcgtcgagtgggagagcaaccacggcaagaaccagcacacccaggaggtgatcaaggactggagcaagcgcgacgaccaccggcaccacgccatcgacgccctggtggtcgcctgcacccgccaggggtacatccagcggatcaacaccctcaactccagcgagacgaaggacgagatgcaccgcaaggtggcgggctccctggtggagttcaaccagaagcacaccctgctcaacaagtacctgatcaccgagaagccgttcaccacgagcgaggtcgaggacgtggtgtccaagatcctggtcagcttcaaggccgggaagaaggccgccacccccggcaagcggaaggtggggaagcgcggcaacaagcaggtcgtgcaggacggcatcatcatcccccgcggggccctccacgcggactccgtgagcggctccatcaagcagtacgaccccaccgggaacttcgagaaccacaacgtgatcaagtacaaggtcggcgtggggaagggctacctgttcgacggcaaggacgacaagaagaagatcgacaagaccatcgactgcatcgtggacaagaagatccgggacctgatcaagcagcgggccgaggagagcaactactccctcaagaagatgttcgagacgccgatcctgttcaaccagcgcgccgtcttcagcgtgcggtgcaagaccgggaacaaggccgtggtccccatccgcaacggctacgtggtgcccgacaacaaccaccacaccgccatctacaagtacgacgggggcctgaaggagcagtgcgtctccctcatgcaggcgatcgagcggaagcgctacaacctgcccatcatcatcaagaacccgaaggagatctacgacaagatcaccgagatcgccaacatcaaccagctcctgttcgacagcctgcccaagctggactgggagttcgtgaccacgctccagaagaacgacatgttcatcctggggatggactactccgccaccgaggaggccctggcggacggcaactaccggctcctgagcgagtacctgtacaaggtgcagaacatctccgacggcatctaccgcctctgccaccacaccatcaccaagttcgacctgagcaaggccaacaagcccgacaagcgcttctacaacatccagagcctgaaggcctggaacacgctcaacccgcagaaggtcaagatcaacatcctggggcagatcgagcggcagtga

SEQ ID NO: 1702 - RNA, 3501 nt, synthetic construct
  misc_feature 1..3501: note = Cas9 variant
  source 1..3501: mol_type = other RNA
atgcacgtggagatcgacttcccccacttcagccgcggcgactcccacctggccatgaacaagaacgagatcctccgggggagctccgtcctgtaccgcctgggcctcgacctggggagcaactccctgggctggttcgtgacccacctcgagaagcgcggggaccggcacgagccggtggccctgggccccggcggggtccggatcttccccgacggccgcgacccccagagcgggacctccaacgcggtggaccggcgcatggcccggggcgcccgcaagcggcgcgaccggttcgtggagcgccggaaggagctgatcgccgccctcatcaagtacaacctgctgccggacgacgcgcgcgagcggcgcgccctcgaggtcctggacccctacgccctgcggaagacggccctcaccgacaccctgcccgcgcaccacgtggggcgcgccctgttccacctcaaccagcggcgcggcttccagagcaaccgcaagaccgactccaagcagagcgaggacggcgccatcaagcaggccgcctcccggctggcgacggacaaggggaacgagaccctgggcgtgttcttcgccgacatgcacctccgcaagagctacgaggaccggcagaccgccatccgcgccgagctggtccggctggggaaggaccacctcaccggcaacgcccgcaagaagatctgggcgaaggtgcggaagcgcctgttcggcgacgaggtgctgccccgggccgacgccccgcacggggtccgcgcccgggccacgatcaccggcaccaaggcgtcctacgactactaccccacccgcgacatgctccgggacgagttcaacgccatctgggccgggcagagcgcccaccacgccacgatcaccgacgaggcgcgcaccgagatcgagcacatcatcttctaccagcggcccctgaagcccgccatcgtgggcaagtgcaccctggacccggccacgcgccccttcaaggaggaccccgaggggtaccgggccccctggtcccacccgctcgcgcagcgcttccggatcctgagcgaggcccgcaacctggagatccgcgacaccggcaagggctcccggcgcctcaccaaggagcagagcgacctggtggtcgccgccctgctcgccaaccgggaggtgaagttcgacaagctgcgcaccctgctcaagctgcccgcggaggcccggttcaacctggagtccgaccgccgggccgccctcgacggggaccagacggccgcgcgcctgagcgacaagaagggcttcaacaaggcctggcgggggttcccgcccgagcgccagatcgccatcgtggcccggctggaggagaccgaggacgagaacgagctcatcgcctggctggagaaggagtgcgcgctggacggcgccgccgccgcgcgcgtcgccaacaccaccctccccgacgggcactgccggctgggcctgcgcgccatcaagaagatcgtgcccatcatgcaggacggcctggacgaggacggggtggccggcgccgggtaccacatcgcggccaagcgggccggctacgaccacgccaagctccccacgggggagcagctgggccgcctgccctactacggccagtggctccaggacgccgtcgtggggagcggcgacgcgcgggaccagaaggagaagcagtacgggcagttcccgaaccccaccgtgcacatcggcctgggccagctgcgccgggtcgtgaacgacctcatcgacaagtacgggccgcccaccgagatctccatcgagttcacccgcgccctgaagctgagcgagcagcagaaggccgagcggcagcgcgagcagcgccggaaccaggacaagaacaaggcccgcgccgaggagctcgcgaagttcggccggcccgccaacccccgcaacctgctgaagatgcggctctgggaggagctggcccacgaccccctggaccgcaagtgcgtctacacgggggagcagatctccatcgagcggctcctgagcgacgaggtggacatcgaccacatcctgccggtggccatgaccctcgacgactcccccgcgaacaagatcatctgcatgcgctacgccaaccggcacaagcgcaagcagacccccagcgaggccttcggctccagccccaccctgcaggggcaccggtacaactgggacgacatcgccgcccgcgcgacgggcctgccgcggaacaagcgctggcggttcgacgccaacgcccgcgaggagttcgacaagcggggcgggttcctcgcccgccagctgaacgagaccggctggctggcccggctcgcgaagcagtacctgggggccgtcaccgaccccaaccagatctgggtggtgcccggccgcctgacctccatgctccgcgggaagtggggcctgaacggcctgctccccagcgacaactacgccggggtccaggacaaggccgaggagttcctggcctccacggacgacatggagttcagcggcgtgaagaaccgggcggaccaccgccaccacgccatcgacgggctggtgaccgccctcaccgaccggtccctgctgtggaagatggccaacgcctacgacgaggagcacgagaagttcgtcatcgagccgccctggcccaccatgcgcgacgacctcaaggcggccctggagaagatggtggtgagccacaagcccgaccacggcatcgaggggaagctgcacgaggactccgcctacggcttcgtcaagccgctcgacgccaccggcctgaaggaggaggaggcggggaacctggtgtaccggaaggccatcgagagcctcaacgagaacgaggtggaccgcatccgggacatccagctgcgcacgatcgtccgggaccacgtgaacgtggagaagaccaagggcgtcgccctggccgacgccctccgccagctgcaggcgccctccgacgactacccccagttcaagcacgggctgcggcacgtgcgcatcctcaagaaggagaagggcgactacctggtgcccatcgccaaccgggccagcggggtcgcctacaaggcctactccgcgggcgagaacttctgcgtggaggtgttcgagaccgccggcgggaagtgggacggcgaggccgtccgccggttcgacgccaacaagaagaacgccgggccgaagatcgcgcacgcgccccagtggcgcgacgccaacgagggcgccaagctggtgatgcggatccacaagggcgacctcatccgcctggaccacgaggggcgggcccgcatcatggtggtccaccggctggacgccgccgccggccgcttcaagctcgccgaccacaacgagaccgggaacctggacaagcgccacgcgacgaacaacgacatcgaccccttccggtggctgatggccagctacaacaccctcaagaagctggccgccgtgcccgtgcgcgtcgacgagctgggccgggtgtggcgcgtgatgccgaactga

SEQ ID NO: 1703 - RNA, 3507 nt, synthetic construct
  misc_feature 1..3507: note = Cas9 variant
  source 1..3507: mol_type = other RNA
atggcccgccccgccttccgggcgccgcgccgggagcacgtgaacggctggacccccgacccccaccgcatcagcaagcccttcttcatcctggtctcctggcacctcctgagccgggtggtgatcgactccagctccgggtgcttcccgggcaccagccgcgaccacacggacaagttcgccgagtgggagtgcgccgtccagccctaccggctgtccttcgacctcgggaccaacagcatcggctgggggctgctgaacctcgaccgccagggcaagccccgggagatccgcgccctgggctcccggatcttcagcgacgggcgcgacccccaggacaaggcctccctggcggtggcccggcgcctcgcccggcagatgcgccggcgccgggaccgctacctgacccggcgcacccgcctgatgggcgccctcgtgcggttcgggctgatgccggcggaccccgccgcccgcaagcggctggaggtcgccgtggacccctacctcgcccgcgagcgggcgacgcgcgagcggctggagcccttcgagatcggccgcgccctgttccacctcaaccagcggcgcgggtacaagccggtgcggaccgccaccaagcccgacgaggaggccggcaaggtcaaggaggccgtggagcgcctggaggcggccatcgccgccgccggcgcgcccaccctgggggcctggttcgcctggcggaagacgcgcggcgagaccctccgggcccgcctggccgggaagggcaaggaggcggcctaccccttctacccggcccggcgcatgctggaggccgagttcgacaccctctgggcggagcaggcccggcaccaccccgacctgctgaccgccgaggcccgcgagatcctccgccaccggatcttccaccagcgccccctgaagcccccgcccgtgggccggtgcacgctgtaccccgacgacgggcgcgcgccccgggccctcccgagcgcccagcgcctgcggctgttccaggagctcgcctccctgcgcgtcatccacctggacctcagcgagcggcccctgacccccgccgagcgcgaccggatcgtggccttcgtgcagggccggcccccgaaggcggggcggaagcccggcaaggtccagaagtccgtgcccttcgagaagctgcgcgggctcctggagctgccgcccggcaccggcttcagcctcgagtccgacaagcggcccgagctgctgggggacgagaccggcgcccgcatcgcccccgccttcgggccgggctggacggccctccccctggaggagcaggacgcgctggtggagctcctgctgaccgaggccgagcccgagcgggccatcgccgcgctgaccgcccgctgggccctcgacgaggccaccgccgcgaagctggccggggccacgctgcccgacttccacggccggtacggccgccgggccgtcgccgagctcctgccggtgctggagcgcgagacccgcggggaccccgacggccgggtgcgccccatccggctcgacgaggcggtcaagctgctgcgcgggggcaaggaccacagcgacttctcccgggagggggccctcctggacgccctgccctactacggcgccgtgctcgagcgccacgtggccttcggcaccgggaacccggcggaccccgaggagaagcgggtcggccgcgtggccaaccccaccgtccacatcgccctgaaccagctgcggcacctcgtgaacgccatcctggcgcgccacgggcggcccgaggagatcgtgatcgagctggcccgcgacctcaagcggagcgccgaggaccgccggcgcgaggacaagcggcaggccgacaaccagaagcgcaacgaggagcggaagcgcctgatcctgagcctcggcgagcgcccgacgccccggaacctgctgaagctccgcctgtgggaggagcagggccccgtcgagaaccggcgctgcccctactccggggagaccatcagcatgcggatgctgctctccgagcaggtcgacatcgaccacatcctgccgttcagcgtgtccctggacgacagcgccgcgaacaaggtggtgtgcctccgcgaggccaaccggatcaagcgcaaccggtccccctgggaggccttcggccacgacagcgagcgctgggccgggatcctggcccgggcggaggccctgcccaagaacaagcgctggcggttcgcccccgacgccctcgagaagctggagggcgagggcggcctgcgcgcccggcacctcaacgacacccgccacctgtcccggctggcggtggagtacctccgctgcgtctgcccgaaggtgcgggtgagccccggccgcctgaccgccctgctccggcgccgctgggggatcgacgccatcctggccgaggccgacgggcccccgcccgaggtccccgcggagacgctggacccctccccggccgagaagaaccgggccgaccaccgccaccacgccctcgacgcggtggtgatcgggtgcatcgaccggagcatggtccagcgcgtgcagctggccgccgcctccgccgagcgggaggcggccgcccgcgaggacaacatccggcgcgtgctggagggcttcaaggaggagccctgggacgggttccgggccgagctcgagcgccgggcccgcaccatcgtcgtgagccaccggcccgagcacggcatcggcggggcgctgcacaaggagaccgcctacggccccgtggacccgcccgaggaggggttcaacctggtcgtgcgcaagcccatcgacggcctctccaaggacgagatcaacagcgtgcgggacccccgcctgcggcgcgccctgatcgaccggctcgccatccgccgccgggacgccaacgacccggcgaccgccctggccaaggccgcggaggacctggccgcccagcccgcctcccgcgggatccggcgcgtccgggtgctcaagaaggagagcaaccccatccgcgtggagcacggcggcaacccctccgggccgcggagcggcgggcccttccacaagctgctgctcgccggcgaggtccaccacgtggacgtggcgctgcgcgccgacgggcggcgctgggtcggccactgggtgacgctgttcgaggcccacggcgggcggggcgccgacggggccgcggccccgccccgcctcggcgacggcgagcggttcctgatgcgcctgcacaagggggactgcctcaagctggagcacaagggccgggtgcgcgtcatgcaggtcgtgaagctggagcccagctccaacagcgtggtggtggtcgagccccaccaggtgaagaccgaccggtccaagcacgtgaagatcagctgcgaccagctccgcgcccgcggggcccgccgggtcaccgtggaccccctgggccgcgtgcgcgtccacgcccccggggcgcgggtgggcatcggcggggacgccggccgcaccgccatggagccggccgaggacatctcctga

SEQ ID NO: 1704 - RNA, 3513 nt, synthetic construct
  misc_feature 1..3513: note = Cas9 variant
  source 1..3513: mol_type = other RNA
atgagcaagtacaacgtgggcctggacatcgggatcgcctccgtcggctggagcatcgtggacgccgacaagaagaagatcatcgacctcgggtcccgcatcttcagctccggcaacgcggccgccaaccaggagcggcgcgggttccggggcacccgccggctgatccgccggcgcaagaaccggctgaccgacgtgatcaacttcttcggcgagaagaagttcatcgacacgaaggtcgtggacaagaacgggcacgtgcactacaagttcagcgtcaacaacaccgagtccccctacgagctccgcgtgaagggcctgagcgagatcctgaccaagcaggagctcgtgatcgccctgtaccacatcgtcaagcaccgggggatctcctacgacctgggcgacctcgaggacgacgggaccagcggcgtgacggactacaagacctccatcaacatcaaccgccagctgctgaacgagaagaccgtgggccagatccagctcgagcggctgaacgagttcgggaaggtccgcggccaggtggaggagaacgagaacgtgaccctgctcaacgtcttcccgagcgccgcgtacgtgaaggaggccacgcagatcctgaccaagcagcgggagttctaccccgagatcaccgacgacttcatcgccaagttcatgctgttcatcacccgcaagcgggactacttcgtggggcccggcaacgagaagtcccgcacggactacggcatctacaagaaggacgggcggaccctcgacaacctgttcgacgagctgatcggcatcgacaagatcaacggggagaagcgcgccagcgcgtccagcctcaccgcccagatctacaacatgctgaacgacctgaacaacctcaccgtccccaacacggaggacggccggctgaccatccagaccaagaaggagatcctggaggccgccaagaccacgaacgggctgttcggcatcgcccagatctgcaagatcatcggctgcaagaaggacgacatcaaggggttccgcatcgacaagtccgagaagaagatcatgcacaccctgagcggctaccgcaagttccggaaggagctggcggacgtgaacatcgaggccaacgacctcaacatcaacctggtgaacaagatcgccgacatcctgaccctcaacaccgagaaggccgagatccgcaagcagctggacaagtccaacatggacatcagcaacgagatgaaggagatcgtcatcaacaagaacaaggagttcctggtggacgggcgggccacgtggcacagcttctcctacaagaccctcaacctgctgatcccggagctcctgaacacccccgaggagcagatgaccatcctgacgcgcctcggcctggtgaagcccaacaacaagaagtacgaggggctgaagaacatccccgcgcggcgcatcaccgaggagatctacaacccggtcgtggcccgggccacccgcgaggccgtcaacgtgttcaacgccatcaccaagaaggtgggccgggacaacatcaaggacgtcatcatcgagctcccccgcgaggacaacgaggtggacatcaagaagggcatcgtgaagcggcagaagcagaacgaggtcgagaaggagacggcggacgccctggtgaagcagcacatgaccatcagcgactccgccctgatcgcccagtaccgcaagatccgggggctcagccagaaggtgcgctactggtaccagcaggacaccatctgcccctactgcggcaagaagatcgaggccgtccagctgatcaacaacaacgactccttcgaggtggaccacatcgtgcccatcagcgtctccttcgacgacagccagaacaacaaggtgctggtgcactcccagtgcaaccaggcgaaggagaagcagaccccgctggggtggctcaacaacggcgggggcttcggccagagcaaggccgactacatcgcccgggtcaagtccaacaagaactacgccaagaacaagatcgacaacctgctgaacgagacggacctcaacgacatcgcgacccagcgcgggttcatccagcggaacctgaacgacacccgctacgccagccggatcgtgctgaacgagttctactccttcttccgcagcaacaacctctccaccaaggtgaaggtcgtgcgcggcaagtggaccagccagatgcggaagaagtggaacggggtgggcggcctgtccaagacgcgcgacacctaccaccaccacgccatcgacgcctgcatcatcgcctgcttccccctgctcaaggcgttcgacaaggccatcaagctgatcgacgtcgacggggagaccggcgagatcctgcaggacaagaaggccatcaagctcgcccaggaggccgagatcgtggagaagatcagcgtgatcaagaacaagaagttcgagaacatggtcaacgagatctacaacttccccctgttcaagcaggtcgagctggcgaacgacatcaccaacctcgagaaccccgtgaagttctcccaccacgtggacaagaaggccaaccgggccgtggccaaccagacgatctacgggacccgcatcaaggagaaggaggtgaccaagcggggcaagaaggagaagatccaggagcgctacaccctggggacgatcaagaacatctacgacatcgacggcttcatgaacttcaagaagctgtacgacaagatcagcaagaacgacgacgtcaagttcctcatgcagaagaacgacccgaagacctgggagaagctgatcgacatcttcaacagctaccccgactccgaggaggtgacccaggtggacggcaaggtcaagcgggtggccgtgagccccttcaagctgtactaccgcgagaacgggttcatcaccaagtactccaagcacaacgacggccccaaggtcgtgagcatcaagtactacgactccaaggtggggagccacatcgacatcacgccgaaggacgcgcggaacaaggtcatcctccagtccctgaagccctggcgcaccgacgtgtacttcaacagcatcacccagcagtacgagctgctcggcctgaagtactccgacctgaagttcaccaacggggtgtacggcatcacgcgggacgcctacgagaagctcaagcacggcgtcagcgaggacggggtgaccgcctggaagcccatctccaagaacagcgagttccgcttctccctgtaccggaacgaccgcgtgcgggtcatcgacgagaagggcgacagcatcgagctcctcttcgcctcccgcaccaccagcaacgaggggtacgtggagctgaagcccatctacaaggcgaagttcgactccaaggaggaggtgggcttctacgggctggtcagcaacggccggctcatcaagaagatgagcaagggcgggtacaagctgtacaaggtgaacacggacatcctgggcaagccgtactacgtgacccgcgagtccgacgagcccaagctcagcctgtga

SEQ ID NO: 1705 - RNA, 3516 nt, synthetic construct
  misc_feature 1..3516: note = Cas9 variant
  source 1..3516: mol_type = other RNA
atggccaagtacagcgtgggcctggacatcgggatctccagcgtcggctgggccatcatcgacatcgagaccaagcagatcgtgaacctcgggtcccgcatcttccccagcggcaacgcggccgggaaccaggagcggcgcggcttccggggcatccgccggctgatccgccggcgcaagaaccggctgaccgacctcaagaagctgctgggggagacgttcttctccgacctcaagaagatcgacagcaacggctacgagtactacgacatcgacttccagatcaacgccaacccgtacgagctgcgcgtgaaggggatcaccgagaagctgtccaagaaggagctcgccgtcgtgctgcaccacatcatcaagcaccggggcatcagctacgacctgggggacctcgaggacgacggcacctccggcgtgagcgactacaagaactccatcaacatcaaccgccagctgctgcgggagaagaccgtcgggcagatccagctcgagcgcctgatcgagttcaaccaggtgcacggccaggtgaagaaggccgaggacgtcagcctgctcaacgtgttcccctccagcgcgtaccgggacgaggccaacaagatcatgatcaagcagcaggagttctactccgagatcacgaacagcttcatggagcaggtcgaccagctggtgtcccgcaagcgggactacttcatcgggcccggcaacgagaagtcccgcaccgactacggcatctacaagagcgacgggcggaccctggacaacctcttcgccgagctgatcggcaccgacaagatcaacggggagaagcgcgccagcgcgagctccctgacggcccaggtgtacaacctcctgaacgacctgaacaacctccacgtgagcaacaccgaggacggcaagctgaccacctccacgaagaaggagatcatcaaggccgccaagaccaccgacggggtcttcggcatcagccagatctgcaagatcatcggctgcaagaaggaggagatcaccgggttccggcaggacaagtccgagaagaaggtgatccacacgctggccggctaccgcaagatccgcaaggcgctcgccaccatcaacatcgaggccaacgagctgaaccccaccgtgttcgaccagatcgccgacatcctgaccctcaacacggagaaggccgagatccggaagcagctggacaaggtccagctggacatcaccgacgagatgaaggagctcgtgatcgacaagaacaaggacttcctggtggacgggcgcgcgacctggcacagcttctcctaccagaccctgaacatgctcatcccggagctgctgaacacgagcgaggagcagatgaccatcctcacccggatgggcctgatgaagtccgacaacgagaagtaccgcgggctgaagaagatccccgccgagaagatcgccagcgagatcttcaaccccgtcgtggccaagtccacccgggaggccatcaaggtgttcaacgcgatcagcaaggagatcggcaagaacaacatcgagcacgtcgtgatcgagctcccccgcgacgacaacgaggaggacgagaagcggaagatccagaagctgcagaaggccaacgagacggagaaggaggccgccgacaacctggtcaagcacaagctcggcatctccgacagcgccctgatcgcgcactaccgcaagttcaaggggctgtcccagaaggtgcggtactggtaccagcaggagacctactgcccgtactgcggcaagatcatcgaggccacccagctgatcaacaacaacgacaacttcgaggtggaccacatcatccccatcagcgtctcctacgacgacagccagaacaacaaggtgctcgtgcactcccagtgcaaccaggccaaggagaagcagacgcccctggggtggatcaacaacggcgggggcttcggccagagcaagaacgagtacaccaaccgcgtcaagaacaacaagaagtacagcaagaacaaggtggacaacctgctcaacgagaccgacctgaccgacatcatcacccagcggtccttcatccagcgcaacctgaacgacacgcggtacgccgcgcgcaccgtgctcgacgagttctacagcttcttcaagtccaacgacctgcccaccaaggtcaaggtggtgcgggggaagtggaccagccagatgcgccggaagtggaacaacgtcggcgggctgcgcaagacccgggacacgcaccaccaccacgccatcgacgcctccatcatcgccagcttcccgctcctgcgcgccttcgaccgcgcgatcaagctgatcgacgtggacaaggagaccggcgagatcgtgcagtacggcaaggcctccctcaacggggacgtcatcgaggagaagtccgtgatccaggcccccatcatcaagaacgagaagttcgagaagctggtggacgagatctacaacttccccctgttcaagcaggtcgagctcgccaacaacatcgagaaccccgagaacccggtgaagttcagccaccacgtggacaagaaggccaaccggaccgtcgcgaaccagaccatctacagcacgcgcatcaagaagaccgagaagatcgtgcggaagaaggtgaccgccaaggaggaggagtacgtcatcggcaccatcaaggacatctacgacgtgacgaacttcgagaagttcaagaagctgtacgacgagtccagcaagaaggacgacatcaagttcctgatgcagaagaacgaccccaagacctgggagaagctcgtggagatcatgaacacctaccccgactacgaggagatctcccagctggacgggaaggtcaagcgcgtgaaggtgagccccttcaagctgtacttccgggagaacggcttcatcaccaagtacgccaagcacaacaacgggccgaaggtcgtgtccatcaagtactacgacagcaagctcggcaaccacatcgacatcacgcccgtgaacgccaacaacaaggtcatcctgcagtccctgaagccctggcgcaccgacgtgtactacaacaacgagacccagcagtacgagctcctgggcctgaagtacagcgacctcaagttcaccaagggggtgtacggcatcacgcgggaggcctacgagaagctgaagtacgggtacaccgacggcgtccccgcgtggaagccgatcagcaaggagtccgagttcaagttcagcctgtaccgcaacgaccgggtgcgcatcatcaacgaggccggggagaagatcgacctcctgttcggctcccggaacgagaccagcgagggctacgtggagatgaagcccatcttcaagaccaacttcgacgacgccgaggaggcctccttctacgggaagacgagcaacaagcgcctgatcaagaagatggcgcggaagggctaccagatctacaaggtcaacaccgacatcctcgggaacctgtactacaccgccaaggagtccaacgagcccaagctggacctctga

SEQ ID NO: 1706 - RNA, 3519 nt, synthetic construct
  misc_feature 1..3519: note = Cas9 variant
  source 1..3519: mol_type = other RNA
atgcgcaagccctacagcatcggcctggacatcgggaccaactccgtgggctgggccgtcatcaccgacgactacaaggtgccgagcaagaagatgcggatccaggggacgaccgaccgcacctccatcaagaagaacctcatcggcgccctgctgttcgacaacggggagaccgcggaggccacgcggctcaagcgcaccacccggcgccggtacacccgccggaagtaccgcatcaaggagctgcagaagatcttcagctccgagatgaacgagctggacatcgccttcttcccccggctcagcgagtccttcctggtgagcgacgacaaggagttcgagaaccaccccatcttcggcaacctgaaggacgagatcacgtaccacaacgactaccccaccatctaccacctccgccagaccctggccgactccgaccagaaggccgacctgcggctcatctacctggcgctggcccacatcatcaagttccgcggccacttcctcatcgaggggaacctggacagcgagaacaccgacgtccacgtgctgttcctcaacctggtgaacatctacaacaacctgttcgaggaggacatcgtcgagacggcctccatcgacgccgagaagatcctcaccagcaagacctccaagagccggcgcctggagaacctgatcgcggagatcccgaaccagaagcggaacatgctgttcggcaacctggtgtccctggccctcgggctgacccccaacttcaagacgaacttcgagctgctcgaggacgccaagctgcagatcagcaaggactcctacgaggaggacctggacaacctcctggcccagatcggcgaccagtacgccgacctgttcatcgcggccaagaagctcagcgacgccatcctgctgtccgacatcatcaccgtgaagggggccagcaccaaggcgcccctcagcgcctccatggtccagcgctacgaggagcaccagcaggacctggccctgctcaagaacctggtgaagaagcagatccccgagaagtacaaggagatcttcgacaacaaggagaagaacggctacgccggctacatcgacgggaagaccagccaggaggagttctacaagtacatcaagccgatcctgctcaagctggacggcacggagaagctgatctccaagctcgagcgggaggacttcctgcgcaagcagcggaccttcgacaacgggagcatcccccaccagatccacctgaacgagctgaaggccatcatccgccgccaggagaagttctaccccttcctcaaggagaaccagaagaagatcgagaagctgttcaccttcaagatcccctactacgtgggcccgctggccaacggccagtccagcttcgcgtggctcaagcggcagtccaacgagagcatcaccccctggaacttcgaggaggtcgtggaccaggaggcctccgcccgcgccttcatcgagcggatgacgaacttcgacacctacctgcccgaggagaaggtgctgcccaagcacagcccgctctacgagatgttcatggtctacaacgagctgaccaaggtgaagtaccagaccgaggggatgaagcgccccgtgttcctgtccagcgaggacaaggaggagatcgtcaacctcctgttcaagaaggagcggaaggtgacggtgaagcagctgaaggaggagtacttctccaagatgaagtgcttccacaccgtcaccatcctcggcgtggaggaccgcttcaacgccagcctggggacctaccacgacctgctcaagatcttcaaggacaaggcgttcctggacgacgaggccaaccaggacatcctggaggagatcgtgtggacgctcaccctgttcgaggaccaggccatgatcgagcggcgcctggtcaagtacgccgacgtgttcgagaagtccgtcctcaagaagctgaagaagcggcactacaccggctgggggcgcctgagccagaagctcatcaacggcatcaaggacaagcagaccggcaagacgatcctggggttcctgaaggacgacggcgtggcgaaccggaacttcatgcagctcatcaacgactccagcctggacttcgccaagatcatcaagaacgagcaggagaagaccatcaagaacgagtccctggaggagaccatcgccaacctcgccgggagccccgccatcaagaagggcatcctgcagagcatcaagatcgtggacgagatcgtcaagatcatggggcagaaccccgacaacatcgtgatcgagatggcgcgcgagaaccagtccaccatgcagggcatcaagaacagccggcagcgcctgcggaagctcgaggaggtgcacaagaacaccggctccaagatcctgaaggagtacaacgtcagcaacacgcagctgcagtccgaccgcctctacctgtacctgctccaggacgggaaggacatgtacaccggcaaggagctggactacgacaacctgagccagtacgacatcgaccacatcatcccgcagtccttcatcaaggacaacagcatcgacaacaccgtgctcaccacgcaggcctccaaccggggcaagagcgacaacgtgcccaacatcgagaccgtcaacaagatgaagtccttctggtacaagcagctcaagagcggggccatctcccagcgcaagttcgaccacctgaccaaggccgagcgcggggccctcagcgacttcgacaaggcgggcttcatcaagcgccagctggtggagacccgccagatcacgaagcacgtggcccagatcctggactcccggttcaacagcaacctcaccgaggactccaagagcaaccgcaacgtcaagatcatcaccctcaagagcaagatggtgtccgacttccggaaggacttcggcttctacaagctgcgcgaggtgaacgactaccaccacgcccaggacgcctacctgaacgccgtcgtggggaccgcgctgctgaagaagtaccccaagctcgaggccgagttcgtgtacggcgactacaagcactacgacctggccaagctgatgatccagcccgacagctccctcgggaaggccacgacccggatgttcttctacagcaacctgatgaacttcttcaagaaggagatcaagctggcggacgacaccatcttcacccgcccgcagatcgaggtcaacacggagaccggcgagatcgtgtgggacaaggtgaaggacatgcagaccatccggaaggtcatgtcctacccccaggtgaacatcgtgatgaagaccgaggtccagacgggcgggttcagcaaggagtccatctggcccaagggcgacagcgacaagctcatcgcccgcaagaagtcctgggaccccaagaagtacgggggcttcgacagcccgatcatcgcctactccgtgctggtggtcgccaagaactgcaagcggaagaacagcaagaccaagaactaccagcggacctgcgggaacaagaacaacggcacccggtga

SEQ ID NO: 1707 - RNA, 3522 nt, synthetic construct
  misc_feature 1..3522: note = Cas9 variant
  source 1..3522: mol_type = other RNA
atgcgccccatcgagccgtggatcctgggcctcgacatcgggaccgacagcctgggctgggccgtgttctcctgcgaggagaaggggccgcccaccgccaaggagctgctcggcgggggcgtccggctgttcgacagcggccgcgacgcgaaggaccacacgtcccggcaggccgagcgcggggccttccggcgcgcccggcgccagacccggacctggccctggcgccgggaccgcctgatcgccctcttccaggcggccggcctgaccccgcccgccgccgagacgcggcagatcgcgctggccctccgccgggaggccgtgagccgccccctggcccccgacgccctgtgggcggccctcctgcacctggcccaccaccgggggttccgctccaaccggatcgacaagcgcgagcgggccgccgcgaaggccctcgccaaggccaagccggccaaggcgaccgccaaggccaccgcccccgccaaggaggcggacgacgaggccggcttctgggagggggccgaggccgcgctgcgccagcgcatggccgccagcggcgcccccaccgtgggcgccctgctcgcggacgacctggaccgggggcagcccgtccgcatgcggtacaaccagtccgaccgcgacggcgtggtggccccgacgcgggccctgatcgccgaggagctcgccgagatcgtcgcgcgccagagctccgcctaccccgggctggactggcccgccgtgacccggctggtgctcgaccagcgccccctgcggagcaagggcgccggcccgtgcgccttcctgcccggggaggaccgcgcgctccgggccctgcccaccgtccaggacttcatcatccgccagaccctggccaacctccggctgccctccacgagcgccgacgagccgcgccccctgaccgacgaggagcacgcgaaggccctcgccctgctgtccaccgcccggttcgtggagtggcccgccctccgccgggcgctgggcctgaagcgcggggtgaagttcaccgccgagacggagcggaacggcgccaagcaggccgcccgcgggaccgcgggcaacctcaccgaggccatcctggcgcccctgatcccgggctggagcgggtgggacctcgaccgcaaggaccgggtcttctccgacctgtgggccgcccgccaggaccggagcgccctgctcgccctgatcggcgacccccgcgggcccacccgggtgacggaggacgagaccgccgaggccgtggcggacgccatccagatcgtcctgcccaccggccgcgcctccctcagcgccaaggccgcgcgggccatcgcccaggccatggccccggggatcggctacgacgaggcggtgaccctggccctgggcctgcaccactcccaccgcccccggcaggagcgcctcgcccggctgccctactacgccgccgcgctgccggacgtggggctcgacggcgaccccgtcgggcccccgcccgccgaggacgacggcgccgccgccgaggcgtactacgggcgcatcggcaacatcagcgtgcacatcgccctgaacgagacgcggaagatcgtgaacgccctgctccaccgccacggccccatcctgcggctggtcatggtggagaccacccgcgagctcaaggccggggcggacgagcggaagcgcatgatcgccgagcaggccgagcgggagcgcgagaacgccgagatcgacgtggagctgcgcaagagcgaccggtggatggccaacgcgcgcgagcggcgccagcgggtccgcctggcccggcgccagaacaacctctgcccctacacctccacgcccatcggccacgccgacctgctgggggacgcctacgacatcgaccacgtgatccccctcgcccggggcggccgcgacagcctggacaacatggtcctgtgccagtccgacgcgaacaagaccaagggggacaagaccccctgggaggccttccacgacaagcccggctggatcgcccagcgggacgacttcctcgcccgcctggacccccagaccgccaaggcgctggcctggcggttcgccgacgacgccggggagcgcgtggcgcgcaagagcgccgaggacgaggaccagggcttcctcccgcggcagctgacggacaccgggtacatcgcccgggtggccctgcgctacctctccctggtcaccaacgagcccaacgccgtggtggcgaccaacggccggctgacgggcctcctgcgcctggcctgggacatcacccccgggcccgccccgcgggacctcctgcccacgccccgcgacgccctgcgcgacgacaccgccgcgcggcgcttcctcgacggcctgacgcccccgcccctggccaaggccgtcgagggggccgtgcaggcccggctcgcggccctgggccgcagccgggtggccgacgccgggctggcggacgccctcggcctgaccctggcctccctcggcgggggcgggaagaaccgcgccgaccaccggcaccacttcatcgacgccgcgatgatcgccgtcaccacccgcggcctgatcaaccagatcaaccaggccagcggggccggccggatcctggacctccgcaagtggccccggaccaacttcgagcccccgtaccccaccttccgcgccgaggtgatgaagcagtgggaccacatccacccctccatccggccggcgcaccgcgacggcgggagcctgcacgccgccaccgtgttcggcgtccggaaccgccccgacgcccgggtgctggtgcagcgcaagcccgtcgagaagctgttcctcgacgccaacgcgaagcccctgccggccgacaagatcgccgagatcatcgacgggttcgccagcccccggatggccaagcgcttcaaggcgctcctggcccggtaccaggccgcccaccccgaggtgcccccggcgctggccgccctcgccgtggcccgcgaccccgcgttcggcccccgcgggatgaccgccaacaccgtcatcgccggccggtccgacggcgacggggaggacgccggcctgatcacgcccttccgcgccaacccgaaggcggccgtgcggaccatggggaacgccgtgtacgaggtctgggagatccaggtgaagggccgcccccggtggacccaccgcgtgctgacccggttcgaccgcacgcagcccgcgcccccgcccccgcccgagaacgcccggctcgtcatgcgcctgcggcgcggcgacctggtgtactggcccctcgagtccggggaccggctgttcctggtgaagaagatggccgtcgacggccgcctcgccctgtggcccgcccggctggccaccgggaaggcgaccgccctctacgcccagctgagctgccccaacatcaacctgaacggcgaccaggggtactgcgtgcagtccgccgagggcatccgcaaggagaagatccggaccacgagctgcaccgccctcggccgcctgcggctgtccaagaaggcgacctga

SEQ ID NO: 1708 - RNA, 3525 nt, synthetic construct
  misc_feature 1..3525: note = Cas9 variant
  source 1..3525: mol_type = other RNA
atgggcaagtacagcatcgggctggacatcggcatctccagcgtggggtggtccatcatcgacatcgagaagaagaagatcgtcgacctcggcagccgcatcttcccctccgggaacgccgccgcgaaccaggaccggcgcggctaccggggcacccgccggctgatccgccggcgcaagaaccggctggccgacgtgatcaacttcctcggggaggagaacttcatcgacaccaaggtggtcgaccagaacggcaacatccactacaagctgctggtgaacagcacggagtccccgtacaagctccgcgtgaaggggctgagcaagatgctgaccaagcaggagctcgtcatcgccctgtaccacatcgtgaagcaccggggcatctcctacgacctgggggacctcgaggacgacggcaccagcggcgtgaccgactacaagacgtccatcaacatcaaccgccagctgctgatcaagaagaccgtcgggcagatccagctcgagcggctgaaggagttcggcaaggtgcgcgggcacgtgaagaaggacgagaacatcaccctgctcaacgtcttccccagctccgcctacgtgaaggaggccacccagatcctgacgaagcagcgggagttctaccccgagatcaccgacgacttcatcaccaagttcatccccttcatcagccgcaagcgggactacttcgtgggcccgggcaacgagaagtcccgcaccgactacgggatctacaagaaggacggccggacgctggacaacctcttcgacgagctgatcgggatcgacaagatcagcggcgagaagcgcgcgtccgccagctccgtcaccgcccagatctacaacatgctgaacgacctcaacaacctgaccgtgaccaacacggaggacgggaagctgaccacccagaccaagcgggagatcatcgaggccgacaagacgaccaacggcctcttcggcatcacccagatctgcaagatcatcgggtgcaagaaggacgacatcaagggcttccgcatcgacaaggtggagaagcccatcatgcacaccctgagcgggtaccgccggttccgcaaggagctggcgaagatcaacatcgaggccaacgacctcgacatcaacctggtcaacaagatcgccgacatcctgacgctcaacaccgagaaggccgagatccggaagcagctgaacaagagcaacatcgacgtgtccaacgagatcaaggagctgatcatcaacaagaacaaggacttcctcgtggacggccgcgccacctggcacagcttctcctacaagaccctgaacctgctcatccccgagctgatgaacacgagcgaggagcagatcaccatcctgacccggctcgggctggtcaagtccaacagcgagaagtacaagggcctgaagaacatccccgcgcgccggatcaccgagggcatctacaacccggtggtggccaaggccacgcgcgaggccgtcaacgtgttcaacgccatcgcgaagaagatcgggcgggacaacatctccgacgtcgtgatcgagctcccccgcgaggacaacgaggccgacatcaagaagggcatcgtgaagcggcagaagcagaacgagctggagaaggaggccgccgacgccctggtcaagcagcagatgaccatcagcgactccgcgctcgtggcccactaccgcaaggtgcgggggctgagccagaaggtccgctactggtaccagcaggggacctgctgcccctactgcggcaagaacatcgaggccgtgcagctgatcaacaacaacgactccttcgaggtggaccacatcatccccatcagcgtctccttcgacgacagccagaacaacaaggtgctggtgcactcccagtgcaaccaggccaagggcaagcagaccccgctcggctggctgaacaacgggggcgggttcggccagaacaagacggagtacgtcgccaaggtgaagaccaacaagaactacagcaagaacaagatggacaacctgctcaacgacatggacctgtccgacatcgtgacccagcggggcttcatccagcgcaacctgaacgacacccggtacgcgagccgcatcgtcctcgacgagttctactccttcttcaagagcaacaacctgagcaccaaggtgaagatcgtgcgggggaagtggacgtcccagatgcgcaagaagtggaacggcgtcgggggcctgaagaagacccgcgacacctaccaccaccacgccatcgacgccagcatcatcgcctccttccccctcctgaaggtgttcgacaaggcgatcaagctgatcgacatcgaccgggagaccggggagatcctccaggacaaggaggccatcaagatgagccaggaggccaagctgctggagaagatccccgtgatccagaacgagaagttcgaggagctcatcaacgagctgtacgacttccccctgttcaagcaggtcgagctcgccaacgacatcacgaacccggagaaccccgtgaagttctcccaccacgtggacaagaaggccaaccgcagcgtcgcgaaccagaccatctacggcacccggatcaaggagaaggagatcaacaagcgcggcaaggtggagaaggtgcaggagcggtacatcctggggaccatcaagaacatctacgacatcgactccttcacgagcttcaagaagatctacgacaagatgtccaagaccggcgacgtcaagttcctgatgcagaagaaggaccccaagacctgggggaagctcgtggagatcctgaacagctaccccgactccgaggagatcacccaggtggacggcaaggtcaagcgcgtgaaggtgagcccgttcgagctgtaccggcgcgagaacgacttcatcacgaagtacgccaagcacaacgacgggcccaagatcgtctccatcaagtactacgacagcaagatcggctcccacatcgacatcacccccatcaacgccaagaacaaggtggtgctccagagcctgaagccctggcggaccgacgtctacttcaactccgagacccgccagtacgagctgctcggcctgaagtacagcgacctgaagttcacgaacggggtgtacggcatcaccagcgaggcctacgagaagctcaagcacgggatctccgaggacggcaccaagacctggaagccgatcgggaagaacagcggcttccggttctccctgtaccgcaacaaccgggtgaagatcgtcgacgagaagggcgagagcctggagctcctgttcgcctcccgcacgaccagcaacgaggggtacgtggagctgaagcccatctacaagtccaagttcgacagcaaggaggacgtgggcttctacgggcagatgaccccctccggccagttcgtcaagaagatggcgcgggtggggtacaagctctacaaggtgaacaccgacgtcctgggcaacccctactacatcacgaaggagagcgacgacccggagctgtccctctacaagaagtga

SEQ ID NO: 1709 - RNA, 3528 nt, synthetic construct
  misc_feature 1..3528: note = Cas9 variant
  source 1..3528: mol_type = other RNA
atggaggagatgaagcagaccggccgcaagaacgaggcccccaagctgaccgacctcaactaccggatcgggctggacatcggcatcgccagcgtggggtgggcggtcctggagaacaactcccacgacgagccgttccgcatcatcgacctcggcgtgcggatcttcgacacggccgagcagcccaagaccggggccagcctggccctgccccgccgggaggcccgctccgcgcggcgccggatccgccggcgccgggaccgcatcgagcggatcaagaagctgttccaggccgagggcctgatcaacatcgacgagttcgaggcccgctacaagatcgccggcctgagcgacgtgtacaagctccggtacgaggggctggaccgcaagctgaccgacgacgagctcgcgcaggtcctgctgcacatcgccaagcaccggggcttcaagtccaccagcaaggccgaggaggccgagaacgagaacgacgccgcgaagaagaaggaggccggggccctcaagaagggcatctccaacaacaagaagctgatggaggagaaggggtaccgcacggtgggcgagatgatgtacctggacgagaacttccggaccgactgcccctggaacgagaacggctacatcctcaccccgcgcaacaagagcggggactacaagcacaccgtgctgcgcgacatgctggtcgacgaggtgcgggagatcttcaagtcccagcgcagcctcggcaacatccacgcctccgaggagctggagaacgcctacctggacatcatgctcagccagcggtccttcgacatggggcccggcgcgcccagcaagtacgccatggagggcttcgaggaccgcgtggggctgtgcacgttcgagggcaagaacggggagaagcgggccgccaaggccgcgtacacctccgagctgttcgtcgccctcgagaagatcaaccacaccaagatcgtgagcgacgacggcgccacccgcttcctgacgacctacgagcggaagtccatcatcgagctgatgcacaagcagcagaccgtgaagtacgccgccgtccgcaaggcgatcgggctcgccgaggaggacaagttctacaacctgaactacagccccaaggccggctccaagaagtccccggaggacaccgacttcgtgaagctggagaactaccacaagatccggaaggccctcggcgaggacatcgtgagcgagcacctccccgcggagaagatcaagctgtacgacagcatcgccacgatcctcaccctgttcaagaacgacgacagccgcatcaagcggttcatcgagctggggatcggcgaggagtgcttcgacgggctcctgtccctgagcccctccaagttccacaacctcagcctggtcgccatgggcaagatcatccccttcctgctcgacgggaacacctacgacaaggcctgcgagctggccggctacgacttcaaggcggacaacaagggcgagaagtccgtgctgctcaaggggaagaacatcaccgacatggtgaacgacatcacgaacccggtcgtgcgccggagcgtgtcccagaccatcaaggtcatcaacgccatcatcctggagtacggcagcccccaggccgtgaacatcgagctggcccgcgagatgtccaagaacttcgacgagcggcgcaagctcaagagcgacatggagtcccgggagaaggagaacaacaacgtgatcaagcgcgtcaaggagtacaagctgaaccccaccgggcaggacatcgtgaagttccggctgtgggaggagcaggaccgccgctgcctgtacagcggcgagaagatcgacatcaacgacctcttctcccgggacgggggctacgacgtcgaccacatcctgccctacagcatcaccttcgacgacacgtaccgcaacaaggtgctggtgaaggcctccgagaaccggcagaagggcaaccgcaccccgtacgagtacttcatggcggagaaggacgacgacgagtggaacgtctacgagaccctcgtgcggaacaccgtgaaggactacaagaaggtcctgaagctgctcaagaagcacatcacggaggacgagaagtccgagttccgcgagcggaacctgaccgacaccaagtacatcacccgcatcatctacaacatgatccggcagaacctggtgctcaagccctacctgagcctggagaaggagcgcaagaagcaggtcatggccgtgaacgggagcatcacgcactacctcagcaagcggtggggcctggagtccaaggaccgccggaccgacacccaccacgcccaggacgccgtggtgatcgcctgcaccacggacgggatgatcaacaagatcagccgctactccaagggccgggagctgctctacagccgcggcttcaagttcgtcgacgaggagaccggggagatcctgtcccgggacaacttcacccgcgaggagtgggacgagaagtacggcgtgaagatccccatcccctgggagcacttccgggacgagctggacatccgcatgagccggtacaacgggaccggcgacgactccatcgacaagaccacgccgcgcgacttcatcctcagccaccgcgacgcgcacaagtggatcaactaccccgagtggatgttcgtggaggggcggcccggccgccggggcgtcctggacgggatcttcgtgtcccgcatgcccaagcacaaggtgagcggccaggcccacgaggagaccgtccggtccgccaagtactacaacgacgggggcagcgtgttcgagtccgggggctacgtggtcaccaagaagtccatccaggacatcaagctgaaggacggcgagatcaaggagttcttcaacccggacagcgaccgcctcctgtacaacgccctggtggaccggctcaacaagttcgagaacgaccccaagaaggcgttcgccgagcccttctacaagcccaaggccgacgggacccagggcccgatcgtgaagaagatcaaggtcttcgagaagcagagctccggggtgttcgtgcgcgacggcaaggggatcgccgccaacggcgcgatggtccggatcgacgtgttctgcgaggaggacaagggcaagaagaagtactacttcgtgcccatctacacggccgacgtcgtgaagaagaagctgcccgaccgcgccgccaccgccaacaagctgatcagcgagtggcgggtgatgaaggaggagaacttcatcttcagcctctactcccgcgacctgatctacatcgagagcgacaagggggtccaggtgaaggacatcgacggcaagatctccaagccggtgaacctgttcgcgtactacctcggggccgacaccagcaccgcctccatcagcggcaagctgcacgactccagcgccaacttccggtccatcgggatccagggcctgcgccggttcgacaagtgccaggtcgacgtgctcggcaacatcagcttcgtgaacaaggagaagcgcatgcccttcaactga

SEQ ID NO: 1710 - RNA, 3531 nt, synthetic construct
  misc_feature 1..3531: note = Cas9 variant
  source 1..3531: mol_type = other RNA
atgaacaaggtgcaggaggactgctacaagaagatcaaggagaagctggccgaccgcgagtaccggatcggcctcgacctgggggtcggcagcatcgggtacgccgtggtgtccctgaagggcgacatgcccgaggacgtcatcctcgcggggagccgcatcttcaagtccagcatcggcgccgccgagcggcgccacttccgggcccagcgcaacacccaccggcaccaccgcgagcggatgcgctacctgtggaagctgctcgccgagaagaacctggcgctgcagctcccggagaacctgtccaagaaggagaacttcaccgacttcgacacgagccggaagcgcttccccatcgaggtgctgcggaacgacccctacatcctccgctacaaggccctggacgagaagctgtccctcttccagctgggctacgccctgtaccacatcgccaaccaccgggggaccgcgagcgtgcgctccttcctcgaggacgacgaggccaaggtcaaggagaacaaggagaccgccaagctggccaagaacaccaagaagatcatgtacgagaagaagtaccggacgttcggcgagtacctgtaccgcgagcggatcgagaagttccgccagaacgagcggatgaaggtgaccaacaagaacgagaacaaggagttcgccgtgacccgcgacatcatcgagaaggaggtcgagatgatcctcggggcgcagaagcgctacaacaccgccgtgctggccgacgactacatcgagcggatcaagaaggccatcttctacgagacggagaagctgatccccgagccggagtactgcccctacttcaaggacgacaagcgcctcccccggagccacaagctgaacgagtaccgccggatctacgaggccctgaacaacacccgctactacatccccgagatcgaggagaagaccggcgagatcctctcccggaaggagaaggagcagctgagcaaggaggagaaggagaagctgttcaacttcctcctgaagaacaaggagctgaccgaggcgaaggtgaagaagctcctgaacctgtccgagatggccaaggtccagctccaggggcgcgacaagaagaaccagaagatcaagggctacgccctgatcacgctggagagcctcccgttctggtccaagctgcccgagcagcagcaggacgagttcctgtacgactggaacaagctccccgacgagaagctgaaggaccggctgcgcaactactacaagctcaccgacgacgagatcgacgagaccttccagaacatcgtgctgcccagcaactacgccccgctgggcaagaaggccatggagatcctcctggagtacatcaagaacgggctgtcctacatcgaggcgctggacaaggccgccgacgagaacaagatcaaggtggagaagcacgagatcaacgacctcctgccctactacggcaagatcctgcaggagagcacccagatgcccatcgggaaggccttctccaagcagttcgccgcgaagaactacaagaagcccgacatcaacaagaacgagcaggagttcggccggatcgccaacccggtcgtgcaccagacgctcaacgagctgcgcaagctgatcaacgagatcatcaccgtgttcggcaagaagcccctcgagatcagcctggagaccagccgggagctgaagaagtcccagaaggagcgcgagctcatcgccaagcagcaggacatcgacgaggagaagcggaagaagatctggaagacctacatcgagccccacctccagcagatcaagagccgctccgacaagctgaagaagctgttcgtcttcgagctgtgggaggaccagaagcacaactgccccttctgcctggagaagatcaacgtggacgacatctacagccgcggggtggacaaggagcacctcttcccgctgaagaagtccgaggacgacagcgagaacaacctggtcatcgcccacaacaagtgcaacgcgcgcaaggccgagcgggcccccttcgacgccttcggccacgagtccatctggaacgacatcttcagcaacgccgagaagaacctcccccgcaagctgtggcgcttccggcaggggtccttcgagaagttcctggagaagcccccgatgctcaagcgcttcgagacggacaacagctacatctccaagatcagcgcgcggtacctggcctgcctgttcgacaagccctccaagatcttctgcgtgaagcccttcctcaccgcccagctgcgcatcgcctggcagctggacgagatcatgatccggctcgccgagaacatcatcctggacagcgagaaggactccttcaacaagggcgggctgcagaagaagaagcgcatcgacaaccggcaccacgcgctcgacgccgtggtcatcgcctacgccagccgcggctaccacaacttcctgaaccgggtgcacgccaagggctacaagatcaactacgacgagaagacctggctgtccgagaccctccggcccccggggaacaagaacctggaggacttcaagagcggcatcatcaacgtcatgatcaacgcgaacatctccatcaagcacgaccacaacaacaaggggcagctggtcaagagcaaggcctacaagctctactacagcgagatcggcaagtacatcatcacgaccctgaagtccgtgagcgagatcctgttcaagcagaaggagaagccccaggacaccctccggcgcgccctgtgcaagttcgaggaccggctgtccgacatcaaggacaagaagctccgcaagaagctggaggacaacatcaccatctacaagagcatcgagaacgagtccgccctgagcaaggcgaagcaggagctcgaggagttcgacctgaaggccaagaaggaggggaagaagggctacgagaagatcacggacatcctgatctacaagaaggcctgctccatgcacggcgggaagtacatccacgtgaagaaccggatcgagaacaagttcttcgccctcaaggagcccaccgagatcgagaccggcttcgggtacgacaccgccgacaacctgagcctggacctctaccacgacaacaacggcaagctgtgcggggaggtgatccgcaagatcgacttcaaccggaaccgcgtgccgaactacaagaaggagggctacatcctgctcgagcggatctaccagggcgacacgctggaggtcgacatctccgacgacaagatcagcctgaagaacaaggtggggtccgcgcccgacaagcgcaccttcgtgaaggtcctcaccttcaccgagagcgaccggtacctgaagaacaagcgcgaccagatccagatcttcttctgcaacctgctcaagtccacgctgaagcacgacgacagctccaagcacgacgacagcttctacgtgtccagcatgcagaagtacaacgtgcgcaaggtcatcctgaccagcctcggcatcatcaagtaccggtccaagatcctgaagaacaaggagatctga

SEQ ID NO: 1711 - RNA, 3531 nt, synthetic construct
  misc_feature 1..3531: note = Cas9 variant
  source 1..3531: mol_type = other RNA
atgctgttccccaagaagctcagcaaggaggaggtggcctacgtcctggtggagatcaactccaacctgaacaacagctccaactacctcggcaacatcagcgaccgctccaaggagctgtacttcaacaagcagaccatcgggcagttcctgtacaccaagctcaaggaggaccggcactacagcctgaagaacaaggtgttctaccgccaggactacctggacgagttcgagcggatctgggagacgcaggccatcttccacaaggagctcaccgaggacctgaagaagcagatccgcgacaccatcatcttctaccagcggcgcctgaagtcccagaagggcctcatcagcctgtgcgagttcgagaacaaggagatcaccatcgagaaggaggggaagacggtcaccaagcagatcggcgtgcgggtgatcccgaagtccagccccctgttccaggagttcaagatctggcagatcctcaacaacgtcatctgcaagaagaaggggacccgcaagaagaaggcggtgacccccgcgcccctgctgttcgagctgttcggcacgccgtccgagaccttcttcagcctggacatggagtgcaagcagctcctcttcgaggagctgaacctgaagggcaacctcaaggccgacaaggtgatccggctgctggggtacatcccccaggagtgggagatcaactacaaccagctcgagggcaaccgcacccagaagtccctgtacgaggcctacctgaagatcatcgagatcgaggggtacgacatcaagaccttcctccggatcaagagcgacaaggaggactgggacctggaggagagccccctgtccgccaaggagatccgcgagaacatccagcacatcttcgagacgctcggcatctccaccgccatcctgtacttcgacgccaccctgcccatcaaggacttcgagaagcaggccagctaccagctctggcacctcctgtactcctacgagagcgacaacagcccgtccgggaacgagaccctgtacaagctgctgcaggacaagttcggcttcaagcgggagcacgccgtcttcctcagcaacatctccttccaggacgactacggcagcctgtccgcgaaggccatccgcaagatctacccctacatcaaggagaaccagtacagcacggcctgcgagctggccgggtaccggcactccaagctcagcctgaccaaggaggagctgaacaaccgccccctcaaggacctgatcagccccctgaagaagaactccctgcggaacccggtggtggagaagggcctcaaccagatgatcaacgtcgtgaacgccctgatcgagaagaactccgagaaggacgcggaggggaacatcatcaagtacttccacttcgacgagatccgcatcgagctggcccgggagctcaagaagaacgcccaggagcgcgccgagatgaccctgaacatcaagaacgccaccatcgagcaggagaagatcaagagcatcctgatctccgacttcggcatcaagaaccccacgaagaacgacatcacccggtaccgcctctaccaggagctggcgcacaacgactacaaggacctgtacaccaacaccgacatccccaaggagctcctgttcagcaagaacatcgacatcgagcacatcgtgcccaaggcccgcgtcttcgacgactccttcagcaacaagacgctggcctaccgggacttcaacctcaagaagggcgagaacaccgccttcgacttcatcgactccagcctgggggaggaggagctgaaccagtacatcgcccgcgtggagaacgcgttcaagaccaagaacatctccgccaccaagtaccggaacctcctgaagaaggccacggagatcaacgacggcttcatcaaccgcgacctgcgggagacccagtacatcgccaagaaggccaaggacctcctgttccagatcacccgcagcgtggtcagcacctccgggagcatcacggaccggctgcgcgaggactggggcctcatcgacatcatgaaggagctgaacatgccgaagtaccgggacctggggctcaccgagatcatcgagcgccgggacggccgcaaggtggaggtgatcaaggactggaccaagcggaacgaccaccgccaccacgcgatggacgccctgaccgtcgccttcacgaagccctcctacatccagtacctgaaccacctcaacgcccggaaggacgagaacaacaagctgtacgcggacatcctgggcatcgagcgcaaggagaccaccaagatccacgacgagaacgggaacgagaagcgggtgttcatcgagcccatccccggcttccgccagatcgccaagaagtacctcgaggagatcctgatcagccacaagaccaagaacaaggtggtcaccaagtccatcaacaagatcgccgggacgaacaagaagcaggagaccctgaccccgcggggccagctccacaaggagaccatctacgggaagtaccactactacagcaacaaggaggagaagatcggcacgaagttcgacaaggagaccatctccaaggtgagcaaccccatctaccgctacgccctgcagaagcgcctggaggccaacgagaacaaccccaagaaggcgttcaccggcaagaacgccctctccaagaaccccatctacctggacgacgccaagaccaagatcctgccggagaaggtcaacctcatctacctggaggaggacttcagcatccggaagaagatcgtgtccgagaaccccacgagcaaggagttcgtgcccaactccatcagcatcgagaagatcgtcgacgaggggatcaagcgcatcctgaaggagcggctcgagacctacaacaacgaccccaagaaggccttcgccgacctggacaagaacccgatctggctgaacaaggagaagggcatctccatcaagcgcgtgaccatcagcggggtgaagaacacccaggcgctccactccaagaaggaccacctgggcaagcccatcctggacaaggaggggcaggagatccccgtcgacttcgtgagcacgggcaacaaccaccacgtggccatctaccgggaccagaagggcaacctccaggagcagatcgtcagcttcttcgaggccgtggtgcgcgcccagcaggggctgccgatcatcgacaagacctacaagcaggaggagggctggcagttcctgttcaccatgaagcagaacgagatgttcgtcttccccaacgagatcaccgggttcaacccctccgagatcgacctcctggaccccaagaacaagaagctgatcagcccgaacctcttccgggtgcagaagatctccatcaaggactacttcttccgccaccacctggagacgaacgtggagaccaacaacatcctgaaggacatcacctggaagcggggcggcctcagcctgctgaaggggatcatcaaggtccgcatcaaccacctcggcaacatcgtgtccatcggggagtactga

SEQ ID NO: 1712 - RNA, 3534 nt, synthetic construct
  misc_feature 1..3534: note = Cas9 variant
  source 1..3534: mol_type = other RNA
atgaacaaggtgcaggagatcgagtacaagaagatcaaggagaagctggccgaccgcgagtaccggatcggcctcgacctgggggtcggcagcatcgggtacgccgtggtgtccctgaagaagtacgacgacctcagctacctgcccgaggacatcatcctggcgggctcccgcatcttcgccagctccatcggggccgtcgagcggcgcgagttccggctccagcgcaacagccaccggcaccgccgggagcgcatgcggttcctgtggaagctgctcgccgagaagcagctggccctgcagccgtccaaggacctcgagaagaaggagaacagcgcggactgcgagacctcccagaagcgcttccccatcaacatcctgaagaacgacccctacatcctgcggtacaaggccctcgacgagaagctgagcctgttccagctcggctacgtgctgtaccacgtggccaaccaccgcggcaccgactccatccggagcttcctggaggacacggacgacaagatcaaggagaacaccaagaccgccaagctcgcgaccgagacgaagaagatcatcgactccaagaagtaccgcaccttcggggagtacctgtacaaggagcggatccagcagaacgagcgcaagaaggtcagcaaccggaagaccgccggcaacaagaacaaggagttcgccgtgacccgcgacatgatcttcaaggagacggagaagatcctggcctcccagaagcagtactacaccaacgtgctcaccgacgagtacatcaaggagatcgagggggccatcttctaccagaccgagaagctgatccccgagagcggctactgcccgtacttcaaggacgagaagcggctgccctgctcccacaagctcaacgagtaccgccgcatctacgaggcgctgaacaacgcccggtacagcgcccccgtcctggacgagaagacgggggagatcctctcctaccaggagggcgaggagttcagcagcgaggagaagaagatcctgttcgacgaggtgctgctcaagggcaagaagctgaccgagtccgagatcaagaagctgctccacctccccgacgggtgcgagatccagctgcagggccgcgacaagcggacccagaagatcaaggggtacgccctgaccgccctggaggcgctgccgttctggagcaagctctcccagcagcagcaggacgagttcctgtacgactggaacggcctgcccgaggagaagctcaagcccaagctgatcgactgctacagcctgacggagaacgaggtggacgagaccttccagaagatccgcctcccctccaactacgccccggtcggcaagaaggccatggagatcctgctgacctacatcaaggacgggtacagctacaccgaggccctggacaaggccgtgtccgagggcaagttcaaggtggacaagcagacgaccatctacgacagcctcccctactacgggaagatcctgcaggagtccacccagaagctgatcggcaaggcgttcagcaagcagttcgccaagcggaactacaagaagcccaacaccaaccgcaacgagcgggagttcgggaagatcgccaaccccgtcgtgcaccagtccctcaacgagctgcgcaagctgatcaacgagatcatcacggtgttcggcaagaagccgctcgagatcggcctggagaccgcccgggagctgaagaagtccagcaaggaccgcgagagcctcgtcaagcagcagaacgagaacgagtacaaccggaacaagatctacaaggactacgtggagccccacctgtcccagatcaagagccgccaggagaacccctcccggtacatcttcaagttcgagctgttcgaggagcagaagtccatctgccccttctgcctcaaggagatcaccccggacgacatcatcaacagcaaggtggacatcgagcacatcttccccatcgaggagagcgaggacgacgccaagaacaacctggtcatcgcgcacaacgagtgcaacgccgacaaggggaagaagtcccccttcgacgccttcggcgacaagaccagcgggaagtacgtgtggaacgacatcctgcacaacgccaagaagaacctcccccacaagatctggcgcttctaccagggcagcctggagaagttcctggagaacaagccgatgctcaagcggttcgggacggacaactcctacatcagcaagatcgcggccaagtacctggcctgcctgttcaacaactccagcaagatcttctgcatcaagtccagcctcaccgcccagctgcgcatcgcctgggagctgaactccatcatgatccccctcgcgaagaacatcctgagcgagaaggagctggaggagttcaagaccctcaagaacaagaagatccggatggacaaccgccaccacgccctggacgccatcaccatcgcctacgccaaccggggctaccacaacttcctgaacaagatccacgcgaagggctacaagatcgactaccgcgagaagaactggctctccaagatcctgctgccgcccctcaaccgcgacctggaggacttcaagatcagcgtgaagaactccatcgagaaggccaacgtcagcatcaagcacgaccacaagacgaacgggtccctggtgaagggcaccgcctacaaggtctactacagcgggaccggcaagtacatcatcaccacgctcaagaacgtggaggagatctccttcaaggagaaggaggaccccgaggacaccctgcggcgcgccctgtgcgggttcgaggacagcaacatcaaggacgagaagctcatcaagaagctgaagtacaacagcgacctgtacaagaagatcctcaacaccaagcccaaggccaagcaggagctggagcaggcgaaccaggagaccaaggaggagggcaagaagacccagaagatcacggacgtgctgatctacaagaaggcctgctccctcgtcggcgagcagtacatccagtgcgccagccggctggagaacaagttcttcgccgtgaaggagcccaccgagatccgcaccgggatcggctacgacaccggggacaacctgttcctcgacctgtactacgacaagacgcggaagctgtgcggcgagatcatccgcaagatcgacttcaaccagaacaagatcccgaactaccagaaggagggctacatcctcttcgagcggatctaccagggggacaccctggaggcggacacctccgaggacaagatcagcctgaagaacaagaccggctccgccctcgacaaccgcacgttcgtgaaggtcctgaccttcaccgagagcgacaagtacttcgacgggaagaaggacaagatccagatcttcttcggcaacctgctcaagtccaactacaagcaggacgacagcttctacatctccagcatgcagaagtacaacgtgcggaaggtgatcctgacctccctggggatcatcaagtaccgcagccagatcctcaagaacaaggaggtctga

SEQ ID NO: 1713 - RNA, 3540 nt, synthetic construct
  misc_feature 1..3540: note = Cas9 variant
  source 1..3540: mol_type = other RNA
atgagcaagaaggtgtcccgccggtacgaggagcaggcccaggagatctgccagcgcctgggcagccggccctactccatcgggctcgacctgggcgtcgggagcatcggcgtggccgtggcggcctacgacccgatcaagaagcagccctccgacctggtcttcgtgagctcccgcatcttcatccccagcaccggggccgccgagcggcgccagaagcggggccagcgcaactccctccggcaccgcgccaaccggctgaagttcctgtggaagctcctggcggagcgcaacctgatgctcagctactccgagcaggacgtgcccgacccggcccggctgcgcttcgaggacgccgtcgtgcgggccaacccctacgagctgcgcctcaagggcctgaacgagcagctgaccctcagcgagctggggtacgcgctgtaccacatcgccaaccaccggggctccagctccgtgcgcacgttcctcgacgaggagaagtccagcgacgacaagaagctggaggagcagcaggccatgaccgagcagctggccaaggagaaggggatcagcaccttcatcgaggtcctcaccgccttcaacacgaacggcctgatcgggtaccggaactccgagagcgtcaagagcaagggcgtgcccgtgcccacccgcgacatcatctccaacgagatcgacgtgctgctccagacccagaagcagttctaccaggagatcctgagcgacgagtactgcgaccggatcgtgtccgcgatcctgttcgagaacgagaagatcgtcccggaggccggctgctgcccctacttccccgacgagaagaagctcccccgctgccacttcctgaacgaggagcgccggctgtgggaggccatcaacaacgcccgcatcaagatgccgatgcaggagggggccgcgaagcggtaccagagcgcctccttcagcgacgagcagcgccacatcctcttccacatcgcccggtccggcaccgacatcacgcccaagctggtgcagaaggagttccccgccctgaagaccagcatcatcgtgctccaggggaaggagaaggccatccagaagatcgcgggcttccgcttccggcgcctggaggagaagtccttctggaagcggctgagcgaggagcagaaggacgacttcttctccgcctggaccaacacccccgacgacaagcgcctcagcaagtacctgatgaagcacctcctgctgacggagaacgaggtcgtggacgccctgaagaccgtgtccctcatcggcgactacgggccgatcggcaagaccgccacccagctgctgatgaagcacctcgaggacgggctgacgtacaccgaggccctggagcggggcatggagaccggggagttccaggagctcagcgtctgggagcagcagtccctgctgccctactacggccagatcctgaccggcagcacgcaggcgctcatggggaagtactggcactccgccttcaaggagaagcgcgacagcgagggcttcttcaagcccaacaccaactccgacgaggagaagtacgggcggatcgccaaccccgtggtgcaccagaccctgaacgagctgcgcaagctcatgaacgagctgatcaccatcctgggcgccaagccgcaggagatcacggtcgagctcgcgcgggagctgaaggtgggggccgagaagcgcgaggacatcatcaagcagcagaccaagcaggagaaggaggccgtcctggcctacagcaagtactgcgagcccaacaacctcgacaagcggtacatcgagcgcttccggctgctggaggaccaggccttcgtgtgcccctactgcctcgagcacatcagcgtggcggacatcgccgccggccgcgccgacgtcgaccacatcttcccccgcgacgacaccgccgacaactcctacggcaacaaggtggtggcgcaccggcagtgcaacgacatcaaggggaagcgcaccccgtacgccgccttcagcaacacgtccgcctggggccccatcatgcactacctggacgagacccccgggatgtggcggaagcgccggaagttcgagaccaacgaggaggagtacgccaagtacctgcagagcaagggcttcgtctcccgcttcgagagcgacaactcctacatcgcgaaggccgccaaggagtacctccggtgcctgttcaaccccaacaacgtgaccgccgtggggagcctgaagggcatggagacgtccatcctccgcaaggcgtggaacctgcagggcatcgacgacctgctcgggagccggcactggtccaaggacgccgacaccagcccgaccatgcgcaagaaccgggacgacaaccgccaccacggcctggacgccatcgtcgccctgtactgctcccggagcctcgtgcagatgatcaacaccatgtccgagcaggggaagcgcgccgtggagatcgaggcgatgatccccatccccggctacgccagcgagccgaacctgtccttcgaggcccagcgggagctgttccgcaagaagatcctcgagttcatggacctgcacgccttcgtcagcatgaagacggacaacgacgccaacggcgcgctgctcaaggacaccgtgtacagcatcctgggggccgacacccagggcgaggacctggtgttcgtcgtgaagaagaagatcaaggacatcggggtgaagatcggcgactacgaggaggtcgcctccgccatccgggggcgcatcaccgacaagcagcccaagtggtaccccatggagatgaaggacaagatcgagcagctccagagcaagaacgaggccgcgctgcagaagtacaaggagtccctggtgcaggccgccgccgtgctcgaggagagcaaccggaagctgatcgagtccggcaagaagcccatccagctgagcgagaagaccatctccaagaaggcgctcgagctggtcggcgggtactactacctgatcagcaacaacaagcgcacgaagaccttcgtggtgaaggagccgtccaacgaggtcaagggcttcgccttcgacaccgggagcaacctctgcctggacttctaccacgacgcccagggcaagctgtgcggggagatcatccggaagatccaggccatgaacccctcctacaagcccgcctacatgaagcagggctacagcctctacgtgcgcctgtaccagggcgacgtgtgcgagctgcgcgcgtccgacctcaccgaggccgagagcaacctggccaagacgacccacgtccggctgcccaacgccaagccggggcgcaccttcgtgatcatcatcaccttcacggagatgggctccgggtaccagatctacttcagcaacctcgccaagtccaagaagggccaggacaccagcttcaccctgaccacgatcaagaactacgacgtgcggaaggtccagctgtccagcgcggggctcgtgcgctacgtgagccccctgctggtcgacaagatcgagaaggacgaggtggccctctgcggcgagtga

SEQ ID NO: 1714 - RNA, 3567 nt, synthetic construct
  misc_feature 1..3567: note = Cas9 variant
  source 1..3567: mol_type = other RNA
atgaagtacatcctgggcctcgacatcggggtgagctccgtcggcatcgccgtgatcagcgaggagaaccagaagaagaccatcgagaacctggccgtgcgcatcgtccccgaggacccggacttccacgggaagttctactccggcaacaccgcgagcaagaacctggagcggacggccaagcgcgggaaccggaagaacaaccagcgcttcaaggcccggcgcgacaagctctaccagtccctgaaggagaacaacatgttccccaccagcaacctgttcgacctctccgccgtggagctgtacggcctgcgggccaaggcggtgagcgagcaggtctccctccaggagctgggccgcatcctgatcctcctgaaccagcggcgcgggttcctgagcaaccggaagtccgtgagcgaggagaactccaccgagtacaaggagcgcatcgccggcctcgagaaggccctggggaacaagaccatcggccagaagctgtacagcgagctccaggagaacaacaacgtgttcgaggtcctgctgcgggagcgcacgtaccagcggtccagctacaccgaggagttcgaccgcatctgggacgagcagaagaagtactacctcatcctgaccgggtccagcaacgaggacgacaacaagggcaccctgtacgacctcatccggaaccgcatcatctactaccagcggcccctgaagtcccagaagggcctgatcagcgagtgcctcttcgagaagcaccacaaggccgtggccaagagctccccctacttcgagctgttccgcatctggcagaagatcaacgacctgagctggaagacgccgaacggggagctgttcaagcccaccgacgagcagaagcagaagctcaagaacgcgctgtggaacggcgacaacctcaaccccaagcacaagctgaccgtgtccaagatcaaggagatcctggggtacaccagccgggagaagatctacctcaacttcacggagctggacggctcccgcacctacagcatcctgcgcaacgccctcatcgaggccggcatcgagaagcccgagcagtacctgttcttcaacatggagaccaacgacgagaagggcgggctgttcgagctctggcacatcacctactccctgccgatcgagaaggaggtcatcaacgccctgaagaaccggttcgggttcgacaagaagcaggcggagatcatcgcccgccgggtgggctacagctccgactacgggagcctctccacgcgcgccatccggaagctgctggtgcacctcgagaagggcctgggctacaccgacgcctgcgacaacatcgggtacgaccacagcggctacaagaccaagatcgacctgcagcccaagctgaagcagctcaagcgcaacgagctgcggaaccccgtcgtggagcagatcctgaaccaggtggtcaacgccgtgaacctcatcatcgagaagtacgggaagatcgacgagatccgcgtggagctggcgcgggagctgcgcaacaacgccaagacccggaagaacatctccctcctgaacagcaagaacaagaagaacaacgacatcatccgcaagaagctgcaggaggagtacggcttcaagttcgtcaacgggcgggacgtgacgcgctacatcctctgggaggagaactccaaggagtgcctgtactgcaacaagaccatcaacggcagcgacatgctgaccggcaacgccgacatcgagcacatcctccccaagtcccggagcttcaacaacgccatgaacaactacatcatcacccaccgcaagtgcaactccgacaaggggcagaagacggcctacgacttcatgagcagcaagggcgaggtgatcctgcagcagtacatcgagaaggtcaacgacctgtacaaggacgggaagggctccatcagcaagaccaagttcgagaacctcctgtgcaagggggaggacatcccgtccgacttcgtggagcggatgaagaaggacagccagtacatcgcgaaggaggccgtcaagatgctgaagaccgtgtgccccaacgtgtacaccacgaccggccaggtcaccgacttcctccgcgaggagtggaagctgaagaacctgctccaggagctgaccttcgagaagtacaaggccatcggccaggtgaaggagaagatcatcaagacgaacaacgggcagaccaagaccttcaaggtgatcgccgactggtccaagcgggacgaccaccgccaccacgccatcgacgcgctgatctgcgccctcaccgaccagaagatcatcttcaagctgaacaacctgaacaagatctaccagtacgagcgcaacgccctcagccagaaggagatcgaggagatcgaggagttcctggagggcaagttctccatcaaggagttcagcgcccagcaggggaacatcatcgagtgctccatccccaacatccggaaggacgcgcagaagcacctggagaacatcctcatcagcttcaagaaggagaactccaaggtcctgacgatgaaccgcaaccagcccaagaactgcaaggagcagatcacctgggtgccgcgggcccgcctgcacgaggacaccatcatgggccgggtgaagcgcatccccgagaagaagatgaagctcaacgacaaggtcagcttcgagcagatcaagatgatcgtgaaccccgagatcaaggagatcctgctgtaccggctcgccaagttcggcgacaaccccaaggtggccttcgccaccaaggcgctgaagaaggagccgatcttctaccgcgagaacgagctgaaggaggtctccatctacgagtgggtgaacaccaagcgggtggccctcaacgagaacatcacggacagccagatcgagaagatcatcgaccaggcctccaagcgcgccgtcaaggagcggctgaacgggggcaagatcaaggaggtgttcaagaacctgaccgagaaccccatccagctcaagaacgggatgatcctgaagaacgtgaccgtcaccgacgagagcaaggtggagaagatccgcaacggcttcgccatcacggggaagaaccaccacgcgctggtgtacaaggacgagaacggcaagtacaacgacaaggtcgtgtccttctgggaggccgtggccatcggcctccggaacgtcaccgagtacgggaacccctaccccatcatcaaccgcaaccacaacgacgagctgggcgagttctacttcagcatgcagatcaacgacctgttcgtgttcgacctcaagcacagcgagaacccgcaggaggagaacgagatcaacttcttcgacgtggagaaccggaagcagatctccgacaagctgttccgcgtccagaagatgagcaagaagtccaacgggcagttcgtgagcgacttccggcaccacctggagacctccgtgatccgcaacgacatgatcctcaagaacatcacctggatcagcatctccaagaacagcgacctggagcggctgacgaagatccgcgtcaaccacctcggcgagatcatcaaggtgggggagtga

SEQ ID NO: 1715 - RNA, 3585 nt, synthetic construct
  misc_feature 1..3585: note = Cas9 variant
  source 1..3585: mol_type = other RNA
atggacttcaccgccgacgtgagcgagctgaacgagtccttcatgcagatccacaccgagagcaagttcgagatcgacacggccaaggtccaggagatctcccagctcctgctggacaacaagatcacccgcatggaccggcagaagcaggtcgcgaacgtgctcgccaagaacagcggcgacaaggaggccgacaagatcaacaagaagatcgccaccgagttctgcaaggccgtgctggggaacaaggcgaagttcaacgtgatcctgggcgaggacgccgtggactccgactggagcttcaagatggacgacgagaactccgacgaggagatcgagatcctcatggggcagaccaacggccagcagcagaacgtcctgcgcatcatccaccagtggtacagccagatcacgctgaacgggatcgtgcccgacggccagatgatctccgagagcatgatcgacaagtacgagctccaccggaagcacctcctgctgctgaagcagcagatcaaggtgaccaaggacaagaagaaggcccagcagctgcacgaggcctacgagcagtacgtccacggcaccggggcgaagaagaagctcacccaggacgacttctactccaaggtgacgaagaacctggagaccagcgacttctccgacgagatcaagaagcagatcaacgccgagaccttcatgccgaagcagcgcaccagcgccaacggcgtgatcccccaccagctgcaccagcaggagctcgacaagatcatcgagaagcaggccaagtactaccccttcctggccgagctgaaccccgacacgaagcggcagaacatcgcgaagtacaagctcgacgagctgatcgccttcaagatcccgtactacgtcgggcccctgatcaccaccgaggaccagaagaagacctccggcaagagcttcgcctggatggtgcgcaaggagcccgggaagatcacgccctggaacttcgaccagaaggtggacaagatggcctccgccgaccagttcatccggcgcatgaccaccaaggacagctacctcatcaccgaggacgtcctgccggcggagtccctgatctaccagaagtacaaggtgctcaacgagctgaacatgatccgggtgaacggcaacaagctgacgaagcacgacaagcagaacatctaccagcaggtcttcgagaagtacaagaccgtgaacgtgaagaaggtccagaactacttcctcaccgacggccgctaccagcacgcccccaagatcaccgggctgagcgacgacaacaagttcaacagcaacctgtccacgtacatcgacttcaagaagatcttccaggacgtggtggacgacccccagaagcagaaggacttcgagcggatcatcgagtggagcaccatcttcgaggaccgccacatctacgaggtcaagctcaaggagatctcctggctgaacgacgagcagcggaaggagctgaagaagaagcgccaccagggctgggggcggctcagcgccaagctgctgaccggcatcttcgacgagaacggctactccatcatggaccagctctggaacacccagaagaacttcatgcagatccaggccgaggaggggttcaacaagaagatccaggccgagaacagcaagcacctggagaagaacgacttcgaggacatcctggaggacgcgtacacgagcccccagaacaagaaggccatccgccaggtgatcaaggtcgtggaggacatccagaagaccatgggcaccgccccgcagaagatcagcatcgagttcacccggtccgccgacaagaacccccgccggagcatcgagcgccagcggcagctcgaggagatctactacaacgacgccaaggagatcgtgtccgaggggatgcaggacaacctgcagaacttcacggacaacaagcagaccctgaccgacaagtacttcctctacttcacccagctgggcatcgacatgtacacggggaagaagatcaacatcgacgagatcggcaactaccagatcgaccacatcctgccccaggcgttcatcaaggacgacagcatcgacaacaaggtcctcgtgtccagcgccatcaacaacggcaagtccgacaacgtgcccctgagcatgtacgcctccgtccgcatcaagagcgaggtgcagaacaagtggaagaacttcgccgagcacgggctgatctcccagcgcaagctgaacaacctcatgaccgacccggagagcatcgacaagtacaaggcgcggggcttcatcaagcgccagctggtggagaccagccaggtcatccggctggtggccgagatcctcaacgagaagtaccagggggagaccgagatcatcgaggtgcgcgccaagatgaactcccagctgcggaaggacttcgacctgctcaagaaccgcaacgtcaacgactaccaccacgccctggacgcctacctgaccacgttcatcggcaactacctctaccggcgctaccccaagctgcggagctacttcacctacgggcacttcaagaagatcgacgacgcgaagctgaagcagttcaacttcctccacgacatcgagaacgacaaggaccccaagtacgtgaacgacaacggcgagctgctgtgggaccgcgagaaggacatcgcctacttcaagaagatctacaacttcaagtacatgctcgtgtcccacgaggtcagcacccggcagggcgccatgttcaagcagaccatcttccccgccgccgcggacgccaagtccaagctgatcccgatcaagaacgacaagcccacggccatctacgggggctacaccaacaacaacgacgcctacctggccatcatcaagctcgcgaagaccgggcagttcaaggtggtgggcgtcccccagcgcgccatcgtgaagctgaagcaggcctacgacaaggagaccggggactacagcaacgtgctgtacaaggtcctcgagcccaagttcgtgaagaagaaggtgaaccggaagacgggcgagatcacctaccaggtcgagaagttcaagatcgtggtgccgaaggtcccctaccgccagctggtgatcgacggcgaccagaagttcatgctggggtccagcacctacaagtacaacgccaagcagctcgtgctgtccgagaacgcgatcaagatcctggacaagaagtccttcgaccagtccggctacaagagctccgacctcgacaccgtctacgacgagatcctgagccaggtggaccggtacttctccatgtacgacaagaacaagttccgcgaggggctgcacaacggcaagaagtacttccagcggctccccatgatcgacaacgtggagaagggcaagatcaaggagaacgggaagttcaagctgctgaacgagatcctcatcggcctgcacgccaaccccagcttcgggaacctgaagtccctcggcatcagcacgccgttcgggatgatgcagttcgccagcggcatctccctgagcgagaacgccatcctgtgctaccagtcccccaccggcatcttcgagcgccgggtcgccctcaaggacctgtga

SEQ ID NO: 1716 - RNA, 3588 nt, synthetic construct
  misc_feature 1..3588: note = Cas9 variant
  source 1..3588: mol_type = other RNA
atgcagaagaacatcaacaccaagcagaaccacatctacatcaagcaggcccagaagatcaaggagaagctgggcgacaagccctaccgcatcgggctcgacctgggcgtggggagcatcggcttcgccatcgtctccatggaggagaacgacgggaacgtgctgctcccgaaggagatcatcatggtgggcagccggatcttcaaggcgtccgccggcgccgccgaccgcaagctgagccgggggcagcgcaacaaccaccggcacacccgcgagcggatgcgctacctgtggaaggtcctcgccgagcagaagctggcgctgcccgtgcccgccgacctcgaccggaaggagaactccagcgagggcgagacgtccgccaagcgcttcctgggggacgtgctgcagaaggacatctacgagctccgggtcaagagcctggacgagcgcctgtccctccaggagctgggctacgtgctgtaccacatcgccgggcaccggggcagctccgcgatccgcaccttcgagaacgacagcgaggaggcccagaaggagaacaccgagaacaagaagatcgccggcaacatcaagcggctcatggccaagaagaactaccgcacctacggggagtacctgtacaaggagttcttcgagaacaaggagaagcacaagcgggagaagatctccaacgccgcgaacaaccacaagttcagccccacgcgcgacctggtgatcaaggaggccgaggccatcctcaagaagcaggccggcaaggacgggttccacaaggagctgaccgaggagtacatcgagaagctgaccaaggccatcggctacgagtccgagaagctcatcccggagagcggcttctgcccctacctgaaggacgagaagcggctgcccgcgtcccacaagctcaacgaggagcgccggctgtgggagaccctgaacaacgcccgctacagcgaccccatcgtcgacatcgtgacgggggagatcaccggctactacgagaagcagttcaccaaggagcagaagcagaagctgttcgactacctcctgaccgggtccgagctcacgccggcccagaccaagaagctgctgggcctcaagaacaccaacttcgaggacatcatcctgcaggggcgcgacaagaaggcccagaagatcaagggctacaagctgatcaagctcgagagcatgcccttctgggcccggctgagcgaggcgcagcaggactccttcctgtacgactggaacagctgccccgacgagaagctcctgaccgagaagctgtccaacgagtaccacctcacggaggaggagatcgacaacgccttcaacgagatcgtgctgagctccagctacgcgcccctgggcaagtccgccatgctcatcatcctggagaagatcaagaacgacctgagctacaccgaggccgtcgaggaggccctgaaggaggggaagctcaccaaggagaagcaggccatcaaggaccgcctgccgtactacggcgccgtgctgcaggagtccacccagaagatcatcgccaaggggttcagcccccagttcaaggacaagggctacaagacgccccacaccaacaagtacgagctcgagtacgggcggatcgcgaaccccgtggtccaccagaccctgaacgagctgcgcaagctcgtgaacgagatcatcgacatcctgggcaagaagccgtgcgagatcggcctggagaccgcccgggagctcaagaagtccgccgaggaccgcagcaagctgtcccgggagcagaacgacaacgagagcaaccgcaaccggatctacgagatctacatccgcccccagcagcaggtcatcatcacgcggcgcgagaacccccggaactacatcctgaagttcgagctcctggaggagcagaagtcccagtgccccttctgcgggggccagatcagcccgaacgacatcatcaacaaccaggccgacatcgagcacctgttccccatcgccgagtccgaggacaacgggcgcaacaacctcgtgatcagccactccgcgtgcaacgccgacaaggccaagcggagcccctgggccgccttcgcgagcgccgccaaggactccaagtacgactacaaccgcatcctgagcaacgtgaaggagaacatcccccacaaggcctggcggttcaaccagggcgccttcgagaagttcatcgagaacaagccgatggcggcccgcttcaagaccgacaactcctacatcagcaaggtggcccacaagtacctggcctgcctcttcgagaagcccaacatcatctgcgtcaaggggtccctgaccgcgcagctgcggatggcctggggcctccagggcctgatgatccccttcgccaagcagctgatcaccgagaaggagagcgagtccttcaacaaggacgtgaacagcaacaagaagatccgcctcgacaaccgccaccacgccctggacgccatcgtgatcgcgtacgcctcccgggggtacggcaacctgctcaacaagatggccgggaaggactacaagatcaactacagcgagcgcaactggctgtccaagatcctgctgcccccgaacaacatcgtctgggagaacatcgacgccgacctcgagagcttcgagtccagcgtgaagacggccctgaagaacgcgttcatctccgtcaagcacgaccacagcgacaacggcgagctcgtgaagggcaccatgtacaagatcttctactccgagcgggggtacaccctgaccacgtacaagaagctgagcgccctcaagctgaccgacccccagaagaagaagacccccaaggacttcctggagaccgccctcctgaagttcaagggccgcgagagcgagatgaagaacgagaagatcaagtccgccatcgagaacaacaagcggctgttcgacgtgatccaggacaacctcgagaaggccaagaagctgctggaggaggagaacgagaagtccaaggcggaggggaagaaggagaagaacatcaacgacgccagcatctaccagaaggccatcagcctctccggcgacaagtacgtccagctgagcaagaaggagccggggaagttcttcgccatctccaagcccacgcccaccaccaccggctacggctacgacaccggggacagcctgtgcgtggacctctactacgacaacaagggcaagctgtgcggggagatcatccgcaagatcgacgcgcagcagaagaaccccctgaagtacaaggagcagggcttcaccctcttcgagcggatctacgggggcgacatcctggaggtggacttcgacatccactccgacaagaacagcttccgcaacaacacgggctccgccccggagaaccgggtcttcatcaaggtggggaccttcaccgagatcacgaacaacaacatccagatctggttcggcaacatcatcaagagcaccgggggccaggacgactccttcaccatcaacagcatgcagcagtacaacccccgcaagctgatcctctccagctgcgggttcatcaagtaccggtcccccatcctgaagaacaaggagggctga

SEQ ID NO: 1717 - RNA, 3594 nt, synthetic construct
  misc_feature 1..3594: note = Cas9 variant
  source 1..3594: mol_type = other RNA
atgagcaagcacgtgctgggcctcgacctgggggtcggctccatcgggtggtgcctgatcgccctcgacgagcaggaccagcccgccgagatcctgggcatggggagccgcatcgtgccgctgaccaccgacgacctcaacgagttctcccagggcaaggcgatcagcaagaaccagaagcggacgacccagcgcaccatccggaagggcctggaccgctaccagctgcggcgcaaggtgctctccgagaagctggccgggcacggcatgctgcccgacaaggacctcatgcagctgcccgtcctggacctctgggagctgcgggcccgcgccgccagccccggggagaagctgtccctcccggagatcggccgggtgctgtaccacatcaaccagaagcgcgggtacaagcacgccaagagcgacgaggcggaggaggtgaccaagcggggcaaggagcagggctacgtcgccacggtgaaggggcgctacgccgagctgcagcgggagggcgcgaccgtggggcagcacttcgcctgcaagctcaaggagcaccgccaggagtcccccagcggcggcttcttctacaactaccggatcaaggaccaggtctacccccgcgaggcctacatcgaggagttcgaccggatcatggaggtgcagtccgtgttctaccccgaggtcctgaccccggccttcatccaggagctgcgcgacaaggtgatcttcttccagcggcccctcaagagctgcaaggggctggtgtccttctgcgagttcgagaagcaggagcgcgtcgtgcagctgaagcgggtgaaccgcgagggcaaggaggagctccaggagcgcaagatcaccatcgggcccaaggtcgcccccaagagctccccgatcgcgcagctgtgcaagctgtgggagagcatccacaacatccggatctactaccccgacggcaaggagcgccccatcacgctcgaggagaagcggaagctgctggcctacctccagacccacgacaagctgaccttcaccgccctgaagaaggagctcaagatctccgacaaggagcgcctgtggtgcgacaagctgctcaagggcgggatcaagggcgacacgacccgggtgctgctgcgcaaggccctcgccgggtacaagcggtacgagcccctgctgcgcatggacctcgagctgcgggacttccaggagatcgtgagcggcaagcgcctgatccggccgatcgtcgacgagtcctacctcagccagcccctgtaccgcctgtggcacatcctgtacagcatcgaggagcgggaggcgatgcgccgggccctcatcgaccagctggggttcctggaggaggacctcgacggcgggctgctggacaagctctaccagatcgacttcgccaagcagggctactccaacaagagcgccaagttcatctgcaagctgctgccccacctccagggcgggcacggctactcccaggcctgcgagctggcggggaagcgccacagcgccggctccctgaccaaggaggagctcgaggagcggcccctgctggagcacatcccgctcctgcagtgcaacgagctgcgccagcccatcgtggagaagatcctcaaccagatgatcaacctggtgaacgccctgcggcagaagtacgggagcatcgacgaggtccgcgtggagctcgcccgcgagctgaagatgtcccgggaggagcgcgaggagaccagcaagcggatccgctcccgggagaaggagaacaaggagatcgccgagcgcatcaaggagtacgagctgtaccccaccaagagccggatccagaagtaccgcctctggcaggaggcgggcgagcagtgcctgtactgcggccggtccatcgacgtcgtgcagttcctgcgcggggacggcgtggagatcgagcacatcatccccaagagcatcctctacgacgactccagcgccaacaagacgtgcgcctgctcccggtgcaacaaggacaaggggaaccgcaccgcctacgagtacatcctggcggagggccgggaggccgagtacctggaccgcctcgagaccctgttccacgacggcaagctgagctactccaagcggcgccggctccagtggaagaaggccgacatcccggtcgacttcatcgagcgccagctgcggctgacgcagtacatcgcccgccaggcccaggagatcctccggcaggggatccgccgcgtgggcgcgagcgaggggtccgtgaccgccaagctgcggcacctgtggggctacgacgacatcctccgcgagctgaacttcgagcggtaccagagcatgggggagaccgagatcgtcagccaggaggagaaggacggctccatcaccaagagcgagcgcatcaaggactggtccaagcggaaggaccaccgccaccacgccatcgacgccctggtggtggcctgcacgcggcagggctacatccagcgcctcaacagcctgaactccgaggaggacagcctgcagatgcaggaggactccaagcagatgcgggagaagatgggcgggcagaagcgccccaccgcggacaagcacagcatcctcgagaactggctgatcctgcagccccacttctcccaccaggaggtcaagagcaaggtggccgagatcctcgtgtccttccggcccgggaagcgcaccgtcagcaccggccggaacacgtacctgcgctccgggaagaaggtgacccagagcggcgtgctgatcccgcggggccccctctccgaggagagcctgtacgggcagatcctgcgcaacggcgagcccacctacgtcaagaaggtggccctcgagtccctgagcgaggcccagatcgagcagatcgtggacccgaagctgcggcgcgagatggtcgcccggacccagcccagcgagggggcgaagctcaaccccaagctgctgctcgccacgcccttctactccgacgccgccggcacccagcgcgtgcgcagcgtgcgggtcgcgatcgagaacgggaagaactccatcgtgccgctgcgctacaacgagagcggcaaggccatcaccttcgtgaaccccggcaacaaccaccacgtcgggatctaccggacctccgagggcaagctggtggagagctgcgtgacgttctggcaggccgtcgaccgcgtgcggtacgggatccccaccatcatccgcaagccccgggaggtgctcgaccagctgctgctccgcgacgacatcccggaggccctgctggcccacctccccgcgtccgactgggagttcgtcgagtacctgcaggccaacgagatgttcctgatcggcctcaccgacgaggagatccagaccgccctggccgagagcgacctgctcaccctgtccaaccacctgtaccgggtgcagaagatgagctccgagtactacgtgttccgctaccacctcgagacggaggtcgccgacaacaagaacaacaccgggatcatccccaagttctaccggctgcgcggccccaacgacacctacctgaaggcgaacccgcggaaggtgaaggtgaacctcctgggcgagatcagcctgccctga

SEQ ID NO: 1718 - RNA, 3615 nt, synthetic construct
  misc_feature 1..3615: note = Cas9 variant
  source 1..3615: mol_type = other RNA
atggagcgcatcctgggcatcgacaccgggaccaacagcctcggctgggccatcgtggacaaggacgagaaccagtaccacctggtcgccaaggggacgaacatcttctccgagggcgtgaagatcgagaaggggatcgagagctccaaggcggccgagcggaccgagcaccgcagcgtgcggaagcactactggcgccggaagatccgcaagatccggctgctcaccatcctgtccgacaacgacctgtgcccccgcctcaagcacgagcagctgcggcagtggcgcctgaagaaggtctacccgaccgacgacacgttcatggagtggcagcggaccgaggacaaggcccaggtgaacccctacaagttccgctacatctgcctcacccagaagctggacctgagcgacatcacccagcggttcatcctcggccgcgccctgtaccacctgaaccagcggcgcggcttcctctccaaccggaaggaggccacgaaggagagcgaggggaccgtgaaggagggcatctccagcctgtccaaggacatgaaggacagcgggtgcgagtacctgggcgagtacttctaccagctctaccagcaggggaagaagatccgcaaccactacaccgcgcggaaggagcactacctgaaggagttcaaggccatctgctccaagcaggagctggacgacgccctcatcgagaagctggagaaggccatcttcgaccagcgccccctcaagagccagaagggccaggtcgggacctgcacgttcgagaagggcaagtcccggtgccccagctcccacccgctgtacgaggacttccgcatgtacagcttcatcaacaacatcaaggtccaggtggacaccctgtacgacaagggcgagcgctccctgaccgacgaggagaagcagctcatcatccccctgttcaagcgcaagagcaagcggaccttccccttcgaggacatcgcgaagaagatcgccgggaagaacaactactgctacatcaagagcaacgaggagaaggcctacaagttcaactaccagatggacacccaggtgtccggcagccccgtgaacgcccagctggaggagatcttcggcgaggactggctctccagcgtgtgcgaggtctacacgctggccaacaacaagtcccggttccagatcatgaacgacgtgtggcacgtgctgttcttctacgacgacgaggacaagctcaaggagttcgcgaaggaccgcctgcagctggacgacgagctcgccgagaagttcagcaagatctccatcccgaacgactacgccgccctgagcctgaaggccatccggaagatcatgccctacctccgcgactacgggctgatctactccgaggcggtcttcctggccaacctcgtggacgtgctgccccagcacgtctggggcatcaaggagatgcgggaggccgccatcgagaacgtgatcgacgtgatgcacagctacgacaagaacaacatcgacgggatcaccctggagggctgcgtcaagaccttcctcaaggagcgctaccaggtgtccgacgacaacctgaagaagctgtaccaccccagcatgctcgacccgtacccccggcagcgccccaacgacgagggggtgttccagctgggcagcccccggatcagctccgtcaagaacccgatggccatgcacagcctgttccgcctgcggaaggtggtcaacctcatgctgaagaagggctacatcacgcccgacaccaaggtgcacatcgagttctcccgcgacctgaacgacgcgaacaagcggtgggccatccagacctggcagcgcgagaacgagaaggagcgggagcgctgccggaaggagatcgagaagtacatcgccagcccctccgacaccgacatcctcaagtaccagctgtgggaggagcagaaccacaagtgcctgtacacgggggacgagatccgcatcaccgacttcctcggcgacaaccccaagtacgacatcgagcacaccatcccgcgcagcgccgggggcgacagcaccaagatgaacctgacgctgtgctccagccggttcaaccgcgacgagaagaagaccaagctccccgccgagctggtgaaccacgacgagatcctggagcggatctccaactggaaggagaagtacgaggacatcgacaagcagatccgcaagatcagcaccaagggggcgacctccaaggaggacaaggacagcaagatccggcgccggcactacctcatcctgcagcgcgactactggcggggcaagtaccagcgcttcacgatgaccgaggtccccgagggcttctcccggcgccaggggaccgacatcagcgtgatctcccggtacgcccgcatgtacctcaagagcgtgttcaagcaggtctacatcgtgaagggcatcgccacctccgacttccggaagatgtgggggatccaggacgagtacgccaagaaggagcgcgtgaaccacgtccaccactgcatcgacgcgatcacgatcgcctgcatcggcaaggccgagtacgacaagctggccgactaccggcaccagtacgacgactacctgttccaggggaagaccaagcccaccttcgacaagccgtggcccagcttcgtgatcgacatcaagcacatccaggacgagctgctcatcgcccactacgcgaaggacaacctggagaagttcaccaagaagaacctgcgcggcaaggacggccggatcatccgcgacaagttcgggaacaagctccagatgaagggcgacacctcccggaacagcctgcacaacgacaagttctacggggccatcaaccacgagggcgagatcaagtacgtgtaccgcacgaacatcgaggccctggacgccaagtccatcggcaacatcgtcgaccccaccgtgcgcagcatcatcgagtccgccatcgcgatccacgggagcctcaaggccgccatcaacaagggcatctggatgaacgaggagaagcacatccccatcaagaaggtgcgggtcttccgcaacgacgtgaagaagccgatcgagctgaaggaccagcgggacctgagcgacaaggactacaagcagcactactacgtgaccaacgacgggaactacatgatgctcatcttctccaagctgaacaacaagggccgcgagatccggcagcacgtcgtgatcaacagcctggaggccaccgaggtgatcaagtcccacaagcgcagccaggtcgggaaggtggtgtgggagtcctactacagcaaggagggcttcgacctcatctacaagctgaagtccggcacgatgatcctgctctacgagaacaaccgggacgaggtctgggacctggacatccgcaacctgcagaagcggctctacatcatcaccaagatgaagtacgacgggcgcatctacatgatgcaccaccaggaggcccgggagaagaaggacctggaggagaagtccggctccttcaagatcaacgaggactaccgccccctgatcgtgaacagctacaaccagttcaacgcgctcgtgcaggacctggacttcgagatcaacgacctgggggagatccggcgcctcatctga

SEQ ID NO: 1719 - RNA, 3630 nt, synthetic construct
  misc_feature 1..3630: note = Cas9 variant
  source 1..3630: mol_type = other RNA
atgaagaaggactacatcctgggcctcgacatcgggatcagctccgtgggctgggggctgctggagctcgacgacaacaacaacccctacaagatcatcgacgtcggcagccgcatcttcaccccgggggaggtggagaagaccggcgactcccgggccaaggagcgccgggagaagcgcggcgcccggcgcatcgcgcggcgccgggagttccgcctggaccgggtgaagaacctgctctacgagaacgggtacctgaagggcaacatcaacagcaacatcgtctccgagaagaacgaggagctgagcatcatcttcaacaacatgatcaacaactactacaacgggaagaacacgaacccctacatcctcaaggtggaggccctggaccgcaagctgaccgacgaggagctctccatcatcctggtgcactacgccaagaagcggggctacaagagcaaccgcgaggaggcctccgacaaggagagcgggaaggtcctgaccgccatcaaggagaacgagaagatcatgaaggacaacaactaccggaccatctccgagatgtacatcaaggacgacaagttcaagaacaagatcaagaacagccccaacgactacaagatctccgtgacgaacgagatgtacctcgaggagatcaacaaggtgctggacagccagatcaagttcggcctgatcaccgacgacttcaagaaccagtacctcgagatctacaactcccgccggagctacgcgaagggccccgggggcaactccccgtacgggggcgacctgatcgagcgcatgaccggcaagtgcaacttcgacgggaacccccgggcccccaagcgcgccttcagctccgagatctacgtcgccctgaccaagctcgtgaacctgaagtacaaggtgaacgacggcgagtacatcaagctgagcgagaaggagatcaagaacatcatcgagaaggcgaaggagaagaagtccatcagctacaaggacctcacgaagatgatcgggaacaacatcgacttcaaggacctgaccctgagcaagaaggagtacatcaagctcatcgaggagctgaagaagaagctgaacatcaagaaggacaccaagatcaacatcaacgagctctccagcgaggacaaggagctgtacaacaagctgtgcaacgacaagctcctgtccaagaccctgatcgagctcaagggctaccacatcctgaaggacagcgtcatcaaggcctactccaaggacatctgggacgaggtgaaggacaacatgtacctgctcgacgacctggccctgtactgcacgaactacaaggtgaacgaggacatcctcaacaagatcaaggagagcgagaacatcgacaacatcttcaacgacatccacttcgtcgagctgctgcccaacttcaaggaccacctcatgctgtccaccgagctgatccggaagctcatcccgatcatgtacgggggcaacacctacgacaaggccatgaacatcctgggctacaaccacagcgacatcaacggggacaaggagaagaaggacctgctggtgcccatctgcgtggacgacaacatcaccaaccagcgcgtcatccgctccctcacgcagacccggaaggtgatcaacagcatcatcaagaagtacggcatgcccaagatcatcaacatcgagaccgcccgcgagctggcgaagtcccggcaggagcgcaacgagatcgccaagaacaacgtggagaagcaggccgagaacgagaagatcaagaaccagctggtcgagctcgggctgttcgtgagcaccgacaagatctccagcacggacctgctcaagtacaagctgtggaaggagcagaacgagttctgcggctactccatgaagaagatcagcatcgaggacctgttcgggaacaacatcgtgcagatcgaccacatcctcccctactcccggacctacaacgacaactacctgaacaagaccctggtctacaccaaggagaaccaggagaagggcaaccgcacgccgtacgagtggttcggcaagaccgacaagtgggacgagtacgagacctacatcaacaacctcaccatcagccagaagaagaaggacaactacctgctgaagaagctcgacttcgacacggagcgggagatgcgcagccagaacctgaacgacaccaagtacatctccaaggagctgagctccctcatcaaggcctacctgaacgtggagaaggtcaacatgtaccccggggccatcaccgcgaagctgcgggcccgctggggcttcaaccggctcacccacagctacctgtccaagaactacatcctgcccaagaacatcaaggaggacatcaacaaggaccgcgacaaccacctccaccacgccatggacgccctggtgatcgccagcatcacgccctccctgcagcagaagatcaccctctacgagaagttcagccggtacatcgacgggctgaccgagctgcagatcaagaacatctcctacatcaagatcgaggacagcgagggccagtactacaacgacgacaccgacgaggtggagacgatcgacatccgcgagtacatcaagcagcagctcgcggagaacaacatctactacaaccggcacaacatctccaagctggagttcccgctgccctacgagaacttcgacaaggaggccaagctccgcgtctacgagcaggacctggacaccctgaagtggaacctcaagagctacaacacctacacccagaaggacatcgacaacgtgcacaccctgatcccctccatcgccaagacgaaggtgagcgggaagatgcacgaggagacctactacggcatcaaggagatcggcaaggacgaggacaagaagatctacaagaccctgcggacccccatcgagaaggtcaagcgcaaggacctcgacaacatcccggaccggctcgggggctccaaggacgtgtacgagagcctggtggagtggttcggggactacgaggtcggcgaggaggtgctgaaggccaacggcaacaagtaccccgtgtccaagagcgacaaggagcacaaggagatcaagaagctgaagctgtacagcgagtacaagaacacggggcacatgatcaacaagtccaacgtcgagaagggcgggatctaccgcatcgacgtgttcaagagcaaggacaaggaggacgacaagctctacttcgccgcgtacgacatcctggagatcaagaagatcaacaccctgaaggagaagaaccgcgtggacgacaacttcaacatcaagctcgactacggccaggggaagaactccaagatcatgagctacaccgacatcatcaacaactacgacctgtacatctccctgaacaagaacgacctcatcaagatcaccacgaacgacggcaaggagagcgtcgcctacgtggtgggctgctccagcgggatgctggaggtcaagtccaagctgggcgacgggtacgacatcatcaagaccgacctcaacgagaacaacatcttcagcaagcagcgggcccagtaccagatcaccgtgtccaccatcaaggagatcaagaagctgagcatctccgtgctgggcgagatcagcgggctctga

SEQ ID NO: 1720 - RNA, 3633 nt, synthetic construct
  misc_feature 1..3633: note = Cas9 variant
  source 1..3633: mol_type = other RNA
atgcgcaccatcctgggcctcgacctggggaccaacagcatcggctgggccgtgatcaactccgtcatcaaggagcagacggagcggatctggatcgagatggccgggagccgcatcatccccatggacgcggccatcctgggcgacttcgacaaggggaactccatcagccagaccgccgagcggacccgcttccggggcgtgcgccggctccgcgagcggcagctgctgcgccgggagcgcctccacaaggtgctgaagatcctgggcttcctcccggagcactacctgaaggggatcgacttcgagaagcacaccggcaagttcctgtccgggagcgagcccaagctcccctgggtcaaggaccggtggggcaagtactccttcctgttccagacggccttcaacgagatgctggccgacttcgcgaagcaccagcccagcctcgtgttcgacgggaagaagatcccgtacgactggaccgtgtactacctgcgcaagaaggccctgaccgagatgatctccaaggaggagctcgcctggatcctgctgaacttcaaccagaagcggggctactaccagctccgcggcgaggaggaggaggacaacgccggcaagagcgtcgagttctacgcgctgaaggtgctgtccgtggaggccaccgacgagaagaaggggcgggacatctggtacaacgtccacctcgagaacgggtgggtgtaccgccggagctccaacgtgcccctggactgggagggccgcgtcaaggagttcatcgtgacgaccgacctgaaccccgacggcacccccaagctcgacaagtacggggaggtgaagcggagcttccgcgccccgaaggaggacgactggatgctgatcaagaagcgcaccgaggccgacatcacgggcacccacaagaccatcgggtcctacatctacgacgccctgctccaggagccccagcagaagatcatcggcaagctggtcaagaccgtggagcggaagttctacaaggaggagctgaacttcatcctccagaagcagtgcgcgttccacgccgagctgcaggaccgcgacctgtacatgcggtgcatcgaggccctctaccccgggaacgaggtgcagcgccggaacatcgccaaccgcgacttcatctacctgctgatcgacgacgtcctcttctaccagcggcccctgaagacgaagaagtccctgatcgccaactgcccgtacgaggagaacgagtacgtgaaccgcaagaccggcgagatcaagaccgcgcccctcaagtgcatcgccaagagccaccccctgttccaggagttccggctgtggtacttcctcagcaacatccgcgtgtaccagaaggagcgggaggtcaacggcaccctgcacctggacgtggacgtgacgaccgagttcctcaagaccgaggacgactacgtcgccctgttcgactggctgaactcccgcaaggagatcgaccagaaggccttcctgcggtaccccgccttcgggctcaagaaggagatcaacaactaccgctggaactacgtggaggacaagttctacccgtgcaacgagacccggcacgcgatcctgagccgcctggagaaggccggcatcgggatcgacttcctcagcgacgagaaggagacggccctgtggcacatcctgtactccgtcagcgacaagcaggagatcgagaaggccctcgccaccttcgcggtgaagaacggcctgaacgagtccttcgtggaggtcttcaagaagttcccgcccttcaagagcgagtacggggcctactccgccaaggccatcaagaagctgctccccctgatgcggtgcggcaagtactgggacatgagcctgatcgacggcaccaccaaggagcgcatcgagcggatcatcgcgggggagtgcgacgagtccatcggcgccaaggtgcgcgagaaggccatgaacctcagcgacatctcctgcttcaagcgcctgcccctgtggctcgcctgctacgtggtctacaaccggcacagcgaggacaaggagatcacgaagtgggagacccccgccgacatcgacgcgtacctggccgccttcaagcagcactccctgcgcaaccccatcgtggagcaggtcatcaccgagaccctccgggtggtgcgcgacatctggaagcaggtcgggaagatcgacgagatccggatcgagctgggccgcgagatgaagaaccccgccgacaagcggaagcgcatgacgacccagatcctggagaacgagaacgccaacctccggatcaaggcgctgctggccgagttcgtgaacccggagtacggggtggagaacgtgcgcccctacagcccctcccagcaggagatcctccggatctacgaggacgccgtcctgaagggcgaggagcagatccccgaggacatcgacgtgatcctgaagaagttcaacaccagcaagctcccgaccaagtccgagttcctgcgctacaagctgtggctcgagcagaagtaccggagcccctacacgggcgagctgatccccctggccaagctgttcaccgccgcgtacgagatcgagcacgtgatcccgcagtcccgctacttcgacgacagcttctccaacaaggtcatctgcgagagcgccgtgaacaagctcaaggacaaccagctggggtacgagttcatcaagaaccaccacggccagaaggtggaggtcgggttcggcaagaccgtggagatcttcagcgtggactcctacgagcggttcgtcaaggagcagtacgccaagagcggcatcaagatgaagaagctcctgatggacgacatccccgagcagttcatcgagcgccagctgaacgactcccggtacatcagcaaggtggtgaaggggctcctgtccaacatcgtccgcgagaagaacgacagcggcgagtacgagcccgaggccgtgtccaagaacatcctggtgtgcaccgggagcgtcaccgaccggctcaagaaggactggggcatgaacgacgtgtggaactccatcgtgagcccccgcttcgagcggctgaacgcgctgacggagacccagtgcttcgggcactgggagaacaaggacggcaagaaggtcttccagaccgccgtgccgctcgagtaccagaagggcttctccaagaagcgcatcgaccaccgccaccacgccatggacgccatcgtgatcgcctgcgcgacccggaaccacgtcaactacctgaacaacgagagcgcctcccgcaacgccaagatcagccggtacgacctgcagcgcctcctgtgcgacaagtcccgcggggacggcaacgggaactaccggtggatcatcaagaagccctggacgaccttcacccaggacgcccgggaggccctgagcggcatcatcgtgtccctcaagcagaacctgcgcatcatcaacaagaccacgaacatctaccagcacttcgacgcgaacgggacccgggtgtacgagaagcagaagatcggcgacagctgggccatccgcaagcccatgcacaaggacaccgtcttcggcgccgtgaacctgcggaaggccctcatcccccagcactacaacctgaccctgttcatcagctcctga

SEQ ID NO: 1721 - RNA, 3642 nt, synthetic construct
  misc_feature 1..3642: note = Cas9 variant
  source 1..3642: mol_type = other RNA
atggagaagcgcctgggcatcgacgtggggaccaacagcctcggctgggccatcgtcgaggtggacgacgaggggtgcaccctgctggaccggggcgtggacatcttccaggagggggtcgcccgcgagaagaaccaggagaagcccgcggtgcaggaccggacggacgcccgcgccctccggcgccactacttccggcgccggctgcgcaagatcgccctgctccgggtgctggtccgccacgacctgtgcccggccctctccgaggagcagctgaacgcgtggcagggcaagggcatctaccccctggacgacgccttcatccggtggcagcgcaccgacgacaacgccgaccggaacccctaccgcgaccggttccgctgcctcaccgaggagctggacctggcctgccgggaggagcgctacgtgctcgggcgggcgctgtaccacctgtgccagcgccgcggcttcctcagcaaccggaaggacgccgggaacgaggccgaggagggcaaggtgaagcaggagatcaagaccctgtccgccgacatggccgcggccgggtgcgagtacctgggcgagtacttctaccgcctctaccagcggaaggagaagatccgcaagcactacacggcccggaacgagcactacctggccgagttccgcgccatctgccggaagcagcgcctggacgaggagctccggcaggcgctggagaaggccatcttctaccagcgccccctcaagagccagaagggcctggtcgggaagtgcaccttcgagaaggacaagtcccggtgcccggtgagccacccccgcttcgaggagttccggatgctgcagttcatcaacaacgtgcgcgtcaccggccccggggacgccgagccccggccgctgtcccccgaggaggtggagatcgtgcgccccctcttcctgcggaagtccaagccccacttcgacttcgaggacatcgccaagaagatcgccggcaagggcaactacgcgtgccgcggggagctgctccaggccccgtaccggttcaactgcgccggcaagagcaccgtcacggggagccccgtgtccgccctgttcgccagcgtgttcggcgacgactggcagcgcgagatctgctccctgtacaccctcggggcgggcaagaacgaggagcagatcctgaacgacgtctggcacgtgctgttcgccttcgaggacgaggagcgcctccaggcctggctgcaggagaagctgcagctcagcgccgacgacgcgaagaccctggccgccttccggctgccccagggctacgcctccctcagcctgaacgtgatcaacaagatcctgccctacctccgccgggggtaccgctacgacgaggccgtcttcttcgcgaacctgggcaaggtgctgccggccgaggtgtacgccgaccccgcccggcgccgggaggtcgagcaggggatctccgcccagatggacgacctgggcgacggggagaagacccgcaaggaggagcggatccgcgactacctccggcgctactggggcgtggaggagaagcggctggagcgcctgtaccaccccagcatgatcgaggcgtacccctccgccagcccgaacggccaggggctcctgcagctgggcagcccccggatccccgccgtccgcaaccccatggccatgcgggccctcttccgcctgcgggtgctgctcaacgagctgctgcgcgaggggaagatcgaccggggcacgaagatcaacatcgagctcgcgcgcgagctgaacgacgccaacaagcgcaaggccatcgagcggtaccagcgcgagcgggaggccgagaaccgcaagtacgcggaggagatccggcagcagtacgtggaggccaccgggcactccatcgagccgagcgaggaggacatcctgaagtaccgcctctgggtcgagcagggccactgctccctgtacaccggcaagaccatcgggatcagcgagttcctgggcgacgggcggcgctacgacatcgagcacacggtgccccggtcccgcggcggcgaggacgcccagtacaacaagaccctctgcgaggaggagttcaaccgggacatcaagcgcgacaagctgcccagcgagctggccaaccacaccgccatcctcgcgtgcgtggagtcctgcgggtggttcgagcggatcgagggcctggagcaccgcgtctggggcgccgaccggcgcgccaagagcgccaccacgaagtccgccaaggacttcgcgatccaggaccggcactactggcgcatgcacctggactactggcggcgcaagtgcgaggccttcaccatgaccgaggtgcccgaggggttcagcaaccgccagggggtggacgtcggcatcatcggccggtacgcccgcctctacctgcagaccgtgttcgaccgggtgtacacggtcaagggggccaccaccgccgcgttccgccggatgtggggcctgcaggaggagtacgccgccaaggagcgcgtgaaccacgtgcaccactgcatcgacgccatcaccatcgcgtgcatcgggtcccgggagtacgccctctgggcccagtacgtccgccaggacgagctgtaccggtggggcgaggccgacaagccgcgctgcgggaagccctggcccacgttcaccgaggacgtgcgggccaccgcggacgagctgctcatcagccaccacaccccggacaacatgcccaagcagtcccgcaagcggctgcgcgtgcggggcaaggtccagcgcaacgaccggggcgaggtgaagtacatgcagggggacacggcccgcggcgccctgcaccagcagaccttctacggggccatcgagcgggacggcgagatccgctacgtggtccgcaagagcctcgaccagctgctgcccgccgacgtggagaagatcgtggacgaggcggtccggcagaaggtgcgcgaggccgtggaggcctacgggttcaaggaggccaccgaccccaccaagcacacggtctggatgaacgaggagaagcagatcccgatccggaaggtgcgcatcctcaccggcgtgaagaaccccatcctgctgaagccccaccgggacgtctccgtgaaggagtacaagcgctactaccacgtggtcaacgacggcaactactgcatggccatctacgaggggcgggaccgccagggccggctcaagcgcaccttcgagatcgtgaacaagctggaggcggcccggtacttcaagcgcagcgccgaccgggagtcccgccccgacctggtgccgctcagcgacgtcaacgggtactccctgaagtacctgctcaagaccggcaccatggtgctgttctacgagaacagccccgacgagctgtacgagtgcagcgtgggggagctcgccaagcggctgtacaaggtcgtgggcatggcccaggacggccgcgtgcagttcctgttccaccaggaggcgcgggaccagaaggccgtcacggccgagtgcgggatgggcatctccgtgttcgacgcccgccaccccgcgcccaagctccggatccgcgtgagcaacttcaagatgttcgtcgaggggtacgacttcgagctgaccgtgaccggcgaggtgaagttcaagcggtga

SEQ ID NO: 1722 - RNA, 3642 nt, synthetic construct
  misc_feature 1..3642: note = Cas9 variant
  source 1..3642: mol_type = other RNA
atggagaagcgcctgggcatcgacgtggggaccaacagcctcggctgggccatcgtcgaggtggacgacgaggggtgcaccctgctggaccggggcgtggacatcttccaggagggggtcgcccgcgagaagaaccaggagaagcccgcggtgcaggaccggacggacgcccgcgccctccggcgccactacttccggcgccggctgcgcaagatcgccctgctccgggtgctggtccgccacgacctgtgcccggccctctccgaggagcagctgaacgcgtggcagggcaagggcatctaccccctggacgacgccttcatccggtggcagcgcaccgacgacaacgccgaccggaacccctaccgcgaccggttccgctgcctcaccgaggagctggacctggcctgccgggaggagcgctacgtgctcgggcgggcgctgtaccacctgtgccagcgccgcggcttcctcagcaaccggaaggacgccgggaacgaggccgaggagggcaaggtgaagcaggagatcaagaccctgtccgccgacatggccgcggccgggtgcgagtacctgggcgagtacttctaccgcctctaccagcggaaggagaagatccgcaagcactacacggcccggaacgagcactacctggccgagttccgcgccatctgccggaagcagcgcctggacgaggagctccggcaggcgctggagaaggccatcttctaccagcgccccctcaagagccagaagggcctcgtcgggaagtgcaccttcgagaaggacaagtcccggtgcccggtgagccacccccgcttcgaggagttccggatgctgcagttcatcaacaacgtgcgcgtcaccggccccggggacgccgagccccggccgctgtcccccgaggaggtggagatcgtgcgccccctcttcctgcggaagtccaagctgcacttcgacttcgaggacatcgccaagaagatcgccggcaagggcaactacgcgtgccgcggggagctcctgcaggccccctaccggttcaactgcgccggcaagagcaccgtcacggggagcccggtgtccgccctgttcgccagcgtgttcggcgacgactggcagcgcgagatctgctccctctacaccctgggggcgggcaagaacgaggagcagatcctgaacgacgtctggcacgtgctgttcgccttcgaggacgaggagcgcctgcagacctggctgcaggagaagctccagctgagcgccgacgacgccaagaccctggcggccttccggctcccccagggctacgcctccctgagcctgaacgtgatcaacaagatcctcccctacctgcgccgggggtaccgctacgacgaggccgtcttcttcgccaacctgggcaaggtgctgcccgcggaggtgtacgccgacccggcccggcgccgggaggtcgagcaggggatctccgcccagatggacgacctcggcgacggggagcagacgcgcaaggaggagcggatccgcgactacctgcggcgctactggggcgtggaggagaagcggctggagcgcctctaccaccccagcatgatcgaggcctacccctccgcgagccccaacggccaggggctgctgcagctcggcagcccgcggatccccgccgtccgcaaccccatggccatgcgggccctgttccgcctgcgggtgctcctgaacgagctgctccgcgaggggaagatcgaccggggcaccaagatcaacatcgagctggcccgcgagctgaacgacgcgaacaagcgcaaggccatcgagcggtaccagcgcgagcgggaggccgagaaccgcaagtacgccgaggagatccggcagcagtacgtggaggcgaccgggcactccatcgagcccagcgaggaggacatcctcaagtaccgcctgtgggtcgagcagggccactgctccctgtacaccggcaagacgatcgggatcagcgagttcctcggcgacgggcggcgctacgacatcgagcacaccgtgccgcggtcccgcggcggcgaggacgcccagtacaacaagaccctgtgcgaggaggagttcaaccgggacatcaagcgcgacaagctgcccagcgagctcgccaaccacaccgccatcctggcctgcgtggagtcctgcgggtggttcgagcggatcgagggcctggagcaccgcgtctggggcgcggaccggcgcgccaagagcgccacgaccaagtccgccaaggacttcgccatccaggaccggcactactggcgcatgcacctcgactactggcggcgcaagtgcgaggcgttcaccatgaccgaggtgcccgaggggttcagcaaccgccagggggtggacgtcggcatcatcggccggtacgcccgcctgtacctgcagacggtgttcgaccgggtgtacaccgtcaagggggccaccaccgccgccttccgccggatgtggggcctccaggaggagtacgcggccaaggagcgcgtgaaccacgtgcaccactgcatcgacgccatcacgatcgcctgcatcgggtcccgggagtacgcgctgtgggcccagtacgtccgccaggacgagctgtaccggcgcggcgaggccgacaagccccggtgcgggaagccgtggcccaccttcaccgaggacgtgcgcgccaccgccgacgagctcctgatcagccaccacacgcccgacaacatgccgaagcagtcccggaagcgcctgcgggtgcgcggcaaggtccagcggaacgaccgcggcgaggtgaagtacatgcagggggacaccgcgcggggcgccctccaccagcagaccttctacggggccatcgagcgcgacggcgagatccggtacgtggtccgcaagagcctggaccagctgctccccgccgacgtggagaagatcgtggacgaggccgtccgccagaaggtgcgggaggcggtggaggcctacgggttcaaggaggccaccgaccccacgaagcacaccgtctggatgaacgaggagaagcagatccccatccgcaaggtgcggatcctgaccggcgtgaagaacccgatcctgctcaagccccaccgcgacgtctccgtgaaggagtacaagcggtactaccacgtggtcaacgacggcaactactgcatggccatctacgaggggcgcgaccggcagggccgcctgaagcggaccttcgagatcgtgaacaagctggaggccgcgcgctacttcaagcggagcgccgaccgcgagtcccggcccgacctcgtgcccctgagcgacgtcaacgggtactccctgaagtacctcctgaagaccggcacgatggtgctgttctacgagaacagcccggacgagctctacgagtgcagcgtgggggagctggccaagcgcctgtacaaggtcgtgggcatggcccaggacggccgggtgcagttcctcttccaccaggaggcccgcgaccagaaggcggtcaccgccgagtgcgggatgggcatctccgtgttcgacgcccggcaccccgcccccaagctgcgcatccgggtgagcaacttcaagatgttcgtcgaggggtacgacttcgagctgaccgtgaccggcgaggtgaagttcaagcgctga

SEQ ID NO: 1723 - RNA, 3651 nt, synthetic construct
  misc_feature 1..3651: note = Cas9 variant
  source 1..3651: mol_type = other RNA
atgaccaagatcctgggcatcgacaccgggacgaacagcctcggctgggccatcgtggacaagaccgccgacaactacaacctgctggacaagggggtcaacatcttccaggagggcgtgaagatcgagaaggggatcgagtccagcaaggcggccgagcgcaccgagcaccgggccacccgcgtgcggtactaccgcatcaagctccggaagatccgcctgctgcggatcctctccgacaaccacctgtgcccgcccctgagccaggaggagctctccacgtggcgcctgaagaaggtctaccccaagaacgagctgttcatgcagtggcagcggaccgacgacgacaccgagaagaccccctacgcctaccgccacaagtgcatccacgagaagctcgacctgagcgacgtgacggaccggtacatcctgggccgcgccttctaccacatcatccagcggcgcggcttcctctccaaccggaaggagcagggcggggaggacagcgggaaggtgaaggagggcatctccaccctgacccacgagatgaacgaggcggggtacgagtacctgggcgactacttctacgccctctacaacaagggcgagaagatccgcaagcactacaccgcccggaacgagcacttcctgagcgagttcaaggccatctgcgagaagcaggacctggagaaggagctcgggtccgaggtcgtgcgcaacatcgagaaggcgatcttcgaccagcggcccctgaagtcccagaagggccaggtggggaagtgcgtcttcgagaagaacaagacgaagtgcccgtccagccaccccatgtacgaggagttccgcatgctgaccttcatcaacaacatcaagatcaagacccccaacgacgacgtgctccggcccctgaacaccggcgagcgcgagaagatcatgccgctgttcttccgcaagtccaagaagcagttcgacttcgaggacatcacgaagaagctcgcccccaagaagatgtacggcttctacaagaaggaggaggacgccgagatgcccttcctgttcaactaccccatggacaccagcgtgtccgggtgcccggtcaccgccgccctgaaggacgtgttcggcgacgactggatcaccgcgatctgcgagacgtacaccctcggggagggcaagagccggttcgacatcgtgaacgacatctggcacgccctgtacttctactccgacaaggacaagctggccgagttcgccatcaaccgcctccagctgagcgaggacgaggccaagatcttcagcgagatctccctgcccgcggactacgccagcctctccctgaaggccatctgcaagatcctgccctacctccggcgcgggctgatctacagccacgccgtcttcctgggcaacctctgcgaggtgatgcccaagtacgagtggtccatcaaggagatgcgggagaccatcatcgacaacatcatcatggagatggacaagtgcgacaccaaggacaagcgcacgttcgaggtgtgcatcaaggactacctgaagggccagtacaacgtcagcgacaactccctgaagaagctctaccacccgagcatgatcgagacctacccccgggtgcagtacaccaacgagcacggggtgtaccagctgggcagcccccgcatcgacagcgtccggaaccccatggccatgcgctccatgttccggctgcgcaagctcgtgaaccggctgctggtggaggggaagatcgaccagaacaccgaggtccacatcgagttcgcgcgcgagctgaacgacgccaacaagcggaacgccatcgccctcttcgtgaaggagaaccagagcgccaacgacgaggcgcgcaagcagatcatcacgctgttcaagaaggagaccggcaccgacatcgagccgaccgacaaggacatcctgaagtacgtcctctgggaggagcagaaccacatctgcctgtacacggggaagcagatccggatctccgacttcatcggcgccaaccccaagttcgacatcgagcacaccatcccccgcagcgtgggcggggactccaccaagatgaacctgaccctctgcgacagccggttcaaccgcgaggtgaagaagacgaagctgcccgtcgagctgccgaaccacgacgagatcatggagcgcatcaaggagtggaagaagaactacgagctcctggacatccagatccggaagaacaagaagctgtccaagggcgccaccaccaaggagcagaaggacaccatcatccgcaagcggcacctcctggagctgcgccgggactactggcgcgggaagtacgagcggttcaccatggagagcgtgcccgagggcttctcccgccggcaggggacggacatcagcgtgatcagcaagtacgcccgcctctacctgaagtccctgttcaaccgggtctacaccgtgaagggcatcgcgaccagcgacttccgcaagatctggggcatccaggacatctactccaagaaggagcggatcaaccacgtgcaccactgcatcgacgccatcgtcatcgcctgcatcgggctcgacgagtacaacaagctgggcgcctactaccacgacgaggagaacaacaagtggtacgggatgagcaaggcctccttcaagaagccctgggcgaccttcgtggaggacatcaagaagatccaggacgagatcctggtgtaccactacacgcccgacaacatgccgaagcagggccgccggcgcatcaagatcgacggcaagaagatcctctgcaagggggacgccgcccggggcagcctgcacaacgacacctactacggggccatcgagaacgacggcgccgtcaagtacgtgaagcgcatcgacctggcgtccctcgaggagaaggacgtgaagaacatcgtcgacgacaccgtgcggagcatcatcgaggccgccatcaaggagaaggggttcaaggacgccatggcctccaccatctggatgaacgaggagaagcgcgtgcccatcaagaaggtccggtgcttcacgcccagcatcaccaagccgctgaacatccgcaagcagcgcgacgtgtccatcaaggagtacaagcagcagtaccacgtggcgaacgacagcaactacctgctcgccctgtacatcggcaccgacaacaagggcaaggagaagcgggagttcgagatcgtcaacatcctgcaggccgcccagtactaccgcacctccaacgacaaggaggtggtggaccggcacatcgtccccatcaagagcgagcacgactaccccttcgcgtacacgctcaagatcgggaccatggtgctgctgtacgagaagtcccccaacgaggtgtgggacgccaccatcaaggagcgcaaccggcgcctctacaaggtcaccggcctgagcacgatgcggatgaaggggcgcaacggcgagtacgcctacgccaccgtgaagctgatccacaacgaggaggcccggccgtccaaggacatcaaggcgaagaacggggagtacgagcagggcgaggagttccgccccgccatcatcatgctccacacccagctgaacgccctggtgcagggctacgacttcgagatcaacgagctcggggagatccggcgcctgcggtga

SEQ ID NO: 1724 - RNA, 3654 nt, synthetic construct
  misc_feature 1..3654: note = Cas9 variant
  source 1..3654: mol_type = other RNA
atggagaagcagcgcatcctgggcctcgaccccgggaccaacagcctgggctgggccgtgctggacttcgacaactccaagcaggagtacaacctcgtccggaagggggaggtgatcttcgaggagggcgtgggcaagagcgagcgcggggagttctccaaggccgcgtaccggaccttctacaagagcacgcgcaagcactacttccggcgccggctgcgcaagatcgaggtcctgaaggtgctcgtgaagtacgacttctgcccgtacctgtccgacgacctgctcaagcagtggcacgagaagaagatctaccccgccgtcaaggagttcatggactggcagcggaccagcgacgccgagggcaagaacccctactacgaccgccactgctgcctgaacgagaagctggacctctccctcaagagcgaccggtacatcctggggcgcgccctgtaccacctgacccagcggcgcggcttcaagtccaaccggctgatccagaacaacgacgagaacgaggaggggaaggtgaagaagggcatcagcgagctctccaccgagatgcaggaggccaactgcaactacctgggggactacttctacaagctgtacacggagaagggcaacaccgtgcagatccgcaagcggtacaccgaccgcgagaagcactacaagaacgagttcaacgcgatctgcgagaagcaggagctcaacgagaccatcgtcaaggagctggacaaggccatcttcttccagcggaagctgaagccccagcgccacggcgtggggaagtgcacgttcgagccgaacaaccggcgctgcgccatcagccaccccgacttcgagcgcttccggatgctctgcttcatcaacaacatcaagatcaagacccccttcgaggagaacctgcgccccctgaacaacgaggagaaggccctcatcgagccgctgttctaccggaagtccatcaagaacttcgacttcgaggagatcgcgaagaagctggccggcaagaacaactactgctacatcaaggacgacagctccaagcagtacaagttcaactaccgcatgagccagggggcctccacgtgccagaccatcgccaagctcaagagcatcttcggcgaggagtggaagaacggcatcgccgagacgtacaccaaccggcgcaagaaggaggggctgaagaagcaggcggagatggtggacgacatctggaacgtcctgtactccgtgagcgagtgcgacgtgctcaaggacttcgccatcaacaagctgcagctggacgagaagaccgccgacaacttcagcaagaccaagctcgcccagggcttcgccacgctgtccctgaaggcgatccggaagatcctccccttcctggagcaggggttcggctacaccgaggccgtcttcctggccaacatccccaccgtggtggggaaggagtactggaacaacgaggacatccgcaacgacatcatggaggagatcaagaccatcttctaccacaacacgctcaagaccaacgacagccacaacaccatcctgttctgcatcaaggacatcctgtccaacaacttcgacctcgcccccggcgccatcgacaagctgtaccacccgagcatgatcaacgtctacaaggacgtgatccccaacgaggacggcatcctgcagctcgggtcccccaagatcgacgcggtgaagaaccccatggccatgcggagcctgcacatcatccgcaaggtcgtgaacgagctgctgcgggagggcatcatcaactccgacaccgaggtgcgcatcgagtacgcccgggagctcaacgacgccaacaagcgccacgccatcgcggactggcagaagaagcagtacgggaagcaccagaagtaccggaaggagatcaaggagctgttcaaggccgagacgggcttcgagatcgagccgaacgagaccgacatcctgaagttcgagctctgggaggagcagaaccacatctgcctgtacaccgggcaggagatcggcatcagcgagttcgtcggcgagaaccccaagtacgacatcgagcacaccttcccccgctccctcgggggcgacagcacgaagatgaacatgaccctgtgcgagaacaagttcaaccgggagaacaagcagaagaagctgccctccgagctggccaaccacagcgagatcctcgagcgcatcgacgactggaagaagaagatctacatcctgcagaagaagtacgactccatccggacccacaacgggatggacaaggagaacaaggacaagaagatcgtgagccgccacaagatcaagctggagctcgactactggaagggcaagtacaaccgcttcaccatgacggagatcccggaggggttctcccggcgccagggcatgggcatcgggctgatcagccggtacgccggcctgtacctcaagaccatcttccacaagaaggacaacccccagaagtccaacgtctacatcgtgaaggggagcatcaccgcggagttccgccggatctggaacatccaggacgactacgagaagaagtgccgcgacaaccacatccaccactgcatcgacgccatcgtggtcggctgcatcggcaagcgggagtacgacctgatggcccagttctaccgcgacgaggagaagtaccggtgggagaagaagaagaagcccttcttcaagaagccctgggagaccttcacgcaggacatgctgtccctcaaggacgaggtgctgaccgtgcacttcaacccgagcaacttcaccaagaaggcccacaagaaggtcttcacccccaaggggatcttcgtggcccagggcgactgcgcgcgcgtgaagctgcacaaggggagctacttcggcgccatcgagcagaagggggagatcaagtacgtcatgcggaaggagctctccgccctgaagatcgaggacatcaagaacatcgtggacgccgtggtcaaggagaaggtgctggccgtggtcaagaagaagggcttcaagcaggcgatggccgagcccatctacatgaacgaggacaagcgcatcctcatcaagaaggtgcggctgttcgtgagccaggccaaccccctgatcgtcaagaagcaccgcgacctctccagcaaggagtacaagcagaactactacgtggacaacgagggcaacctgatgatcgccatgtacgagggggtgaagaagaacggcaagatcgaccgggagatcaccgtcgtgaacaacctggaggccgcgaagttcttccgccagtcccagaagaacaacgccgagaagcagctcatcagccacctgtccccgaagaacgggtaccccctgaagacggtgctcacccagaagcagctggtcctgatgtacgaggacagccccaaggagatcaagctccgggacaccaagaacatggtgaagcgcctgtaccaggtgttcggcatcgagaaggacgggcgggtcaagctgaagttccaccaggaggcccgctccgagggcctcaacatcaacagcgccgcgttcaagatccaggacaccccggagtccctgtaccggcacaccaagagcaacctgaaggtgctcgtgaacggcgtcgacttcaagatcaacatcctgggggagatctccctgatctga

SEQ ID NO: 1725 - RNA, 3654 nt, synthetic construct
  misc_feature 1..3654: note = Cas9 variant
  source 1..3654: mol_type = other RNA
atggagaagcagcgcatcctgggcctcgaccccgggaccaacagcctgggctgggccgtgctggacttcgacaactccaagcaggagtacaacctcgtccggaagggggaggtgatcttcgaggagggcgtgggcaagagcgagcgcggggagttctccaaggccgcgtaccggaccttctacaagagcacgcgcaagcactacttccggcgccggctgcgcaagatcgaggtcctgaaggtgctcgtgaagtacgacttctgcccgtacctgtccgacgacctgctcaagcagtggcacgagaagaagatctaccccgccgtcaaggagttcatggactggcagcggaccagcgacgccgagggcaagaacccctactacgaccgccactgctgcctgaacgagaagctggacctctccctcaagagcgaccggtacgtgctggggcgcgccctgtaccacctgacccagcggcgcggcttcaagtccaaccggctgatccagaacaacgacgagaacgaggaggggaaggtgaagaagggcatcagcgagctctccaccgagatgcaggaggccaactgcaactacctgggggactacttctacaagctgtacacggagaagggcaacaccgtccagatccgcaagcggtacaccgaccgcgagaagcactacaagaacgagttcaacgcgatctgcgagaagcaggagctcaacgagaccatcgtgaaggagctggacaaggccatcttcttccagcggaagctgaagccccagcgccacggcgtggggaagtgcacgttcgagccgaacaaccggcgctgcgccatcagccaccccgacttcgagcgcttccggatgctctgcttcatcaacaacatcaagatcaagacccccttcgaggagaacctgcgccccctgaacaacgaggagaaggccctcatcgagccgctgttctaccggaagtccatcaagaacttcgacttcgaggagatcgcgaagaagctggccggcaagaacaactactgctacatcaaggacgacagctccaagcagtacaagttcaactaccgcatgagccagggggcctccacgtgccagaccatcgccaagctcaagagcatcttcggcgaggagtggaagaacggcatcgccgagacctacaccaaccggcgcaagaaggaggggctgaagaaccaggcggagatggtcgacgacatctggaacgtgctgtactccgtgagcgagtgcgacgtcctcaaggacttcgccatcaacaagctgcagctggacgagaagaccgccgacaacttcagcaagaccaagctcgcccagggcttcgccacgctgtccctgaaggcgatccggaagatcctccccttcctggagcaggggttcggctacaccgaggccgtgttcctggccaacatccccaccgtggtcgggaaggagtactggaacaacgaggacatccgcaacgacatcatggaggagatcaagaccatcttctaccacaacacgctcaagaccaacgacagccacaacaccatcctgttctgcatcaaggacatcctgtccaacaacttcgacctcgcccccggcgccatcgacaagctgtaccacccgagcatgatcaacgtgtacaaggacgtgatccccaacgaggacggcatcctgcagctcgggtcccccaagatcgacgcggtcaagaaccccatggccatgcggagcctgcacatcatccgcaaggtggtgaacgagctgctgcgggagggcatcatcaactccgacaccgaggtccgcatcgagtacgcccgggagctcaacgacgccaacaagcgccacgccatcgcggactggcagaagaagcagtacgggaagcaccagaagtaccggaaggagatcaaggagctgttcaaggccgagacgggcttcgagatcgagccgaacgagaccgacatcctgaagttcgagctctgggaggagcagaaccacatctgcctgtacaccgggcaggagatcggcatcagcgagttcgtgggcgagaaccccaagtacgacatcgagcacaccatcccccgctccctcgggggcgacagcacgaagatgaacatgaccctgtgcgagaacaagttcaaccgggagaacaagcagaagaagctgccctccgagctggccaaccacagcgagatcctcgagcgcatcgacgactggaagaagaagatctacatcctgcagaagaagtacgactccatccggacccacaacgggatggacaaggagaacaaggacaagaagatcgtcagccgccacaagatcaagctggagctcgactactggaagggcaagtacaaccgcttcaccatgacggagatcccggaggggttctcccggcgccagggcatgggcatcgggctgatcagccggtacgccggcctgtacctcaagaccatcttccacaagaaggacaacccccagaagtccaacgtgtacatcgtgaaggggagcatcaccgcggagttccgccggatctggaacatccaggacgactacgagaagaagtgccgcgacaaccacatccaccactgcatcgacgccatcgtcgtgggctgcatcggcaagcgggagtacgacctgatggcccagttctaccgcgacgaggagaagtaccggtgggagaagaagaagaagcccttcttcaagaagccctgggagaccttcacgcaggacatgctgtccctcaaggacgaggtgctgaccgtccacttcaacccgagcaacttcaccaagaaggcccacaagaaggtgttcacccccaaggggatcttcgtggcccagggcgactgcgcgcgcgtcaagctgcacaaggggagctacttcggcgccatcgagcagaagggggagatcaagtacgtgatgcggaagaagctctccgccctgaagatcgaggacatcgagcacatcgtggacgccgtcgtgaaggagaaggtgctggccgtcgtgaagaagaagggcttcaagcaggcgatggccgagcccatctacatgaacgaggacaagcgcatcctcatcaagaaggtgcggctgttcgtcagccagaccaaccccctgatcgtgaagaagcaccgcgacctctccagcaaggagtacaagcagaactactacgtggacaacgagggcaacctgatgatcgccatgtacgagggggtcaagaagaacggcaagatcgaccgggagatcacggtggtgaacaacctggaggccgccaagttcttccgccagtcccagaagaacaacgcggagaagcagctcatcagccacctgtccccgaagaacgggtaccccctgaagaccgtcctcacccagaagcagctggtgctgatgtacgaggacagccccaaggagatcaagctccgggacaccaagaacatggtgaagcgcctgtaccaggtcttcggcatcgagaaggacgggcgggtggagctgaagttccaccaggaggcccgctccgagggcctcaacaagaacagcgccgccttcaagatccaggacacgccggagtccctgtaccggcacaccaagagcaacctgaaggtgctcgtcaacggcgtggacttcaagatcaacatcctgggggagatctccctgatctga

SEQ ID NO: 1726 - RNA, 3654 nt, synthetic construct
  misc_feature 1..3654: note = Cas9 variant
  source 1..3654: mol_type = other RNA
atgaagtacaactacgtgctgggcctcgacatcgggatcagctccgtcggctgggggctgctggccctcgacgagaacaacaacccctacaagatcatcgacgtgggcagccgcatcttctccccgggggaggtggagaagaccggcgacagcaaggccaaggagcggcgcgagaagcggggcacccgccgggtcatccgccggcgcgagttccggctggaccgcgtgcggaacctgctctacgagaaggggtacctgaagggcaacatcacgtccaacatcgtgagcgtcaagaacgaggagctgaccatcatcttcaacgacatggtgaacaactactacaagtccaaggacaccaacccctacaagctcaaggtggaggcgctggaccgcaagctgaccaacgacgagctcagcatcatcctggtccactacgccaagaagcgggggtacaagtccaaccgcgaggagagctccgacaacgacaacggcaaggtgaaggaggccatcaaggagaacacgaacctgatggaggagaagaagtaccggaccatcagcgagatgtacatcaagaacgagaagttcaagaacaagatcaagaacgggcccgacgactacaagctctccgtgaccaacgagatgtacctggaggagatcaacaaggtcctggacagccagatcggcttcggcctcatcgacgacaacttcaagaacgagtacctggagatctacaactcccgccggcactacagcgaggggcccggctactactacgccaaggacgccaacgggaacaaggtgaaggtgcgctccccgtacggcggcgacctgatcaagaagatgaccggggtctgcagcttcgacaagaaggcgcgggcccccaagtacgccttctccagcgagctgttcgtgagcatctccaagctggtgaacctgcgctacaagatcgacgacgacagctacaagcagctcacgaaggagcagatcaacgagctgatcgacgaggccaagaacaagaacaaggtcacctacaagtccctgatcaagatcctcggcatcaagaacatcaaggtgaaggacctgaacctgagcaagtccgagtacatcaaggtgatcgacgagctcaagaagaagctgaacatcagcaaggaggagaagatcgacatctactccctggacgaggagaacaagaagatctacgacgacatctacaacgagaagctgttcagcaagaccctcatcgagttcaaggggtacaacctgctcaagaaggcgatcaccctgtcctacaacagcggcacgtggaacgacgtcaaggacaacatcgagttcctggacgagctcgccctgtactgcaccgactacaaggtgaacaacgagatccaggagcacatccacaactccctgatcatcgacagccggttcgacgactccaacttcgtggagaacctccccaacttcaaggaccacctgatgctgagcaccgacatcatccgcaagctcatccccatcatgctggaggggatcacctacgacaaggccatggacaagatcggctacaaccactccaacctgtacaaggacacgatcaaggaggacctcctggtcccggtgtacgtcagcaagaacatcaccaaccagcgcgtgatccggtccctgacccaggcccgcaaggtgatcaacgccatcatcaagaagtacggcagccccaagatcatcaacatcgagaccgcgcgggagctggccaagacgcagaaggagcgccggatcatcgagaagaaccagcaggacaagcagtacgagaacgagcgcatcaagaagcacctcgtcgagctggagctgttctccgacgagagcaagatcaccgggaacgacctcctgaagtacaagctgtggcaggagcagaaggagttctgcggctacagcatgaagaagatcaagctcgaggacctgttctccaacaacatcgtgcagatcgaccacatcctgccctacagccggacctacaacgacaactacctcaacaagaccctggtgtacacgaagtacaaccaggacaaggggaacaagaccccctacgagtggttcggcaagaccgacaagtggcaggagtacgaggccttcatcaactccctgagcatctcccagaacaagaaggacaactacctcctgaagaacctggaccaggacgccgagcgcgagatgcgggagcagaacctcaacgacaccaagtacatcagccgcgagctgctgtccctcatcaaggcctacctgaacgtcgacgaggtgaacgcgttcccgggggccatcacggccaagctgcgggcccgctggggcttcaaccggctcacccacagctacatctccaagacctacatcatgcccgaggacatgaagaagggcatcaacaaggaccgcgacaaccacctccaccacgccatggacgcgctggtgatcgccagcatcaccaagtccctccagcagaagatcacgctgtacgagaagttcagccggtacgtcgacgggatcaccaagaacgagctgggcaagatctccaccgggaacatcaacgacgacctctacaactactacgacgaggagaccggcgagatcaaggagctggagctgcgccagtacatcaagaaccaggtggcccagaacaacatctacttcagcaagcacaacgtgtccaagctcatcttccccacgccctacaacaacttcgtcgaggaggccaagctgcgggtgtacgagcgcgacctggaggtgctcaagtggaacctgaagaacctggggacctacaccagctccgagctcaaccggatccacgtcctgatcccgagcgtggccaagaacaagatcagcggccgcctgcacgaggagacctactacggcctcaaggaggtggggatcggcgaggacaaggtcacctacaagacgctgaagacccccatctccaaggtgaagaagaaggacctggacaacatccccgactgcaagggcgggagcaaggacatctacaacgcgctcgtgaagtggttcggcaactgcgagaccggggaggaggccctgaagatgcacgacggcaagtaccccgtcaacccgaacgacaaggagcagaaggagatccgcaagatcaaggtgtacaccaagtacaacgccacggggcacgtggtcaacaacggcaacgtggagaagggcgggatctaccggatcgacgtgttcaagtccaagaacaaggaggacaacaagctgtacttcaccagctacgacatcttcgagatcgagcagatcaaggcctacgagaagggcaagaacatcaacttctccatcaagctcgagtacgggcagggcaagaacaacaagatcctgctgtacaaggacgtcaagaacgagtacgacctcatcatgagcatctacaagaacgacctgatccgcatcaagaccaagaccgggaacaagtccacggcgtacgtggtgggcttcagcgggggcaagctggagatcaagtccaccatcggcgacgggtacgacatcatcggcaacaacaacatcttcgacaagagcatggagcggtaccgcgtcacctccagcaccatcgtgaagatcgacaagctctccatcagcatcctgggggaggtgtccggcctgtga

SEQ ID NO: 1727 - RNA, 3657 nt, synthetic construct
  misc_feature 1..3657: note = Cas9 variant
  source 1..3657: mol_type = other RNA
atgaacaagcgcatcctgggcctcgacaccgggaccaacagcctgggctgggccgtggtcgactgggacgagcacgcccagtcctacgagctgatcaagtacggggacgtgatcttccaggagggcgtgaagatcgagaaggggatcgagagctccaaggcggccgagcggagcggctacaaggccatccgcaagcagtacttccggcgccggctccgcaagatccaggtcctgaaggtgctggtgaagtaccacctctgcccctacctgtccgacgacgacctgcggcagtggcacctccagaagcagtaccccaagagcgacgagctgatgctgtggcagcgcacgtccgacgaggagggcaagaacccgtactacgaccggcaccgctgcctccacgagaagctggacctgaccgtcgaggccgaccggtacaccctcgggcgcgccctgtaccacctgacccagcggcgcggcttcctcagcaaccggctggacacgtccgcggacaacaaggaggacggggtggtcaagagcggcatctcccagctgagcaccgagatggaggaggccgggtgcgagtacctcggcgactacttctacaagctgtaccacgagcagggcaacaaggtgcgcatccggcagcgctacaccgaccggaagaagcactaccagcacgagttcgacgccatctgcgagaagcaggagctgtccagcgagctcatcgaggacctgcagcgcgccatcttcttccagctgcccctcaagtcccagcggcacggggtgggccgctgcaccttcgagcgcgggaagccccggtgcgcggacagccacccggactacgaggagttccgcatgctgtgcttcgtgaacaacatccaggtcaagggcccccacgacctggagctccggcccctgacgtacgaggagcgcgagaagatcgagcacctgttcttccggaagtccaagcccaacttcgacttcgaggacatcgccaaggagctcgccggcaagaagaactacgcctggatccacgacaaggaggagcgcgcctacaagttcaactaccggatgacccagggggtgccgggctgccccaccaccgcgcagctcaagagcatcttcggggacgactggaagacgggcatcgccgagacctacaccctgatccagaagaagaacgggtccaagagcctgcaggagatggtggacgacgtctggaacgtgctgtacagcttctccagcgtggagaagctgaaggagttcgcccaccacaagctccagctggacgaggagaacgccgagaagttcgccaagatcaagctgtcccacagcttcgcggccctctccctgaaggccatccgcaagttcctgcccttcctccggaagggcatgtactacacccacgccagcttcttcgccaacatccccacgatcgtcggcaaggagatctggaacaacgagcagtcccgcaagtacatcatggagaacgtgggggagctggtgttcaactaccagccgaagcaccgggacgtccagggcaccatcgagatgctgatcaaggacttcctcgcgaacaacttcgagctgcccgccggggccaccgacaagctgtaccaccccagcatgatcgagacctacccccacgccctgcgcaacgagttcggcatcctccagctggggtccccgcggacgaacgccatccgcaaccccatggcgatgcggagcctgcacgtgctccgccgggtggtcaaccagctgctgaaggagtccatcatcgacgagaacaccgaggtgcacgtcgagtacgcccgcgagctcaacgacgccaacaagcggcgcgccatcgcggaccgccagaaggagcaggacaagcagcacaagaagtacggcgacgagatccggaagctgtacaaggaggagaccggcaaggacatcgagcccacccagacggacgtgctgaagttccagctctgggaggagcagaaccactactgcctgtacaccggggagcagatcggcatcaccgacttcatcgggagcaaccccaagttcgacatcgagcacaccatcccgcagtccgtgggcggggacagcacgcagatgaacctgaccctctgcgacaaccgcttcaaccgggaggtcaagaaggccaagctgcccaccgagctggccaaccacgaggagatcctcacccgcatcgagccctggaagaacaagtacgagcagctggtgaaggagcgggacaagcagcgcacgttcgccggcatggacaaggccgtgaaggacatccggatccagaagcgccacaagctgcagatggagatcgactactggcggggcaagtacgagcgcttcaccatgaccgaggtccccgaggggttctcccggcgccagggcaccgggatcggcctcatcagccggtacgcgggcctgtacctgaagtccctcttccaccaggccgacagccgcaacaagtccaacgtgtacgtggtcaagggggtggccacggccgagttccggaagatgtggggcctgcagagcgagtacgagaagaagtgccgcgacaaccacagccaccactgcatggacgccatcaccatcgcgtgcatcgggaagcgggagtacgacctgatggccgagtactaccacatggaggagaccttccgccagggccgggggtccaagccgaagttcagcaagccctgggccaccttcaccgaggacgtgctcaacatctacaagaacctgctggtcgtgcacgacacgcccaacaacatgcccaagcacaccaagaagtacgtgcagacctccaagggcaaggtcctcgcccagggcgacaccgcccgcgggagcctgcacctggacacgtactacggcgcgatcgagcgggacggggagatccgctacgtggtgcgccggccgctctccagcttcaccaaccccaaggagctggagaacatcgtcgacgagaccgtgaagcgcaccatcaaggaggccatcgccgacaagaacttcaagcaggccatcgcggagcccatctacatgaacgaggacaagggcatcctgatcaagaaggtgcggtgcttcgccaactccgtcaagcagccgatcaacatccgccagcaccgggacctcagcaagaaggagtacaagcagcagtaccacgtgatgaacgagaacaactacctgctggccatctacgaggggctcgtgaagaacaaggtcgtgcgcgagttcgagatcgtgtcctacatcgaggccgccaagtactacaagcggagccaggaccgcaacatcttctccagcatcgtccccacgcactccaccaagtacggcctgcccctgaagaccaagctcctgatgggccagcaggtcctgatgttcgaggagaaccccgacgagatccaggtggacaacaccaaggacctcgtgaagcggctgtacaaggtggtggggatcgagaaggacggccgcatcaagttcaagcaccaccaggaggcgcggaaggaggggctgacgatctacagcaccccgtacaagaacaacgacgactacgtccccatcttccgccagtccatcaagaacatcaacatcctcgtggacggcatcgacttcaacatcgacatcctggggaaggtgaccctgaaggagtga

SEQ ID NO: 1728 - RNA, 3657 nt, synthetic construct
  misc_feature 1..3657: note = Cas9 variant
  source 1..3657: mol_type = other RNA
atgaacaagcgcatcctgggcctcgacaccgggaccaacagcctgggctgggccgtggtcgactgggacgagcacgcccagtcctacgagctgatcaagtacggggacgtgatcttccaggagggcgtgaagatcgagaaggggatcgagagctccaaggcggccgagcggagcggctacaaggccatccgcaagcagtacttccggcgccggctccgcaagatccaggtcctgaaggtgctggtgaagtaccacctctgcccctacctgtccgacgacgacctgcggcagtggcacctccagaagcagtaccccaagagcgacgagctgatgctgtggcagcgcacgtccgacgaggagggcaagaacccctactacgaccggcaccgctgcctccacgagaagctggacctgaccgtcgaggccgaccggtacaccctcgggcgcgccctgtaccacctgacccagcggcgcggcttcctcagcaaccggctggacacgtccgcggacaacaaggaggacggggtggtcaagagcggcatctcccagctgagcaccgagatggaggaggccgggtgcgagtacctcggcgactacttctacaagctgtacgacgcccagggcaacaaggtgcgcatccggcagcgctacaccgaccggaacaagcactaccagcacgagttcgacgccatctgcgagaagcaggagctgtccagcgagctcatcgaggacctgcagcgcgcgatcttcttccagctgcccctcaagtcccagcggcacggggtgggccgctgcaccttcgagcgcgggaagccccggtgcgccgacagccacccggactacgaggagttccgcatgctgtgcttcgtgaacaacatccaggtcaagggcccccacgacctggagctccggcccctgacgtacgaggagcgcgagaagatcgagcccctgttcttccggaagtccaagccgaacttcgacttcgaggacatcgccaaggccctcgccggcaagaagaactacgcgtggatccacgacaaggaggagcgcgcctacaagttcaactaccggatgacccagggggtgcccggctgccccaccatcgcccagctcaagagcatcttcggggacgactggaagaccggcatcgccgagacgtacaccctgatccagaagaagaacgggtccaagagcctgcaggagatggtggacgacgtctggaacgtgctgtacagcttctccagcgtggagaagctgaaggagttcgcccaccacaagctccagctggacgaggagtccgcggagaagttcgccaagatcaagctgagccactccttcgccgccctcagcctgaaggccatccgcaagttcctgcccttcctccggaagggcatgtactacacccacgcgtccttcttcgccaacatcccgaccatcgtcggcaaggagatctggaacaaggagcagaaccgcaagtacatcatggagaacgtgggggagctggtgttcaactaccagcccaagcaccgggaggtccagggcacgatcgagatgctgatcaaggacttcctcgccaacaacttcgagctgcccgccggggccaccgacaagctgtaccaccccagcatgatcgagacctacccgaacgcgcagcgcaacgagttcggcatcctgcagctcgggtccccgcggaccaacgccatccgcaaccccatggccatgcggagcctgcacatcctgcgccgggtggtgaaccagctcctgaaggagtccatcatcgacgagaacacggaggtccacgtggagtacgcccgcgagctgaacgacgcgaacaagcggcgcgccatcgccgaccgccagaaggagcaggacaagcagcacaagaagtacggcgacgagatccggaagctctacaaggaggagaccggcaaggacatcgagcccacccagaccgacgtcctgaagttccagctgtgggaggagcagaaccaccactgcctctacacgggggagcagatcggcatcaccgacttcatcgggagcaacccgaagttcgacatcgagcacaccatcccccagtccgtgggcggggacagcacccagatgaacctgacgctgtgcgacaaccgcttcaaccgggaggtgaagaaggccaagctccccaccgagctggccaaccacgaggagatcctgacccgcatcgagccctggaagaacaagtacgagcagctcgtcaaggagcgggacaagcagcgcaccttcgcgggcatggacaaggccgtgaaggacatccggatccagaagcgccacaagctgcagatggagatcgactactggcggggcaagtacgagcgcttcacgatgaccgaggtgccggaggggttctcccggcgccagggcaccgggatcggcctgatcagccggtacgccggcctctacctgaagtccctgttccaccaggccgacagccgcaacaagtccaacgtctacgtggtgaagggggtcgccaccgcggagttccggaagatgtggggcctccagagcgagtacgagaagaagtgccgcgacaaccacagccaccactgcatggacgccatcacgatcgcctgcatcgggaagcgggagtacgacctgatggccgagtactaccgcatggaggagaccttcaagcagggccgggggtccaagcccaagttcagcaagccctgggccaccttcaccgaggacgtgctgaacatctacaagaacctcctggtggtccacgacacccccaacaacatgccgaagcacacgaagaagtacgtgcagacctccatcggcaaggtgctggcgcagggcgacaccgcccgcgggagcctccacctggacacctactacggcgccatcgagcgggacggggagatccgctacgtcgtgcgccggcccctgtccagcttcacgaagcccgaggagctcgagaacatcgtggacgagaccgtcaagcgcaccatcaaggaggccatcgcggacaagaacttcaagcaggccatcgccgagccgatctacatgaacgaggagaagggcatcctgatcaagaaggtgcggtgcttcgccaagtccgtgaagcagcccatcaacatccgccagcaccgggacctgagcaagaaggagtacaagcagcagtaccacgtcatgaacgagaacaactacctcctggccatctacgaggggctggtgaagaacaaggtggtccgcgagttcgagatcgtgtcctacatcgaggcggccaagtactacaagcggagccaggaccgcaacatcttctccagcatcgtgcccacccactccacgaagtacggcctccccctgaagaccaagctgctcatgggccagctggtcctgatgttcgaggagaacccggacgagatccaggtggacaacaccaaggacctcgtgaagcggctgtacaaggtcgtggggatcgagaaggacggccgcatcaagttcaagtaccaccaggaggcccggaaggaggggctgcccatcttcagcaccccctacaagaacaacgacgactacgcccccatcttccgccagtccatcaacaacatcaacatcctcgtggacggcatcgacttcacgatcgacatcctggggaaggtcaccctgaaggagtga

SEQ ID NO: 1729 - RNA, 3657 nt, synthetic construct
  misc_feature 1..3657: note = Cas9 variant
  source 1..3657: mol_type = other RNA
atgaacaagcgcatcctgggcctcgacaccgggaccaacagcctgggctgggccgtggtcgactgggacgagcacgcccagtcctacgagttcatcaagtacggggacgtgatcttccaggagggcgtgaagatcgagaaggggatcgagagctccaaggcggccgagcggagcggctacaaggccatccgcaagcagtacttccggcgccggctgcgcaagatccaggtcctcaaggtgctggtgaagtaccacctgtgcccctacctctccgacgacgacctgcggcagtggcacctccagaagcagtaccccaagagcgacgagctgatgctgtggcagcgcacgtccgacaagaagggcaagaacccctactacgaccggcaccgctgcctgcacgagaagctcgacctgaccgtcgaggccgaccggtacaccctggggcgcgccctctaccacctgacccagcggcgcggcttcctgagcaaccggctcgacacgtccgcggacaacaaggaggacggggtggtcaagagcggcatctcccagctgagcaccgagatggaggaggccgggtgcgagtacctgggcgactacttctacaagctctacgacgagcagggcaacaaggtgcgcatccggcagcgctacaccgaccggaacaagcactaccagcacgagttcgacgccatctgcgagaagcaggagctgtccagcgagctgatcgaggacctccagcgcgccatcttcttccagctgcccctgaagtcccagcggcacggggtgggccgctgcaccttcgagcgcgggaagccccggtgcgcggacagccacccggactacgaggagttccgcatgctctgcttcgtgaacaacatccaggtcaagggcccccacgacctggagctgcggcccctcacgtacgaggagcgcgagaagatcgagcccctgttcttccggaagtccaagccgaacttcgacttcgaggacatcgccaaggccctggccggcaagaagaactacgcctggatccacgacaaggaggagcgcgcgtacaagttcaactaccggatgacccagggggtgcccggctgccccaccaccgcccagctcaagagcatcttcggggacgactggaagacgggcatcgccgagacctacaccctgatccagaagaagaacgggtccaagagcctgcaggagatggaggacgacgtgtggaacgtcctctacagcttctccagcgtggagaagctgaaggagttcgcccaccacaagctgcagctcgacgaggagtccgccgagaagttcgcgaagatcaagctgagccactccttcgccgccctgagcctcaaggccatccgcaagttcctgcccttcctgcggaagggcatgtactacacccacgcctccttcttcgcgaacatcccgacgatcgtgggcaaggagatctggaacaacgagcagaaccgcaagtacatcatggagaacgtcggggagctcgtgttcaactaccagcccaagcaccgggaggtgcagggcaccatcgagatgctgatcaaggacttcctggccaacaacttcgagctccccgccggggccaccgacaagctgtaccaccccagcatgatcgagacctacccgcacgcccagcgcaacgagttcggcatcctgcagctggggtccccgcggacgaacgcgatccgcaaccccatggccatgcggagcctccacatcctgcgccgggtcgtgaaccagctgctcaaggagtccatcatcgacgagaacaccgaggtgcacgtcgagtacgcccgcgagctgaacgacgccaacaagcggcgcgcgatcgccggctggcagaaggagcaggacaagcagcacaagaagtacgtggacgagatccgcaagctgtacaaggaggagaccggcaaggacatcgagcccacccagacggacgtcctcaagttccagctgtgggaggagcaggaccaccactgcctgtacaccggggagcagatcggcatcaccgacttcatcgggagcaacccgaagttcgacatcgagcacaccatcccccagtccgtgggcggggacagcacgcagatgaacctcaccctgtgcgacaaccggttcaaccgcgagatcaagaaggccaagctgcccgcccagctctccaaccacgaggagatcctggcccggatcgagccctggaagaacaagtacgagcagaagatcaaggagcgcgacaagcagcggaccttcgcgggcatggacaaggccgtgaaggacctgcgcatccagaagcggcacaagctccagatggacatcgactactggcgcggcaagtacgagcggttcaccatgacggaggtcccggaggggttcagccgccggcagggcaccgggatcggcctgatctcccgctacgccggcctgtacctcaagagcctgttccaccaggccgactcccggaacaagagcaacgtgtacgtggtcaagggggtggccaccgcggagttccgcaagatgtggggcctgcagagcgagtacgagaagaagtgccgggacaaccactcccaccactgcatggacgccatcaccatcgcctgcatcgggaagcgcgagtacgacctcatggccgagtactaccggatggaggagacgttccgccagggccgggggagcaagcccaagttctccaagccctgggccaccttcaccgaggacgtgctgaacatctacaagaacctgctcgtcgtgcacgacacccccaacaacatgccgaagcacaccaagaagtacgtgcagacgagcaagggcaaggtcctggcgcagggcgacaccgcccgcgggtccctgcacctcgacacctactacggcgccatcgagcgggacggggagatccgctacgtggtgcgccggcccctgagctccttcaccaagcccaaggagctggagaacatcgtcgacgagacggtgaagcgcaccatcaaggaggccatcgcggacaagaacttcaagcaggccatcgccgagccgatctacatgaacgaggacaagggcatcctcatcaagaaggtgcggtgcttcgccaagagcgtcaagcagcccatcaacatccgccagcaccgggacctgtccaagaaggagtacaagcagcagtaccacgtggtgaacgagaacaactacatgctggtcatctacgaggggctcgtgaagaacaaggtggtccgcgagttcgagatcgtgagctacatcgaggccgcgaagtactacaagcggtcccaggaccgcaacatcttcagctccatcgtgcccacccacagcgccaagtacggcctgcccctgaagaccaagctcctgatgggccagctggtcctcatgttcgaggagaacccggacgagatccaggtggacaacacgaaggacctggtgaagcggctgtacaaggtcgtggggatcaagaaggacggccgcgtgaagttcaagttccaccaggaggcccggaaggacgggctcctgatcttctccaccccctacaagaacaacaacggctacgtccccatcttccgccacagcaagaagaacatcaacatcctggtggacgggaaggacttcaccatcgacatcctcggcaaggtgaccctgaaggagtga

SEQ ID NO: 1730 - RNA, 3660 nt, synthetic construct
  misc_feature 1..3660: note = Cas9 variant
  source 1..3660: mol_type = other RNA
atgaaggaggaggtgcgcggcaagaaccggagccagacctgggccatcctggccaagttcttcgtctggtccgagaaggagagcgtgtggaacgagaaggaggcgcgcaccgaggagcgggtgaaggagtacaagctcgtcgggctgaagcgcgacacgaagggcaacgagctgaagctcgagaactaccggtggcgcgtgcaggccctgtccgagcagctgaaccccgagatcgtggccatcgtcctccaggagatcaacgggcagatcagcgcctccagcggctacctgggggccatctccgaccggagcaagcagctgtacttcaaccgccagaccgtgggccagtacctcatgtccgagctggagaaggacccgaacgtgagcctgcggaaccgcgtcttctaccggcaggactacctcgacgagttcgaccgcatctgggagaagcaggcggagttccacgaggagctgaccgtggagctgaagaaggagatccgggacatcatcatcttctaccagcgccggctcaagtcccagaagggcctgatcagcttctgcgagttcgagaagcgcgaggtggtcgtggaggaggacgggcggaagaagaacaagaccgtgggctgccgcgtcatcccccggtcccaccccctgttccaggagttcaagatctggcagacgctcaacgacatcgaggtgttcgcctgggacaagcagagcaagcgcaagaaggccgacaagtccagcatcctgttcgacaactccgaggacgccctgctcgtggaggggaagcggttcctgtaccaggaggagaaggagctgctcgcgaaggagctgttcgtcaaggagagcatgaagaaggccgaggtgctgaagctcctgttcgagaactaccaggagctggacctcaacttcaagcagatcgacggcaaccacaccgggttcgccctgttctccgcctacagcaagatgatcgagaagtacggctacgagcccgtggacttcaagcgcagcgccgacgagatcatcgagaagctggagaccatcttcaccaacctcggctggaacacggagctgctgtccatcgacctcagcaaggaggacaaggagctggagcgccagtcctacttccggctgtggcacctcctgtacagcttcgagggggacaacaccccgaccggcaacgggaagctgctcgagaagatcatgcagctgtgcgacgtcgagaaggagtacgcggtggagctggccaacgtgtccttccaggaggactacggcagcctctccgccaaggccatcaagaagatcctgccctacctgaaggagggcaaccagtacgacgtcgcctgcgactacgcggggtaccgccacagccggtccagcctcaccaaggacgagatcgagaacaagatcctgaaggacaagctggagatcctgcccaagaactccctccgcaaccccgtggtcgagaagatcctgaaccagatggtgaacctgatcaacacgctcatcgacacctacggcaagccggacgagatccgggtggagctggcccgcgagctgaagaagaacgccaaggagcgggaggagctcaccaagagcatcgcccgcaacacccgggagcacgacgagatccgccagctgctgcggacggagttcgggatgatgaacgtctcccgcaacgacatcatccggtacaagctctacgaggagctgaaggacaacggctacaagaccctgtacagcaacgagtacatcccccgcgagaagatcttctccaaggagatcgacatcgagcacgtgatcccccaggcccgcctcttcgacgacagcctgtccaacaagaccctggagtaccgggcgatcaacatcgagaaggggaacaagaccgcctacgacttcgtgaaggagaagtacggcaacgacggcctcgagaagttcctgaaccggtgcgagacgctgttcaaggacaagcgcaccaagctccggaagctgaagatggaggagaaggacatccccgaggggttcatcgaccgcgacctgcgcaacacccagtacatcagcaagaaggccttcgccatgctcaacgagatctcccggcgcgtcgtggccaccacgggcagcatcaccgacaagctgcgggaggactggcagctggtggacctcatgaaggagctgaacctgccgaagtacgagaagctcgggatggtcgagatgttcgaggacaaggacggccgcaagatcaagaagatcaccgactggaccaagcggaacgaccaccgccaccacgcggtggacgccctgacggtggccttcaccaaggacgtcttcatccagttctacaacaacaagaacgccgcgtggatgcccgccagcaaggagcacgccaacatcaccgggatcaaggcccggtacttcgagaacggcaaggccctggcgcccatgcccctcgcccagttccgcgccgaggccaagcggcacctggagaacctgctcgtgtccatcaaggccaagaacaaggtgatcaccagcaacgtcaaccgcacgaagaacaagaacggcgagaaccggaagctgcagcagaccccgcgcgggcagctgcacctcgagaccgtgtacggctcccaccggcagtacgcgaccaagatcgagaaggtgaacgccgccttcgacgtcacgaagatcgccaccgtgagcaagctggcctaccgcaacgcgctgctcaagcggctggaggccttcgggaacgaccccaagaaggccttcaccggcaagaacaccctggagaagaaccccctctacctggacgagaaccagaccgagatggtgcccgagaaggtccagacggtggagttcgagaccgtgtacaccatccgcaagccgatcgaccccaacctgtccatcgacaaggtcgtggacgtgaagatccggagcgtcctcgagaagcgcctgaaggagtacgggggcgacgccaagaaggcgttcgtgaacctggacgagaaccccatctggctcaacgaggccaagggcatctccatcaagcgggtgagcatccgcgggatctccaacgcccagagcctgcacgagaagaaggacaaggacggcaacctgatcctcgggaaggagggccggaagatccccgtcgacttcgtgaacaccggcaacaaccaccacgtggccatctacaagaagccggtcctggacaaggtgggccaggtggtcctggacgaggaggggaaccccaagtacgagctcgacgaggtggtggtctccttcttcgacgccgtgacgcgcgcgaacctggggcagcccatcatcgacaaggactaccgccggagcgagggctggcagttcctgttctccatgaagcagaacgagtacttcgtgttccccaacgacaagaccgggttcaacccgaaggaggtcgacctcctgaaccccgagaactacgccctgatcagccccaacctcttccgcgtgcagaagttcgcctacaagaactacgtgttccggcaccacctggagaccaccatcaaggacacgtccagcaccctgaagggcatcacctggaccgacttccgctccagcaagggcctcgacaagatcgtcaaggtgcgggtggaccacatcgggcagatcgtcagcatcggcgagtactga

SEQ ID NO: 1731 - RNA, 3663 nt, synthetic construct
  misc_feature 1..3663: note = Cas9 variant
  source 1..3663: mol_type = other RNA
atgaagcgcatcctgggcctcgacctggggagcgcctccatcggctgggccctgatcgaggaggacgagaaggggatccggatcatcgcgctcggcagccgcatcatcccctacaacgggaccgagggccaggacttcgccaagggcgccggggagtcccggaacagcctgcgcacccaggcccggacgacccgcaagggctacgaccggtaccagctgcgccggaagtacctcatcaacgtgctggagaagaacctgatgatgccgtccgaggacctccgcaagatgcccaagatgaacctgtggcagctgcggagcaaggccgtcaccgagtacatctcccgccaggagctcgggcggctgctgctctggctgaaccagaagcgcggctacaagagctcccggagcgacgcgaacctggacaagaaggacaccgactacgtgaaggaggtgaagtcccgcttcgacaagatcaaggagaagaaccagacgatcgggcagtacttctacgagagcctccagtgcgacgagtacttccgggtcaaggagaacgtgttcccccgcgaggcctacatcgccgagttcgacgccatctgctcccggcagaaggaccacctgggcctgagcgaggagctcatcgcggagatccgcaacgagatcatctactaccagcggcccctgaagtcccagaagggcctggtgagcgtctacgacttcgaggggaagtggatgaaccagaacggcaaggagctgttcatcgggccgaaggtggcccacaagtccagccccctcttccagctggccaagatctgggagtccgtgaacaacatcaagctcagcaccaagtacggcgacaccatcgagctgaccctggaggagaagaagcagctcgtcgagttcctggacaacaacgagaagctgacgaccgccgccctcttcaagatcctgcgcaaggacaagaaggagtacatcctgcccaagcagctcgagaagggcctgcaggggaacatcaccaagtgcaagatcgcggacatcctgggcagcaagtacaaccagctcctgcagctgaacctcgagaagcaggaggtggggaccccctgctacctgtacacgaagtccaccggcgaggtgctgggggagaagccgctccagtacatcgacaagagcgtcgagaaggagctgttctaccagctgtggcacaccatctactccatcagcgacgaggacgagtgctgcaaggccctccagaagcgcttcgacatcgacgccgagaccgccggccggctggccaagatcgacttctccaagtacggcttcgggaacaagagcgcgaaggccatccgcaagatcctgccctacctgatggagggcgacaagtactccgacgccatgtgctacgccgggtacaaccacagcaactccctcacgaaggaggagaaccacgagcggaagctgaacgacaagctgaagctcctgaccaagaacagcctgcgccagcccatcgtggagaagatcatgaaccagatgatccagctcgtgaacaccatcatcgacaagtacggcaagcccgacgagatccggctggagctggcccgcgagctcaagcagtccaaggaggagcggaacgacgcggacaaggccatgagcaagcgccagcgggagaacaaggaggccgagaagaagctggaggagcacgggatccgcgccacccacaacaacatcctgaagtaccgcctcttcgaggagatgggcgagaagaagcacgaggccatctgcatctactgcggcaacccgatctccttcagcgcggccatgaacggggacgaggtcgacgtggagcacatcatcccccggtccaagctgttcgacgacagccagtccaacaagacgctggcccaccggaagtgcaacgccaacaagaacgacatgaccgcgtacgacttcatgaagaccaagagcaagcaggacttcgacaagtacgtggagcgcgtcaaccagctctacgccgaccggatcatctcccgcagcaagtacaacaagctgctgatgagcgaggacgacatcccctccaacttcatcgaccggcagctccgcgagagccagtacatcgccaccaaggcccgggagatcctgcagacgatctgctacaacgtgtggtccaccagcggcaccgtgaccgccgagctgcgccacctctgggggtgggacgacatcacgatgaacctgcagatgcccaagtacaaggagctgggcctcaccgagatggtcgagtggacctccgaccacgggaagaacgtgcacagcaaggaggtgatcaagggctggaccaagcgcgacgaccaccggcaccacgcgatcgacgccctgacgatcgcctgcaccaagcagggcttcatccagcgcttcaacaccctgtccagctccaagacccgggacgacatgcagaaggagctcgagaagtgcagcatccagttccgcgagaagcggtccctgctggagaagtacatcatcagccagcgcccgatctccgtcagcgacgtggccgaggccgtctcccggatcctcatcagcttcaaggcggggaagaaggtggccacgatcggcaagcgcaaggtgaaggggaaggtcgtgcagcagggcatcgtggtcccccggggcgccctgtccgaggggagcgtgtacggcaagatccgcaccatcgtgcggaagatgcccgtcaagtacctgttcgagaaccccgacctcatcttcaagccgtacatcaaggccctggtgaaggagcgcctggccgagttcgacaacgacaacaagcaggcgctcgccagcctgaagaagaaccccgtgtacctggacaaggagaagaccaagctcctggagtacgggacctgcttcaaggacgagtacgtcaagaagtacgacgtgaaccccaacttcaccaagatcgccgacgtgatcgacggcaaggtcaagcagatcctggaggaccggctctccaagttcgggggcaagcccaaggaggccttcaaggacgtggtgaaggacggcaagacgctgaagtggtacgaggacgaggggctggagcgcccgatccggagcgtccgctgcctcaccggcctgtccgcggtggtgcccgtcaagaaggacgagaacgggatggacatcggcttcgtgaagcccgggaacaaccaccacgtggccatctacgtcggcgccgacggcaaggggcaggagcacgtgtgcaccttctggaacgccgtggagcggaagaagtacggcctgcccatcatcatcaaggacgccaacgaggtctgggacaagatcaccatggcgggggacgacgtgtacccgcagagcttcctctccctgctgcccaagcccgactggacgctcaagctgagcatgcagcagaacgagatgttcatcctgggcatggaggaggacgaggtgaagttcgccatcgagtccaaggactacaagctcctgagcgaccacctgtaccgcgtccagaagctctccagctccgactacaacttcatccaccacctggagaccgacgtgcagaagaagaccatgacctaccgggtgcgcagcctgtccggcctcttcgccctgcggccgttcaaggtccgcatcgactgcctggggaacatcatccccagctga

SEQ ID NO: 1732 - RNA, 3669 nt, synthetic construct
  misc_feature 1..3669: note = Cas9 variant
  source 1..3669: mol_type = other RNA
atgaagaagcgcatcctgggcctcgacagcgggaccaactccctgggctgggccgtggtcgaccgggacgagaacaaccagtacagcctgatcaagtacggggacctcatcttcgaggagggcgtgaagatcgagaagggggtggagtccagcaaggccgcggagcgcacctcccaccgggccctgcgcaagctgtacttccggcgccggctccgcaagatcgaggtcctgaaggtgctggtgaagtacaacctctgcccccaggtcagcgaggaggagctgcacctgtggcacacgcggaagctctacccgcagaacaaggacctgctgcagtggcagcgcaccgacgagaaggccggcaagaacccctacatctaccggtaccgctgcctccacgaggagctggacatgtccgtgagcgccaaccggatgaccgtgggccgcgccatgtaccacctggcgcagcggcgcgggttcctctccaaccggctggacaacgaggaggacgagaaccagatcggcgccgtcaagtgcgggatcagcaacctgaccgaggagatccagtccagcggctgcaagtacctcggggagtacttctacaagctgtacaacgagcacggcaacacggtgcgcctgcggacccgctacacctcccgggagttccactacaagaaggagttctacgccatctgcgagaagcagaagctcgacaagaagctgatcgaggagctggccagcgcgctctacttccagcgccccctgaagtcccagcgccacaccgtgggccggtgcacgttcgagcccaacaagccgcgctgcgccgacagccaccccgcctacgaggagttccggatgctgtccttcatcaacaccatcaaggtccaggggccctacgacaccgagctccgcgtgctgaacaccgaggagcgggacagcatcacgaagctgttctgccgcaagtccaagcccaacttcgacttcgaggacatcgccaaggagctcgccggccggaacaactactgctacatcggggacgtggtcgacaaggcgtacaagttcaactaccgcatgagccagggcgtgagcggctgcccgaccaccacctacctgatcaacgtgttcgggcaggactggcagacgggcatcgccgagtcctaccaggccatcgacaccaagctggggcagaagtccgtcgacgccatgatcgacgacgtgtggaacgtgctctactccttcagctccaaggacaagctgcgggacttcggccgcaagaagctgcagctcggggacaaggaggccgacaccttcgcgaacatcaagctgacccacaagttcgccagcctgtccctcaaggccatccggaagatcaacatcttcctgcgcatgggcctggtctacagccacgccgtgacgctcgccaacatccccaccatcgtgggcaccgacatctggcagcggaagcgcaacttcatcctggcggagctgctccccctgatcgagaacttcaaccccaaggagaccaagctgcaggagacgctggacttctgcgtcaaggacttcctccagaacaacttcgagctgaagaacggggccgtggacaagctgtaccacccgtccatgatcgaggcctaccccgacgccggcctcaacagcaacgggatcctgcagctgggcagcccccggaccaacgccatccgcaaccccatggcgatgcggagcctccacgagatccgcaaggtcatcaaccagctgctgaaggacaagatcatcaaccaggacaccgagatccacgtggagtacgcccgggagctcaacgacgccaacaagcgcaaggccatctccatctggcagaagtcccaggagaagctgcacaagaagtacgtggaggagatcaccaacctgtacaaggaggagacggggaaggcgatcgtcccgaccgacaccgacatcctcaagttcaagctgtgggaggagcagaaccacatctgcctgtacaccggccagcagatcggcatcgccgagttcctcggggccacgcccaagtacgacatcgagcacaccatcccccagagcgtgggcggggacagcaccgacatgaacctgaccctgtgcgactcccgcttcaaccgggagatcaagaaggcccagctccccacgcagctgggcaaccacgccgacatcctggtgcgcatcgcggggtggaagaacagctacgagaagctctccaaggacatcgaccggatccgcacccacagcggcatggccaaggacatcaaggaccggctgatccagaagcgccacctcctgaagctggagcgggactactggcgcggcaagtacgagcggttcaccatgaacgagatcccggaggggttcagccgccggcagggcgtcgggatcggcctgatctccaagtacgccggcctctacctcaagagcctgttccacgacaagaacgagcgcaacaaggggcacgtgttcgtggtcaagggcaccaccacggccgagttccggaagatgtgggggctgcagaacgagtacgagaagaagtcccgcaacaaccacgtgcaccactgcatcgacgccatcaccatcgcgtgcatcggcaagcacgagtacgcccagatggcccagtactaccacgacgaggccgagtacctgtaccaccacgggatcaagcccatcttccccaagccctggaagaccttcaccgaggacctgctcgacctggagcacagcctgttcgtggtccaccactccccgaacaacatggccaagcaggcgcggaagcgcatcatcacgagcaccggccagcactgggcccagggcgactccgcccacgggagcctccacaacgacacctactacggcgccatcgagcgggacggggagatcaagtacgtggtgcgccgggcggtctccagcttcgagcagatgtccgacgtggacagcatcgtggacgacgtcgtgaaggagaccgtgcgcaaggccctggagggcaagaacttcaaggaggccgtcaacgcccccatctacatgaacaaggagaagggggtgctgatcaagaaggtgcggtgctacgccaagtccatcaagaagcccatcgacatccgcacgcaccgcgacagctccagcaaggagtacaagcggaagttccacgtctccaacgacatcaactacctcatcgcgatctacgagggcaccgtgaagggcaaggtgaagcgcgacttcgaggtcgtgaagaacatcgaggccgccaacttcttcaagcggagccaggaccgccgggactaccccaccatcgtgccggagaagtccatcaagcacgggttccccctgaagaccacgctgaccaacggcaccatggtcatcctctacgaggagaacaaggaggagatcgacttcaccaagaaggaggacatctgccgccggctgtacaagctggtggggatgagcagcatgatcgtgtccggctgcgagtacggggtcctcagcctgcgccaccaccaggaggcccggccctccaaggacatcaagagcaagaacggcgccttcaagaacggcgaggcgctgcgcccggccatcacgatgctccacacccagttcaacgccctggtggagaacatcgacttcaacatcgacgtgaccgggaacatcgagctgatctga

SEQ ID NO: 1733 - RNA, 3669 nt, synthetic construct
  misc_feature 1..3669: note = Cas9 variant
  source 1..3669: mol_type = other RNA
atgaagaagcgcatcctgggcctcgacagcgggaccaactccctgggctgggccgtggtcgaccgggacgagaacaaccagtacagcctgatcaagtacggggacctcatcttcgaggagggcgtgaagatcgagaagggggtggagtccagcaaggccgcggagcgcacctcccaccgggccctgcgcaagctgtacttccggcgccggctccgcaagatcgaggtcctgaaggtgctggtgaagtacaacctctgcccccaggtcagcgaggaggagctgcacctgtggcacacgcggaagctctacccgcagaacaaggacctgctgcagtggcagcgcaccgacgagaaggagggcaagaacccctacatctaccggtaccgctgcctccacgaggagctggacatgtccgtgagcgccaaccggatgaccgtgggccgcgccatgtaccacctggcccagcggcgcgggttcctctccaaccggctggacaacgaggaggacgagaaccagatcggcgcggtcaagtgcgggatcagcaacctgaccgaggagatccagtccagcggctgcaagtacctcggggagtacttctacaagctgtacaacgagcacggcaacacggtgcgcctgcggacccgctacacctcccgggagttccactacaagaaggagttctacgccatctgcgagaagcagaagctcgacaagaagctgatcgaggagctggccagcgccctctacttccagcgccccctgaagtcccagcgccacaccgtgggccggtgcacgttcgagcccaacaagccgcgctgcgcggacagccaccccgcctacgaggagttccggatgctgtccttcatcaacaccatcaaggtccaggggccctacgacaccgagctccgcgtgctgaacaccgaggagcgggacagcatcacgaagctgttctgccgcaagtccaagcccaacttcgacttcgaggacatcgccaaggagctcgccggccggaacaactactgctacatcggggacgtggtcgacaaggcctacaagttcaactaccgcatgagccagggcgtgagcggctgcccgaccaccacctacctgatcaacgtgttcgggcaggactggcagacgggcatcgcggagtcctaccaggccatcgacaccaagctggggcagaagtccgtcgacgccatgatcgacgacgtgtggaacgtgctctactccttcagctccaaggacaagctgcgggacttcggccgcaagaagctgcagctcggggacaaggaggccgacaccttcgccaacatcaagctgacccacaagttcgcgagcctgtccctcaaggccatccggaagatcaacatcttcctgcgcatgggcctggtctacagccacgccgtgacgctcgccaacatccccaccatcgtgggcaccgacatctggcagcggaagcgcaacttcatcctggccgagctgctccccctgatcgagaacttcaaccccaaggagaccaagctgcaggagacgctggacttctgcgtcaaggacttcctccagaacaacttcgagctgaagaacggggcggtggacaagctgtaccacccgtccatgatcgaggcctaccccgacgccggcctcaacagcaacgggatcctgcagctgggcagcccccggaccaacgccatccgcaaccccatggccatgcggagcctccacgagatccgcaaggtcatcaaccagctgctgaaggacaagatcatcaaccaggacaccgagatccacgtggagtacgcgcgggagctcaacgacgccaacaagcgcaaggccatctccatctggcagaagtcccaggagaagctgcacaagaagtacgtggaggagatcaccaacctgtacaaggaggagacggggaaggccatcgtcccgaccgacaccgacatcctcaagttcaagctgtgggaggagcagaaccacatctgcctgtacaccggccagcagatcggcatcgcggagttcctcggggccacgcccaagtacgacatcgagcacaccatcccccagagcgtgggcggggacagcaccgacatgaacctgaccctgtgcgactcccgcttcaaccgggagatcaagaaggcccagctccccacgcagctgggcaaccacgccgacatcctggtgcgcatcgccgggtggaagaacagctacgagaagctctccaaggacatcgaccggatccgcacccacagcggcatggcgaaggacatcaaggaccggctgatccagaagcgccacctcctgaagctggagcgggactactggcgcggcaagtacgagcggttcaccatgaacgagatcccggaggggttcagccgccggcagggcgtcgggatcggcctgatctccaagtacgccggcctctacctcaagagcctgttccacgacaagaacgagcgcaacaaggggcacgtgttcgtggtcaagggcaccaccacggccgagttccggaagatgtgggggctgcagaacgagtacgagaagaagtcccgcaacaaccacgtgcaccactgcatcgacgccatcaccatcgcctgcatcggcaagcacgagtacgcgcagatggcccagtactaccacgacgaggccgagtacctgtaccaccacgggatcaagcccatcttccccaagccctggaagaccttcaccgaggacctgctcgacctggagcacagcctgttcgtggtccaccactccccgaacaacatggccaagcaggcccggaagcgcatcatcacgagcaccggccagcactgggcgcagggcgactccgcccacgggagcctccacaacgacacctactacggcgccatcgagcgggacggggagatcaagtacgtggtgcgccgggccgtctccagcttcgagcagatgtccgacgtggacagcatcgtggacgacgtcgtgaaggagaccgtgcgcaaggcgctggagggcaagaacttcaaggaggccgtcaacgcccccatctacatgaacaaggagaagggggtgctgatcaagaaggtgcggtgctacgccaagtccatcaagaagcccatcgacatccgcacgcaccgcgacagctccagcaaggagtacaagcggaagttccacgtctccaacgacatcaactacctcatcgccatctacgagggcaccgtgaagggcaaggtgaagcgcgacttcgaggtcgtgaagaacatcgaggcggccaacttcttcaagcggagccaggaccgccgggactaccccaccatcgtgccggagaagtccatcaagcacgggttccccctgaagaccacgctgaccaacggcaccatggtcatcctctacgaggagaacaaggaggagatcgacttcaccaagaaggaggacatctgccgccggctgtacaagctggtggggatgagcagcatgatcgtgtccggctgcgagtacggggtcctcagcctgcgccaccaccaggaggcccggccctccaaggacatcaagagcaagaacggcgccttcaagaacggcgaggccctgcgcccggcgatcacgatgctccacacccagttcaacgccctggtggagaacatcgacttcaacatcgacgtgaccgggaacatcgagctgatctga

SEQ ID NO: 1734 - RNA, 3678 nt, synthetic construct
  misc_feature 1..3678: note = Cas9 variant
  source 1..3678: mol_type = other RNA
atgagcaagcgcatcctgggcatcgacgtggggaccaactccctcggctgggccgtcgtggaccggaccgactgcgacaactacacgctggtgaagcgcggggacgtcatcttccaggagggcgtgaacatcgagaaggggaacatcgagaagtcccgggccagcgagcgcaccggccaccggagcacccgcaagcactacttccggcgccggatgctgaagatcaaggtgctcgagatcctggtcgagcaccagctgtgcccctacctctcccacgaggagctgcaccagtggatgacccgcaaggtgtacccgacgaacgaggacttccggctgtggctccgcaccaacgacgcgaacgaccagaacccctaccacgaccggcacgtgtgcctgcacgagcgcctggacctccggctgcaggagaaccgctaccggctgggccgcgccctctaccacctggcccagcggcgcgggttcctgagcaaccggctcgagcagaactccaagaccgacgagaccggcgccgtcaagagcgacatctcccagctgaacgaggagatgaagaaggccgggagccagtacctgggcgactacttctactggctctaccaggagtacgggaaccaggtgacgctgcgcatccgctacaccgaccggaagcagcactaccagaaggagttcgaggcgatctgccagcgccagcagctgtccgacgacctcgtggacaagctgcggcgcgccatctacttccagcggagcctgaagtcccagcgcgccggcgtcggcaagtgcaccttcgagcccgacaagccccggtgcgccctcagccacccgcgctacgaggagttccggatgctgtccttcctgaacaacgtgaaggtgaaggggcccagcgacgactccctccgccccctgagcccctccgagaaggagaagatcaagccgctgttcctccgcaagagcaaggcgaacttcgacttcgaggacatcgccaaggccatcgccggcaaggggaagtacgcctgcatccgggacaaggagggcgcgcagaagccctaccagttcaactacgccctgagccagggcgtctccgggtgccccgtgaccgccaagctgatcgccgtgttcggcgagagctgggagcggaacctcgtcaacgcctaccgctcccggaacgacatgcgcaagagcgacgaggagatcgtgaacgaggtgtggaacgtcctgtactccttcagctccaaggagaagctgcgggcgtgggggatggagaagctcggcctggacgaggcctgcgccggggagttcgccgacatcacgctgcccaccgccttcgcggccctcagcctgaaggccgtgaacaagatcctgccgttcctccgccagggcttcatctactcccacgccgtgatgctggccaacatcccctacatcatcggcatggaccggtggaacgagccccgccagcgccagttcatcatggacaacctgcaggagctcctggacaacttcaccgcgagcgacaaggccctgcagcagaccctggacttctgcatcaaggacttcctcctgaacaactacgagctggcccccgggaaggccgaccggctctaccacccgtccatgatcgagacgtaccccgacgcgaaggccgacggccaggggatctaccagctgggcagccccgccaccaacgccatccgcaaccccatggccatgcggtccctgcacatcctccgccgggtcgtgaaccagctgctgaaggagaagaccatcgacagcgagaccgaggtccacatcgagtacgcgcgcgagctcaacgacgccaaccggcgctgggccatcaaccagtggcagcggaagcaggagacgcagcgcaaggactacgccgagaagatccggaaggtgtacgccgacgagttcgagaaggtgatcgagccgacccaggaggagctgctgaagtaccagctctgggaggagcagcagcacctgtgcctgtacaccggggagcagatcggcctcaccgacttcatcggccccaacccccgctacgacatcgagcacacgatcccccagtccatgggcggggacagcacccggatgaacctgaccctgtgcgagcgcacctacaaccggacggtcaaggggaaccgcatgccgtcccagctcgcggagcacgagagcatcctgacccggatcaagccctggaaggacaagtacgaggagctgaccgtgaagatcaacaagctccgcacccaccccggcatggacaaggcctccaaggacaacatcatccggaagcgccacctcctggagctcgagcgggactactggttccagaagtaccagcgcttcacgatgaccgaggtgcccgaggggttcagcctgcgccagggcaccggcatcgggctgatcggcaagtacgccgggctgttcctcaagagcctgttccaccacgtcaaggagcggaaccgcaagcaggtctacgtgatcaagggcccgatcaccgccgagttccggcgcctgtggggcctgcagaacctgtacgagcagaagtcccgggacaaccacgcccaccactgcatcgacgcgatcgtgatcgcctgcatcaaccccgccgagtacgcccgcatggcgagctactaccggcaggaggaggacttccgcctcaacaaggggaacaagcccgtgttcccgaagccctggacgaccttcacccaggacctgcaggccctggaggccgagctcctggtggtccacgagacccggaacaacctgaccaagaaggcccgcaagcgggtgcgcacgaagggcgggaacgtgctctccgagagcgactccgcccggggcagcctgcacaacgacacctactacggggcgatccagaaggacggcgtcatccgctacgtggtgcggaaggccctgtccagcctctccgagaaggacgtcaaggacatcgtggacaagaccgtgcgcgagaaggtccaggccgccatccaggagaagggcgccaaggaggcgctggccgggaccatctacatgaacgaggagaagggcatcacgatcaagaaggtgcggtgcttcaccaagatcgccagccccctggccatccgccggcaccgcgacgcctccgcgaaggagtacaagcgcccctactacgtgaccaacgagagcaactacgtcatggggatctacgagggctgcatcaaggagaagaccaagcgggagttcatcctcgtgaacaacctggaggccgtgcgccagctgaaggccgcccggaagcagggggtcgtgtccagcatcctcccgcccgtgtccgccaagagccagttccccctgaagtaccgcctgtacacgggcaccctcgtcctgctgtacgagaactcccccgaggagatcgacttcaccaaccaggtggacatctgcaagcggctctacaaggtgaccggcctgagcagcatgacggtcaccgggaaccagtacggcaccatccagctgcgctaccaccaggaggcgcggcaggccaaggacctcaaggcccagaacggggcctacaaggagggcgaggagcaccgcccggcgatcatgatgctgcacacccagttcaaggccctggtggaggggacggacttccggatgaacatcctcggcgagatcgagcccctgcgcaagtga

SEQ ID NO: 1735 - RNA, 3690 nt, synthetic construct
  misc_feature 1..3690: note = Cas9 variant
  source 1..3690: mol_type = other RNA
atgggcgaccgcaagtacaacctggggctcgacatcggcaccagctccatcgggttcgccgccgtggacgagaacaaccagcccatccgggtcaagggcaagaccgcgatcggggtgcgcctgttcgaggagggcaagacggccgccgaccggcgcggcttccggaccacccgccggcgcctgagccggcgccggtggcgcatcaacctcctgaacgagatcttcgacgcccacctggccgaggtggacccgaccttcctcgcgcggctgaaggagtccaaccgcagcaacctggaccccaagaagtccttccaggggagcctcctgttccccgagcggaaggactaccagttctacgaggagtaccccacgatctaccacctccgcaaggccctgatggagaaggaccggaagttcgacatccgcgagatctacctggccgtccaccacatcatcaagtaccggggcaacttcctgaacgggaccccgatgcgctccttcaaggtggagaacatcgagctcaacaccctgttcgaccagctgaaccagctctacgccgagatcgtgcccgacaacgagctggcgttcgacctggcccaggtcgccgacgtgaaggacgtgctcagctccaccacgatctacaagatggacaagaagaagcagctggtcaagatgatgctgctccccgccagcaacaaggccctgcagtccgagaacaagaagatcgtgacccagttcgtgaacgcgatcctgaactacaagttcaagctcgacgtcctgctccaggtggagaccgacgccgactggagcctgaagctgaacgacgagggcgccgacgacaagctggaggagttcaccggggacctcgacgagaaccggctggagatcatcgacctgctccagcgcctgcacaactggttctccctgaacgagatcacgaaggacggcaacagcctctccgccgccatggtggagaagtacgagaaccaccaccaccacctgggcctgctcaagaaggtcatcgagaaccaccccgacgcgaagaaggccaaggccctgaaggagacctacaccgcctacgtggggaagaccgacgacaagacgcagaaccaggacgacttctacaaggccgtggagaagaacctggacgacagcccggacgcgaagggcatcaagcgcctcatccagctggaccagttcatgcccaagcagcggaccgggcagaacggcgccatcccccaccagctgcaccagcaggagctcgaccagatcatcgagaagcagtccaagtactaccccttcctggccgagccgaaccccaacgtcaagcgccggaaggacgccccctacaagctggacgagctgatcgccttcaagatcccctactacgtgggcccgctcgtgacccccgaggagcaggcgcagaacaaggagaacgtcttcgcctggatgaagcgcaaggccgccgggcccatcaccccctggaacttcgacgagaaggtggaccggatggagagcgcgaaccgcttcatccggcgcatgacgaccaaggacacctacctgttcggcgaggacgtgctgccggccgagtccatgatctaccagaagttcgtcgtgctcaacgagctgaacaacctgaagatcaacgggcggcacctcagcctgaaggacaagcaggacgtctacaacgacctgttcaagcagcagaagaccgtgagcatcaaggccctccagaactactacgtgacgaagaagaaggccgccaccgcgcccaccgtcggcgggctggccgaccccaagaagttcctgtccagcctctccacctacatcgacttcaagaacatgttcggcgagcgcgtgaacgacccccagttccaggaggacctggagcagatcgtggagtggagcacgatcttcgaggaccggggcatcttcaaggccaagctgcaggccctcgggtggctgtccgagaagcagatccagcagctggtcgccaagcgctacaagggctgggggcggctcagcaagaagctgctgaccggcctcaagaacgcggaggggtactccatcctggacgagatgtggcgcagcaccgagaacttcatgcagatccagtcccggccggagttcgccgccctgatccagcaggccaacgagaagcagttcgagggcaacgaccccgacaacgtgtgggagaacatcgagaacatcctcggcgacgcctacaccagcccccagaacaagaaggcgatccgccaggtggtcaaggtggtgcaggacatcgagaaggccgtcgggaacccgcccgagaagatcgccatcgagttcacgcgggaggccgcggccaacccccagcgcacccagtcccggctgcgcaccctggagaagctctacgagagcgccgaggaggtggtggacgccggcctgaccgccgagctggcggagttcaaggagaacaagcacgtcctctccgacaagtactacctgtacttcacgcagctggggcgcgacgtgtacaccggcgacaccatcagcctcgacaagctgaacgactacgacgtggaccacatcctgccccagtccttcatcaaggacgacagcctcgacaaccgggtcctgaccatccgcgccgtgaacaacgggaagtccgacaacgtgccggccaagatgttcggcaagaagatgggcagcttctggcggcacctcctggacaacgggatgatctccaagcgcaagtacaacaacctgatcaccgaccccgacaacatcagcaagtacgcccagaagggcttcatcaaccggcagctggtcgagacgagccaggtgatcaagctcaccgccaacatcctgaacgggatctacgacaaggacaccgagatcatcgaggtgcccgcgaagatgaactcccagatgcgcaagatgttcgacctggtcaaggtgcgggaggtgaacgactaccaccacgccttcgacgcctacctcaccatcttcatcggcaactacctgtacaagtgctaccccaagctgcgcccgtacttcgtctacgacaacttcaagaagttcggcaacaaggaggacatcgggcacaagcggttcaacttcctcggcaagatcgagcgcgagaagaaggtggtggcccccgagacgggggagatcctgtggagcaacgtcgcccccaacgagaccatcaagcagatcaagaaggtgtacaactacaagttcatgatcgtgtcccgggagatcaccacccgccgggcggagctgttcaaccagacggtctaccccaagaactaccgcggcaagctcatcccgatcaaggaggaccggcccaccgacctgtacgggggctacagcggcaacaccgacgcctacctggccatcgtggccctcgaggacaagaagaaggggaagtacttcaaggtggtcggcatccccacccgcgcggccgccaagctggagaagctgaagcagcaggactcccagcagtacctccaggccctgcacgaggtgatcgcgccccagttcaccaagagcacgaagaaggggatcaagaagaccgagttcgagatcgtgctggacaaggtccactaccggcagctcgtgcaggacggcccggtgaagatgatgctggggtccagcacctacaagtacaacgccaagcagctggtcctctccgagaaggccctgtga

SEQ ID NO: 1736 - RNA, 3696 nt, synthetic construct
  misc_feature 1..3696: note = Cas9 variant
  source 1..3696: mol_type = other RNA
atgatcacccgcatcctgggcctcgacaccgggacgaacagcctggcctgggccgtggtcgaccgggacgcgaacggcaactacaccctggtgaagcgcggggacgtgatcttcaccgagggcgtcaagatcgagaaggggatcgagtccagcaaggccgccgagcggaccgcccacaaggccctccgcgtgcactactcccggcgccggctgcacaagatcgacacgctgaaggtgctcgtcgagctggacctgtgcccctacctcagcaacgagcagctgaacctgtggaaggcgaagaagacctacccgctcaccgacgacttcatgctgtggcagcgctccggcagcgccgaggagaacaacccctactactgccggcaccgctgcctgacccagaagctcgacctgacggaccagtcccagcggttcctgctcggccgcgccttctaccacctggcccagcggcgcgggttcctgagcaaccggctcgacacctccgcggacagcgacgagtccggcaaggtcaagagcgggatcgccgagctgtccgtggagatggagaaggccggctgcgagttcctgggggagtacttctaccagctctacaagcagcacggcaacaccatcaagctgcgcagccggtacaccgaccgcgaggagcactacaagaaggagttcctggccatctgcgagaagcaggagctcgaccccaagtgggtggaggccctgcagcgggcgatctacttccagcgccccctgaagtcccagcggaagggcgtggggaagtgcacgttcgagccgaagaagccccgctgcgccgagagccaccccgactacgaggccttccgcatgctctgcttcctgaacaacgtgaagatccagacccccaacgacacctccctgcggccgctcaacgaggacgagcgcgagaagatctggcccctgttcttccgcaagagcaagcccaacttcgacttcgaggacatcgccaaggccctggcgggcaagaacaactacgcctggtacaaggacgccggggagaagcccttcaagttcaactaccggatgcagcagggcgtctccggctgcccggtgaccgcccagctcatcgacatcttcgggagcgactggcagacggccatcgcggagacctacaccgccgtggagaagaagaacggcaccaagacgatcgacgagatggccgacgacgtctggaacgtgctgtacagcttctccagcaaggacaagctgaaggccttcgccaccgagaagctccagctggacgaggcgtccgccaccaagttcgccaacgccaagctgccccacgggttcgcgagcctctccctgaaggccatccggaacatcctgcccttcctccgccagggcttcatctacgcccacgccgtgcacctggccaagatccccgacatcgtcaccaaggcggtgtggaacgacgccgacaagcgggagatgatcctgagcgggctcatggagatcatcgagaactacaacccgaaggaccgcggcgtggagggcacgatcgacttctgcatcaagtcccacctccaggacgtcatcgacctgcggcccggggccgccgacgccctgtaccaccccagcatgatcgagacctaccccgacgcgaagctgaacaagatgggcgtgttccagctggggtccccgcgcaccaacgccatccggaaccccatggccatgcgcagcctgcacatcctccggtccgtggtcaaccagctgctgcgcgacggcatcatcgaccggaacaccgaggtgcacgtcgagtacgcccgcgagctcaacgacgccaacaagcggaaggcgatcgccgactaccagcgcgagcaggagaagaagcggaagcagtaccgcgacgacatcatcgccctgtacaagagcgagtgccacaaggagatcgagcccacggacaccgacatcctgaagttccagctctgggaggagcaggaccacctgtgcctgtacaccgggacccagatcggcatctgcgacttcctcggcgacaaccccaagttcgacatcgagcacacggtgccgcgctccgtgggcggggacagcacccagatgaacctgaccctgtgcgacgccaccttcaaccggcaggtcaagggggcgcagctcccctcccagctgagcaaccacgccgacatcctggtgcgcatcgaccactggaagtccaagtgcgaggacctccggaagcagctggacaagatccgcacgtacggcgggatggagaaggccatgaaggaccggctgatccagaagcgccaccggctcaagatggacctggactactggcagggcaagtacagccgcttcaccatgaccgaggtgcccgagggcttctcccggcgccagggggccggcatcgggctggtcagcaagtacgccggcctcttcctcaagagcctgttccacaacgagcagaaccccaacaagtccaacgtgtacgtggtcaagggcgtgaccaccgcggagttccggcgcatgtgggggctgcagggcgagtacgagaagaagtcccggctgaaccactgccaccactgcatcgacgccatcacgatcgcctgcatcgggaaggccgagtacgacaagatggcccagtactaccacgacgaggagctgttccagtggcgcggcaccaccaccaagccgcacttcaacaagccctggcccacgttcaccgaggacgtgctcgcgatcgagcagagcctgctggtcaagcacctcaccaaggacaacatgccgaagcaggccaagaagcgggtgcgcaccgccacggggaagtacctggcccagggcgacaccgcccggggcagcctgcacaaggacacctactacggggcgatcgagcaggacggcgagatccgctacgtgctccggaagcccctgaacaagttcgagaacgaggccgagctggagaagatcgtcgaccaggccgtgaaggagaagatcaaggaggccatcgcggggaagaacttcaagaccgccatcacggagcccatcttcatgaacaaggagaagggcatccgcatcaacaaggtgcggtactacgtcaaggcccaggagcgcctcaagatccgccagcagcgggacctgtccagcaaggagtacaagcagttcttctgcgtggagaacgagtccaactacctgctcgccatctacgagggggagctgaagggcaagaaggagcgcgacttctgcgtggtcaacaacctggagagcgccgcgtgcctcaagcggtccaacaagggcaaggccgcgcccctggtgccggagcgcagcgaggagcggaacctgcccctcctggccgtgctgaagcgcgggacccaggtcctcttctacgagaactcccccgaggagatcctgttcgacaacccccaggacctggtgcggcgcctctacaaggtgaccggcatcaacaccaagaaggacgtcaagaacgggaagacgtacctgtacggcaacatcgagctgcggttccaccagaacgcccagaagaaggacgacgtgaagatgcagagcggggtgtacaagaacaacgaggtcctccgccagggcatcgtgctgtcccacaagcagttcaaggccctggtggagggcgtcgacttcgagttcaacgtgctcggggagatcaagaagaaggagcggcacgcctga

SEQ ID NO: 1737 - RNA, 3699 nt, synthetic construct
  misc_feature 1..3699: note = Cas9 variant
  source 1..3699: mol_type = other RNA
atgaccaagacccggatcctgggcctcgacacggggaccaacagcctgggctgggccatcgtggaccgggacgaggtctccgggcagtacgagctggtggaccgcggcgacctcatcttcaccgagggggtgaagatcgagaagggcatcgagagctccaaggccagcgagcggacccagcaccgcgcgctgcggaagcagtacttccgccggcgcctgcggaagatcgaggtcctccgcgtgctgacgttctaccacctgtgcccgcccgtgtccgaggaggagctccacctgtggcacgtcaagaagatctaccccgtggagaaccacgagttcatgatctggcagcggaccaacgacaacgagggcaagaacccctactactaccgccacatctgcctgcacaccaagctcaacctgaccctgatgaaggaccggtacatcctcgggcgcgccctgtaccacctgagccagcggcgcggcttcctctccaaccggctggaccagagccaggacgaggacgacaaggggacggtgaagaccggcatctccagcctgtccaaggacatgaacgacgccgggtgcacctacctcggcgactacttctacaagctgtacagcgagaacggcaaccgcgtccggatccgcaaccactacaccgcccggaacgagcactacctggccgagttcgaggcgatctgccaggtgcagaagctcgagcccgagctggtggaggccctgcgccgcgccatcttcttccagcggccgctcaagtcccagcgcaagggggtcggcaagtgcacgttcgagccccggaagccccgctgcgccgacagccaccccgactacgaggagttccggaagctgtgcttcatcaacaacatcaagatccagacctccgacgacgacaccatgcgcccgctgaacaaggaggagcggcagcgcatcaacagcctcttctaccgggtgtccaaggcgaacttctacttcgaggagatcgccaagctgctcgggggccgcaacaactactgctacttcaaggacgaggtgcagaaggacttcaagttcaactaccggatgagccagtccgtcagcggctgccccaccacggcccagctgcgcaacatcttcggggaggactggaagaccggcatcgccgagacctaccagcacagcgccaagaaggacgggtccctgaagaccgtggacgagatggcggacgacatctggaacgtgctgtacagcttctccagcaaggactgcctctacaacttcgccgtcaacaagctgcagctggaggaggacaaggccaagaagttctccaagatcaagctcagccacggcttcgcctccatcagcctgaacgccatccacaagatcctgcccttcctccggatggggatgatctactcccacgcggtgctgttcgccaacatccccacgatcgtgggcatggacgtctggaacgacgagagcaagcgccagcacatcatgaccgagctgtccgacctcgtgttcaactacgacccgaagaaccgggaggtggagggcaccatcgagatgtgcatcaaggacttcctgctgaacaactacgacctccccgccggggccgtctgccgcctgtaccaccccagcatgatcgacacctaccccgacgccaaggcgaacaagtacggcgtgctgcagctggggtccccggccacgaacgccatccggaaccccatggccatgcgcagcctccacgagctgcggcacgtcgtgaacctgctcctgcgcaagggcaagatcgaccagaacaccgaggtgcacgtcgagtacgcccgcgagctgaacgacgcgaacaagcggaaggccatcgccgaccgccagcgggagctcgacaagctgcacaagaagtaccacgacgacatcatcaccctgtacaaggaggagaccgggaaggacatcaaccccacgcaggccgacatcctcaagttccagctgtgggaggagcaggagcacgtgtgcctgtacaccggccgccagatcggcatctccaagttcctcgggcccgacccggagttcgacatcgagcacaccgtgccccggagcgtcggcggggactccacccagatgaacatgacgctgtgcgaccgccggttcaaccgcgacgtgaagaaggcgatgctgcccagccagctccccaactaccaggagatcctgccgcggatcgagaagtggaagaagaagtacgagaagctgaccaaggacatcgaccactgcatcacccactccggcatgaccaaggaggccaaggacagcatcatccagaagcgccaccggctcacgctggagcacgactactggcgcaacaagtacagccggttcaccatgaccgaggtgcccgaggggttctcccgccggcagggcgccggcatcgggctggtcagcaagtacgccggcctcttcctgaagtccctgttccacgaccccaccgaccgccggcgcagccacgtgtacgtggtcaaggggaccacgaccgccgagttccggaagatgtggggcctccagtccgagtacgagaagaagtcccgcgacaaccacgtgcaccactgcgtggacgcgatcaccatcgcctgcatcggcaagaacgagtacaacaagatggccagcttctaccacgacgaggaggccttcgagcgcggggagtgcgagaagccccacttcgacaagccgtggcccaccttcacgcaggacgtcctgggcctggagaagcggctcatcgtggtgcacagcacccaggacaacatgcccaagcacgccaagaagtacgtccgcaccccgcgggggaagttcatcgcgaagggcgactgcgcccgcgggtccctgcacctggacacctactacggcgccatcaagcacaaggacgacacggagccccggtacgtgctccgccgggagctgagctccttcgacagcgtgaacgacctggacatcatcgtcgacgacgccgtgcgcgagaagatcaaggaggccgtgaagggcaagtccgggaaggcgttcaaggaggccctcgccaacgtctacatgaacaaggagaaggacatccggatcaagaaggtgcgctgctacgtgcccagcgtcaagcggcccatcgacatccgccaccagcgggacatgtcccgcttcgactacaagcggcagttccacgtggccaacgacggcaactacatgatggcgatctacgagggggtggtcaagggcaagctgaagcgcgacttcgagctggtgaagaacatcgaggccgccagctacttcaaggtgtcccaggacaacgagagcttcagctccatcgtcccggagaagtccagcaacgggttccccctcaaggccgtgctgaagatcggcacccacgtgctgctctacgagaacaccgccagcgagatcgacttctccgaccccgtcgacctgacccggcgcctgtacaaggtggtgggcctcagctccgcgatcatcaacaactgcagctacgggttcatcacgctgcggttccaccaggaggcccgccaggccaagaacctgaagctcaccaagggcgtcttcaagaacgtggacaactaccgcggggccatcatcctgtaccacacccagctgaaggccctcgtggagggctacgacttcgacatcaacatcctgggggagatcacctccaagcagtga

SEQ ID NO: 1738 - RNA, 3705 nt, synthetic construct
  misc_feature 1..3705: note = Cas9 variant
  source 1..3705: mol_type = other RNA
atgcccaacttctggagcatcttcaccgagaacctgcagacctacctcatgaagacgcgcatcctgggcctggacaccgggaccaactccctcggctgggccgtggtcgaccgggacgagaacaaccagtacaccccgatctgccgcggggacctgatcttcacggagggcgtgaagcaggagaaggggatcgagttcagcctggccgcggagcggacctcctaccgcgccagccggcgccactacttccggcgccggctccgcaaggtggaggtcctgaaggtgctggtgaagcacaagctctgcccgcccctgtccgacgaggccctgaaccggtggcacaccaagaaggagtaccccctcgacgaggacttcatcctgtggcagcgcaccaacgaggccgacaacaagaacccctaccacgaccggcacatctgcctgcaccgcaagctcaacctgaaggacagccagacggaccggtacaccctgggccgcgccctctaccacctgacccagcggcgcggcttcctgtccaaccggctcgaccagaacgaggaggcggaggagaccgggaaggtcaagagcgccatctccgagctgagcaaggagatgaaggaggccggctgcgagttcctgggggactacttctacctcctgtaccgcacggagggcaaccgggtgcgcatccgctcccggtacaccgaccgcgagaagcactacctgcaggagttcaaggagatctgccgggtgcaggagctcgacgaggacctggccaaggcgctggagaagaccatcttcttccagcgccccctcaagagccagcggcagggggtcggcaagtgcaccatggagaagggccactcccgctgcgccgtgagccaccccctgtacgaggagtaccggctgctctgctacctgaacaacatccgcatcaagacgccctccgacgaccggctgcgcccgctcaacgccgaggagcgggagaagatcacgcccctgttctacaaggagaagaacttcgacttcgagaagatcgccaagaagctggccgggaagacccccttcggctggatccgcgacgcggaggactggccctaccagttcaactaccggatgacccaggaggccccggcctgccccaccaccgcccagctcatcaaggtgttcggggaggactggaaggccgcgctggccgagacctacaccatgagcgccaagcaggacggcacgctgaagaccgaggacgagatctgcaccgacatctggaacgtcctctactccttcagctccaaggagaagctgaaggagttcggcctgaagaagctccagctggacgaggtgcaggccaaggccttcagcgagatccgcctgacccgggacttcgcgagcctctccctgaaggccatccgcaagatcctgttcttcctgcggacgggggaggactacagcaaggccatcttcctcgccaacatccccaccatcgtgggcgaggagatctggaacgacatcgagcgccggtcccgcctgctgtacaaggtcgacctcgccctgcgcccccaggaggagcgggacgcggaggagcaccgcaccatcgccgagcggatcaaggccgccgtggcggccgaggtgccggacgcccccatcgacctgctctaccaccccagcatgatcgaggcctaccccgacgccaagcgcaacgagcggttcgactgctaccagctggggtccccgaagaccaacgcggtccgcaaccccatggccatgcggagcctgcacatggtgcgcaaggtgatcaaccacctcctgcggaagcacatcatcgacgagaagacggagatccacatcgagtacgcccgcgagctgaacgacgccaacaagcggcaggccatcgcggactggcagcgcgagctctccaagcggcacaccgcctacgcccagaacatccgccagctgtacaaggccgagaccggcctggtcatcgagcccaccaaggccgacatcctcaagtaccagctgtgggaggagcagcagcacgtgtgcctgtacacggggaagaagatcggcatcgcggacttcctcggcgccaaccccaagttcgacatcgagcacaccatcccgcggagccgcgggggcgactccacccaggagaacctgaccctgtgcgagagcaagttcaaccgggacatcaagcgcgacaagctccccaccgagctggccaactacgaggagatcctggcccggatcgagcactggaagaagcagtgctacgcgctcaagctgaagcgcgacgggatccggacgcactccggcctggagaagtccatcaaggacagccgcatccgccggcgccacctcgtggggctggagtacggctacctgaagggcaagtacgaccggttcaccatgaaggaggtccccgaggggttcagccgccggcagggcgccgggatcggcctcatctccaagtacgccgggctgttcctcaagagcctgttcaaggaccccaagaacccgaaccgctccaacgtgtacgtcgtgaagggcgccatcaccgccgagttccggaagctgtggggcctgcagcaggcggacgaggccaagagccgcgagaaccacacccaccactgcatcgacgcctacacgatcgcctgcatcgggccctgcgagtacgccgcgctcgccgcctactaccggtccgacgaggagttcaagtacggccgccggcgcgagaagccccagttcgagaagccgtggcccaccttcaccgaggacctgctgaagctccaggaggagctgctgatcgtgcaccagaccacggacaagctcgggaagcgggaccgccggaaggtcaagacgccccgcggcaagttcctgaccggcggggacagcgcccggggccgcctgcaccaggagacctactacggggccatcaactacgacggcaacatcaagtacgtggtgcggaagcccctcgacagcctgaccgagaaggacctggacaagatcgtcgacgagaccgtgatggggatcgtgaagggcgcggtcgaggccaagggctccctcaaggaggccctggccgacgggatctacatgaacaaggagaagggcatcctgatcaagcgcgtgcgcatcttcagcgacgtgtccgagccgatcaacctcaagcagctgcgggacgtcagcaccaaggagtacaagcgccacatccacctccggaaggacgagaactacctgttcgcgatctacgaggggatcgacaagaagaagaacaagaagcagaccgagacggccaccgtggactacctggacgccgccaagttctacaaggactccaagcgccgggacaaggccaacagcctggtgggcgactactccaagaagaacaagctccccctgaagtgcatcctgaagaagcgccagatggtcctcttctacgagcacagccccgaggagatccggttcaaggacaagaaggacctgtcccgccggctgtacatcgtgaccagcatcgcgaaggacgggcgcgtgaagttcctccaccaccaggccgccaccgccacgggcatccagtccagcccctccccgttcaccaacgacggcgagcaccagccctactaccggctgagcgcctccaacatcaaggtcctggtggcggggatcgacttcgacatcaacatcctcggcgagatcacccccaagctgtga

SEQ ID NO: 1739 - RNA, 3711 nt, synthetic construct
  misc_feature 1..3711: note = Cas9 variant
  source 1..3711: mol_type = other RNA
atgtacttctacaagaacaaggagaacaagctgaacaagaaggtggtcctcggcctggacctggggatcgccagcgtgggctggtgcctcaccgacatctcccagaaggaggacaacaagttccccatcatcctgcacggggtgcgcctgttcgagaccgtcgacgacagcgacgacaagctcctgaacgagacgcggcgcaagaagcggggccagcgccggcgcaaccggcgcctgttcacccggaagcgcgacttcatcaagtacctcatcgacaacaacatcatcgagctggagttcgacaagaacccgaagatcctggtgcggaacttcatcgagaagtacatcaaccccttctccaagaacctcgagctgaagtacaagagcgtgaccaacctgcccatcgggttccacaacctccgcaaggccgcgatcaacgagaagtacaagctggacaagtccgagctgatcgtcctcctgtacttctacctgagcctccggggcgccttcttcgacaaccccgaggacaccaagtccaaggagatgaacaagaacgagatcgagatcttcgacaagaacgagagcatcaagaacgccgagttcccgatcgacaagatcatcgagttctacaagatctccggcaagatccgcagcacgatcaacctgaagttcgggcaccaggactacctgaaggagatcaagcaggtcttcgagaagcagaacatcgacttcatgaactacgagaagttcgccatggaggagaagtccttcttcagccggatccgcaactactccgagggccccgggaacgagaagtccttcagcaagtacggcctctacgccaacgagaacgggaaccccgagctgatcatcaacgagaagggccagaagatctacaccaagatcttcaagaccctgtgggagagcaagatcggcaagtgctcctacgacaagaagctctaccgggcgcccaagaacagcttctccgccaaggtgttcgacatcaccaacaagctgacggactggaagcacaagaacgagtacatcagcgagcgcctgaagcggaagatcctcctgagccgcttcctgaacaaggactccaagagcgccgtggagaagatcctcaaggaggagaacatcaagttcgagaacctgtccgagatcgcctacaacaaggacgacaacaagatcaacctgccgatcatcaacgcgtaccacagcctcaccaccatcttcaagaagcacctgatcaacttcgagaactacctgatctccaacgagaacgacctcagcaagctgatgtccttctacaagcagcagagcgagaagctgttcgtgcccaacgagaaggggtcctacgagatcaaccagaacaacaacgtgctccacatcttcgacgccatcagcaacatcctgaacaagttctccaccatccaggaccggatccgcatcctggagggctacttcgagttcagcaacctcaagaaggacgtcaagtccagcgagatctactccgagatcgccaagctgcgcgagttcagcgggacgtccagcctgtccttcggcgcctactacaagttcatccccaacctcatcagcgagggcagcaagaactactccaccatcagctacgaggagaaggccctgcagaaccagaagaacaacttctcccacagcaacctgttcgagaagacctgggtggaggacctgatcgcgtcccccaccgtgaagcggagcctccgccagacgatgaacctgctgaaggagatcttcaagtactccgagaagaacaacctcgagatcgagaagatcgtcgtggaggtgacccggagctccaacaacaagcacgagcgcaagaagatcgaggggatcaacaagtaccggaaggagaagtacgaggagctgaagaaggtctacgacctgccgaacgagaacaccaccctcctgaagaagctgtggctcctgcgccagcagcagggctacgacgcctacagcctgcggaagatcgaggccaacgacgtgatcaacaagccctggaactacgacatcgaccacatcgtgccccgctccatcagcttcgacgactccttcagcaacctcgtcatcgtgaacaagctggacaacgccaagaagtccaacgacctgagcgccaagcagttcatcgagaagatctacgggatcgagaagctcaaggaggcgaaggagaactggggcaactggtacctgcggaacgccaacgggaaggccttcaacgacaagggcaagttcatcaagctgtacacgatcgacaacctcgacgagttcgacaactccgacttcatcaaccgcaacctgagcgacaccagctacatcaccaacgccctggtgaaccacctcaccttctccaacagcaagtacaagtactccgtcgtgagcgtcaacggcaagcagacgtccaacctgcggaaccagatcgccttcgtggggatcaagaacaacaaggagaccgagcgcgagtggaagcggcccgagggcttcaagagcatcaactccaacgacttcctgatccgcgaggaggggaagaacgacgtgaaggacgacgtcctcatcaaggaccggagcttcaacggccaccacgcggaggacgcctacttcatcaccatcatctcccagtacttccgcagcttcaagcggatcgagcgcctgaacgtgaactaccggaaggagacccgcgagctggacgacctcgagaagaacaacatcaagttcaaggagaaggcctccttcgacaacttcctgctgatcaacgccctcgacgagctgaacgagaagctgaaccagatgcgcttcagccggatggtgatcacgaagaagaacacccagctgttcaacgagaccctctactccgggaagtacgacaagggcaagaacaccatcaagaaggtcgagaagctgaacctcctggacaaccgcacggacaagatcaagaagatcgaggagttcttcgacgaggacaagctgaaggagaacgagctcaccaagctgcacatcttcaaccacgacaagaacctgtacgagaccctcaagatcatctggaacgaggtgaagatcgagatcaagaacaagaacctgaacgagaagaactacttcaagtacttcgtgaacaagaagctgcaggagggcaagatcagcttcaacgagtgggtcccgatcctcgacaacgacttcaagatcatccggaagatccgctacatcaagttctccagcgaggagaaggagaccgacgagatcatcttctcccagagcaacttcctgaagatcgaccagcggcagaacttctccttccacaacacgctgtactgggtgcagatctgggtgtacaagaaccagaaggaccagtactgcttcatcagcatcgacgcccgcaacagcaagttcgagaaggacgagatcaagatcaactacgagaagctcaagacccagaaggagaagctgcagatcatcaacgaggagcccatcctgaagatcaacaagggggacctcttcgagaacgaggagaaggagctgttctacatcgtcggccgggacgagaagccccagaagctggagatcaagtacatcctcgggaagaagatcaaggaccagaagcagatccagaagcccgtgaagaagtacttcccgaactggaagaaggtgaacctgacctacatgggcgagatcttcaagaagtga

SEQ ID NO: 1740 - RNA, 3717 nt, synthetic construct
  misc_feature 1..3717: note = Cas9 variant
  source 1..3717: mol_type = other RNA
atgaccaaggtgctgggcctcgacctgggggccgccagcgtcggctgggcgatgatcgaggaggaggagaagtcccacaagatcctggggctcggcagccgcatcatcccctacgaggggaccgagggcaacgacttcgccaagggcacgggggagtcccggaacgccctgcgcaccaaggcccggaccgcccgcaagggctacgaccggtaccagctgcgccggaagtacctcgtggacaccctggtgaagaacgagatgatgccggacgagtacctgcgcaagctccccaagatgcagctgtgggagctgcggagcaaggcggtcacgaccgagatcaccaagcaggagctcgggcgcctgttcctgtggctcaaccagaagcggggctacaagtccagccgctccgacgccaacctggacaagaaggacaccgagtacgtggtggaggtcaagagccggcacgagaagatcaaggagtccgggttcacgatcggccagtacttctacagcgagctgaagtccaacgagtacttccgcgtgaaggagaacatcttcccccgggaggcctacatcgaggagttcgacgccatctgcaagcagcagaagcgccacctcaccgacaagctgatcagccggatccgcaacgagatcatctactaccagcggcccctgaagtcccagaagggcctcgtgagcgtctgccgcttcgaggggttcttcaagaagggcatcaacgggaaggagtacttcgtgggcccgaaggtggcgcccaagtccagccccctgttccagaccgtcaagatctgggagaacatcaactccatccggctgagcgaccgcaacggcaaggagatcatgctctccctggagcagaagaagtgcatcttcaaccacctggacaacaacgagaagctcacccccaaggacctgttcatcatcatcggggtgaagaaggagaactgcttcgtgaacaagcagctggagaagggcatccaggggaacgtcaccaagagcacgatcctcaagtgcttcggcgagaacaacgactacgacaagtggctgaagctggacctcaacatcatcgtgaagaaggacaccttcgggtacctgtacgacaagaagaccggcgagatcatcggcgagaagctgatcaagcacgtggacagcgccgtcgagcgcgagccgctctaccagctgtggcacacgatctactccatcaacaacaccgacgagtgcagcgccgccctgcagaacaagttcgggttcgactccgagaccgccgacaagctcagcaacatcgacttcggcaaggcggggttcggcaacaagtccgccaaggtgatccggaagatcctgccctacctgatggagggggacgactacagccagtccatgagctacgccggcttcaaccactccgacagcctcaccaaggacgagaacctgaagcgcaagctgctcgacaagctgcggcccatcgagaagaactccctgcgccagcccatcgtggagaagatcctcaaccagatggtcaacgtggtgaacgccatcatcgacaagtacggcaagccggacgagatccggatcgagctggcccgcgagctgaagcagaacaaggaggagcggaacaagacggacaaggacatgagcaagcgccagcgggagaacggggagatctccaagcgcctggcggagtacggcctccgggccacccgcaacaacatcatcaagtggcggctgtacgaggagatcgacaaccaggacaagaagctgaacgccatctgcgtctactgcgggcagcccatcagcctcaccgaggccatcaagggcaacgaggtggacgtcgagcacatcatccccaagtccaagctgttcgacgacagccagtccaacaagaccctggcccaccgccggtgcaacagcacgaagggggacatgaccgcgtacgacttcatggagaacaagcccgcccaggtgttcaacgcctacatcgagcgcgtgaacatgctctacgacaacaagatcatccggaaggtcaagcgcgacaagctgctgatgccggagtccaagatccccgacaacttcatcgaccggcagctccgcgagagccagtacatcgccagcaaggcccgcgagatcctgcagaccatctgctacaacgtgtggtccaccagcggcacggtgaccgcgcggctgcgccacctctggggctgggacgacgccaccatgtccctgcagctgcccaagtaccgggagctcgggctgaccgagatggtcgagtgggagagcgagcacggcaagcagaagcactccaaggaggtgatcagcgactggtccaagcgcgacgaccaccggcaccacgccgtggacgccctgacgatcgcgtgcaccaagcaggggttcatccagcgcttcaacaccctcaacagctccaagaccaaggaggacatggagttcgagatcgccaagtgcagcatcgagtaccgggagaacctgtccaagctggagaagtacatcatcgccctccgccccatcccggtcagcgaggtggaggacgccgtggccaacatcctgatctccttcaagagcggcaagaaggtcgcggtgaagggcaagcggaagatcgggaagcgcggcaacaagaagatcatccagacggacatcatcatcccccacgggtccctgagcgaggagtccgtgtacggcaagatcaagaccatcgagcgggagaagcccctcaagtacctgttccagaacagccagctgatcttcaacaacaagatcaagatcctcgtcgaggagcgcctggccaccttcgagaacgacaccaagaaggccctggccagcctcaagaaggtgcccgtgtacctggacgaggagaagaccatcgtcctggagtacgccacgtgcttcaaggaggagtacgtgaagaagtacgacgtggacaccaacttctccaagaccgacaaggtcatcgacgacaagatcaaggagatcctccagcaccggctggggaagttcggcggcaaggcgaaggagaaggaggccttcaaggacgtgcagcagggggacaagaccatcaagtggtacgaggacgagggcctggagcgcccgatccacagcgtgcggtgcttcacggggctctccgccatcgtccccgtgaagaaggacgagaacggcatcgacatcgggttcgtgaagcccggcaacaaccaccacatcgccatctacagcgacaaggacggcaaccgctacgagcacatctgcaccttctggcacgccgtcgagcggaagaagtacgacatccccgtggtgatcaaggactccaacgagatctggaacaagatctggagcaagccggaggggtcctacccccagagcttcctggacaagctgccccaggagaacctcaccctggacctgtccatgcagcagaacgagatgctcatcctgggcatgagctacgaggacatcaagaccgcgatcgacaactccgactacaagcagctgagctccaacctctaccgcctgcagaagctggccaacgccaactacatgttccggcaccacctcgagacgcagatcatcgacgacaacaacagcaaggcctcccgccggttcatcaacatccacagcctgaaggcgctgttcgcctggaacccgtacaaggtcaacatcaactgcctcggggacatccagaccaactcccgctga

SEQ ID NO: 1741 - RNA, 3720 nt, synthetic construct
  misc_feature 1..3720: note = Cas9 variant
  source 1..3720: mol_type = other RNA
atgaccgagaagcgcaagttcgacatccgggaggtgtacctggccatccaccacatcgtcaagtaccgcggcaacttcctcaacagcgccaccgtggactccttcaagacgagcaacatcgacttcacctcccagttcgaccggctgaacgagctgtaccgccaggtgatcctcgaggagcccttccagatcaacatgaaccaggtcgacaagatgaccaacaagctgctggacaacgacgcgctcaagctggacacccagaagcaggtcgccaagctgctcccggtgatctacaacgacaagcccgtggacaagcagtacacgcggctggccaccgagttcagcaaggccatcctggggtacaagaccaagctcgacgtgatcctgaacctggacacccagaacgccaaggactgggcgatccgcctcgacgacgaggacatcgacgacaagctgcccgccctggtggagaacctcgacgagtcccggcaggagatcgtcacgatcatccgcgacctgtacgcccagatcaccctgaacgccatcgtgcccaagggcaagagcctctccgagagcatggtggacaagtacaacgaccacaaggaccacctggacctgctcatggggctgatccacgagctgggcgacgactccgcgaaggggatcaagctccgggaggcctacacccagtacgtcggcaagagcggcgacaagaccctgaaccaggacgacttctacgccgccatcaagaagaacctggacgaggactccaagcgcagcccgaagatccagcggctcatcgagcaggcctccttcatgcccaagcagcgcacgagcgcgaacggggtgatcccccaccagctgcaccagctggagctcgaccggatcatcgagaaccagggccgctactaccccttcctgaaggagccgaactccaacacccacaagcccaacgggggcaagtacaagctggacgagctcgtggccttccggatcccctactacgtcgggcccctgatcaccaagcaggaccaggagaagaccagcggcgccgacttcgcctggatgatccgcaagccgggccagggcggggagatcacgccctggaacttcgaccaggaggtggaccggatggcctccgcgaacaccttcatccgccggatgaccaccaaggacagctacctggtggccgaggacgtcctccccgactccagcctgatctacgagaagttcaaggtgctgaacgagctcaacatgctgaaggtgaacgaccgccggctgagcatctcccagaagcaggacctcttcaacaacctgttcaagaagcagaagacgatccgcaccaagaagctgcagacctacatccgcaccaagtgggagctccccagcgtcatgatctccgggctgagcgacccggacaagttcaactccagcctggccacgtacatcgacttccgggacgtgttcggcgagaaggtggacgaccccaaccgccaggccgactacgagaagatcatcgagtggtccaccgtcttcgaggaccggaagatctaccaggccaagctgaaccagctcgactggctgaccgagagccagtccaaggcgctgctcaccaagcactacacgggctgggggcgcctgagcaagaagctgctcaccggcctgaaggaccagaacggggactccatcctggaccagctctggaagaccaacgacaacttcatgcagatccagagccgggacgagttcgccaagcagatccacgacgagaacgccaagcagttccacgaggccaacaacgtggacgacatcctggacgacgccttcaccagcccccagaacaagaaggcgatccgccaggtcgacaaggtggtgcaggacgtcgtgaaggccgtgggctacgcccccgacaagatcgccatcgagttcacgcggtccccgcaggaccgcccccagcggaccttctcccgccagcggcagctgcagagcacctacctcaacgtcgcgaaggccctgatgaagtccaacctgaaccaggagctcaagagcgtgatcgactcccagcagaccctgacggacaagctgtacctctacttcacccagctggggcaggacatgtacaccggcaaggagatcaacttcgacgagctggtgaactaccagatcgaccacatcctcccccaggccttcatcaaggacgacagcctggacaaccgcgtcctggtgagcgcccccatcaacaacgccaagtccgacaacgtgccggtcaagaagttcggcgcgaagatggggtacttctggaagcagctcgccgagaaccacctgatcagcaagcggaagctgaacaacctcaccaccgaccccgacaagatcggcaagttcacggcccaggggttcatccaccgccagctggtggagacctcccaggtgatccggctggtcgccaacatcctcggcaacgagtacgggcacgacggcaccaccatcatcgaggtgacggccaagatgaaccaccagatgcgcaaggacttcgacctgatcaagatccgggacgtgaacgactaccaccacgcgatggacgcctacctgaccgcctacgtcggcgactacctctacctgcgctaccccaagctgcggagctacttcgtgtacggggacttcaagaagctcaaggaccagtccctgaagatccgcaacttcaacttcctgcacgacctcaccaacgacgaggccggcgacaagatcgtggaccaggagaccggggagatcatctgggacaagcacgagagcgtcaagcagctgaagaaggtgtaccactacaagttcatgctggtgtcccaggaggtctacacgcgccaggacgccctcttcaaccagaccatctaccccgcgagcgacgccgacaagcggaagctgatcccgatcaagaacaacaagcccgtggacgtgtacggcgggtactccggcaacgtcgacgcctacatggccatcgtgcgcatccacggcaagaaggaggacaagtacaaggtggtcggggtgcccatgcgggcggtggccgacctgaagaaggccgagagcaagggccgcgacaactacctcaacgccgtccacgaggtgctgaagccgcagttcaccaagaagaagaaggaccggaagaccggggagatcacggagatgatggacgacttcgacgtgctgctcggcaaggtctactaccgccagctgatcgtggacggcaacaagaagttcatgctggggtccagcacctaccagtacaacgccaagcagctcgtgctgtccgacaaggcgatgcaggtcctgagcaaggacgacaagctcaagaaccaggacgagaaccagaacctgatcgacgtgtacgacgagatcctggagaaggtggaccagtacttcgagctctacgacatcaacaagttccggcagaagctgcacgacggccgcaagaagttcatcgagctgcccgtcgacaacgacttcaacgggaagaagctcatctcctacggcaagcgggccaccatcatcagcatcctgaacgggctgcacgccaacgccaccatgtccaacctcaagtacctgggcatcagcagccccttcggcatgctccaggtgcccaacgggatcatcctgtccccggccagccgcatctgctaccagtcccccacgggcctgttcgagcggaaggtgaagctgagcgacctctga

SEQ ID NO: 1742 - RNA, 3738 nt, synthetic construct
  misc_feature 1..3738: note = Cas9 variant
  source 1..3738: mol_type = other RNA
atgatcatctacttcatcttcgagaagatcgtgaacaccatcctggtcatgaagaagatcgtgggcctcgacctggggaccaacagcatcggctgggccctgatcaacgcctacatcgacgagtacaacaaggagcacctctacgggatcgaggcgtgcggctcccgcatcatccccatggacgccgccatcctggggaacttcgacaagggcaacagcatctcccagacggccgaccggaccagctaccgcggcatccggcgcctgcgggagcgccacctcctgcggcgcgagcggctgcaccgcatcctcgacctgctggggttcctcccgaagcactactccgacagcctgaaccggtacggcaagttcctgaacgacatcgagtgcaagctcccctgggtgaaggacgagaccgggtcctacaagttcatcttccaggagagcttcaaggagatgctggccgacttcaccgagcaccaccccaagctgatcgcgaacaacaagaaggtcccctacgactggacgatctactacctccgcaagaaggccctgacccagaagatctccaaggaggagctggcctggatcctcctgaacttcaaccagaagcggggctactaccagctgcgcggggaggaggaggagaccccgaacaagctcgtggagtactacagcctgaaggtggagaaggtcgaggactccggcgagcggaagggcaaggacacctggtacaacgtgcacctggagaacgggatgatctaccgccggacgagcaacatccccctcgactgggagggcaagaccaaggagttcatcgtgaccaccgacctggaggccgacgggtcccccaagaaggacaaggagggcaacatcaagcgcagcttccgggcgcccaaggacgacgactggacgctgatcaagaagaagaccgaggccgacatcgacaagatcaagatgaccgtcggcgcctacatctacgacaccctcctgcagaagccggaccagaagatccgcgggaagctggtgcggacgatcgagcgcaagtactacaagaacgagctctaccagatcctgaagacccagtccgagttccacgaggagctgcgcgacaagcagctctacatcgcctgcctgaacgagctgtaccccaacaacgagccccggcgcaacagcatctccacccgggacttctgccacctcttcatcgaggacatcatcttctaccagcgccccctcaagagcaagaagtccctgatcgacaactgcccgtacgaggagaaccggtacatcgacaaggagagcggcgagatcaagcacgccagcatcaagtgcatcgcgaagtcccaccccctgtaccaggagttccgcctgtggcagttcatcgtgaacctgcggatctaccgcaaggagaccgacgtcgacgtgacgcaggagctcctgcccaccgaggccgactacgtgaccctgttcgagtggctcaacgagaagaaggagatcgaccagaaggccttcttcaagtacccgcccttcgggttcaagaagaccacgagcaactaccggtggaactacgtcgaggacaagccctacccctgcaacgagacccacgcccagatcatcacccgcctgggcaaggcccacatccccaaggcgttcctgtccaaggagaaggaggagaccctgtggcacatcctctacagcatcgaggacaagcaggagatcgagaaggccctgcactccttcgccaacaagaacaacctgagcgaggagttcatcgagcagttcaagaacttcccgcccttcaagaaggagtacgggtcctacagcgccaaggccatcaagaagctcctgcccctgatgcggatgggcaagtactggtccatcgagaacatcgacaacggcacgcgcatccggatcaacaagatcatcgacggggagtacgacgagaacatccgcgagcgggtgcgccagaaggcgatcaacctcaccgacatcacccacttccgggccctgcccctgtggctcgcctgctacctggtgtacgaccgccacagcgaggtcaaggacatcgtgaagtggaagaccccgaaggacatcgacctgtacctcaagtccttcaagcagcacagcctgcggaaccccatcgtggagcaggtcatcacggagaccctgcgcaccgtgcgcgacatctggcagcaggtcggccacatcgacgagatccacatcgagctcgggcgggagatgaagaaccccgccgacaagcgcgcccggatgtcccagcagatgatcaagaacgagaacaccaacctgcgcatcaaggcgctgctcacggagttcctgaaccccgagttcggcatcgagaacgtgcggccgtacagcccctcccagcaggacctgctccgcatctacgaggagggggtgctgaacagcatcctggagctccccgaggacatcggcatcatcctgggcaagttcaaccagaccgacaccctgaagcggccgacccgctccgagatcctccggtacaagctgtggctggagcagaagtaccgcagcccctacaccggggagatgatccccctctccaagctgttcacgcccgcctacgagatcgagcacatcatcccgcagagccggtacttcgacgacagcctgtccaacaaggtcatctgcgagagcgagatcaacaagctcaaggaccgctccctgggctacgagttcatcaagaaccaccacggggagaaggtggagctggccttcgacaagcccgtggaggtcctcagcgtggaggcctacgagaagctggtgcacgagtcctacagccacaaccggtccaagatgaagaagctgctcatggaggacatccccgaccagttcatcgagcgccagctgaacgacagccggtacatctccaaggtcgtcaagagcctgctctccaacatcgtgcgcgaggagaacgagcaggaggcgatcagcaagaacgtgatcccctgcaccggcgggatcaccgaccggctgaagaaggactggggcatcaacgacgtgtggaacaagatcgtgctgccgcgcttcatccggctcaacgagctgaccgagtccacgcgcttcaccagcatcaacaccaacaacaccatgatcccctccatgcccctggagctccagaagggcttcaacaagaagcggatcgaccaccgccaccacgccatggacgccatcatcatcgcctgcgccaaccgcaacatcgtcaactacctgaacaacgtgagcgcgtccaagaacacgaagatcacccggcgcgacctgcagaccctcctgtgccacaaggacaagaccgacaacaacgggaactacaagtgggtgatcgacaagccctgggagacgttcacccaggacaccctgaccgccctccagaagatcacggtcagcttcaagcagaacctgcgggtgatcaacaagaccaccaaccactaccagcactacgagaacggcaagaagatcgtgagcaaccagtccaagggggacagctgggccatccgcaagtccatgcacaaggagaccgtccacggcgaggtgaacctgcggatgatcaagacggtgagcctcaacgaggccctgaagaagccgcaggccatcgtcgagatggacctgaagaagaagatcctcgcgatgctggagctgggctacgacaccaagcgcatcaagaactacttcgaggagaacaaggacacctggcagtga

SEQ ID NO: 1743 - RNA, 3741 nt, synthetic construct
  misc_feature 1..3741: note = Cas9 variant
  source 1..3741: mol_type = other RNA
atgcgcctggtgtacctcgccctggcccacatgatcaagttccggggccacttcctgtacgagggggacctcaaggcggagaacaccgacgtccaggccctgttcaaggacttcgtggaggagtacgacaagaccatcgaggagagccacctgtccgagatcacggtggacgccctcagcatcctgaccgagaaggtctccaagagctcccgcctggagaacctcatcgcccactaccccaccgagaagaagaacaccctgttcggcaacctgatcgccctcagcctggggctgcaggcgaacttcaagacgaacttccagctctccgaggacgccaagctgcagttcagcaaggacacctacgaggaggacctggagggcctcctgggggaggtgggcgacgagtacgccgacctgttcgtgtccgccaagaacctctacgacgcgatcctgctgagcggcatcctcaccgtcgacgacaactccaccaaggccccgctgagcgcctccatggtgaagcggtacaaggagcacaaggaggagctggccgccttcaagcgcttcatcaaggagaagctccccaagaagtacgaggagatcttcaaggacgacacgaagaacgggtacgcgggctacgtgggggccgacaagaagctgcggaagcgcagcggcaagctggccaccgaggaggagttctacaagtacgtcaaggggatcctcaacaaggtggagggcgccgactacttcctggacaagatcgaccgggaggacttcctgcgcaagcagcggaccttcgacaacggctccatcccccaccagatccacctccaggagatgcacgccatcctgcgccggcagggggagcactaccccttcctgaaggagaaccaggacaagatcgagaagatcctcaccttccgcatcccgtactacgtgggccccctggcgcggaaggggagccgcttcgcctgggccgagtacaaggccgacgagaagatcacgccctggaacttcgacgacatcctggacaaggagaagtccgccgagaagttcatcacccggatgaccctcaacgacctgtacctgcccgaggagaaggtcctcccgaagcacagccccctgtacgagaccttcacggtgtacaacgagctgaccaaggtgaagtacgtcaacgagcagggcgaggcgaagttcttcgacaccaacatgaagcaggagatcttcgaccacgtgttcaaggagaaccgcaaggtgaccaaggacaagctcctgaactacctgaacaaggagttcgaggagttccggatcgtcaacctcacgggcctggacaaggagaacaaggccttcaacgcctccctggggacctaccacgacctgcgcaagatcctcgacaagagcttcctggacgacaaggtgaacgagaagatcatcgaggacatcatccagaccctgaccctcttcgaggaccgggagatgatccgccagcggctgcagaagtacagcgacatcttcacgacccagcagctgaaggagctcgagcgccgccactacaccggctgggggcggctgtcctacaagctgatcaacggcatccgcaacaaggagaacaagaagaccatcctcgactacctgatcgacgacgggtacgccaaccggaacttcatgcagctgatcaacgacgacgccctcagcttcaaggaggagatcgcgcgcgcccagatcatcggcgacgtggacgacatcgccaacgtcgtgcacgacctgcccggctcccccgccatcaagaaggggatcctgcagagcgtgaagatcgtcgacgagctcgtgaaggtcatgggccacaacccgacgaacatcatcatcgagatggcgcgggagaaccagaccaccgacaaggggcgccggaactcccagcagcgcctgaagctgctccaggacagcctgaagaacctggacaaccccgtgaacatcaagaacgtggagaaccagcagctccagaacgaccggctgttcctgtactacatccagaacggcaaggacatgtacaccggggagacgctcgacatcaacaacctgtcccagtacgacatcgaccacatcatcccccaggccttcatcaaggacaacagcctggacaaccgcgtcctcacccggtccgacaagaaccgcggcaagagcgacgacgtgccctccatcgaggtggtccacgagatgaagtccttctggagcaagctgctgagcgtgaagctcatcacccagcggaagttcgacaacctgaccaaggccgagcgcggcgggctgacggagaacgacaaggccggcttcatcaagcggcagctcgtggagacccgccagatcaccaagcacgtcgcccaggtgctggacgcgcggttcaacgccaagcacgacgagaacaagaaggtgatccgcgacgtcaagatcatcaccctgaagtccaacctcgtgagccagttccggaaggacttcaagttctacaaggtgcgcgagatcaacgactaccaccacgcccacgacgcctacctgaacgccgtcatcgggaccgcgctgctcaagaagtacccgaagctggcctccgagttcgtgtacggcgagttcaagaagtacgacgtgcgcaagttcatcgccaagagcgacaaggagatcgggaaggccacggccaagtacttcttctactccaacctgatgaacttcttcaagaaggaggtcaagttcgcggacggcaccgtggtggagcggcccgacatcgagaccagcgaggacggcgagatcgcctggaacaagcagaccgacttcaagatcgtccgcaaggtgctcagctacccccaggtgaacatcgtcaagaagacggaggtgcagacccacgggctggaccggggcaagccccgcgggctgttcaacgccaacccgtcccccaagcccaagcccgacagctccgagaacctcgtgggcatcaagcggaacctggacccgaagaagtacggcgggtacgccggcatcagcaactcctacgcggtcctggtgaaggccatcatcgagaagggggtgaagaagaaggagaccatggtcctcgagttccagggcatcagcatcctggaccgcatcaccttcgagaaggacaagcgggccttcctgctcgggaagggctacaaggacatcaagaagatcatcgagctgcccaagtactccctgttcgagctcaaggacggcagccgccggatgctggcctccatcctgagcacgaacaacaagcgcggggagatccacaagggcaacgagctgttcgtgccccagaagttcaccaccctcctgtaccacgccaagcggatcaacaaccccatcaacaaggaccacatcgagtacgtgaagaagcaccgcgacgacttcaaggagctcctgaactacgtcctggagttcaacgagaagtacgtgggggcgaccaagaacggcgagcggctcaaggaggccgtggccgacttcgactccaagagcaacgaggagatctgcacgtccttcctgggggccgtcaacagcaagaacgccggcctgttcgagctcacctccctgggcagcgcgtccgacttcgagttcctgggggtgaagatcccgcgctaccgggactacacccccagcagcctcctgaaggactccatcctgatccaccagagcatcaccggcctctacgagacgcgcatcgacctgtccaagctgggggaggactga

SEQ ID NO: 1744 - RNA, 3747 nt, synthetic construct
  misc_feature 1..3747: note = Cas9 variant
  source 1..3747: mol_type = other RNA
atgaagaagatcctgggcctcgacctggggagcgcctccatcggctgggccgtgatcaccgagaacgtcgagaacgggatcaccaagtgcgacatcctgggcatggggagccgcatcatcccctacgagggcacggagggcaaggacttcaccaaggggaccggcgagtcccggaacagcctccgcaccaaggcgaagacggcccggaaggggtacgaccgctaccagctgcggcgcaagtacctggtggacaccctcatcaagaaccagatgtacccggacgaggccacccggaacctgcccaagatgaagctgtgggagctccgcgacaaggccgtgcactcccccgtcagcctgatggagctgggccggctcctgctgtggctcaaccagaagcgcgggtacaagtccagccggtccgacgccaacctgggcaagaaggacaccgagtacgtggcgacggtcaagagccgccacgagaagatgaaggagctggacgtgaccatcggccagtacttctaccgggagctctccgccaacgagttcttcaaggtgaaggagaacatcttcccccgcgaggcctacatcgaggagttcgacgccatctgcaagacccagcagatcgcgcacccgatgatcctgcggagcgagctgatcgacaagatccgcaacgaggtgatctactaccagcggcccctcaagtcccagaaggggctggtcagcgtgtgcgagttcgagggcttctggcgcatcgggaaggacggcaaggagtacttcgtgggccccaaggtcgcccccaagtccagcccgctgttccagctcgccaagatgtgggagaacatcaacaacatcaagatcgggtcccggaccggcgaggacctgaagctgacgaccgagcagaagtgggccatcttccagcacctcgacaacaacgagaagctgacccccaccgacctgctcaagatcctgaacctgaagaaggagaactgctacgtgaacaagcagatggggaagggcctcaacgggaacatcacgaagcacgccatcctgcagtgcctgggcggcagcgacaagtacgagaacctcctgaagctggagctcaagatggtggacggggacaaggagggctacctgtacgaccgcaagaccggggaggtcctgaactccaagatgatcaagttcatcgaccccatggtggagcaggagcccttctaccagctctggcacatcatctacagcatccacgaccaggaggagtgcagccgggtgctgcaggcgaagttcgacatcgagcagccgatcgccgacaagctggccgccatcgacttctccaagcacgccttcggcagcaagtccgcgaaggtcatccgcaagatcctcccctacctgatggacggggacggctacagcgaggccatgtcctacgccggctacgaccacagcaactcccagaccaaggaggagaacctgcagcgcaagctcctggacctgctgaagcccatccccaagaacagcctccggcagccgatcgtggagaagatcctgaaccagatggtgaacgtcgtgaacgccatcatcgagaagtacgggaaccccgacgagatccgcgtggagctggcccgggagctcaagcagtccaaggaggagcgcaacgacgcggacaaggccatgagcaagcggcagcgcgagaacgacgccatcaccaagcggctggaggagttcggcctgcgcgccacgcggaacaacatcatcaagtggcgcctctacgaggagatcgacaaccaggagaagaagctgaacgccatgtgcgtctactgcgggcagcccatctccctgaccgaggcgctccggggcaacgacgtggacatcgagcacatcatccccaagagcaagctgttcgacgactcccagagcaacaagaccctggcccaccgccactgcaacaagaacaagaacgacctcaccgcctacgacttcatgaaggggaagccggaggccgtcttcaacgagtacgtggagcgggtgaacctgctgtacgacaaccacatcatccgcaaggcgaagcgggacaagctcctgatgacggagtccaagatccccgacaacttcatcgaccgccagctgcgggagagccagtacatcgccaagaaggcccgcgagatcctccagaccatctgccacgacgtctggtccaccagcggcaccgtgacggccgagctgcggcacctgtggggctgggacgacgtgaccatgaacctccagatggccaagtaccgcgagctggggctgacccaccaggtcgagtgggagtccgagcacggcaagaacaagcacgagaaggaggtgatcaccgactggacgaagcgcgacgaccaccggcaccacgcggtggacgccctcaccatcgcctgcaccaagcaggggttcatccagcgcttcaacaccctgagcgccgccaagacgcgggaggacatgatgttcgacatcgagcagcgcagccacgagttcaaggagaagcggtccctgctcgagaagtacatcatcagcgagcagcccctgaaggtcgacgaggtggagaaggcggtgtccaacatcctgatcagcttcaagtccggcaagaaggtcgccgtgtggggcacccgcaagatcgggaagcggggcagcaagaaggtgatccagaagaagatcatcgtcccccgcgggtccctcagcgaggagtccgtgtacggcaagatcaagaagcaggaggagaaggactacaagtacctgttcgagaacccgcagctgatcttcaaccccaccatcaaggccaaggtggaggagcggctcctgatgttcgacggggacgtcaagaaggccatcaccagcctgaagaagatccccatctacctcgacaacaacaagaccgtggtgctggagaaggccatctgcctgaaggacgagttcgtcatcaagtactccgtggacatcaacttcaacaaggtggacaaggtcgtggaccccaagatcaaggagatcctccagaaccgcctgaagaagttcggcggcaaggagaaggaggcgttcaaggacgtgcagctggaggacaagatgatcatcaagtggtacgaggacgaggggctcgagcggccgatcaagagcgtccgctgcttcacgggcctgtccgccgtggtgcccgtcaagaaggacgagaacgggaacgacatcggcttcgtgaagcccgggaacaaccaccacatcgccatctacaccgacaccgaggagaacaagcagcagcacgtgtgcaccttctggcacgccgtcgagcggaagaagtacgacatcccggtgatcatcaagaacacgaacgaggtgtgggacaagatccagagccagcccgacggcacctaccccgactccttcctggagatgctgcccccgcccaacctcaacctgctcgtcaacatgcagcagaacgagatgttcatcctgggcaccaccacggaggacatcaagctggcgatcgacaagcgcgactacaagatcatcggggacaagctctaccggctgcagaagatgagcatcaagccctccagcggccagatcgacatcgtgttccgccaccacctggagacccagctcatcgacgacgagaacagcaagaagtccaagcggttctacaacgtgcagagcctgggggccctgttcgccctcaaccccttcaaggtccgcatcgacaacctgggcaacctggtgaaggagaagtga

SEQ ID NO: 1745 - RNA, 3762 nt, synthetic construct
  misc_feature 1..3762: note = Cas9 variant
  source 1..3762: mol_type = other RNA
atgaaggcccgcggcaacttcctgcaccaggacacccccgggctcaccgccgcgaacgccaacatgggcgacgccgtggagaagctgtgcgtcgccctggaggactggtgcacgctccggaacctggagtgcaacatccgcaagaaccagaagaacatccagaacctgctcgaggggaagaccgtggaggtgagcgccgagaacgcgctgaaggagtccttcgacagctcccgggccagccgcaaggacaaggccaccatcctgtccacctggatcgccatccagccgggcgagtacctcgacgcgaagcaggccaaggacgccagcaaggagatcgccaacgtcctgttcgggctgcagggcaacatgaagaagatcttcatcgagttcgaggaggaccagaagatccggctcgacaacgacgagcaggtcgaggccttctactccctgtgccccgacgacggcgtggcgctgttcgagagcttccagtccatctacagcgcctacatcctcatggggatcctgaagaacgccaacggcgggtccatcagctcctgcaaggtggccgcctacgaccagtacaaggaggacctgaagctcctgaaggacctggtgcgcgagttcgcgagcgagaagtacgacgagttcttccggggcgacatcttcgactccagcaaggggttccgcgcccggaactacaaccccgccacggccaagggctacaccaagtacaactccgtgcgcggcgccagctacgacgacttcaagaaggaggtcgagaagatcttcaaggggaccgtggcggaggaggacatccggtacgtggacatgatgcagcgcttcgccgagggcaccttcctccggcgcctgaagacgtccgacaacgggagcatcccctaccagctgcacctcgaggagatggacgccatcgtcgagaaccagaagcagttctacccgttcctggagagcgagaaggagaagctggagtccctcgtgaccttccggatcagctactacgtgggccccctgacccagaagaacgcccgcctggacaaccacaacaacgcccggttcgcgtggtcccagcgcaaggagggcaaggagcacgcccgggtctacccctggaactgggaggaggtgatcgaccgcaagcagagcgccgccaagttcatggagcggctcaccgggacgtgcacctacatcctggacgagcccgtgctgccgcgctgctccctcctgtacgaggagtactgcctgctcaacgagctgaacggcagcaagtggcgcgacatgggcggggactggcaccggttcgactacgagacccgcatggagatcatcgagaacctgttcaagaagaagaaggggtccgtcaagtacgcggccgtggaggactggctcaagtgcgagaagcacaagagctgcgccgaggtgaagggcggccagggggagaccggcttcgagtccaagctgagctcctacgtcttcttcaaggaggtgctgcacgtggacgagatcgacgaggccgacatccccatgatcgaggagctcatctggtggaacacgctgttcgaggaccggagcatcctgaaggagtccatcgaggacaagtacggggaccgcctcaccgacgaccagatcaaggccatctgcaagaagcggttcaccggctgggggcgcctgagcaaggagctgctctgcggcatcaagacccacacggacaacggcccctactccatcatggacgtcctgcgggaggggaaccccaacaacaacgcgcgcagcgagaccatggtgttcatggagatcctgcgggacgacaagttcggcttcgacaagctgatcgaggaggagaacatgcgccgggtctccgaggtggacaacttcgacgtgaacgacctcccggggagccccgccgtccgccggaccgtgaaccaggccaagcgcatcgtggacgagatcgtcggcatcgccgggtgcgagccccagaacatcttcatcgaggtgacccgggacgaggacggccgcaacaagggccggcgcacgaagcggcgctacgacaacatcaagaacgccatcgcggccctgaagaaggagcagaaggagtacttcaacaaggacgtgtccgacagcctgaacaagaccaaccccagcgacctcgacaacgagcgcctggccctgtacttcatgcagaacgggaagtgcatgtactgcggcaaggacctcgacatcaagcagctggacaagtaccaggtcgaccacatcctgccgcagtcctacgtgaaggacgacagcttcgagaacaaggccctcgtgcacatggaggacaaccagcggaagtccgccagcatgctgctggacgactccatcatccgcaagatgaagccctactgggaggcgctccgggccgccgggctgatcggcgagaagaagttcaagaacctgacccgcgtccgggtgagcgacaaggagctcggcgggttcatcgcccgccagatggtggagacctcccagagcatgaagctgacgtccctggtcctcgagaagacctaccccaacaccaacgtgcggcccgtgaaggcgggcttcagctccgacctgcgcaagcggctggacctcatcaagtgccgcgagatcaacgactaccaccacgcccacgacgcctacctggcctgcgagatcgggcagttcatcaccatgcggcacaacaagctgtacgagaacccgatcagctactcccacgccgtcaaggacttcatcgcgaagcgcgccaagtacgccaacgaccacggcacgcccatgagcacctacgggatgcccggctccagctccttcgtgatcagcagcttcctcacctccggcttcgacgaggagaccggggagatcttcaaggacgcctggagcgccgaggtggcggccgtccggatccgcgagtccctgaaccggaaggactgctacatcagccgcatgcccgaggagacgtccggcgccttctggaaggagaccctgatcagcccgcgggacccctccctcgggaagaacctgagcctgcccatcaagaagggcctcgacccccgcaagtacgggggctacaacgagcagaagttcgcctacttcttcgtgtacgaggccgtgaagatcaagaagaagggcgaggtcaaggagtacgtgttcgcggccgtgccggtccaggtggccgccatcgtggcgcgggaccccaacgccctgaccgggttcgccaagaaggacgccgaggcccgcaagatcaagttcctgcggatcatccgcgagaaggtctacaagtaccagctcatcgaggtgaacggcgagcgcctgtacatcaccgggctgaagtccgtgcggaacgcgcgccagatcgccctcagccaggacatgaccacggtcttcctgaaggccatcaacgacaaggacgtggccgaggacgagctgaagtccctcttcgaggagatcgtgcagcggtaccgcctgtgcgccaaccggctgggcaaccagctcaagatcttcagcctgtccgacagcttcaactccgcgaacagcgagtccaagaagcgcgccctggtcagcctcgtggccatcatcgacgccaagaccaacaagatcgacctgtccgggatcggcagcggcaaggccgtggggaacatgcggctgagcttctccaaggagatgagcaactccaagaaccacttcgcgttcatcgaccagagcgtcaccggcatgttcgagcgcaagacctacctctga

SEQ ID NO: 1746 - RNA, 3777 nt, synthetic construct
  misc_feature 1..3777: note = Cas9 variant
  source 1..3777: mol_type = other RNA
atgaccgaggagaaccccgacatccgcaaggtgttcctggccatccaccacatcctcaagaaccggggccacttcctgctgcaggggcagagcttcaaggagggcaacctcaacaacctgatcaaggagctgctcaacctggacatcctgcacatctccatcgagatcaccgaggagaacatcaacaagatcacggagatcgccctcgagaagaagaccctgaccgacaaggtcaacgacctgaagaagatctacccgaaggagaagcagctcctggaggcgttccgcctgatcttcgggggcaagaccagcctcgacaagctgttcgccatcgacgagtacaaggagctggacgcctccgtcaagagcgtgtccttcaaggagaagatctacgaggaggtgcggcacgactacgagcaggtcctcagcaactacatcgagctgctggacctcgccaagctggtgtacgactccatcatcctgagcgacatcaagaaggaggggaagacgctctccgagagcaaggtggagctgtaccacaagcaccgcgaggacctgaccaagctcaagaccctggtgaagaacgactccaagctgagcgaggacaagaaggtggagctctactccgccatcttcaaggaggacaaggacaagggcaccaactacgtcaactacatccgcaagagcgaggagggcaaggggtgcaactacgaggacttcaagaagttcctggtgaaggagctggcgaagctcgaggagtccagcgccaaggaggagatcctgcgggacctggagctcgagctgttcctgcccctccagcggacgaaggacaactccgtggtcccctaccagatccacaaggaggagctggtgaagatcctggacaacgccgccaagtaccacaagttcctcaacgagaaggacgacagcggctactccatcatcgagaaggtgatccagctgctggagttccgcatcccctactacgtcgggccgctcaacagcagcaagaaggcgaaggtggacggcttcgcctggtccgtgcggaacaaggggtacgagaacacccccgtcaccccctggaactacgagaaggtgatcgacgagagcgcctccgccgagaagttcatcaccaacctgacgaacaagtgcacctacctgaagggcgaggacgtgctccccaagagctccctgctgtacagcgagttcgccctgctcaacgagctgaacgcgctgaagtacgacggcaaccgcatctccctcgaggcccggaacgtcatcatcgagaagctgttcaaggagcaggggaagaaggtgaccaagaccagcatcaagaacctgctcaaggccgagggctacatcgacgggaagggcgagatcacgggcatcgacatcaccgtgaagaacgacctgaagtcctaccgcgacttcaagaagatcctgggggacaagttcaacaccgagcacgtcgagaacatcatcctctggatcaccctgtacggcgagagccggaagctgatcaaggccaagatcgaggccgtgtacggggacatctactccaaggaggagatcgcgaagatgagccgcctcgtctacaaggactggggccggttctcccgcaagctgctgacggagctcgtgagcaagaagctgtacaacgaggagaccggggagtgcctgaacatcatcggcgccatgcggcagaacaacatcctcttcatggagctgctggccgaccgcttcgactactcccagcagatcatcgactacaacaaggagctccagaaggaggtgaccgagatcaccccggagatcctggacgacctgtacgtcagcccctccgtgaagcggagcatctggcagacggtgcgcatcgtcgaggagctcaagaagatcatcggctgcgcccccgccaagatcttcgtggagaccacccggtccaaccaggacaagaagaagcccaccgacagccgcaagaagcagctggagctgttctacaaggcggtgaagaaggacgtcaaggacctcgagaaggagatcgggagcctgaacttcgacaagctgaacgagcgcctctccagcgtggagccgtccaagctgaaggccaagaagctgtacctctactacacgcagctgggccggtgcatgtacagcggggagaccatcgacatcacccagctgaacaccacggcctacgacatcgaccacatctacccccagtccaaggtgaaggacgacagcttcaccaacaccgtcctcgtgaagcgcgagtacaacgccgccaagaccgaccggtaccccctgggctccgacatccagacgcccagcaaccgccggttctggaagttcctgaaggagaaggggctcatcaccgacgagaagtacaaccgcctggtgcggaccgaggagttctccgacgaggagctgaccggcttcatcgcgcgccagctcgtcgagaccagccagtccgtgaaggccgtggccggcatcctgggggagctgaacccgaagacgagcatctgctactccaaggccgagaacgtcagctccttccggcagaacttcggcaagatcaaggaggggaaccgcaagagcgacaacaccgagcagctcatcaaggtgcgggagatcaacgactaccaccacgcgaaggacgcctacctgaacgtggtcgtgggcaacgtgtacgacaccaagttcacccgcaacgtcttcaacttcatcaaggacaagaaggacgggcggaagtactccctgaacaacgtgttctacgagaacgtgagcaacagcaacaacgtcgcctgggagctcaacaagacggtgcaccaggtggagaaggtcatgaacaacaacaacatcctggtgacccgccggacctccgagcagaagggcggcctgttcgacgccaccgtgtacaaggccaaggtcgcggccaaggccaaggagggggtgtactaccccctcaagacgagcgaccccgtggtcaacgacgtgaccaagtacggcgggttcaccaaggtgaagatcgcctactactccatcttcgagtacaccctggtcaacaagaagggcgaggagaagatcacgcgcatcatccccatcccgatctacgtgagccagaacatcaaggacgactccaccctgctcgagttcggcaagacccagatcaacatcaagagcggggaggaggtgaaggacttcaagctgaagtaccggaagctgtgcatcggcgacctcgtcaagatcaacaacttcttcaacttcatcgggggcaagaccaacgactccttcgtgtacgacggggccgtgcaggtcacgctggacaccgagagcgagcgctacatcaagaccctgtccaagtaccagaactggaagaaggagaacaaggacggcgagctctgggagagcatcaccaaggagaagaacacggagctgtacaacctgctcgtggagaagatgaactccggcatcttcatcaagaagaagcccaacaagttcaacgagctgaacagcgaggagatccggaacaacttctccagcatctccctggaggagcaggcgaaggtgctcctggaggtcctgaacctcctgaccaacaagaagtccatcttcgacctcaagagcatcaacatcaccgccgcccgcgggaagatcagcttcaacctgtccaacctgagccagttcagcatcatcgagcagtccgtggccggcttctacgagaaggagatcaccatcatcggggacaaggagaacgacatggagaacaacaactgctga

SEQ ID NO: 1747 - RNA, 3780 nt, synthetic construct
  misc_feature 1..3780: note = Cas9 variant
  source 1..3780: mol_type = other RNA
atgaagtacatcctgggcctcgacctgggggtggccagcatcggctgggccgtcaccgagatcaacgagaagggggagcccgtgggcctgatcgacgcgaactccgtgatcttcaagccgctcgacaacgacaaggggaagctgtacaacgtcgagcgccgggacaagcgcggcagccggcgcatcctgcggcgcaagaagcaccgggtggagcgcaccaagatgctcctggtgaactccagcttcctgacgaacgaggagatcgacaacctctacgtcggcaagctggacaacatctacgaggtgcggctgaaggggctcaaggagcagctgtccaagaacgagatcgcccgcctgatgatctactactgcaagaaccggggcttcaagagcaaccgcaagaccgaggacctcgagatcctgaagtccctgggggagaagatcagcgagaaggactccgacgagaagaagctcaagcccatcatcgccaagaacaccgagctgatcgagagcaagggcctgacccccatcgaggtgatctacatgatccgggagaacgacaactccatcctcgggttcaagaacaaggagggcaactacaagttcggcttcaagcgcaaccaggtcatcgacgaggtgcggaagatcctggggacgcagcagatcctgagcaaggagatcgtggacgagtacatcgacatcctctccagccagcgcgacttctccgacggccccgggggcgacagcaagtacaagatcgactacaccaagctggccggcaagtgcaagtacaccggggaggtccgggccgtgaagtccgcgccgagctacgagatcttcaccatgctgcagaagctcaacgacatccgctacgtgaagttcacgtccgaggacaagatcgagaagaagaagctgagcaaggaggtcatccacaagctgtacgacctcgtggtggagaagaacaagaccctgacctacgacctgatcgagaagtccatcgacgaggagaacatcaagctcctgaacatccccaagctgagcaagagcaagtacgtcgagctccggaagtcctacttcaaggagcgcaacgacaacgagaacctgaccgaggaggagatcaacgccttcaacgagaagctgaacaacgagcggatgaagcaggagctcatccgcaacaacctgaaggcctacaaggagctcaagagcaagttcaagaagaacaacatcgacgagaaccgcatcaaggagctgggcgggatctacttcctggacctggtggccgagctcctgacgtactccaagaccgacgagaagctggagtacttcgtggagaacgtcgagcggtacagcctcttcaaggagcagcgcgacatcgtggagatcatcaagaccttccccaactacaccaagaacggcaacctgtccctgagcctggtgcgggagctcaacaagctgctgatggaggggcacgactacgagtccagcctctccagcctgaactactacatcgacacggacgtcgactgggagaagttccccaccatctccgagatcgaggacagcctgtccaccaagatcaccaacccgaacgtgaagcacatcctcgtcatcctgcgcaagctgtacaacacgctcctgttcaagtacggccggcccgagaaggtgcacctggagctcagccgcgacttctccaacgacttcagcacccggaacaagatccagaaggagcagctggagaacaaggtgcgccgggaggtcgcggccttcgagatgtacggcgccaacaaggacatcgtggccgggaaggaccgcctgtccaacgacgacttcgtgcggatcaagctctgggaggagcagaacaaggtctgcatgtacagcggccgcaccatcgagaagtaccagctgaccagcgccgaggtgcagatcgaccacatcctgccctactccaagagcttcgacaactcctacagcaacaaggtgctcgtcttctccaacgagaaccaggacaagaaggagcggacgccctaccagtggctgaaggggaccgagaagtggaacgagttcaagcagcgcgtgcggctgaacctcaacatcagcaacaagaagaaggagaacctgctgttcgaggacgaggtggtcaacaacgagttcctcgagcgcgagctgcacgcgacctcctacagctcccggctggccctcaacatcttccagcgcctgatcccggtgagcgacgaggacaagtacgacgagcacggcaacgagaaggtgaagtacctgtacaaccggaacgtcatcgccttccaggggaagatgacctccatgctccgcaacctgtacagcctgaacaagtacacgcactccttcgagagcgacaccctcgacatcgacaacaaggccttcatcctgaaggagttcgagatcaacaaggacaacctgaagatgaccgcctacaacgtgaacaccggcctcgagatcacgtccgagaccaaggtggagaagaacaagagcggcgagttcaagaccatcaaggacgagctgctgaagaaggagctcgacaagaaggagaacctgatcgagatctccgactacttcaaggacaaggtcctgttcgacctcaagatcgtggacttcgaggagatcgacaccgtggagcccgagatcatcagcatcctgtacaagatgatcacggcgctgaaggaggaggtctacagcaagaaccgcgagaaccacctccaccactccctggacgccttcctgctcaccatcatgaaccggagcatgcagatgaagctgatcaagtacaaccagctgatctccgtgctcaagaacaaggagatcgagatcttcaacgaggagaagggggagtacatcgacagcaaggagttcgccgaggagctgcagaagcagaagatcatcgacatcgacggcaacgagcgcgggatcaagttcaacgtgaacggcaagacccaccggctgaacctcgtcaagccctacgagaacttcctggacgacatcaagaacaagatcttcgacaagcgcgagaacaacaagctgccctaccacgtggtgaagtccaaggtcagcggggccctccacgccgagaccatcctgggcgagtccaagggcgagatcaccaagcggatcagcgtgttcgacatcaactacaagaacctggggaagatcttcgacaaggacggctcccagaaggagatctacgagacgctcgtgaagtggctggaggccaagagcaaggactacccgaagctgaagaacgggaacatcatcaagaaggtcaagatcgtggacggcaacaaggacaagctcatcaagctgggcaacaagcgctacgtggagatggggcggaccaccgtcaagatcctggtgctcaagaaggaggcggaggagggcctgaagttcgcctccatcgggcgctacaagtacaacctgctcaagagcgagaaggacgtgaacatctccatctggaaggacgccatccacttctgcaaggtccggtacaacaagctgaaggagaacggctaccgcctgatccacgagctcatccccggggagaccatcgagctggagctgaacaagggcaacatcagcaagtgcctcgtggtgggcttctccgggggcaagatcgagatcagctccgtcatcggggacgccctggacctgatcaacgacaagatcagcacgcggatcaaggagcgctactacatcaccgtgtccaccatcaagagcatcaagaagatcaacaagaacatcctcggcgactga

SEQ ID NO: 1748 - RNA, 3792 nt, synthetic construct
  misc_feature 1..3792: note = Cas9 variant
  source 1..3792: mol_type = other RNA
atgcacaagaacaaccccgacatccgcgagctgttcctcgccatccaccacatcctgaagtaccggggccacttcctgttcgccgggcagcagttcaagggcagcgagatcaaggacaacatccgcgagctcctgcagtacaactccctgaacatcaagatcgacatcaccgacgagctcatcaacaacatcgcggagatcctgctgaagaagaagaacagcaccgacaagatcatcgagttcaagaagctgttcgccgacgagaagcagctgatcgaggccctgcggctcgccctggggaacaagacgcagctggccaagctgttcgacatcgaggcgtacaaggagctggacatctccatcaagaccatcagcttcaaggagaagatctacgaggacgtgcgctccaactacgaggagatcctgggcgagtacatcatcgtcctcgacaccgccaagctgatctacgacgccatcatcctgagcgagatcaagatcaagaacatgaccatctccgagagcaaggtgatctcctacgagaagcacgggaaggacctcaagcagctgaagcagctgatcaaggaggacagcaagctctccaagaaggagaagcggcagctgttcgagaacatcttcgtgaaggaggacgagaaggaggccaactacgtcaactacatcggcaagaacaacgtgggcagctccaagagctcctgcagctacgaggacttcaagaagtccctgatcaaggagctcaagtactgcgaggagagcaagctgaagcaggacatcctggcggagctcgagctggagacgttcctgccgcgccagcggaccaaggacaactccgtgatcccctaccagatccacaaggaggagctcgagaagatcctgaacaacgccgtccagtaccaccccttcctgaacaacaccgacgagtacgggatcagcatcaaggagaagatcatccagctcctggagttccgcatcccctactacgtgggcagcctgaacacctcccacaaggtggggaacggcgggttcagctggtccgtccggaacaagggctacgagcgcacggccgtgaccccgtggaacttcaacaaggtgatcaacaaggaggagagcgccaagaacttcatcgagaacctcaccaaccagtgcacctacctgctgtacgaggacgtcctccccaagcactccctgctgtacagcgagttcacgctcctgaacgagctgaactccatcaactacggcgggaagcggctcaccgtggagcaccgcaacctgatcatcgagcggttcttcaagcagagcgcccccaaggcgaccggcaaggagctgaagaagttcctgatgtccgagggggtgatcgacggcaaggacgagctcagcggcttcgacatctccatcaagaacgacctcaagagctaccgcgacttcaagaagatcctgggggagaagttcgactccgagaaggtcgagaagatgatccggtggatcaccctcttcggcgagagcaagcagctgctggtggacaagatcacgaaggagtacggggacatctactccagcgaggagatcaagaagatctccggcctcacctacaaggactgggggcgcctgagcgagaagctgctcaccgagatcgtgtccagccagctgtacgacgagagcaccggcgagtgcttcaacatcatcaacgccatgcggaacaacacgctcctcttcatcgagctgctgggcaccaactacgactacttcgagaagatcaacacctacaacgggaagctccgcaaggagatcaccgagatcacgccccacatcctggacgacctgtacgtctccccggccgtgaagcggagcatctggcaggtcgtgcgcatcgtggaggagctcaagaaggtgatcggctccgagcccaagcggatcttcgtcgagaccacccgcagcaacaaggagaagaagggggacgacggccgcaaggactcccggaagaaggccctgctggagctctacaagaagatcaagaccagcgacatcgccgagctggagaaggcgctggggcacacggtggacttcgacaagaagaagcaggacctcaccgacatcgacaacaacaagctgaaggcccgcaagctgtacctctactacacccagctgggccggtgcctgtacaccggcaaggccatcgacctcaacaacctgttcgggtccaacagcgagtacgacatcgaccacatctacccccagtccaagacgaaggacggcagctggaacaacctggtcctcgtgaacaagaccgagaactccaagaagtccaacgggctgatcagcgagagcatccagcgcaagaacaagcacttctggcggttcctgaaggccaagaacctcatctccgaggagaagtacaagcgcctgacccggaccgaggacttcacggacggcgagctgagcgggttcatcgcccgccagctcatcgagacctcccagagcgtgaaggtcgtgagcaagatcctgcagaacctgaaccccaccaccgagctctgcttctccaaggcggagaacgtgagcgacttccggcaggagttcggcaagatcaaggtcggcaagcgcaagaacctgaccgaggaggagcagaagaaggccaaggaggggcagctgatcaaggtgcgggacctcaacgacctgcaccacgccaaggacgcctacctgaacatcgtggtcggcaacgtgtaccacatcaagttcacgcgcaacccgaagaacttcatccggaagaacttcaagaaccgcgagtacaccctcaacaccctgttctactccgacaaggtggagcggaacggggaggtcgcctgggagaagggcaagaccgaggagatcgtgagctccgtgatgtgcaacaacctgatcaacgtcacgcgccggaccagcgagcagaagggcgcgctctacgaggccaccatctacaaggccaacgccgcgaaggaggggtcctactaccccgtgaagaccaacaacaagaacctgaagaacgtgacgcgctacggcgggttcaccagcatcaagatcgcctactactccatcttcaagtacgacatccggaacaaggacaaggtcaaggagaacatcaagatcatccccatccccatctacatcagccagaacatcaagaccgacctggacctcatcaacttcgccgagaagcagatcaagctgaagaagggcgagaacatcgagaacctgcagctcatctacaagaagctgaacatcggggccctggtgaagatcgaccactacccgtactacatcggcggcaagaccgacgacaacttctacgtggacggggccgtccaggtgctcctgtccagcgacatcgagcgctacctgaaggaggtggtcaagttcgtgaacttccagcgcgagaacaaggaggcgaaggtgtccaaggagcacatcagcctcgaggagaacatcaagctgtacaacacgctggtctgcaagatggccaccaagatcttcacccacaagaagaacaacaagtacaacgacctcacccaggacaaggccaagaacacgttcaacaagctgtccctggaggagcagtgcaaggtgctcctggagatcctgaacctcctgaccaacaagaagaccaccttcgacctgagcctcatcaacgagaagacgtcccgggtgaagtgcggcttcaacctgctgaaccagaagcagttcagcatcatcgagcagtccgtcaccgggctctacgagaaggagatcaagatcatcgaggactga

SEQ ID NO: 1749 - RNA, 3795 nt, synthetic construct
  misc_feature 1..3795: note = Cas9 variant
  source 1..3795: mol_type = other RNA
atgaagaacgtgctgggcctcgacctggggaccaacagcatcggctgggccctgatcgaggtcgacgagaacaacctccccatccgcatcatcgccatggggtcccggatcatcccgctgagcacctccgacaaggaggagttccagcgcggcctgagcatcacgaagaaccagtcccggaccgtgagccgcacccagcggaaggggtacgaccgcaagcagctcaagaagtccgacctgaagaagatcctgaacaagtacaacatcttccccagcgaggagctcctgcggctgcccatgctcgacctgtggaagctgcgctccgacagcgcgaaccccgacgagaacatctccgccgagcagctcggccggatcctgtacatgctgaaccagaagcgcggctacaagagcgcccggtccgaggccaacgccgacaagaaggacagcgactacgtgcaggcggtcaaggggcgctacgaccagctcaaggaccggaagcagaccatcggccagtacttctacgacgagctgtacaacgccaacgccaacaactcctacttccgcatcaaggaggaggtgtacccgcgggaggcctacatcgaggagttcgacacgatcatcagcgcgcagcgcgagaagcacgacttcctgaccgacgaggtggtccaccagctccggaacgagatcatctacttccagcgcaagctgaagtcccagaaggggctggtgagcatctgcgagttcgagggcttcgagaagaccgtgttcgacaaggagaagaacaagaacaaggtcgtgttcgtggggcccaaggtcgcccccaagaccagccccctcttccagctgtgccggatctgggaggtggtgaacacgatcaccctgaagatcaagaacccggagggctccaagtacaagtggggcgagaagatccccgacatcaaggagaaggagatcctcgccgactacctgttcaagaacgagagcctgtccttcagcaagctcctggagatcctggagctcaagaaggagaacgtctacgtgaacaagcagatcctgaaggggatcaagggcaacgagacctactccgccctgcacagcatcctcggggacaacgagctgctgaacttcgacgtgtccatcatgaccagcaaccagacggccctcctggtcgaccgcaagaccggcgagatcctggaggagcgggcgggcctcgagctggacgcctccctggagaaggagcccctctaccagctgtggcacaccatctacagcctgaaggacctcgacgagtgcaagaacgccctgatcaagcgcttcgacttcgacgacgagaccgccgagaagctgtcccgcatcgacttcaacaagcaggccttcgggaacaagagcaacaagtccatgcggaagatcctgcccttcctcatggagggctacgactacagccagtccagctccctggcggggtacaaccacagcaactccctgacgaagaacgagcgcgagcagcagatcaccctcgaccggctggagctgctcccgaagaacagcctgcgccagcccatcgtggagaagatcctgaaccagatgatcaacgtggtcaacgccatcctcgacgagtacggcaagccctccgagatccgggtggagctggcccgcgagctgaagcagagcaaggacgagcggaacgagaccgacctccagaacagcaagaacaagaagctgaacgacgagatcgggaagcgcctggaggagctcggcctgcccgtgaccaagcggtacatccagaagtacaagttcatcttcccgtccctgagcaagaacctcaaggaggccaaggtcaacaaccagtgcatctactgcggcgagacgttcaacctgaccgaggccctgtccggggacgcgtacgacgtggaccacatcgtccccaaggccctcctgttcgacgacagccagaccaacaaggtgctggtgcaccgcaagtgcaactccaccaagacgaaccagaccgcctacgactacatcgccaccaagggcgacgagcacctcaagctgtacagcgagcggctggacgactggttcgagcgcgggatcatctcctacagcaagatgcagcggctcaaggtctcccacaaggagtacctggagcgcaagaagctgggcaaggagaccgagacggacaagaagctctgggagaacttcatcgaccggcagctgcgcgacacccagtacatcagccggaagtcccgcgagatcctgcagaagatctgcaacgacgtgaagaccaccgagggcggggtgacggccaagctccggaacctgtggggctgggacgacgtcctgatgaacctccagatgcccaagtacaaggagctggggcagaccatcaccaaggagtggaccagcgagcacggcaagcgcaagcaccagaaggaggagatcgacaactggacgaagcgcgacgaccaccggcaccacgcgatcgacgccctggtgatcgcctgcaccaagcaggggttcatccagcgcatcaacaccctcaactccagcgacaccaaggacctgatgatcaaggaggtggaggaggccaagatcgagttcaacgagaagaccacgctgctcgagaagtacctgaagacccagaagcccttctccacccaggaggtcatgaaggaggcggacaagatcctggtgagcttcaaggccggcaagaaggtggccaccatcacgaagttcaaggccaccgggaagaacaaggagaccggcgtcatcgtgccgcggggcgccctccacgagcagtccgtgtacgggaagatcaaggtcatcgagaaggacaagcccctgaagtacctgctcgagaacagcgacaagatcgtgaacccccgcatcaagaacctgatcgagatcaagctgagcgagaacaagaacgaccccaagaaggcgctcctggccctgaagaagatcccgatcttcctcgacgaggagcagtccatcaccctggagaaggccagctgctacaacgacgccacggtgctgaagtacaagctccagaacctgaaggccgcgcaggtcgacgacatcgtggacgagaaggtgaagaagatcgtccgggagcgcctgtcccagttcggcaacaaggagaaggaggccttcaaggacaccctctggttcaacgaggagaagaagatccccatcatcaccgtgcggctgttcgcccgccccgacgccaacaacctgcagaccatcaagaaggacgagaacgggaacggcatcggcttcgtggtcacggggaacaaccaccacatcgccatctacgaggacaaggacaacaagcccgtgcagcacagctgcaccttctggcacgcggtggagcggaagaagtacaacatcccggccgtcatccgcgactccagcgaggtgtggaacgacctcctgcggaaggagctgcccgagtccttcctcaacaagctgcccgccgacaacctgaacctcaagttcagcatgcagcagaacgagatgttcatcctgggcctgtcccaggacgagttcgtgaaggccatcgcgaacaacgacaagagcctcctgtccaagcacctgtacctcgtctggagcatctccgagaacaactactggttccgccaccacctggagaccaagaacagcgacctgaagaagaccgacggggtgaaggagtccaagcggctctacaacatccgcagcctgggctccctgttcagcctcaacccgatcaaggtgcggctgaactacctgggggagatcacgaagatcggcgagtga

SEQ ID NO: 1750 - RNA, 3801 nt, synthetic construct
  misc_feature 1..3801: note = Cas9 variant
  source 1..3801: mol_type = other RNA
atggccaagtacatcctgggcctcgacctggggaccaacagcatcggctgggccctgatcgaggtggacgagaacaacatccccatccgcatcatcgtcatggggtcccggatcatcccgctcagctccaacgaccgcgaggagttccagcggggcctgagcatcaccaagaaccagaaccgcacgatctcccggacccagcgcaaggggtacgaccggaagcagctgaagcgcaacgacctcaacaaggtgctgaacaagtacaacatcttccccagcaagatgctgctcaacctgcccatgctggacctctggaagctgcggtccgacagcgcgaactccaacaaggacatcagcgccgagcagctgggccgcatcctctacatgctgaaccagaagcggggctacaagtccgtgcgcagcgaggccaactccgacaagaaggacaccgactacgtccaggccgtgaaggggcggtacgcccagctgaaggaccgcaaccagaccatcggccagtacttctacgaggagctctacaacgcgaacgtgaacaacagctacttcaagatcaaggaggaggtctacccccgggaggcctacatcgaggagttcgacacgatcatcaactcccagaagaccaagcacgagttcctgaccgaccagttcgtgcaccagctgcgcaacgagatcatctacttccagcggaagctcaagagccagaaggggctgatctccatctgcgagttcgagggcttcgagaagaccgtgttcgacaaggagaagaacaagcacaagatcgtcttcgtggggccgaaggtggcgccccgcagcgcgcccctgttccagctctgccgggtctgggaggtgatcaacacgatctccatcaaggtgaagaaccccgagggcagcaagtacaagtggggcgagcgcatcccgagcatcaaggagaaggagatcctggccgactacctgttcaagaacgaggtcctctccttcaccaagctgctggagatcctcgggctgaacaagaacgacgtgtacgtgaacaagcagatcctgaagggcatcaaggggaacgagacctacgccaccctctacaacatcctgggcgagaacgagttcctgaacttcgacgtcagcatcatcccctccaaccacacgagcatgctcgtggacaagaagaccggcgagatcctggaggagcgggccgggctggagctcgacgtgtccctggagaagcagcccttctaccagctgtggcacaccatctacagcctcaaggacctggacgagtgcaagaacgccctgatcaagcgcttcgacttcgacgacgagaccgccgagaacctctcccgcatcgacttcaacaagcaggccttcggcaacaagagcaacaagtccatgcggaagatcctgcccttcctgatggaggggtacgactacagccagtcctgcagcctcgccggctacaaccactccaacagcctgacgaaggacgagcgcgagcagcaggtcaccctggaccggctggagctcctgccgaagaactccctgcgccagcccatcgtggagaagatcctcaaccagatgatcaacctggtgaacgccatcctggaccagtacggggagctcagcgagatccgggtcgagctggcccgcgagctgaagcagtccaaggacgagcggaacgacgccgacctccagaacaccaagaacaagaagctgaacgacgagatcggcaagcgcctggcggagctcggcctgcccatcaccaagcggtacatccagaagtacaagttcatcttccccagcctgtccaagaacctcaaggacgcccacgtgaacaaccagtgcatctactgcggggagacgttcaacctgagcgaggccctgagcggcgacgcctacgacgtcgaccacatcgtgccgaaggccctcctgttcgacgactcccagaccaacaaggtgctggtccaccgcaagtgcaacagcaccaagaccaaccagacggcgtacgactacatctccaccaagggggacgagcaggtccggatctacttcgagcgcgtggacgactggttcaagagcggcatcatctcctacagcaagatgcagcggctcaaggtgtcccacaaggagtacctggagcgcaagaagatcgggaaggagaccgagaccgacaagaagctgtgggagaacttcatcgaccggcagctccgcgacacgcagtacatcagccggaagtcccgcgagatcctgcagaaggtgtgcaacaacgtgaccaccaccgagggcggcgtcacggccaagctgcggaacctctgggggtgggacgacgtgctgatgaacctgcagatgcccaagtaccgcgagctcggccagaccgtgatcaaggagtggaccagcgagcacgggaagcgcaagcaccagaaggaggaggtcgagaactggaccaagcgggacgaccaccgccaccacgccatcgacgccctggtgatcgcctgcacgaagcagggcttcatccagcggatcaacaccctgaactccagcgacaccaaggacctcatgctgaaggaggtggaggaggcgaaggtcaagttctccgagaagaccaccctgctcgagaagtacctgcgcacgcaggagcccttcagcacccaggaggtgatgcgggaggccgacaaggtgctggtctccttcaaggccgggaagaaggtggccaccatcaccaagttcaaggcgatcggcaagaacaaggacagcggcgtgatcgtcccccgcggggccctccacgagcagtccgtgtacggcaagatcaaggtgatcgagaaggacaagccgctgaagtacctgttcgagaacagcgaccggatcgtcgaccccaaggtgaagaagctcgtggaggtccgcctgagcgagaacgagaacaactccaagacggccatcagcaccctgaagaaggcccccatcttcctcaacgaggagaagaccgaggtgctggagaaggcctcctgctacaacgacgcgaccgtgctgaagtacaagctccagagcatcaaggcctcccaggccgacgacatcgtcgacgagcgggtgaagttcctggtgaaggagcgcctggcccagttcgggaacaaggagaaggaggccttcaaggacatcctctggttcaacgaggagaagcagatccccatcatcagcgtccggctgttcgcgcgcccggacgccaacaacctccaggtgatcaagaaggacgagaacggcaagtccatcggcttcgtgctgacggggaacaaccaccacatcgccatctacgaggacaaggacaacaagctgatccagcacagctgcaccttctggcacgccgtcgagcggaagaagtacaacatccccgtggtgatcaagaactccagcgacgtctggtcccagctgctcgacaagcagctgcccgagagcctgctcaacaagctgcccaccgacaagctgaacctcaagttctccatgcagcagaacgagatgttcatcctgggcctgagccagaaggagttcgacgaggccatcaagaacaaccacaagtccttcctcagcaagtacctgtacctggtgtggtccatcagcaacaacgactactacttccgccaccacctcgagaccaagaacacggagctgaagaacatctccaccgcgaaggagagcaagcggtacttccgcttcaagagcgtgggggccctggtcggcaccaacccgatcaagatccggctcaaccacctgggggagatcaacaaggtgggcgagtactga

SEQ ID NO: 1751 - RNA, 3807 nt, synthetic construct
  misc_feature 1..3807: note = Cas9 variant
  source 1..3807: mol_type = other RNA
atgaccaagaacatcctgggcctcgacctggggaccaacagcatcggctgggccctgatcgaggtggacgagaacaacacgcccatccgcatcatcgccatggggtcccggatcatcccgctcagcacctccgacaaggaggagttccagcgcggcctgagcatcaccaagaaccagtcccggaccgtcagccgcacgcagcggaaggggtacgaccgcaagcagctgaagaagtccgacctcaagaagatcctgaacaagtacaacatcttccccagcgaggagctgctcaagctgcccatgctggacctctggaagctgcggtccgacagcgcgaaccccaacgagaacatctccgccgagcagctgggccgcatcctctacatgctgaaccagaagcggggctacaagagcgcccgctccgaggccaacgccgacaagaaggacaccgactacgtgcaggcggtgaaggggcggtacgcccagctgaaggagcgcaaccagaccatcggccagtacttctacgaggagctctacaacgccaacaccaacaacagctacttccggatcaaggaggaggtctacccgcgcgaggcctacacggaggagttcgacaccatcatcaacgcgcagaagaacaagcacgacttcctgaccgacgaggtggtgcaccagctgcggaacgagatcatctacttccagcgcaagctcaagtcccagaaggggctggtcagcatctgcgagttcgagggcttcgagaagaccgtgttcgacaaggagaagaacaaggacaaggtggtcttcgtggggcccaaggtggcccccaagacgagccccctgttccagctctgccggatctgggaggtcgtgaacaccatctccctgaagatcaagaacccggagggctccaagtacaagtggggcgagaagatccccaacctgaaggagaagcagatcctcgccgactacctgttcaagaacgacagcctgagcttcaccaagctcctggagatcctggacctcaacaagaacgacgtgtacgtcaacaagcagatcctgaaggggatcaagggcaacgagaccttctccacgctgcacaccgtgctcggggacaacgagctgctgaacttcgacgtgagcatcatcccctccaaccacaccagcatgctcgtcgacaagaagaccggcgagatcctggaggagcgcgccggcctggagctcgacgcctccctggagaaggagcccctgtaccagctctggcacacgatctacagcctgaaggacctggacgagtgcaagaacgcgctcatcaagcggttcgggttcgacgacgagaccgccgagaagctgtcccacatcgacttcaacaagcaggccttcggcaacaagagcaacaagtccatgcgcaagatcctgccgttcctgatggaggggtacgactacagccagtcctgcagcctcgccggctacaaccactccaacagcctgaccaaggacgagcgggagcagcagatcaccctggaccgcctcgagctgctgtccaagaacagcctccgccagcccatcgtggagaagatcctgaaccagatgatcaacgtggtcaacgccatcctggagcagtacgggaagctctccgagatccgggtggagctggcgcgcgagctgaagcagagcaaggacgagcggaacgacgccgacctccagaactccaagaacaagaagctgaacgaggagatcggcaagcgcctggccgagctcggcctgcccgtgacgaagcggtacatccagaagtacaagttcatcttccccagcctgagcaagaacctcaaggacgcccacgtcaacaaccagtgcatctactgcggggagaccttcaacctgaccgaggccctgtccggcgacgcgttcgacgtggaccacatcgtcccgaaggccctcctgttcgacgacagccagaccaacaaggtgctggtgcaccgcaagtgcaactccacgaagaccaaccagaccgcctacgactacatcgggaccaagggcgaggagcaggtccgggtgtacagcgagcgcatcgacgactggttcaagcgggggatcatctcctacagcaagatgcagcgcctcaaggtgtcccacaaggagtacctggagcggaagaagctgggcaaggagacggagaccgacaagaagctctgggagaacttcatcgaccgccagctgcgggacacccagtacatcagccgcaaggcccgggagatcctgcagaaggtctgcaacaacgtgaccacgaccgagggcggggtgaccgccaagctccgcaacctgtggggctgggacgacgtcctgatgaacctccagatgcccaagtacaaggagctggggcagaccgtgatcaaggagtggacctccgagcacggcaagcggaagcaccagaaggaggagatcgagaactggacgaagcgcgacgaccaccggcaccacgcgatcgacgccctggtggtcgcctgcaccaagcaggggttcatccagcgcatcaacaccctcaacagctccgacaccaaggacctgatgcagcgcgagatcaaggaggccaagaagctgctcggcgagaactacaacgagaaggagttcgagaacgacaacgagttcgtgaagaaccacaaggagcggctgagccagctggacgactacctccgcctgcagaagcccgtgaagttcgacacgaagtacgtcgagcaggaggcggacaaggtgctggtgtccttcaaggccggcaagaaggtcgccaccatcaccaagttcaaggccaccgggaagaacaaggacacgggcgtgatcgtgccccgcggggccctccacgaggcgggcctgtacggcatccggaccatctacagcaagggcgggatcgccgagaagcacatcatcaagaagtacaaggtcggggtgtccgcccaggaccacatcttcaccggcaaggagacctacagcgtgaagaaggacaagaacgggaacgagaaggtcgacgacaagatcaagatcgtgctggactccatcgtggacaacaaggtcaaggaggtggtgctcaaccggctgaaccgcggcttcaacaacgaggaggactaccggatcgacgtcaagaaggccctgaacaacttcaagaacctcgacgaggacccgctgtggtacaacgagagcaagggcatcaagatcctgagcatcaagctcaagacggggctgaaggactccgtggtgcccctgcgcctcaacgagaagaacgaggtcatcaccctggtgaagaccggcaacaaccaccacatcgccatctacgaggacaacgacgggaagctgatccagtacagctgcaccttctggcacgcggtggagcggaagaagtacaacatccccacggtcatcaagaactccagcgaggtgtggaaccaggtgctcgacaagaagctgcccgagtccttcctgaaccgcctcccggccgacaagctgaacctgaagttcagcatgcagcagaacgagatgttcatcctcggcctgctggaggaggagttcgacaaggccatcaaggacaacgacaagtccctcctgagcaagtacctgtacctcgtctggtccatcgccgagggggactactggttccggcaccacctggagaccaagaacaccgagctgaagaagaccaacggcgccaaggagagcaagcgctacttccggctctccacgaagggcctgatcgacctgaaccccgtgaaggtgcgcctcaaccacctgggggagatcaccaagatcggcgagtactga

SEQ ID NO: 1752 - RNA, 3810 nt, synthetic construct
  misc_feature 1..3810: note = Cas9 variant
  source 1..3810: mol_type = other RNA
atgaacaacagcatcaagtccaagcccgaggtgaccatcggcctggacctcggggtcggcagcgtggggtgggccatcgtggacaacgagaccaacatcatccaccacctgggctcccgcctgttcagccaggccaagacggcggaggaccggcgctccttccgcggggcccggcggctcatccgccggcgcaagtacaagctgaagcggttcatcaacctgatctggaagtacaacagctacttcggcttcaagaacaaggaggacatcctcaacaactaccaggagcagcagaagctgcacaacaccgtcctgaacctcaagctggaggccctgaacgccaagatcgacccgaaggccctctcctggatcctgcacgactacctgaagaaccgcggccacttctacgaggacaaccgggacttcaacgtgtaccccaccgaggagctcgcgaactacttcggggagtacggctactacaaggggatcatcgacagcaaggaggacaacgacgacaagctggaggagggcctgaccaagtacaagttctccaaccagcactggctcgaggagatcaagaaggtgctgagcaaccagacggggctgcccgagaagttcaaggaggagtacgagtccctcttcagctacgtccgcaactactccgagggccccggcagcatcaactccgtgagcccgtacgggatctaccacctggacgagaaggagggcaaggtggtccagaagtacaacaacatctgggacaagaccatcgggaagtgctccatcttccccgacgagtaccgggcccccaagaacagccccatcgccatgatcttcaacgagatcaacgagctgtccaccatccgcagctacagcatctacctcaccggctggttcatcaaccaggagttcaagaaggcctacctgaacaagctgctcgacctgctgatcaagacgaactccgagaagccgatcgacgcgcggcagttcaagaagctccgcgaggagaccatcgccgagagcatcggcaaggagaccctgaaggacgtggagcgggaggagaagctggagaaggaggaccacaagtggaagctcaaggggctgaagctgaacaccaacggcaagatccagtacaacgacctctccagcctggccaagttcgtgcacaagctgaagcagcacctcaagctggacttcctgctcgaggaccagtacacgaccctggacaagatcaacttcctgcagtccctcttcgtctacctggggaagcacctccgctacagcaaccgggtggactccgccaacctcaaggagttcagcgactccaacaagctgttcgagcgcgtgctgcaggagcagaaggacgacctgttcaagctgttcgagcagaccgacaaggacgacgagaagatcctggcccagacccacagcctgtccacgaaggcgatgctcctggccatcacccggatgaccaacctggacaacgacgaggacaaccagaagaacaacgacaagggctggaacttcgaggccatcaagaacttcgaccagaagttcatcgacatcaccaagaagaacaacaacctcagcctgaagcaggacaagcgctacctggacgaccgcttcatcaacgacgccatcctctcccccggggtcaagcggatcctgcgcgaggccacgaaggtgttcaacgcgatcctgaagcagttcagcgaggagtacgacgtgaccaaggtcgtgatcgagctcgcccgggagctgtccgaggagaaggagctggagaacaccaagaactacgagaagctcatcaagaagaacagcgacaagatctccgagcgcctggaggccctggacatcgccgaggacaagatcgaggacatcctcaagagccccaccaagtcctacaaggtgctgctgtggctccagcaggaccacatcgacccctacagccagaaggagatcgccttcgaggacatcctgacgaagaccgagaagaccgagatcgaccacatcatcccgtacagcatctccttcgacgacagctccagcaacaagctgctcgtcctggcggagtccaaccaggccaagagcaaccagaccccctacgagttcatcacgtccggcaacgccggcatcaagtgggaggactacgaggcctactgccggaagttcaaggacggggacaccagcctgctcgactccacccagcgcagcaagaagttcgccaagatgatgaagaccgacacgtccagcaagtacgacatcggcttcctggcgcggaacctgaacgacacccgctacgccaccatcgtgttccgggacgccctcaaggactacgccaacaaccacctggtggaggacaagcccatgttcaaggtcgtgtgcatcaacgggggcgtcacctccttcctgcgcaagaacttcgacaagagctggtacgcgaagaaggaccgggacaagaacatccaccacgccgtggacgcctccatcatcagcatcttctccaacgagacgaagaccctcttcaaccagctgacccagttcgccgactacaagctgttcaagaacaccgacgggagctggaagaagatcgaccccaagaccggcgtggtcacggaggtgaccgacgagaactggaagcagatccgcgtgcggaaccaggtcagcgagatcgccaaggtgatcaacaagtgcatccaggactccaacatcgagcgcaaggcgcggtacagccgcaagatcgagaacaagaccaacatctccctcttcaacgacaccgtgtacagcgccaagaaggtcggctacgaggaccagatcaagcggaagaacctgaagacgctggacatccacgagtccgccgaggagaacaagaacagcaaggtgaagaagcagttcgtgtaccgcaagctcgtcaacgtgtccctgctgaacaacgacaagctcgccgacctgttcgccgagaaggaggacatcctgatgtaccgggcgaacccgtgggtgatcaacctcgccgagcagatcttcaacgagtacaccgagaacaagaagatcaagagccagaacgtcttcgagaagtacatgctggacctgaccaaggagttccccgagaagttctccgaggccttcgtcaagagcatgctccgcaacaagaccgccatcatctacaacgtggagaagaaggtggtgcaccgcatcaagcggctgaagatcctgtccagcgagctcaaggagaacaagctgtccaacgtgatcatccgcagcaagaacgagtccgggacgaagctgagctaccaggacaccatcaactccatcgccctcatgatcatgcggagcatcgaccccaccgcgaagaagcagtacatccgcgtccccctgaacaccctgaacctccacctgggcgaccaggacttcgacctgcacaacatcgacgcctacctcaagaagccgaagttcgtgaagtacctgaaggccaacgagatcggggacgagtacaagccctggcgggtgctgacgtccggcaccctcctgatccacaagaaggacaagaagctgatgtacatcagcagcttccagaacctcaaggacgtcatcgagatcaagaacctgatcgagaccgagtacaaggagaacgacgactccgaccccaagaagaagaagaaggccaaccgcttcctgatgaccctcagcacgatcctgaacgactacatcctgctcgacgcgaaggacaacttcgacatcctggggctgtccaagaaccggatcgacgagatcctcaacagcaagctgggcctggacaagatcaccaagtga

SEQ ID NO: 1753 - RNA, 3810 nt, synthetic construct
  misc_feature 1..3810: note = Cas9 variant
  source 1..3810: mol_type = other RNA
atgaacaacagcatcaagtccaagcccgaggtgaccatcggcctggacctcggggtcggcagcgtggggtgggccatcgtggacaacgagaccaacatcatccaccacctgggctcccgcctgttcagccaggccaagacggcggaggaccggcgctccttccgcggggtccggcggctcatccgccggcgcaagtacaagctgaagcggttcgtgaacctgatctggaagtacaacagctacttcggcttcaagaacaaggaggacatcctcaacaactaccaggagcagcagaagctgcacaacaccgtgctgaacctcaagtccgaggccctgaacgccaagatcgacccgaaggccctgagctggatcctccacgactacctgaagaaccgcggccacttctacgaggacaaccgggacttcaacgtctaccccaccaaggagctggccaagtacttcgacaagtacgggtactacaagggcatcatcgactccaaggaggacaacgacaacaagctcgaggaggagctgaccaagtacaagttcagcaacaagcactggctggaggaggtgaagaaggtgctctccaaccagacggggctgcccgagaagttcaaggaggagtacgagagcctgttctcctacgtccgcaactacagcgagggccccgggtccatcaacagcgtgtccccgtacggcatctaccacctcgacgagaaggagggcaaggtggtccagaagtacaacaacatctgggacaagaccatcgggaagtgcaacatcttccccgacgagtaccgggcgcccaagaacagccccatcgccatgatcttcaacgagatcaacgagctgtccaccatccgcagctacagcatctacctgaccggctggttcatcaaccaggagttcaagaaggcctacctcaacaagctgctggacctcctgatcaagacgaacggggagaagccgatcgacgcccggcagttcaagaagctgcgcgaggagaccatcgcggagtccatcggcaaggagaccctcaaggacgtggagaacgaggagaagctggagaaggaggaccacaagtggaagctgaagggcctcaagctgaacaccaacgggaagatccagtacaacgacctgagctccctcgccaagttcgtgcacaagctgaagcagcacctgaagctcgacttcctgctggaggaccagtacgccacgctcgacaagatcaacttcctgcagagcctgttcgtctacctcggcaagcacctccggtacaacaaccgcgtggactccgccaacctgaaggagttcagcgactccaaccggctgttcgagcgcgtgctgcaggagcagaaggacgggctgttcaagctgttcgagcagaccgacaaggacgacgagaagatcctcgcccagacccacagcctgtccaccaaggcgatgctgctcgccatcacgcggatgaccaacctggacaacgacgaggacaaccagaagaacaacgacaagggctggaacttcgaggccatcaagaacttcgaccagaagttcatcgacatcaccaagaccaacaacaacctgagcctcaagcaggacaagcgctacctggacgaccgcttcatcaacgacgccatcctgtcccccggggtcaagcggatcctccgcgaggccacgaaggtgttcaacgcgatcctgaagcagttcagccaggagtacgacgtgaccaaggtcgtgatcgagctggcccgggagctctccgaggagaaggagctggagaacaacaagaactacaagaagctgatcaagaagaacagcgacaagatctccgagggcctcaaggccctggacatcgccgaggacaagatcgaggacatcctcaagagccccaccaagtcctacaaggtgctgctgtggctgcagcaggaccacatcgacccctacagccagaaggagatcgccttcgaggacatcctcaccaagacggagaagaccgagatcgaccacatcatcccgtactccatcagcttcgacgacagctccagcaacaagctgctggtcctcgcggagtccaaccaggccaagagcaaccagaccccctacgagttcatcacctccggcaacgccgggatcaagtgggaggactacgaggcctactgccgcaagttcaaggacggcgacacgagcctgctggactccacccagcggagcaagaagttcgccaagatgatgaagaccgacacctccagcaagtacgacatcgggttcctcgcgcgcaacctgaacgacacgcggtacgccaccatcgtgttccgcgacgccctgaaggactacgccaacaaccacctcgtcgaggacaagcccatgttcaaggtggtgtgcatcaacggcggggtcacctccttcctgcggaagaacttcgacaagagctggtacgcgaagaaggaccgcgacaagaacatccaccacgccgtggacgcctccatcatcagcatcttctccaacaagaccaagacgctgttcgaccagctcacccagttcgccgactacaagctgttcaagaacaccgacggcagctggaagaagatcgaccccaagaccggcgtggtcaccgaggtgacggacgagaactggaagcagatccgggtgcgcaaccaggtctccaagatcgccgaggagatcgacaagtgcatccaggacagcaacatcgagcggaaggcgcgctacagccggaagatcgagaacaagaccaacatctccctgttcaacgacaccgtgtacagcgccaagaaggtggggtacgacgaccagatcaagcgcaagaacctcaagaccctggacatcgacgagtccgtcgaggagaacaagaacagcaaggtgaagaagcagttcgtgtaccggaagctggtcaacgtgtccctcctgaacaacgacaagctggccgacctcttcgccgagaaggaggacatcctgatgtaccgcgccaacccgtgggtgatcaacctggcggagcagatcttcaacgagtacacggagaaccggaagatcaagagccagaacgtcttcggcaagtacatgctcgacctgaccaaggagttccccgagaagttctccgaggccttcgtcaagagcatgctgcgcaacaagaccgccatcatctacaacgtggagaagaaggtggtgcaccgcatcaagcggctcaagatcctgtccagcgagctgaaggagaacaagctctccaacgtgatcatccgcagcaagaacgagtccgggaccaagctgagctaccaggacacgatcaactccgtcgccctgatgatcatgcggagcatcgaccccaccgccaagaagcagtacatccgcgtgcccctcaacaccctgaacctgcacctcggcgaccacgacttcgacctgcacaacatcgacgcgtacctgaagaagccgaagttcgtgaagtacctcaaggccaacgagatcggggacgagtacaagccctggcgggtcctgatctccggcagcctgctcatccacaagcgcgacaagaagctgatgtacatctccagcttccagaacctgaacgacctcatcgagatcaagaacctgatcgagaccgagtacaaggagaacgtggacagcgaccccaagaagaagaagaaggcctcccagatcctgcggagcctctccacgatcctgaacgactacatcctgctcgacgccaaggacaacttcgacatcctgggcctgagcaagaaccgcatcgacgagatcctcaactccaagctggacctggacaagatcgcgaagtga

SEQ ID NO: 1754 - RNA, 3822 nt, synthetic construct
  misc_feature 1..3822: note = Cas9 variant
  source 1..3822: mol_type = other RNA
atgaagaagatcctgggcctcgacctggggaccaacagcatcggctgggccctgatcgaggtggacgagaacaacttccccatccgcatcatcgccatggggtcccggatcatcccgctcagctccaacgacaaggacgagttccagcgcggcctgagcatcaccaagaaccagtcccggacggtcagccgcacccagcggaaggggtacgaccgcaagcagctgaagaagtccgacgacttcaagtacagcctccggcgcatcctgaacaagtacaacatcttcccctccgaggagctgctcaagctgcccatgctggacctctggaagctgcggagcgacgcggtgaaccccaacgagaacatctccgccgagcagctgggccgcatcctctacatgctgaaccagaagcggggctacaagagcgcccgctccgaggccaacgccgacaagaaggacaccgactacgtgctggcggtcaaggggcggtacgcccagctcaaggaccgcaaccagaccatcggccagtacttctacgaggagctgcacaacgccaagacgaccaacagctacttccggaccaaggaggaggtgtacccgcgcgaggcctacatcgaggagttcgacaccatcatcaacgcgcagaagtccaagcacgacttcctgacggacgaggtggtccaccagctccggaacgagatcatctacttccagcgcaagctcaagagccagaaggggctggtgtccatctgcgagttcgagggcttcgagaagaccatcttcgacaaggagaaggacaagaacaaggtggtcttcgtggggcccaaggtggcccccaagaccagccccctgttccagctgtgccggatctgggaggtcgtgaacaccatcacgctgaagatcaagaacccggagggctccaagtacaagtggggcgagaagatccccaacatcaaggagaaggaggccctcgccgactacctgttcaagaacgagaccctgagcttcaacaagctcctggacatcctggagctcaagaaggagaacgtgtacgtcaacaagcagatcatcaaggggatcaagggcaacgagacctacagcgccctgcaccgcatcctgggggacaacgagctcctgaagttcgacgtgtccatcatccccagcaaccacacctccatgctggtggacaagaagacgggcgagatcctcgaggagcgggcgggcctggagctggacgtcagcctcgagaaggagcccctgtaccagctgtggcacaccatctactccatcaaggacctcgacgagtgcaagaacgccctgatcaagcgcttcgggttcgacgacgagatcgccgagaagctgagccacctcgacttcaacaagcaggccttcggcaacaagtccaacaagagcatgcgcaagatcctgccgttcctgatggaggggtacaactactcccagagctgcaccctggccggctacaaccactccaacagcctcaccaaggacgagcgggagcagcaggtcacgctggacaagctggagctcctgcccaagaactccctgcgccagcccatcgtggagaagatcctcaaccagatgatcaacgtggtgaacgcgatcctggaggagtacgggaagcccagcgagatccggatcgagctggcccgcgagctcaagcagtccaaggacgagcggcacgacgccgacctgcagaacagcaagaacaagaagctgaacgaggagatcggcaagcgcctcaccgagctgggcctgccggtgaccaagcggtacatccagaagtacaagttcatcttcccctccctcagcaagtccctgaaggacgcccaggtcaacaaccagtgcatctactgcggggagaccttcaacctgacggaggccctcagcggcgacgcgtacgacgtggaccacatcgtccccaagagcctgctgttcgacgactcccagaccaacaaggtgctcgtgcaccgcaagtgcaacagcaccaagaccaaccagacggcctacgactacatcgcctccaagggggaggaggaggtccagatctacagcgcccgggtggacgactggttcaagcgcggcatcatctcctacagcaagatgcagcggctgaaggtgtcccacaaggagtacctggagcgcaagagcctcaacaaggagaccgagaccgacaagaagctgtgggagaacttcatcgaccggcagctgcgcgacacccagtacatctcccgcaagagcaaggagatcctccagaaggtctgcaacaacgtgacgaccaccgagggcggggtgaccgccaagctgcgggacctgtggggctgggacgacatcctcatgaacctgcagatgcccaagtacaaggagctgcggcagacggtcatcaaggagtggacctccgagcacgggaagcgcaagcaccagaaggaggagatcgagaactggaccaagcgggacgaccaccgccaccacgcgatcgacgccctcgtgatcgcctgcaccaagcagggcttcatccagcgcatcaacaccctgaacagctccgagacgaaggacctgatgcagcaggagatcaacgaggccaagaagctcctgggggagaactacaaggacaaggagttcgagaacagcaacgagctggtgaagaaccacaagggccggctctccaagctggacgactacctgcgcctccagaagccgatcaagttcaacaccaagtacgtcgagaaggaggcggacaagatcctgatcagcttcaaggccgggaagaaggtggccaccatcaccaagttcaaggccacgggcaagaacaaggacaccggcgtgatcgtcccccgcggggccctgcacgaggcgggcctctacggggtgcggaccatctactccaagggcggcatcgccgagaagcacatcatcaagaagtacaaggtgggggtcagcgcccaggaccacatcttcaccggcaaggagagctactccgtgaagaaggacaagaacgggaacgagaaggtggacgacaagatcaaggtcgtgctggacagcatcgtggactccaaggtcaaggagatcgtgctgaaccggctcaacttcggcttcagcgacggggaggactacaagaacaacgtgaagaaggccctgaacaacttcaagaacctggacgagtaccccctctggtacaacgagaacaagggcatcaagatcctgtccatcaagctgaagacgggcctcaaggacagcgtcgtgcccctgcgcctgaacgagtccaacgaggtgatcaccctcgtcaagaccgggaacaaccaccacatcgccatctacgaggacaagaacagcaagccggtgcagcactcctgcaccttctggcacgcggtggagcggaagaagtacaacatccccgccgtcatcaagaagtccagcgacgtgtggaaccagctgctggacaaggagctccccgagagcttcctgaacaacctgcccgaggacaacctcaacctgaagttctccatgcagcagaacgagatgttcgtgctgggcctcagccaggaggagttcaaggaggccatcgagaacaacgacaagtccctgctgagcaagtacctctacctggtctggtccgtgagcgagaacaactactggttccgccaccacctggagacgaagaactccgacctcaagaagaccgagggggccaaggagagcaagcggctgtacaacatccgcagcgtgtccagcctgttctccctcaacccggtcaaggtgcggctgaaccacctgggcgagatcaccaagatcggggagtactga

SEQ ID NO: 1755 - RNA, 3825 nt, synthetic construct
  misc_feature 1..3825: note = Cas9 variant
  source 1..3825: mol_type = other RNA
atgaccaagcacatcctgggcctcgacctggggaccaacagcatcggctgggccatcatccaggtggacaacaacaacaacgtccccatccagatcatcgccatggggtcccgcatcatcccgctggacagcaacgaccgggaccagttccagaagggccaggcgatctccaagaacaaggaccgcacgaccgcccggacccagcgcaaggggtacgaccggaagcagctcaagaagtccgacgacttcaagtacagcctgaagaagatcctggagaagctcgacatcttccccaccgaggagctgatgaagctgcccacgctcgacctgtggaagctgcgcagcgacgccgtgtccaacatcgaggacatcacccccaagcagctcggccggatcctgtacatgctgaaccagaagcgcggctacaagagcgcccggtccgaggccaacgcggacaagaaggacaccgactacgtggccgaggtcaaggggcgctacacccagctcaaggacaagggccagacgctggggcagtacttctacaaggagctgagcgacgccaaccagaacaacacctactaccgggtgaaggagaaggtgtacccgcgcgaggcctacatcgaggagttcgacgcgatcatcaacgtccagaagtccaagcacagcttcctcaccgacgaggtgatccactccctgcggaacgagatcatctactaccagcgcaagctcaagagccagaagggcctggtgtccatctgcgagttcgaggggttcgagaccacgtacttcgacaagaagacccagcaggacaagaccatcttcaccggccccaaggtcgcgccccggacgagccccctgttccagttctgcaagatctgggaggtggtgaacaacatctccctgaagaccaagaacccggagggcagcaagtacaagtggtccgaccgcatccccaccatcgaggagaagcagaccatcgccaactacctccaggagaacgagaacctgagcttcatcgagctgctcaagatcctgcagctgaagaaggagcaggtctacgccaacaagcagatcctcaaggggatccagggcaacacgaccttcagcgccatccacaagatcatcgggaactccgagcacctgaagttcgacatcgagaccatccccagcaagcacttcgccgtgctggtggacaagaagaccggcgagatcctcgacgagcgggactccctggagctgaacagcgccctcgagcaggagcccttctaccagctgtggcacacgatctactccatcaaggacctggacgagtgcaagaaggccctcatcaagcgcttcaacttcgaggaggagatcgccgagaagctgagcaagatcgacttcaacaagcaggccttcggcaacaagtccaacaaggcgatgcggaagatgctgccgtacctcatgctggggtacaaccagagcgaggccgagtccttcgccggctacaaccgccggctgaccaaggaggagaagtccaagaacgtcagcgacgagcccctccagctgctggccaagaacagcctccgccagcccgtggtggagaagatcctgaaccagatgatcaacgtcgtgaacgccatcatcgagaagtacgggaagcccgaggagatccgcgtggagctggcgcgggagctgaagcagtccaaggacgagcgcgaggacgccgacaagcagaacggcttcaacaagaagctcaacgagctggtcgccaccaagctgaccgagctcgggctgccgacgaccaagcactacatccagaagtacaagttcatcttccccgccaaggacaagaactggaaggaggcccaggtggcgaaccagtgcatctactgcggcgacaccttcaacctgaccgaggccctcagcggcgacaacttcgacgtggaccacatcgtccccaaggccctgctgttcgacgactcccaggccaacaaggtgctcgtccaccggagctgcaactccacgaagaccaacaacaccgcgtacgactacatcaccaagaaggggagccaggccctgaacgactacgtggcccgcgtggacgactggttcaagcggggcatcatctcctacgggaagatgcagcgcctgaaggtcagcttcgaggagtaccaggagcggaagaagatcggcaaggagacggaggccgacaagcgcatctgggagaacttcatcgaccggcagctccgcgagaccgcctacatcgcgaagaaggccaaggagatcctggagaaggtgtgccacaacgtgaccagcaccgaggggaacgtcaccgccaagctgcggcagctctggggctgggacaacgtgctgatgaacctgcagctccccaagtacaaggagctggagaagaagacgaagcagaccttcacccagctgaaggagtggacctccgaccacggcaaccgcaagcaccagaaggaggagatcatcaactggacgaagcgggacgaccaccgccaccacgccatcgacgccctcgtgatcgcgtgcacccagcaggggttcatccagcggatcaacaccctgagctccagcgacgtcaaggacgagatgaagaaggagctggaggaggacaagaccgtgtacaacgagcgcctcacgctgctggagaactacctcctggagaagaagccgttctccaccgaggagatcgagaaggaggccgacaagatcctggtgagcttcaaggccggcaagaaggtcgccaccctctccaagtacaaggccaccgggatcaacgagatcaagggcgtgctggtgccccgggggcccctgcacgagcagagcgtctacggcaagatcaaggtgatcgagaaggacaagcccctcaagtacctgttcgagaactccgacaagatcgtgaacccgctgatcaagcacctcgtcaagacgcgcctgctggagaacgagaacaacgcgcaggccgccctcgtgaccctgaagaacaagcccatcctgctcaacaacaagcagaccgagatcctggagaaggccagctgctacaacgaggcgaccgtgctgaagtacaagctccagtccctgaaggccagccagatcgacgacatcgtcgacgagaagatcaagttcctgatcaaggagcggctctccaagttcggcaacaaggagaaggaggccttcaaggacatcctgtggttcaacgagaagaagcagatccccatcacgagcatccgcctgttcgcccgccccgacgccaacaacctccaggtgatcaagaagcacgagaaggggaagaacatcggcttcgtgctgtccgggaacaaccaccacatcgcgatctacgaggacaagaacaacaagctgatccagcacatctgcgacttctggcacgccgtcgagcggaagcgcaacaacatcccggtgctcatcgaggacaccagcaccatctggaaccacctgatcaacgaggacttctccgagagcttcctgaacaagctccccaacgacagcctgaagctgaagttctccctccagcagaacgagatgttcatcctgggcctgcccaaggagcagagcgaggaggccatcaagtccaacaacaagagcctcctgtccaagcacctgtacctcgtgtggagcatcaccgacggcgactacttcttccggcaccacctggagacgaagaacaccgagctgaagaagatcgacgggtccaaggagagcaagcgctacctccggctgtccaccaagagcctggtcgacctcaacccgatcaaggtgcgcctgaaccacctgggcgagatcaccaagatcggggagtga

SEQ ID NO: 1756 - RNA, 3846 nt, synthetic construct
  misc_feature 1..3846: note = Cas9 variant
  source 1..3846: mol_type = other RNA
atggaggacgacagccagcacgacatccgcgagatctacctggccatccaccacatggtgaagtaccggggcaacttcctcgtcgaggggaccctggagtccagcaacgccttcaaggaggacgagctgctcaagctgctgggccgcatcacccggtacgagatgtccgagggggagcagaacagcgacatcgagcaggacgacgagaacaagctcgtggcgcccgccaacggccagctggccgacgccctgtgcgccacgcgcgggtcccggagcatgcgcgtggacaacgcgctcgaggccctgtccgccgtcaacgacctgagccgggagcagcgcgccatcgtgaaggcgatcttcgccggcctcgagggcaacaagctggacctggccaagatcttcgtgtccaaggagttcagctccgagaacaagaagatcctcgggatctacttcaacaagagcgactacgaggagaagtgcgtccagatcgtggactccggcctgctggacgacgaggagcgggagttcctcgaccgcatgcaggggcagtacaacgccatcgccctgaagcagctgctcggccggagcacctccgtgagcgactccaagtgcgcgagctacgacgcccaccgcgccaactggaacctgatcaagctgcagctccggaccaaggagaacgagaaggacatcaacgagaactacgggatcctggtcggctggaagatcgactccggccagcgcaagagcgtgcgcggggagagcgcctacgagaacatgcggaagaaggccaacgtgttcttcaagaagatgatcgagacctccgacctgagcgagacggacaagaaccggctcatccacgacatcgaggaggacaagctgttcccgatccagcgcgactccgacaacggcgtcatcccccaccagctgcaccagaacgagctcaagcagatcatcaagaagcaggggaagtactaccccttcctgctggacgcgttcgagaaggacggcaagcagatcaacaagatcgagggcctcctggccttccgggtgccctacttcgtggggccgctggtcgtgcccgaggacctccagaagtccgacaacagcgagaaccactggatggtgcgcaagaagaagggcgagatcaccccctggaacttcgacgagatggtcgacaaggacgccagcgggcggaagttcatcgagcgcctggtgggcaccgactcctacctgctcggggagcccaccctgccgaagaacagcctgctctaccaggagtacgaggtgctgaacgagctgaacaacgtccgcctctccgtgcggacgggcaaccactggaacgacaagcgccggatgcgcctgggccgggaggagaagaccctgctctgccagcgcctgttcatgaaggggcagaccgtgaccaagcggacggccgagaacctgctgcgcaaggagtacggccggacctacgagctcagcgggctgtccgacgagagcaagttcacctccagcctgtccacctacggcaagatgtgccgcatcttcggggagaagtacgtcaacgagcaccgggacctcatggagaagatcgtggagctgcagacggtcttcgaggacaaggagaccctgctccaccagctgcgccagctggagggcatcagcgaggccgactgcgcgctcctggtgaacacccactacaccggctgggggcggctgtcccgcaagctcctgacgaccaaggccggcgagtgcaagatcagcgacgacttcgcgccccggaagcactccatcatcgagatcatgcgcgccgaggaccggaacctgatggagatcatcaccgacaagcagctcgggttcagcgactggatcgagcaggagaacctgggcgccgagaacgggagctccctgatggaggtggtcgacgacctccgcgtgagccccaaggtgaagcggggcatcatccagtccatccgcctgatcgacgacatcagcaaggccgtcggcaagcgcccctcccggatcttcctggagctcgccgacgacatccagccgagcgggcgcaccatctcccgcaagagccggctgcaggacctgtaccggaacgccaacctcggcaaggagttcaaggggatcgccgacgagctgaacgcgtgctccgacaaggacctgcaggacgaccgcctcttcctgtactacacgcagctgggcaaggacatgtacaccggcgaggagctcgacctggaccggctgagctccgcctacgacatcgaccacatcatcccccaggccgtgacccagaacgacagcatcgacaaccgcgtgctcgtcgcccgggccgagaacgcgcgcaagaccgactccttcacgtacatgccccagatcgccgaccggatgcgcaacttctggcagatcctgctggacaacgggctcatcagccgggtgaagttcgagcgcctgacccggcagaacgagttctccgagcgcgagaaggagcggttcgtgcagcgcagcctggtcgagacccggcagatcatgaagaacgtggccaccctcatgcgccagcggtacggcaactccgccgccgtgatcgggctgaacgcggagctgacgaaggagatgcaccgctacctcggcttcagccacaagaaccgcgacatcaacgactaccaccacgcccaggacgccctgtgcgtcgggatcgccggccagttcgccgcgaaccggggcttcttcgccgacggggaggtgagcgacggcgcccagaactcctacaaccagtacctgcgcgactacctccgggggtaccgcgagaagctgagcgccgaggaccggaagcagggccgcgcgttcgggttcatcgtgggctccatgcggagccaggacgagcagaagcgcgtcaacccccggaccggcgaggtggtgtggtccgaggaggacaaggactacctgcgcaaggtcatgaactaccggaagatgctcgtgacccagaaggtgggggacgacttcggcgccctgtacgacgagacccgctacgccgccacggacccgaaggggatcaagggcatccccttcgacggggccaagcaggacaccagcctgtacggcggcttctccagcgcgaagcccgcctacgccgtcctcatcgagtccaaggggaagacccggctggtgaacgtgaccatgcaggagtacagcctgctcggcgaccgcccctccgacgacgagctgcggaaggtcctggccaagaagaagtccgagtacgccaaggcgaacatcctcctgcgccacgtgccgaagatgcagctgatccggtacgggggcgggctcatggtgatcaagagcgccggcgagctgaacaacgcccagcagctgtggctcccctacgaggagtactgctacttcgacgacctgagccagggcaaggggtccctggagaaggacgacctcaagaagctgctggacagcatcctcggctccgtccagtgcctgtacccctggcaccgcttcaccgaggaggagctggccgacctccacgtggccttcgacaagctgcccgaggacgagaagaagaacgtgatcacggggatcgtcagcgcgctgcacgccgacgccaagaccgccaacctctccatcgtgggcatgaccggcagctggcggcgcatgaacaacaagagcgggtacaccttctccgacgaggacgagttcatcttccagagcccgtccggcctgttcgagaagcgcgtgacggtcggggagctgaagcggaaggcgaagaaggaggtgaacagcaagtaccgcaccaacgagaagcggctccccaccctgtccggcgccagccagccctga

SEQ ID NO: 1757 - RNA, 3861 nt, synthetic construct
  misc_feature 1..3861: note = Cas9 variant
  source 1..3861: mol_type = other RNA
atgaccaagaacatcctgggcctcgacctggggaccaacagcatcggctgggccctgatcgaggtggacgagaacaacacgcccatccgcatcatcgccatggggtcccggatcatcccgctcagcacctccgacaaggaggagttccagcgcggcctgagcatcaccaagaaccagtcccggaccgtcagccgcacgcagcggaaggggtacgaccgcaagcagctgaagaagtccgacctcaagaagatcctgaacaagtacaacatcttccccagcgaggagctgctcaagctgcccatgctggacctctggaagctgcggtccgacagcgcgaaccccaacgagaacatctccgccgagcagctgggccgcatcctctacatgctgaaccagaagcggggctacaagagcgcccgctccgaggccaacgccgacaagaaggacaccgactacgtgcaggcggtgaaggggcggtacgcccagctgaaggagcgcaaccagaccatcggccagtacttctacgaggagctctacaacgccaacaccaacaacagctacttccggatcaaggaggaggtctacccgcgcgaggcctacacggaggagttcgacaccatcatcaacgcgcagaagaacaagcacgacttcctgaccgacgaggtggtgcaccagctgcggaacgagatcatctacttccagcgcaagctcaagtcccagaaggggctggtcagcatctgcgagttcgagggcttcgagaagaccgtgttcgacaaggagaagaacaaggacaaggtggtcttcgtggggtccaaggtggcccccaagacgagccccctgttccagctctgccggatctgggaggtcgtgaacaccatctccctgaagatcaagaaccccgagggcagcaagtacaagtggggcgagaagaccccgaacctgaaggagaaggagatcctcgccgactacctgttcaagaacgacagcctgtccttcaccaagctcctggagatcctggacctcaacaagaacgacgtgtacgtcaacaagcagatcctgaaggggatcaagggcaacgagacgttcagcgccctgcacaccgtgctcggggacaacgagctgctgaacttcgacgtgtccatcatccccagcaaccacacctccatgctcgtcgacaagaagaccggcgagatcctggaggagcgcgccggcctggagctcgacgcgagcctggagaaggagcccctgtaccagctctggcacacgatctactccctgaaggtgctggacgagtgcaagaacgccctcatcaagcggttcgggttcgacgacgagaccgccgagaagctgagccacatcgacttcaacaagcaggccttcggcaacaagtccaacaagagcatgcgcaagatcctgcccttcctgatggaggggtacgactactcccagagctgctccctcgccggctacaaccacagcaactccctgaccaaggacgagcgggagcagcagatcaccctggaccgcctcgagctgctgagcaagaactccctccgccagccgatcgtggagaagatcctgaaccagatgatcaacgtcgtgaacgcgatcctggagcagtacgggaagctcagcgagatccgggtggagctggcccgcgagctgaagcagtccaaggacgagcggaacgacgccgacctccagaacagcaagaacaagaagctgaacgaggagatcggcaagcgcctggccgagctcggcctgcccgtcacgaagcggtacatccagaagtacaagttcatcttccccagcctgtccaagaacctcaaggacgcccacgtgaacaaccagtgcatctactgcggggagaccttcaacctgaccgaggcgctgagcggcgacgccttcgacgtcgaccacatcgtgcccaaggccctcctgttcgacgactcccagaccaacaaggtgctggtccaccgcaagtgcaacagcacgaagaccaaccagaccgcctacgactacatcgggaccaagggcgaggagcaggtccggatctactccgagcgcgtggacgactggttcaagcgggggatcatcagctactccaagatgcagcgcctcaaggtgagccacaaggagtacctggagcggaagaagctgggcaaggagacggagaccgacaagaagctctgggagaacttcatcgaccgccagctgcgggacacccagtacatctcccgcaaggcccgggagatcctgcagaaggtgtgcaacaacgtgaccacgaccgagggcgggatcaccgcgaagctccgcaacctgtggggctgggacgacgtcctgatgaacctccagatgccgaagtacaaggagctggggcagaccgtgatcaaggagtggaccagcgagcacggcaagcggaagcaccagaaggaggagatcgagaactggacgaagcgcgacgaccaccggcaccacgccatcgacgccctggtggtcgcctgcaccaagcaggggttcatccagcgcatcaacaccctcaactccagcgacaccaaggacctgatgcagcgcgagatcaaggaggcgaagaagctgctcggcgagaactacaacgagaaggagttcgagaacgacaacgagttcgtgaagaaccacaaggagcggctgtcccagctggacgactacctccgcctgcagaagcccgtgaagttcgacacgaagtacgtcgagcaggaggccgacaaggtgctggtgagcttcaaggccggcaagaaggtcgccaccatcaccaagttcaaggccaccgggaagaacaaggacacgggcgtgatcgtgctccgcggggcgctgcacgagcagtccgtctacggcaagatcaaggtgatcgagaaggacaagcccctgaagtacctcttcgagaacagcaagaagatcgtgaaccccaagatcaaggtcctggtggaggagcggctggccgagaacgagaacaactccaagctcagcctgagcaccctgaagaagaacccgatcttcctcaacgaggagaagaccgagatcctggagaaggcctcctgctacaacgacgccaccgtgctgaagtacaagctccagagcctgaaggcctcccaggcggacgacatcgtcgacgaccgggtgaagttcctggtgaaggagcgcctcgcccagttcggcaacaaggagaaggaggccttcaaggacacgctgtggctgaacgaggagaagcagatccccatcatcaccgtccgcctcttcgcccggcccgacgccaacaacctgcaggcgatcaagaaggacaagaacgggcgggacatcggcttcgtgctgaccgggaacaaccaccacatcgccatctacgaggacaaggacaacaagctcgtgcagcacagctgcaccttctggcacgccgtcgagcgcaagaagaacaacgtgcccgccgtgatcaagaactccagcgacgtctggaaccagctgctggacaaggagctcccggagtccttcctgaacaagctgcccatcgacaagctcaagctgaagttcagcctgcagcagaacgagatgttcgtgctcggcctgctgcaggaggacttcgaggcggccatcgagaacaacgacaagacgctcctgtccaagcacctgtacctcgtgtggagcatcaccgacggggactacttcttccggcaccacctggagaccaagaacaccgagctgaagaagacggagggcgccaaggagtccaagcgctacttccggctcagcaccaagggcctgatcgacctgaaccccgtcaaggtgcgcctcaaccacctgggggagatcaccaagatcggcgagtactga

SEQ ID NO: 1758 - RNA, 3864 nt, synthetic construct
  misc_feature 1..3864: note = Cas9 variant
  source 1..3864: mol_type = other RNA
atgaagaccgtgctgggcctcgacctggggaccaacagcatcggctgggccctgatcgagctcgacgagaacaacatccccatccgcatcgtcgccatggggtcccggatcatcccgctgagcacgtccgacaaggaggagttccagcgcggcctgagcatcaccaagaaccagtcccggaccgtgagccgcacccagcggaaggggtacgaccgcaagcagctcaagaagtcctacctgaagaagatcctgaacaagtacaacatcttccccagcgacgagctcctgaagctgcccatgctcgacctgtggaagctgcggtccgacagcgcgaaccccaacgagaacatctccgccgagcagctcggccgcatcctgtacatgctgaaccagaagcggggctacaagagcgcccgctccgaggccaacgccgacaagaaggacacggactacatccaggcggtgaaggggcggtacgcccagctcaaggaccgcaaccagaccatcggccagtacttctacggggagctgaacgacgccaacgagaacaacagctacttccggatcaaggaggaggtctacccgcgcgaggcctacaccgaggagttcgacaccatcatcaacgcgcagaaggacaagcacgacttcctgacggacgaggtgatccaccagctccggaacgagatcatctacttccagcgcaagctgaagtcccagaagggcctggtgagcatctgcgagttcgaggggttcgagaagaccgtcttcgacaaggagaagaacaaggacaaggtggtgttcgtcggccccaaggtggcccccaagaccagccccctcttccagctgtgccggatctgggaggtggtcaacaccatcacgctgaagatcaagaacccggagggcagcaagtacaagtggggcgagaagatccccgacgtgaaggagaaggagatcctcgccgactacctgttcaagaacgagtccctgagcttcaccaagctcctggagatcctgaagctcaacaagaacaacgtgtacttcaacaagcagatcctgaaggggatcaaggggaacgagacctacagcatcctgcactccatcctcggcgacagcgagctgctgaacttcgacgtctccatcatccccagcaaccacacctccatgctcatcgacaagaagacgggcgagatcctggaggagcgcgccgggctggagctcgacaccagcctggagaaggagcccctgaaccagctctggcacaccatctactccatcaaggacctggacgagtgcaagagcgccctgatcaagcggttcggcttcgacgacgagaccgcggacaagctctcccgcatcgacttcaacaagcaggccttcgggaacaagagcaacaagtccatgcggaagatcctgccgttcctgatggagggctacgactacagccagtcctgcagcctggccgggtacaaccactccaacagcttcacgaaggacgagcgcgagcagcagatcaccctcgacaagctggagctgctccccaagaactccctgcgccagcccatcgtggagaagatcctgaaccagatgatcaacgtggtcaacgccatcctcgagcggtacggcaagcccagcgagatccgcgtggagctggcccgggagctgaagcagtccaaggacgagcgcaacgacaccgacctccagaacagcaagaacaagaagctgaacgaggagatcggcaagcggctggcggagctcgggctgccgctgaccaagcgctacatccagaagtacaagttcatcttccccagcctctccaagaacctgaaggacgcccacgtgaacaaccagtgcatctactgcggcgagacgttcaacctgaccgaggccctcagcggggacgccttcgacgtcgaccacatcgtgcccaaggccctgctgttcgacgactcccagaccaacaaggtgctcgtccaccggaagtgcaacagcaccaagacgaaccagaccgcgtacgactacatcgccaccaagggcgacgagcaggtccgcgtgtactccgagcgggtggacgactggttcaagcgcgggatcatcagctactccaagatgcagcggctgaaggtgagccacaaggagtacctggagcgcaagaagctcggcaaggagaccgagacggacaagaagctgtgggagaacttcatcgaccggcagctgcgcgacacccagtacatctcccggaagtcccgcgagatcctccagaaggtctgcaacaacgtggccaccaccgagggcggggtgacggccaagctgcggaacctgtggggctgggacgacgtcctcatgaacctgcagatgcccaagtacaaggagctggggcagaccgtggtgaaggagtggacctccgagcacggcaagcgcaagcaccagaaggaggagatcgagaactggaccaagcgggacgaccaccgccaccacgccatcgacgcgctcgtcgtggcctgcaccaagcaggggttcatccagcgcatcaacacgctgaacagctccgagaccaaggacctgatgcagcaggagatcaaggaggccaagaagctcctgggcgagaactacaacgagaaggagttcgagaacaacaacgagagcgtgaagaaccacaaggagcggctgtcccagctcgacgactacctgcgcctgcagaagccggtcaagttcgacaccaagtacgtggagcaggaggccgacaaggtgctcgtcagcttcaagtccggcaagaaggtggcgaccatcacgaagttcaaggccaccgggaagaacaaggacaccggcgtgatcgtcccccgcggggccctgcacgagcagaacgtgtacggcaagatcaaggtgatcgagaaggacaagagcctgaagtacctcttcgagaacagcgagaagatcgtcaaccccaagatcaagaacatcgtggagatcatcctgtccgagaacgagaacaacagcaagatggccctgtccaccctcaagaagaaccccatcttcctgaacgaggagaagacggacctgctcgagaaggccagctgctacgagtacgtgaccgtccggaagtacccgctgaacaccatcaaggcgtcccaggccgacgacatcgtggacgagcgggtgaagttcctggtcaaggagcgcctcacccagttcggcaacaaggagaaggaggccttcaaggacacgctgtggttcaacgaggagaagcagatccccatcatcaccgtgcggctgttcgcccgccccgacgccaacaacctccaggcgatcaagaaggacgagagcgggaaggagatcggcttcgtggtcatggggaacaaccaccacatcgccatctacgaggacaaggacggcaagctggtgcagcactcctgcaccttctggcacgccgtggagcggaagaagtacaacatcagcaccgtcatcaagaactccagcgacgcctggaaccagttcctggacaacgagctccccgagccgttcctgaacaagctgcccgccgacaacctcaacctgaagttctccctgcagcagaacgagatgttcatcctcgggctgagccaggaggagttcgacaaggcgctgaagtccaacgacaagagcctcctgtccaagcacctgtacctcgtgtggagcatctccgagaacaactactggttccgccaccacctggagacgaagaacagcgacctgaagaagaccaacggcgtgaaggagtccaagcggctctacaacatccgcagcctgggcagcctgttctccctcaaccccatcaagatccggctgaaccacctgggggagatcaccaagatcggcgagtacagctga

SEQ ID NO: 1759 - RNA, 3867 nt, synthetic construct
  misc_feature 1..3867: note = Cas9 variant
  source 1..3867: mol_type = other RNA
atgcgcctgttcgaggagggccacaccgccgaggaccggcgcctcaagcggaccgcccgccggcgcatcagccggcgccggaaccgcctgcggtacctgcaggcgttcttcgaggaggccatgacggacctcgacgagaacttcttcgcccgcctgcaggagtccttcctggtgcccgaggacaagaagtggcaccggcacccgatcttcgccaagctcgaggacgaggtcgcctaccacgagacctaccccaccatctaccacctccgcaagaagctggcggacagctccgagcaggccgacctccggctgatctacctggccctcgcccacatcgtgaagtaccgcgggcacttcctgatcgagggcaagctgagcaccgagaacacgtccgtgaaggaccagttccagcagttcatggtcatctacaaccagaccttcgtgaacggggagagccggctcgtgtccgcgcccctgcccgagagcgtcctgatcgaggaggagctcaccgagaaggcctcccgcaccaagaagtccgagaaggtgctgcagcagttcccgcaggagaaggccaacggcctgttcgggcagttcctcaagctgatggtgggcaacaaggccgacttcaagaaggtcttcggcctggaggaggaggccaagatcacgtacgcgagcgagagctacgaggaggacctcgaggggatcctggccaaggtgggcgacgagtactccgacgtgttcctggccgccaagaacgtctacgacgccgtggagctcagcaccatcctggcggactccgacaagaagtcccacgccaagctgagcagctccatgatcgtgcggttcaccgagcaccaggaggacctcaagaagttcaagcgcttcatccgggagaactgccccgacgagtacgacaacctgttcaagaacgagcagaaggacgggtacgccggctacatcgcccacgccgggaaggtcagccagctgaagttctaccagtacgtgaagaagatcatccaggacatcgcgggcgccgagtacttcctcgagaagatcgcccaggagaacttcctgcgcaagcagcgcaccttcgacaacggcgtgatcccccaccagatccacctggccgagctccaggccatcatccaccggcaggcggcctactaccccttcctgaaggagaaccaggagaagatcgagcagctggtcacgttccgcatcccgtactacgtggggcccctcagcaagggcgacgcctccaccttcgcctggctgaagcggcagagcgaggagcccatccgcccctggaacctgcaggagaccgtggacctcgaccagtccgcgaccgccttcatcgagcggatgacgaacttcgacacctacctgccgagcgagaaggtcctgcccaagcactccctcctgtacgagaagttcatggtgttcaacgagctgaccaagatcagctacaccgacgaccgcgggatcaaggccaacttctccggcaaggagaaggagaagatcttcgactacctcttcaagacgcggcgcaaggtgaagaagaaggacatcatccagttctaccggaacgagtacaacaccgagatcgtcaccctgagcggcctggaggaggaccagttcaacgcctccttcagcacctaccaggacctgctcaagtgcgggctgacgcgcgccgagctggaccaccccgacaacgcggagaagctcgaggacatcatcaagatcctgaccatcttcgaggaccggcagcgcatccggacccagctgtccaccttcaagggccagttcagcgccgaggtgctcaagaagctggagcgcaagcactacacggggtggggccggctgtccaagaagctcatcaacgggatctacgacaaggagagcggcaagaccatcctggactacctggtcaaggacgacggcgtgtccaagcactacaaccgcaacttcatgcagctcatcaacgacagccagctgtccttcaagaacgccatccagaaggcccagagctccgagcacgaggagaccctgagcgagaccgtgaacgagctcgccgggagccccgcgatcaagaagggcatctaccagtccctgaagatcgtcgacgagctggtggccatcatggggtacgccccgaagcggatcgtggtcgagatggcccgcgagaaccagacgaccagcaccggcaagcggcgctccatccagcgcctcaagatcgtggagaaggccatggcggagatcgggagcaacctgctgaaggagcagcccaccacgaacgagcagctccgggacacccgcctgttcctgtactacatgcagaacggcaaggacatgtacaccggcgacgagctctccctgcaccggctgagccactacgacatcgaccacatcatcccccagtccttcatgaaggacgacagcctcgacaacctggtgctggtcgggtccaccgagaaccgcggcaagagcgacgacgtgccctccaaggaggtggtcaaggacatgaaggcctactgggagaagctctacgccgccgggctgatcagccagcggaagttccagcgcctgaccaagggcgagcagggcgggctcacgctggaggacaaggcgcacttcatccagcggcagctggtggagacccgccagatcaccaagaacgtggccggcatcctcgaccagcggtacaacgccaagtccaaggagaagaaggtccagatcatcaccctgaaggccagcctgacgtcccagttccgcagcatcttcgggctctacaaggtgcgggaggtgaacgactaccaccacggccaggacgcctacctgaactgcgtcgtggcgaccaccctgctcaaggtgtacccgaacctggcccccgagttcgtctacggggagtaccccaagttccagaccttcaaggagaacaaggccacggccaaggccatcatctacaccaacctgctccgcttcttcaccgaggacgagccccggttcaccaaggacggcgagatcctgtggtccaacagctacctgaagacgatcaagaaggagctcaactaccaccagatgaacatcgtgaagaaggtggaggtccagaagggcgggttcagcaaggagtccatcaagccgaagggccccagcaacaagctgatccccgtgaagaacgggctggacccccagaagtacggcgggttcgactccccggtggtcgcgtacaccgtcctcttcacccacgagaagggcaagaagcccctgatcaagcaggagatcctgggcatcaccatcatggagaagacgcgcttcgagcagaaccccatcctcttcctggaggagaaggggttcctgcggccgcgcgtgctcatgaagctgcccaagtacaccctgtacgagttccccgagggccggcgccggctcctggccagcgccaaggaggcccagaaggggaaccagatggtgctgcccgagcacctcctgaccctgctctaccacgccaagcagtgcctgctgccgaaccagtccgagagcctcgcgtacgtggagcagcaccagcccgagttccaggagatcctggagcgcgtggtcgacttcgccgaggtgcacaccctggccaagtccaaggtgcagcagatcgtcaagctgttcgaggccaaccagacggcggacgtgaaggagatcgccgccagcttcatccagctgatgcagttcaacgccatgggcgccccctccaccttcaagttcttccagaaggacatcgagcgggcgcgctacaccagcatcaaggagatcttcgacgccaccatcatctaccagtcccccacggggctgtacgagacccgccggaaggtggtcgactga

SEQ ID NO: 1760 - RNA, 3903 nt, synthetic construct
  misc_feature 1..3903: note = Cas9 variant
  source 1..3903: mol_type = other RNA
atgtggggcgtgagcctgttcgaggccgggaagaccgccgcggagcgccggggctaccgctccacccggcgccggctcaaccaccgcaagttccggctgcgcctgctcgaggacatgttcgagaaggagatcctgagcaaggacccctccttcttcatccggctgaaggaggccttcctcagcccgaaggacgagcagaagcagttcaaggggaacatcctgttcaacgacaaggactacacggacgccgactactacgagcagtacaagaccatctaccacctccgctacgacctcatctcccagcaccggcagttcgacatccgcgaggtctacctggccatccaccacctgatcaagtaccggggccacttcatctacgaggaccagaccttcaccacggacgggaaccagctccagcaccacatcaaggccatcatcaccatgatcaacagcaccctgaaccgcatcatcatccccgagaccatcgacatcaacgtgttcgagaagatcctgctcgaccggatgatgaaccgctccagcaaggtgaagttcctgatcgagctgacgggcgaggacaagcaggacaagcccctcctgaaggagctgttcaacctcatcgtcggcctgaaggcgaagcccgcctccatcttcgagcaggagaacctggccaccatcgtggagaccatgaacatgagcaccgagcaggtccagctcgacctgctgacgctcgccgacgtgctggcggacgaggagtacgacctgctcctgaccgcccagaagatctactccgccatcatcctggacgagagcatggacgggtacgagtacttcgccgaggccaagaaggagtcctaccggaagcaccaggaggagctcgtgctggtgaagaagatgctcaagagcaacgcgatcaccaacgacgagcgcgccaagttcgagtacttctacaccgactacatcggcgccaagtccagcaactacgaggagtccaagaacatcaagaaggggctgagcgccgcctacggcaagtactccaaggaggagcggctgttcaagcacatcgagctgctcctggcgaaggagaacgtcctgacgaccgtggagcacgccctcctggagaagaacatcaccttcgccagcctgctcccgctgcagcgcagctcccggaacgccgtgatcccctaccaggtccacgagaaggagctggtggccatcctcgagaaccaggcgacctactaccccttcctgctggagcagaaggacaacatccacaagctgctcacgttccgcatcccctactacgtggggccgctggccgaccagaaggacagcgagttcgcctggatggtccgcaagcaggccggcaagatcacccccttcaacttcgaggagatggtggacatcgacgcctccagcgaggcgttcatcaagcggatgaccaacaagtgcacctacctgatccacgaggacgtgatccccaagcactccttcagctacgccaagttcgaggtcctcaacgagctgaacaagatccgcctggacggcaagcccatcgacatcccgctcaagaagcggatcttcgaggggctgttcctggagaagacgaaggtgacccagacctccctcaagaagtggctggccgagcacgagcacatgaccgtgagcgtcgtgcagggcacgcagaaggagaccgagttcgccacctccctgcaggcgttccaccgcttcgtgaagatcttcgaccgggagaccgtcagcaaccccgccaacgaggagatgttcgagaagatcatctactggtccacggtgttcgaggacaagaagatcatgcgccggaagctcagcgagtacccccagctgaccgagcagcagcaggtccagctggcccaggtgcgcttccgggggtggggccgcctctcccagcggctgatcaaccgcatcaagacccccgtgagcggcgacgaggaccacaagctgtccatcaacgagatcctctggcagaccaacgagaacttcatgcagatcatccggaacaaggactacctgttcaagaagatcatcgaggagcagttcgagaacgagacggccctgctcaacaagcagcgcatcgacgagctggccgcgagcccggccaacaagaaggggatctggcaggccatcaagatcgtcaaggagctggagaaggtgctccagcagcccgccgagaacatcttcatcgagttcgcccggtccgacgaggagagcaagcgctccacgccccgggacaagttcatcgagaaggcgtacgcccagctgaagaaggagaccgacaccttcaacctggagcacctcaaggagctgaagcagcgcagcaagcagctgagctcccagcggctgttcctgtacttcatccagaacggcaagtgcatgtacagcggggagcacctggacatcgagcgcctcgactcctacgaggtggaccacatcctgccccagagctacatcaaggacaactccatcgagaacctggccctcgtcaagaaggtggagaaccagcgcaagaaggacagcctgctgctcaactccagcatcatcaaccagaactactcccggtgggagcagctgaagaacgccggcctgatcggggagaagaagttccgcaacctcacccggaccaagatcaccgaccgcgacaaggagggcttcatcgcccggcagctggtggagacccgccagatcaccaagcacgtcacgcagctgctccagcaggagtacaaggacaccaccaaggtgttcgcgatcaaggccaccctggtgagcggcctgcggcgcaagttcgagttcatcaagaaccggaacgtcaacgactaccaccacgcccaggacgccttcctcgtggcgttcctggggacgaacatcacctccaactacccgaagatcgagatggagtacctgttcaagggctaccagcactacctcaacgaggtgggcaagagcgccgccaagcccaagttcaccttcatcgtcgagaacctgtccaagcagcagtacaacagcaccacgggggaggtgaagtggaaccccgaggtggacatcgccaagctgaagcgcatcctcaacttcaagcagtgcaacatcgtccggaaggtggaggagcagtccggggccctgttcaaggagaccatctaccccgtggaggagagctccagcaagaccatcccgctgaagaagcacctcgacaccgcgatctacggcggctacacggccgtcaactacgccagctacgccctgatccagttcaagaaggggcgcaagctgaagcgggagatcatcggcatccccctcgccgtgcagacccgcatcgacaactccgagaccagcctgcaggcgtacatcgccgagcagatcaagtccgaggtggagatcctgaacgggcggatcctcaagtaccagctgatcagcaacaacggcaaccgcctgtacatcgccgggccctccgagcggcacaacgcccgccagctcatcgtcagcgacgaggccgcgaaggtgatctggctgatctccaccaagcaggccgacgaggccatgttcctgaagtactaccggctcgagcacctggaggccgtgttcgaggagctgatccgcaagcaggcggccgactaccagatcttcgagaagctcatcaagaagatcgaggtcaacaaggtgtacttctacagctgcacgtacaacgagaaggtgaaggtcatcgaggagctgctgaagatcacccaggccaacgccaccaacggcgacctcaagctgctgaagatgtccaaccgggagggccgcctcgggagcgtgtccgtggccctggacttcaagatcatcaaccagagcgtcaccggcctgtaccagtccatcgaggactacaacaactga

SEQ ID NO: 1761 - RNA, 3930 nt, synthetic construct
  misc_feature 1..3930: note = Cas9 variant
  source 1..3930: mol_type = other RNA
atgggcagcgtggggttcgccggcatcgacaaccagtacaacctggtccgcaccaaggggaagaacgtgatcggcgtgcggctgttcgacgaggccgactccgcggccgagcgccgggggcaccgcaccaaccggcgccggctgcagcgccggcgctggcggctgcgcctcctggacgacatcttcgccaagcccctgcaggccgtcgacccgaacttcctcgcccggctgaagtacagctacgtgaacaagaaggaccagggccagcaggaccactactacggcgggtacgtgttcggctccacggcggccgaccaggcctaccaccaggcctaccccaccatctaccacctccgcaagcggctcatggaggacgaccagaagcacgacctgcgcgaggtctacctggcgatccaccacatcgtgaagtaccgggggaacttcctcaacccccagagctccctggacatcgaccagcagttcgacgtgaccgacttcgcccaggccctggcccgcttcgccgaccaccaggcgctcagctgggccctggaggcccccatccggttcctggaggccgagctcgccaccggcctgtccaacagcgcgcgcgtcgacgccgccatcgaggccttctccttcgacacgaaggtggaccgggccgcgatcaaggagatgctgaaggggctcagcggcaaccagatcgacttcaccaagctgttcgtgaacgtcgactccgccgactgggaccaggaggagcgcaagcagtggaagatgaagctgagcgaggaggacttcgacgagcaggccctcccgatcctggagcgcctgtcccaggacgagaccgagttcttcctcgccatcaagcgggcctacgacggcatcgcgctgatgcgcttcctgggggacgagcagagcctctccagcgccatgatcaaggcctacgaggaccaccggcgcgacctgaccttcctgaagacccaggtgcggacgccccagaaccgccaggccctctccgagggctacaccaactacctgagcgtggacgacaagaagcacaagcgcggggcgaaggagctggcccagctcatcgaggcctccgacgccagcgagcaggacaaggccaccatgctggaccggatcgcgaacgaccagttcgcccccaagcagcggacgaaggccaacggcctgatcccctaccagctccacctggccgagctgaagaagatcctcgccaagcagggccagtactacccgttcctgctggacaccttcgcgaagcaggggcagagcgtcaacaagatcgaggagctcgtgcagttccgcgtgccctactacgtcggccccatggtgcccaagtccgagaccgccgggaacgccgagaaccactgggtggagaagaacgacggccagaccaaggtcagcgtgacgccgtggaacttcgaccaggtgttcaaccgggaccgcgccgccaagtccttcatcgaccggctgaccgggaccgacacctacctgatcggcgagcccacgctcccccgccacagcctgacctacgagaccttcaccgtcctgaacgagctgaacaacatccggatcgacggcaagcgcctccccgtggagacgaagcaggcgatcgtcgaggacctgttcaagaagtaccggctggtgaccaagaagcgcctccaggactacttcgcctccttcgggaagcgggaggtggagctgaccggcctggccgacgagagccgcttcacctccagcctcacgtcctaccacgacctgcaggggctgctcggcaccgacttcatcaccaacccgcagaaccacagcctgctggagaagatcgtcgagatccagaccgtgttcgaggactccgacatcgccgagcgcgagctcgggaagctgggcctggagcagaagctcatcccccggctggcgaagaagcactacacgggctgggggaacctgagccgcaagctcctggacacctccttcatccacgaccccgagcggcccgaggagccggtgagcatcatggacctgctctacaccaccaacaagaacttcatggagatcctgcacgactccgagtacggcgtcgaggagtggctcaagagccagaacatgatcgacgaccagaaggacatccagatgcgcatcgacgagctgacgacctcccccgccaacaagcgggggatcaagcaggccttcaacgtgctggacgacatcacccaggccatgggcgaggagcccgcctacgtgtacctggagttcgcgcgcgagaagcaggccagccggcgcaccgtctcccggaagaagcgcctcgagaccctgtacaagaacgccgccctgaagacggagttcaaggccatcaaggaggcgctcgccgaggagagcgacgaccggatgcaggacgaccgcctgtacctgtactacgcccagctcgggcgggacatgtacaccggccagagcatctccatcgaccagctgagctcccactacgacatcgaccacatcgtgccccgcgccttcatcaaggacgacagcctggagaacaaggtgctcgtcaaccggaccgacaacgcccgcaagaccgactccgcgacgttcaccgccgacgtgaaggccaaggccttcccgctgtggcagcagctgaagaagctcggcctgatcagcgcgaagaagttccggctgctcacccgcaccggggacttcacggagatggagcgggagcgcttcatcgcccggcagctggtggagacccgccagatcatcaagaacgtcgccgccctgatcgagggccacttctcccagacccaggccgtggcgatccgcgccgaggtgaccggggagctccggcagctgacgcagatcaagaaggaccgcgacatcaacgactaccaccacgcccaggacgccctgctcgtcgccaccgcgggcacctacctgcaccggcacttccccaagcgcgacgcccggttcatctacaacgagttcgactactacacccagcactggctgaagaaccagggcgagaaccgccggcgccacccctacagcttcgtggtggggacgatgtccaagggcaacgaggactggacccccgacaacctcaactacctgcggaaggtcatgcagtacaagaccatgctgatgacccgcaagccggtggggcccgagggcgccctctacaaggagacgctgatcgccgccgaccccaagaagcggctggtgggggcgagcaaggagcgccaggacccgaccatctacggcggctacaccaaggagtccagcgcctacatgtccctcgtccgggccgggggcaagaaccagctggtgaagatccccgtgcgcatcgccaacgagatccacagcgggcagcggaagctggacgactacgtccaggccaaggtgaagaagttcgagcgcatcctcctgcccaagatctccctgggccagctcgtggaggacgaggggcagcggttctacctggcgaccaacgagatgaagcacaacgccaagcagctgtggctcgaccagaaggtcgtgacgacctacaagcgcctgaccgccgagagccccgtggaggacttcctgaccgtcttcgacgccctcacgtccagcgcgaccatccaccacttcaagttctaccagcgggacctggagctgctccgcgacaaccgcgccggcttccaggacctggccaaggccacccagctgaaggtgctcaaggacgtgctgtacgagctgcacgacaacgccggctggcgggacccgatcaagcagtacttcaaggagatcgggctcaaggtccgcatgtggaccaagctgcagaaggagggcgggatcaagctgacggaccaggcggagctcatctaccagagcccctccggcctgttcgagaagcggcgccgggtgcaggacctgctctga

SEQ ID NO: 1762 - RNA, 3939 nt, synthetic construct
  misc_feature 1..3939: note = Cas9 variant
  source 1..3939: mol_type = other RNA
atgcagaacggcttcctggggatcaccgtgagctccgagcaggtcggctgggccgtgaccaaccccaagtacgagctcgagcgcgccagccggaaggacctgtggggcgtgcgcctgttcgacaaggcggagacggccgaggaccggcgcatgttccggaccaaccgccggctcaaccagcgcaagaagaaccggatccactacctgcgcgacatcttccacgaggaggtcaaccagaaggacccgaacttcttccagcagctggacgagtccaacttctgcgaggacgaccggaccgtggagttcaacttcgacaccaacctctacaagaaccagttccccacggtgtaccacctccgcaagtacctgatggagaccaaggacaagcccgacatccggctcgtctacctggccttcagcaagttcatgaagaaccgcgggcacttcctgtacaaggggaacctcggcgaggtgatggacttcgagaactccatgaagggcttctgcgagagcctggagaagttcaacatcgacttccccaccctgtccgacgagcaggtcaaggaggtgcgggacatcctctgcgaccacaagatcgccaagaccgtgaagaagaagaacatcatcacgatcaccaaggtcaagagcaagaccgccaaggcgtggatcgggctgttctgcggctgctccgtgccggtgaaggtgctgttccaggacatcgacgaggagatcgtcaccgaccccgagaagatcagcttcgaggacgcctcctacgacgactacatcgccaacatcgagaagggggtgggcatctactacgaggccatcgtgagcgcgaagatgctgttcgactggtccatcatgaacgagatcctgggggaccaccagctgctcagcgacgccatgatcgccgagtacaacaagcaccacgacgacctgaagcgcctgcagaagatcatcaagggcacgggctcccgggagctctaccaggacatcttcatcaacgacgtcagcgggaactacgtgtgctacgtgggccacgccaagaccatgtccagcgccgaccagaagcagttctacaccttcctgaagaaccgcctgaagaacgtcaacgggatctccagcgaggacgcggagtggatcgacaccgagatcaagaacggcacgctcctgcccaagcagaccaagcgggacaacagcgtgatcccccaccagctgcagctccgcgagttcgagctgatcctggacaacatgcaggagatgtacccgttcctcaaggagaaccgggagaagctgctgaagatcttcaacttcgtgatcccctactacgtcggccccctcaagggggtggtccgcaagggcgagtccaccaactggatggtgcccaagaaggacggggtgatccacccgtggaacttcgacgagatggtcgacaaggaggccagcgccgagtgcttcatctcccgcatgaccggcaactgcagctacctgttcaacgagaaggtgctgcccaagaactccctcctgtacgagacgttcgaggtgctgaacgagctcaaccccctgaagatcaacggggagcccatcagcgtcgagctgaagcagcggatctacgagcagctgttcctgaccggcaagaaggtgaccaagaagtccctgaccaagtacctcatcaagaacggctacgacgaggacatcgagctgagcgggatcgacaacgagttccactccaacctcaagagccacatcgacttcgaggactacgacaacctgtccgacgaggaggtggagcgcatcatcctccggatcacggtcttcgaggacaagcagctgctgaaggactacctcaaccgcgagttcgtgaagctgagcgaggacgagcggaagcagatctgctccctgagctacaagggctgggggaacctctccgagatgctgctgaacggcatcaccgtgaccgacagcaacggggtcgaggtgtccgtgatggacatgctctggaacaccaacctgaacctgatgcagatcctcagcaagaagtacggctacaaggccgagatcgagcgctacaacaaggagcacgagaagaacatctacaaccgggaggacctgatggactacctgaacatcccgcccgcccagcgccggaaggtcaaccagctcatcacgatcgtgaagtccctgaagaagcgctgcggcgtgcccaacaagatcttcttcaaggtcagccgggagcaccaggacgaccccaagcgcaccagctcccggaaggagcagctgaagtacctctacaagagcctgaagtccgaggacgagaagcacctgatgaaggagctcgacgagctgaacgggcacgagctgagcaacgacaaggtgtacctctacttcctgcagaagggccgctgcatctactccgggaagaagctgaacctcagccggctgcgcaagtccaactaccagaacgacatcgactacatctacccgctgagcgcggtgaacgaccggtccatgaacaacaaggtcctcaccggcatccaggagaaccgcgccgacaagtacacctacttccccgtggaccccgagatccagaagaagatgaaggggttctggatggagctggtgctgcagggcttcatgagcaaggagaagtacttccggctctcccgcgagaacgacttcagcgagaacgagctggtctccttcatcgagcgcgagatcagcgacaaccagcagtccggccggatgatcgccagcgtgctgcagtactacttccccgagtccaagatcgtgttcgtcaaggagaagctcatcagcagcttcaagcgcgacttccacctgatctccagctacgggcacaaccacctccaggccgccaaggacgcgtacatcacgatcgtggtgggcaacgtctaccacaccaagttcaccatggacccggccatctacttcaagaaccacaagcggaaggactacgacctcaaccgcctgttcctggagaacatctcccgggacgggcagatcgcctgggagagcggcccctacggctccatccagaccgtgcgcaaggagtacgcccagaaccacatcgccgtgacgaagcgggtcgtggaggtgaagggcggcctcttcaagcagatgcccctgaagaaggggcacggggagtaccccctgaagaccaacgacccgcgcttcgggaacatcgcgcagtacggcggctacaccaacgtcaccgggagctacttcgtgctcgtggagtccatggagaagggcaagaagcggatcagcctggagtacgtccccgtgtacctgcacgagcgcctcgaggacgaccccgggcacaagctgctgaaggagtacctcgtggaccaccggaagctgaaccacccgaagatcctgctcgccaaggtccgcaagaactccctgctgaagatcgacggcttctactaccggctcaacgggcgcagcggcaacgccctgatcctgaccaacgccgtggagctcatcatggacgactggcagacgaagaccgcgaacaagatctccggctacatgaagcggcgcgccatcgacaagaaggcccgggtgtaccagaacgagttccacatccaggagctggagcagctgtacgacttctacctcgacaagctggagaacggggtctacaagaaccgcaagaacaaccaggccgagctgatccacaacgagaaggagcagttcatggagctcaagaccgaggaccagtgcgtgctgctgaccgagatcaagaagctgttcgtgtgcagccccatgcaggccgacctgacgctgatcggcgggtccaagcacaccggcatgatcgcgatgagctccaacgtcaccaaggccgacttcagcatcatcgccgaggaccccctcgggctgcggaacaaggtgatctactcccacatgggcgagaagtga

SEQ ID NO: 1763 - RNA, 3939 nt, synthetic construct
  misc_feature 1..3939: note = Cas9 variant
  source 1..3939: mol_type = other RNA
atgcagaacggcttcctggggatcaccgtgagctccgagcaggtcggctgggccgtgaccaaccccaagtacgagctcgagcgcgccagccggaaggacctgtggggcgtgcgcctgttcgacaaggcggagacggccgaggaccggcgcatgttccggaccaaccgccggctcaaccagcgcaagaagaaccggatccactacctgcgcgacatcttccacgaggaggtcaaccagaaggacccgaacttcttccagcagctggacgagtccaacttctgcgaggacgaccggaccgtggagttcaacttcgacaccaacctctacaagaaccagttccccacggtgtaccacctccgcaagtacctgatggagaccaaggacaagcccgacatccggctcgtctacctggccttcagcaagttcatgaagaaccgcgggcacttcctgtacaaggggaacctcggcgaggtgatggacttcgagaactccatgaagggcttctgcgagagcctggagaagttcaacatcgacttccccaccctgtccgacgagcaggtcaaggaggtgcgggacatcctctgcgaccacaagatcgccaagaccgtgaagaagaagaacatcatcacgatcaccaaggtcaagagcaagaccgccaaggcgtggatcgggctgttctgcggctgctccgtgccggtgaaggtgctgttccaggacatcgacgaggagatcgtcaccgaccccgagaagatcagcttcgaggacgcctcctacgacgactacatcgccaacatcgagaagggggtgggcatctactacgaggccatcgtgagcgcgaagatgctgttcgactggtccatcctgaacgagatcctgggggaccaccagctcctgagcgacgccatgatcgccgagtacaacaagcaccacgacgacctgaagcgcctccagaagatcatcaagggcacgggctcccgggagctgtaccaggacatcttcatcaacgacgtcagcgggaactacgtgtgctacgtgggccacgccaagaccatgtccagcgccgaccagaagcagttctacaccttcctgaagaaccgcctcaagaacgtcaacgggatctccagcgaggacgcggagtggatcgacaccgagatcaagaacggcacgctgctgcccaagcagaccaagcgggacaacagcgtgatcccccaccagctccagctgcgcgagttcgagctgatcctcgacaacatgcaggagatgtacccgttcctgaaggagaaccgggagaagctgctcaagatcttcaacttcgtgatcccctactacgtcggccccctgaagggggtggtccgcaagggcgagtccaccaactggatggtgcccaagaaggacggggtgatccacccgtggaacttcgacgagatggtcgacaaggaggccagcgccgagtgcttcatctcccgcatgaccggcaactgcagctacctgttcaacgagaaggtgctccccaagaactccctgctgtacgagacgttcgaggtgctcaacgagctgaaccccctgaagatcaacggggagagcatctccgtcgagctcaagcagcggatctacgagcagctgttcctgaccggcaagaaggtgaccaagaagtccctcaccaagtacctgatcaagaacggctacgacaaggacatcgagctgagcgggatcgacaacgagttccacagcaacctgaagtcccacatcgacttcgaggactacgacaacctcagcgacgaggaggtggagcagatcatcctgcgcatcacggtcttcgaggacaagcagctgctcaaggactacctgaaccgggagttcgtgaagctgtccgaggacgagcgcaagcagatctgcagcctctcctacaagggctgggggaacctgagcgagatgctgctcaacggcatcaccgtgaccgactccaacggggtcgaggtgagcgtgatggacatgctgtggaacaccaacctgaacctcatgcagatcctgtccaagaagtacggctacaaggccgagatcgagcactacaacaaggagcacgagaagacgatctacaaccgggaggacctgatggactacctcaacatcccgcccgcccagcgccggaaggtcaaccagctgatcaccatcgtcaagagcctgaagaagacctacggcgtgcccaacaagatcttcttcaaggtgagccgcgagcaccaggacgaccccaagcggacctccagccgcaaggagcagctcaagtacctgtacaagtccctcaagagcgaggacgagaagcacctgatgaaggagctggacgagctgaacgggcacgagctctccaacgacaaggtgtacctgtacttcctgcagaagggccggtgcatctacagcgggaagaagctcaacctgtcccgcctgcgcaagagcaactaccagaacgacatcgactacatctaccccctctccgcggtgaacgaccggagcatgaacaacaaggtcctgacgggcatccaggagaaccgggccgacaagtacacctacttcccggtggaccccgagatccagaagaagatgaaggggttctggatggagctggtgctccagggcttcatgtccaaggagaagtacttccgcctgagccgggagaacgacttctccgagaacgagctggtcagcttcatcgagcgcgagatctccgacaaccagcagagcggccggatgatcgcctccgtgctccagtactacttccccgagagcaagatcgtgttcgtcaaggagaagctgatcagctccttcaagcgcgacttccacctgatcagctcctacgggcacaaccacctccaggccgccaaggacgcgtacatcaccatcgtggtgggcaacgtctaccacgccaagttcaccatggaccccgccatctacttcaagaaccacaagcgcaaggactacgacctgaaccggctgttcctcgagaacatcagccgcgacgggcagatcgcctgggagtccggcccgtacggcagcatccagacggtgcggaaggagtacgcccagaaccacatcgcggtgaccaagcgcgtcgtggaggtgaagggcgggctgttcaagcagatgcccctgaagaaggggcacggcgagtaccccctcaagaccaacgacccccggttcgggaacatcgcccagtacggcggctacaccaacgtcaccgggtcctacttcgtgctggtggagagcatggagaagggcaagaagcgcatctccctggagtacgtcccggtgtacctccacgagcggctggaggacgaccccgggcacaagctgctcaaggagtacctggtggaccaccgcaagctgaaccaccccaagatcctcctggccaaggtccggaagaacagcctgctcaagatcgacggcttctactaccgcctgaacgggcggtccggcaacgccctgatcctcacgaacgcggtggagctgatcatggacgactggcagaccaagaccgccaacaagatcagcggctacatgaagcgccgggccatcgacaagaaggcccgcgtgtaccagaacgagttccacatccaggagctggagcagctctacgacttctacctggacaagctggagaacggggtctacaagaaccggaagaacaaccaggccgagctcatccacaacgagaaggagcagttcatggagctgaagaccgaggaccagtgcgtgctgctcacggagatcaagaagctgttcgtgtgctccccgatgcaggcggacctgaccctcatcggcgggagcaagcacaccggcatgatcgccatgtccagcaacgtcaccaaggccgacttcgccgtgatcgccgaggaccccctggggctgcgcaacaaggtgatctactcccacatgggcgagaagtga

SEQ ID NO: 1764 - RNA, 3942 nt, synthetic construct
  misc_feature 1..3942: note = Cas9 variant
  source 1..3942: mol_type = other RNA
atgcactacctggacgagatcttcgcgccccacctccaggaggtggacgagaacttcctgcgccggctgaagcagagcaacatccacccggaggaccccgccaagaaccaggccttcatcggcaagctcctgttccccgacctgctcaagaagaacgagcgcgggtaccccaccctgatcaagatgcgggacgagctgccggtcgagcagcgcgcccactaccccgtgaccaacatctacaagctccgggaggccatgatcaacgaggaccgccagttcgacctgcgggaggtgtacctggccgtccaccacatcatgaagtaccgcggccacttcctcaacaacgcctccgtggacaagttcaaggtggggcggatcgacttctacaagagcttcaacgtcctgaacgaggcgtacgaggagctgcagaacggcgaggggtccttcacgatcgagcccagcaaggtggagaagatcggccagctcctgctggacaccaagatgcgcaagctcaaccggcagaaggccgtggccaagctgctggaggtcaaggtggccgacaaggaggagaccaagcgcaacaagcagatcgcgaccgccatgtccaagctcgtgctgggctacaaggccgacttcgccacggtcgccatggcgaacgggaacgagtggaagatcgacctgagctccgagaccagcgaggacgagatcgagaagttccgggaggagctctccgacgcccagaacgacatcctgaccgagatcaccagcctgttctcccagatcatgctcaacgagatcgtgcccaacggcatgagcatctccgagagcatgatggaccgctactggacgcacgagcggcagctggccgaggtgaaggagtacctggccacccagccggcctccgcgcgcaaggagttcgaccaggtctacaacaagtacatcgggcaggcccccaaggagcggggcttcgacctcgagaaggggctgaagaagatcctgagcaagaaggagaactggaaggagatcgacgagctcctgaaggccggcgacttcctgcccaagcagcgcacctccgccaacggcgtgatcccccaccagatgcaccagcaggagctcgaccggatcatcgagaagcaggccaagtactacccgtggctggcgaccgagaaccccgccacgggggagcgcgaccggcaccaggccaagtacgagctggaccagctcgtgagcttccgcatcccctactacgtcggccccctggtgaccccggaggtgcagaaggccacctccggggccaagttcgcgtgggccaagcgcaaggaggacggcgagatcaccccctggaacctgtgggacaagatcgaccgggccgagagcgccgaggcgttcatcaagcgcatgacggtcaaggacacctacctcctgaacgaggacgtgctgcccgccaacagcctcctgtaccagaagtacaacgtgctgaacgagctcaacaacgtccgggtgaacggccgccggctgtccgtcgggatcaagcaggacatctacaccgagctgttcaagaagaagaagaccgtgaaggtgagcgacgtcgcctccctggtgatggccaagacgcgcggcgtgaacaagcccagcgtcgaggggctctccgacccgaagaagttcaacagcaacctggccacctacctggacctcaagtccatcgtgggcgacaaggtggacgacaaccggtaccagaccgacctggagaacatcatcgagtggcgcagcgtcttcgaggacggggagatcttcgcggacaagctgaccgaggtggagtggctcacggaccagcagcggtccgccctggtgaagaagcgctacaagggctggggccggctgagcaagaagctcctgaccgggatcgtcgacgagaacggccagcgcatcatcgacctgatgtggaacaccgaccagaacttcatgcagatcgtgaaccagcccgtgttcaaggagcagatcgaccagctcaaccagaaggccatcaccaacgacgggatgacgctgcgggagtgggtcgagtccgtgctggacggcgcctacaccagcccccagaacaagaaggccatctggcaggtcgtgcgcgtggtggaggacatcgtcaaggcggtggggaacgcccccaagtccatcagcatcgagttcgcccggaacgagggcaacaagggcgagatcacccgctcccggcgcacccagctccagaagctgttcgaggaccaggcccacgagctggtgaaggacacgagcctcaccgaggagctggagaaggccccggacctgtccgaccggtactacctctacttcacccagggcgggaaggacatgtacaccggggaccccatcaacttcgacgagatcagcacgaagtacgacatcgaccacatcctgccccagtccttcgtcaaggacgacagcctggacaaccgcgtgctcgtgagccgcgcggagaacaacaagaagtccgaccgggtccccgccaagctgtacgccgccaagatgaagccgtactggaaccagctgctcaagcagggcctgatcacccagcgcaagttcgagaacctgaccatggacgtggaccagaacatcaagtaccggagcctcgggttcgtgaagcgccagctggtcgagacccgccaggtgatcaagctgaccgcgaacatcctcggctccatgtaccaggaggccggcacggacatcatcgagacccgggccgggctgaccaagcagctgcgggaggagttcgacctccccaaggtgcgcgaggtcaacgactaccaccacgccgtggacgcctacctgaccacgttcgcgggccagtacctgaaccggcgctaccccaagctccggagcttcttcgtgtacggggagtacatgaagttcaagcacggctccgacctgaagctgcgcaacttcaacttcttccacgagctcatggagggcgacaagagccaggggaaggtcgtggaccagcagaccggcgagctgatcaccacccgggacgaggtggccaagtccttcgaccgcctgctcaacatgaagtacatgctggtcagcaaggaggtgcacgaccggtccgaccagctgtacggggccacgatcgtgaccgccaaggagagcggcaagctcacctccccgatcgagatcaagaagaagcgccccgtcgacctgtacggggcctacaccaacggcacgagcgcgttcatgaccatcatcaagttcaccggcaacaagcccaagtacaaggtgatcggggtgcccaccacgtccgccgtcggcctgaagcgggtggggaagccgggcagcgagtcctacaaccaggagctccaccgcatcatcaagagcaaccccaaggtgaagaaggacttcgagatcgtcgtgccccacgtgtcctacagccagctgatcgtcgacgacgactgcaagttcaccctggccagcgacacctaccagcaccccgccacccagctcgtgctgtccaaggagagcatggagatcatcgccgacgacttcaagttcgtcaaggagaacacggcgaccgccgacgagcagctggtgcgggtgttcgacgagatcgtcaaccagatgaaccactacttcaccatcttcgaccagcgctccaaccggcagaaggtgaccaaggcccgcgacaagttcgtgagcctcccgacggagtccgagtacgagggggccaagaagacccaggtcggcaagaccgaggtgatcaccaacctgctgatgggcctccacgcgaacagcgcccagggggacctgaaggtgctgggcctctccacgttcgggttcttccagagctccggcgggctgaacctgagcgaggacgccatgatcgtctaccagtcccccaccggcctcttcgagcgccggatctgcctgaaggacatctga

SEQ ID NO: 1765 - RNA, 3942 nt, synthetic construct
  misc_feature 1..3942: note = Cas9 variant
  source 1..3942: mol_type = other RNA
atgagcttcaaggagaactccaagatctactacggcctggacatcgggaccgacagcgtgggctggtccaccacgaacgagaagtacgagctcctgcgctacaagaacaacctgatgtggggcgtcagcctcttcgaggccgcctccctggcggaggagcggcgcgggcaccggacccagcgccggcgctacgaccggcgccagcagcgggtggccctgctcggggagctgttcgccaaggagatcctgaagaccgaccccgacttcttcctccgcctgaaggagagctccctgtacccggaggaccggaccagcaagaacgtgaacacgtacttcgacgacgccgacttcaaggactccgactacttcaagatgtaccccaccgtccaccacctcatcaaggagctgagcgagtccaacaagccccacgacgtgcgcctggtgtacctcgcctgcgcgttcatcgtcgcccaccggggccacttcctgaacggcgccgacgagaacaacgtgcaggccgtgctggacttcgacagctcctactgcgagttcaccgactggttcaagagcaacgacatcgaggacaaccccttctccgagagcgtcaagaacgagttctccgtgatcctccgcaagaagatcgggatcaccgcgaaggagcgggagatcaagaacctgctgttcggcacgaccaagaccccggactgctacaaggacgaggagtaccccatcgacatcgacgtgctcatcaagttcatcagcgggggcaagaccaacctggccaagctgttccgcaacccctcctacgacgagctcgacatccagacggtcgaggtggggaaggccgacttcgccgacaccatcgacctgctggccagcagcatggaggacaccgacgtgcccctcctgtccgcggtcaaggccatgtacgactggagcctgctcatcgacgtgctgaagggccagaagaccatctccgacgccaaggtgtgcgagtacgagcagcacaagagcgacctgaaggccctcaagtacatcgtccggaagtacctggaccgcgcccagtacgacgagatcttccggacggcgggcgagaagccgaactacgtgtcctacagctacaacgtgaccgacgtcaagctgaagcagctcccctccaacttcaagaagaagaacagcgaggagttctgcaagtacatcaagtccaagctggagaagatcaagcccgagagcgacgacgaggccgtgtacaacgagctgatcgagaagtgcaactccaagaccctctgccccaagcaggtcaccgacgagaaccgcgtgatcccgtaccagctgtactaccacgagctgagcatgatcctcgacaaggcctccgcctacctggacttcctgaacaagacggaggacgggatcagcgtgaagcagaagatcctcaccctgatgaagttccggatcccctacttcgtcggccccctggtgaagcgcaacgagaccgacaacgtgtggatcgtccgcaaggccgaggggcggatctacccctggaacttcgagaacatggtggacttcgacaagtccgaggacggcttcatccgccggatgacctgcaagtgcacgtacctcgcgggcgaggacgtgctgccgaagtacagcctgctgtactccaagtacaccgtcctcaacgagatcaacaacatcaaggtgaacggggagaagatcagccccgagctgaagcaggacatcttcaacgagctgttcatgaagacctcccgcgtgaccgtcaagaagatcacggagctcctgaagcggaagggcgccttcagcgaggagaagggggacagcctgtccggcgtggacatcaacatcaagagctccctcaagagctacctggacttccgccggctgctcgagaacgggtccctgagcgagaacgacgtggagcgcatcatcgagcggatcaccgtcaccaccgacaagccccgcctggtgtcctggctcaaggccgagtacagcgacctgcccgccgaggacatccggtacatctcccgcctgagctacaaggactacggccggctctccgccaagctgctgacgggctgctacgagctcgacaccaacaccggggagatcggcgggcgcagcatcatcgacttcatgtgggcggagaacatcaacctgatgcagatcctgtccgacagctacggctacaagtccttcatcgaggaggagaacaagaagtactacatgatcaacccgaccgggagcatcgcccagacgctccgggagatgtacgtgtcccccagcgtcagccgcgccatcatccggaccatggagatcgtgaaggagctgcgcaagatcaccaagaaggaccccgacaagatcttcgtggagatggcccggggcggcaagcccgaggagaaggggaagcgcacctccagccgccgggagcagatcgagaagctgtacgactccgcgaaggccttcgtcagcgacgaggacatctcccacatgcgcagccagctcggctccctgagcgacgagcagctgcggcgcgagaagtactacctctacttcatccagttcgggaagtgcatgtactccggcgaggccatcgacttcagccggctgggggacaaccactgctacgacatcgaccacatcttcccgcagtccaagatcaacgacgacagcctgcacaacaaggtgctcgtgaagtcccagctgaacggcgagaagtccgacgactaccccatcaaggccgagatccgcaacaagatgcaccccctgtggaagaacctcttctaccgggaccccaagaacccggccgacaaggtcaagtacgagcgcctgacccggagcacgcccttcaccgaggacgagctggcgggcttcatcgagcgccagctcgtggagacccggcagagcaccaaggccgtggccacgctgctgaaggagatgttccccgactccaagatcgtctacgtgaaggccggccaggtgagcgagttccgccacgacttcgacatgctcaagtgccgggagatcaacgacctgcaccacgccaaggacgcgtacctgaacatcgtcatcgggaacgtgcacgacgtgaagttcacctccaacccgatgaacttcgtcaagaacgccgacaagcactacaccatcaaggtgaaggagaccctcaagcacaaggtgagccgcaacggggagacggcctggaaccccgagaccgacttcgacaccgtcaagcggatgatgagcaagaactccgtgcgctacgtgcggtactgctacaagcgcaagggcggcttcttcaaccagaaccccgaccgggccgggaaccccgacctggcccgcctgaagaaggacctcgacccggtcaagtacggcgggtacaacagcaagtccatcagctgcttctccctgatcaagtgcaccggcgtgggggcggtgatcatccccgtcgagctgctctgcgagaagcggtacttcagcgacgactccttcgccagcgagtacgcctactccgtgctgaagaacgccctgcccgcgaagaacatcgccaagatcagcatcgacgacatctccttccccctcaagcgccgcccgatcaagatcaacacgctgttcgagttcgacggctaccgggtgaacatccgcagcaaggactcctaccactacttcaccatcagctccgccatggccgccatctacagcaaggacacctccgactacatcaaggcggtcagctcctacatcgacaagagcgacaagggcagcaagttcaagcccggggaggccttcgacgtgctgtccaacctcaaggtgtacgacgagatcgccaagaagtgcatcagcgagcccttctccaagatcagcaagctggccgaggccggcaagcggtggaagaaggaggagatctccctgcagaactgcctcctgtga

SEQ ID NO: 1766 - RNA, 3945 nt, synthetic construct
  misc_feature 1..3945: note = Cas9 variant
  source 1..3945: mol_type = other RNA
atgctgaagaaggactacagcatcggcctcgacatcgggaccaactccgtgggccacgccgtcgtgaccgacgactacaaggtgcccacgaagaagatgaaggtcttcggggacaccagcaagaagaccatcaagaagaacatgctgggcgtgctcctcttcaacgaggggcagaccgccgcggacacgcgcctgaagcggggcgcccgccggcgctacacccggcgcaagaaccggctgcgctacctccaggagatcttcgccccggccctggccaaggtggaccccaacttcttctaccggctggaggagtccagcctcgtcgcggaggacaagaagtacgacgtgtaccccatcttcggcaagcgcgaggaggagctgctgtaccacgacacccacaagaccatctaccacctccggtccgagctggccaacaacgaccgccccgccgacctgcggctcgtgtacctggccctggcgcacatcatcaagtaccgcgggaacttcctcctggagggcgagatcgacctgcggacgaccgacatcaacaaggtcttcgccgagttcagcgagaccctcaacgagaactccgacgagaacctggggaagctggacgtggccgacatcttcaaggacaacaccttcagcaagacgaagaagtccgaggagctcctgaagctgagcggcgccaagaagaaccagctcgcccaccagctgttcaagatgatggtggggaacatgggctccttcaagaaggtcctgggcaccgacgaggagcacaagctcagcttcgggaaggacacctacgaggacgacctgaacgacctgctcgcggaggccggcgaccagtacctggacatcttcgtggccgccaagaaggtgtacgacgccgcgatcctggcctccatcctcgacgtcaaggacacccagacgaagaccgtgttcagccaggccatgatcgagcgctacgaggagcaccagaaggacctgatcgagctgaagcgggtgttcaagaagtacctcccggagaagtgccacgacttcttctccgagcccaagatcagcgggtacgccggctacatcgacggcaaggtctccgaggaggacttctacaagtacaccaagaagaccctgaaggggatccccgagacggaggagatcctgcagaagatcgacgccaacaactacctccgcaagcagcggaccttcgacaacggcgcgatcccccaccaggtgcacctgaaggagctggtggccatcgtcgagaaccaggggaagtactacccgttcctccgcgagaacaaggacaagttcgagaagatcctgaacttccggatcccctactacgtgggccccctggcccgcgggaacagcaagttcgcctggctcacccgcgccggcgagggcaagatcaccccctacaacttcgacgagatgatcgacaaggagacgtccgcggaggacttcatcaagcggatgaccatcaacgacctgtacctgccgaccgagcccgtgctgcccaagcacagcctcctgtacgagcgctacaccatcttcaacgagctggccggggtccggtacgtgacggagaacggcgaggccaagtacttcgacgcccagaccaagcgcagcatcttcgagctgttcaagctggaccggaaggtctccgagaagatggtgatcaagcacctgaaggtggtcatgcccgcgatccgcatccaggccctcaaggggctggacaacggcaagttcaacgccagctacgggacctacaaggacctggtggacatgggcgtggccccggagctcctgaacgacgaggtcaactccgagaagtgggaggacatcatcaagaccctgacgatcttcgagggccggaagctcatcaagcgccggctggagaactaccgcgacttcctgggggaggacatcctccggaagctgagccgcaagaagtacaccggctgggggcggctgtccgccaagctcctggacggcatctacgacaagaagacccacaagaccatcctggactgcctcatgacggaggactacagccagaacttcatgcagctgatcaacgacgacacctactccttcaaggagaccatcaagaacgcccaggtgatcgagaaggaggagaccctggccaagaccgtgcaggagctccccgggagccccgccatcaagaagggcatcctgcagtccctggagatcgtcgacgagatcatcaaggtgatgggctacaagcccaagagcatcgtggtcgagatggcccgcgagacgcagaagacccacgggacccggaagcgcgaggaccgggtgcagcagatcgtgaagaacctcaaggacgccaacgagctgccgaagaagctgccctccaacgcggagctcagcgacgagcgcaagtacctgtactgcctgcagaacggccgggacatgtacaccggggcgcccctcgactacgaccacctccagttctacgacgtcgaccacatcatcccccagtccttcctgaaggacgacagcatcgagaacaaggtgctgacgatcaagaaggagaacgtgcgcaagaccaacggcctgccgtccgaggccgtcatccagaagatgggcagcttctggaagaagctgctcgacgccggggccatgaccaacaagaagtacgacaacctgcgccggaacctgcacggcgggctcaacgagaagctgaaggagcgcttcatcgagcggcagctggtggagacccgccagatcacgaagtacgtggcgcagctcctggaccagcggctgaactacgacggcaacggggtcgagctcgacgagaagatcgccatcgtgaccctgaaggcccagctggcctcccagttccgcagcgagttcaagctccggaaggtgcgcgcgctgaacaacctgcaccacgcccacgacgcctacctcaacgccgtcgtggccaacctgatcatggcgaagtaccccgagctggagcccgagttcgtgtacggcaagtaccggaagaccaagttcaagggcctcgggaaggccaccgccaagaacacgctgtacgccaacgtcctgtacttcctcaaggagaacgaggtgtaccccttctgggacaaggcccgcgacctgccgaccatcaagcggtacctgtaccgcgcccaggtgaacaaggtccggaaggcggagcgccagaccggcgggttctccgacgagatgctcgtgcccaagagcgacagcggcaagctgctgccccggaaggaggggctcgacccggtgaagtacggcggctacgccaaggccgtcgagtcctacgccgtgctgatcaccgcggacgaggtgaagaaggggaagacgaagaaggtcaagaccctggtgaacatccccatcatcgacagcaagaagtacgaggccgaccccaccgcctacctcgcctcccgcggctacaccaacgtgacgaacagcttcatcctgcccaagtactccctgctcgaggacccggaggggcggcgccggtacctggcgagcttcaaggagttccagaaggccaacgagctgatcctcccccagcacctggtcgagctgctctactgggtgaacgccaaggacggcgagcagaagctggaggaccacaaggccgagttcaaggagctgttcgacaagatcatggagttcgccgacaagtacgtggtcgcgcccaagaactccgagaagatccgccggctctacgaggagaaccaggacgccacccccatggagctggggaagaacttcgtggagctgctccgctacaccgccgacggcgccgccagcgacttcaagttcttcggcgagaacatcccgcgcaagcggtacaactccgcggggagcctgctgaacggcaccctcatctaccagtccaagacggggctgtacgagacccgcatcgacctgggcaagctctga

SEQ ID NO: 1767 - RNA, 3948 nt, synthetic construct
  misc_feature 1..3948: note = Cas9 variant
  source 1..3948: mol_type = other RNA
atgggctacagcgtggggctggacatcggcaccgggtccgtcggctgggtggtgaccaacgaggacgggaagctcgcccgcgccaagggcaagaacctgatcggcgtccggctgttcaagacggcggagcccgccgccgaccgccggaccaaccgcaccacccggcgccggctcagccgccggaagtggcgcctgcggctgctcgacgagctgttcgccaacgagctggggaagatcgactccaacttcctcacgcgcctgaagtacagctacgtgcacccgaaggacgacgccaaccgggcgaactactacggcgggtacctgttccccacccaggaggagaccaagaagttccacgccaagtaccccaccatctaccacctccgcctggccctgatgacggagtcccggcagttcgacctccgcgagatctacctggccatgcaccagatcgtgaagtaccggggccacttcctgaacagccagtccaagatgaccatcgggaacacctacaacccccaggacctccagaccgcgatggagaactacgccgaggccaagggcctgagcatcgagctgaagcagccggaggagatggtcgccatcctcacgggcgaggccgggttcggcctgtccaagaaggcgaaggccgagaagctgctcaacaacttcttcttcgacaccaaggaggagaaggccaccgtgcaggccatcctggccgggatcgtgggcaacaccatcgacttcacgaaggtcttcaaccgccagctgaccggcgacaccctcaaggcgtggaagctgaagctggacagcgagaccttcgacgtggactccgagcccatcctcagcgacctggacgacgacgagacggagctgttcttcgccatccggcaggccttcgacgggttcaccctcatgaacctgctgggcgaccagacctccatcagcgccgccatggtggagcgctacacccagcaccacgacgacctcctgacggtcaagcaggtcgcgaagaagcaggggctgtcccacaaggagttcagcaacatctactccgccttcctcaaggacgacaccgacaagggcatgaagaagctgctggaggagagcaacctctccaccgaggacgtgaacgggatccagctgcggatggacagccacgacttcctgccccagcagcgcaccaaggccaacagcgtgatcccccaccagctccacctggccgagctggaggccatcatcgagaaccagggccagtactacccgttcctcctggagacgttcgagaaggagggcaccgcggccaacaagatcgccgagctgctgaagttccgcatcccctactacgtggggcccatggtgaccaagaaggacgtcgagaacgccggcggggacgcgaccaaccactgggtgacgcggaacgagggctacgagaagtccgccgtgaccgcctggaacttcgaccaggtcttcaaccgcgaccaggccgccctcgacttcatccagcggctgaccgggaccgacacgtacctgatcggcgagcccaccctcccgcagaacagcctgaagtaccagatgttcaccgtgctgaacgagctcaacaacgtgaaggtcaacggccgccggatcgacaaccagaccaagcacgacctgatccaggacctgttcaagtccaagaagaccgtgagcctcaaggcgttccaggactactaccagtcccagggcaagagcgacatccaggtcgtggggctggccgacaagacgaagttcaactccaacctgagcacctacatcgacctctccaagaccttcagcgccgaggagatggagaacccccagaaccaggacctgctggagcagatcgtggagatccagaccgtcttcgaggactccaagatcgccgagcgcgagctcagcaagctggagctgacgcccgagcaggtcaccaagctcgccaagacccactacaccgggtggggcaacctgtccaacaagctgctcacgacccccatcgtggacgtgagcgggaagaaggtgtccatcctggaccagctggcgaagaccagcaagaacttcatgtccatcatcagcaacgagcagtacggcgtgcaggactggatcaaggagcagaacaccacggagaccaccggcaccctcgaggacaagctggccgacctgacgacctccccggccaacaagcgggggatcaagcaggccttcaacgtcctcttcgacatccagaaggccatgaagtccgagcccgaccgcgtgtacctggagttcgcgcgggagacccagaccagcgtgcgcacgatgagccggtacaactacctgaagggcctctaccagagcaagtccctggacgccgaggccaagaacctgaagaaggagctcgccgagaccgaccagaagaagttcgacaacgaccgcctgtacctgtacttccagcagcaggggaaggacatgtacaccggccagcccatcaacatcgacaagctcagctccgactacgacatcgaccacatcatcccccaggcgttcaccaaggacgacagcatcgacaaccgggtcctggtgtcccgcccggagaacgcccgcaagagcgactccggcacgtacaccaccgaggtgcaggccgccgccagcgggctgtggaagaccctcgtccagtccggcttcatcagccggaagaagtacgaccggctgacgcacgcgggggactactccgagggccagaagaccgggttcatcgcccgccagctggtggagacccggcagatcatcaagaacgtggccgccctcatcgagagcgagttcgaccagacccaggccgtcgcgatccgcgccgagatcacgggcgacatgcgccggctggtggccatcaagaagcaccgcgagatcaactccttccaccacgccttcgacgccctgctcatcaccgcggccggccagtacatgcagaagcggtaccccgaccgcgacagcaacaacgtgtacaacgagttcgaccggtacaccaacgactacctgaagaagctgcgcgagtccagcagcaaggacgaggtccggaagctcaagcccttcgggttcatcgtgggcaccatggccaaggggaacgaggactggacgaccgagcagaccgagtacctgcgccacatcatgaacttcaagaacatcctgaccacctacaagacgggccccgaccgggggccgctctccaaggagaccatctacgccgtggaccccaaggcgaagctgatcggcaccaacaagcaccgccaggacgtcagcctgtacggcgggtacacctacccctactccgcctacatgacgctcgtgcgggccaacggcaagaaccagctggtgaaggtcagccgctccgccgccagcctgatgaagtccgggcagctcaagctggaggactacgtgcagcagcagcccgaggtgaagaagttcgagaagatcctgctcgagcacctcccgctgggccagctggtcgacaacgacgggaagctgatgtacctgaccagctacgagttctaccacaacgcgaagcagctctggctgtccaccgagaacgccgacctgatcagctccctcagcatcgactccgacgaccagaagctgatcaaggccttcgacatcctgaccgccgacagcgtgatcgagcggttccccttctacgagatcgacctcaagaagctgatcgagctgcgcgacaagttcgtgctcatcgacaacaagctggacgtcctgcgggtggtgctcaaggccctgcagctggactccgcgcagcagaagcccctcaagctgatcgacaaggccgccacggactggaagaactaccgccaggccggcggcatcaagctgagcgacaacgccgagatcatctaccagtccaccaccgggatcttcgagaagcggatcaagatcagcgacctcctgtga

SEQ ID NO: 1768 - RNA, 3951 nt, synthetic construct
  misc_feature 1..3951: note = Cas9 variant
  source 1..3951: mol_type = other RNA
atgctgcagaagaactacaccatcggcctcgacatcgggaccaacagcgtgggctacgccgtcatcaacgacaactacaaggtgcccgccaagaagatgaaggtgctggggaacacggacaagaagaccatcaagaagaacctgatgggcgtcctcctgttcgacgcgggggagaccgccgccaccacgcgcctgaagcggggcacccgccggcgctacacccggcgccggaaccgcctccggtacctgcaggagatcctgggcccggagctcgccaaggtggacgccaacttcctgcaccgcctggcggagtccagcctcgtgaccgaggacaaggagttctccgcctaccccatcttcggggaccgggaggaggagctgctgtaccacaagacgtacaagaccatctaccacctccgcagcgccctggccaacaaggacgagaaggcggacctgcggctcatctacctggccctggcccacatcatcaagtaccgcggcaacttcctcatcgagggggagatcgagctgtccgacaccgacatcgacaaggtctacgccgacttctgccggagcttcaacgagctgttcgacaccgaggtgctccaggagatcgaggtggaggccatcttcaaggacaagacgctgtccaagaccaagaaggcggaggagctggtcaaggtgagcggcgtgaagaagaaccaggtcgcccaccagttcctcaagatgatggtggggaacaccgtgaacttcaagaaggtcttcaacctgaccgaggaccagaagctgtccttcggcacggacagctacgaggacgagctcaacgacctgctggccaagtccgacgaccgctacctcgacgtgttcgtggccgccaagaaggtctacgacaccgcgatcctggccaacatcctgaacaccaagaacagcgtggccaccaagacgatcttctcccagagcatgatcgagcggttcaaggaccaccagaaggacctcaaggagctgaagcagctgttcaagacctacctccccgagaagtaccccgacttcttcggcaactccaaggaggacgggtacgccggctacatcgaggggaagaccaacgaggagaagttctacacccacacgaagaagatcctgaagaacatcccgcaggccgcgagcgtgctggcccagatcgacgtcggcaactacctccgcaagcagcggaccttcgacaacggcgtgatcccccaccagatccagctgaaggagctgctcgccatcatcgagaaccaggggaagtactaccccttcctgctggagaacaaggagaagatcgccaagatcctcaccttccgcatcccctactacgtgggcccgctggcccgggggaactcccgcttcgcgtggctgaagcgcgtcggcaaggagaagatcacccccttcaacttcgagaacgtggtcgacctggagagctccgccgagcggttcatcgagcgcatgacgctcaacgacctgtacctgcccgaggagaaggtgctccccaagcacagcatgctgtacgagaagttcagcatcttcaacgagctggccgggatccggtacatcaccgacaacggcgagatgaagttcctcgacgcccagaccaagcagtccatcttcgagctgttcaagcaggagcgcaccgtgaaggagaagaaggtcctggacctcctgaagacgctgatgccgagcgagcgggtggtggcgatcaagggcatcgacaacgggaagttcaacgcctccttcggcacctaccacgacctcagcaagatggggttcaagaccgagaagatcgcctccgagagcaaccaggcccgctgggaggagatcatcaagaccctgacgatcttcgaggaccggaagctgatcaagtcccgcctccggaagtacgacgacttcctgaacgagaaggagatcggcgccctgagcaagcgcaagtacaccgggtggggccggctctccgcgaagctgatcgacggcatctacgacaagaagacccaccagaccatcctggacttcctcatgaacgaggactacaaccagaacttcatgcagctgatcagcaacgacaactactccttcaagaagatcatcgaggacagccaggtcatcaaggaggaggggtccctgaccgaggtgatccaggagctccccggcagccccgccatcaagaaggggatcctgcagtccatcgagatcgtggacgagctggtcaaggtgatgggcgggaaccccaagaagatcgtggtcgagatggcccgcgagacgcagaagacccacggcaccacccggcgcgaggcccggatcaaggagatcatcaagaacctcaacaagctgaagctgaacgagctcccgaaggacctgcccagcaacgaggagctgtccgacgagaaggtgtacctctactgcctgcagaacggccgcgacatgtacacgggggcgcccctggacctcgacaacctgagccagtacgaggtggaccacatcatcccccagtccttcctgaaggacgacagcatcgagaacaaggtcctcaccgccaagatcgagaacagccggaagaccaacggcctgccgtccgtggagatcgccaagaagatgggggccttctggcgcagcctgctcaaggtgggcgccatctccgagaagaagtaccggaacctgcgccgcagcctgcacggcgggatgaccgagaagctcaaggagacgttcgtcaagcggcagctggtggagacccgccagatcaccaagtacgtggcccagatcctgaactcccggttcaacgaggagaagaacgaggacaaggtcgcgatcgtgaccctcaaggcccagctgacgagccagttccgcaaggacttcgagctgtacaaggtgcgggagatcaacaacctccaccacgcccacgacgcctacctgaacgcggtcctggccaccctcctgatgacctccttccccgagctggagcccgagttcgtgtacggcaagtaccgcaagaccaagttcaaggggctcggcaaggccacggccaagaacaacctgtacaccaacatcctgcagctcctgaaggaggagagcgcccagtactgggacaccaaggagcgggacctggcgaccatcaagaagaacgtgtaccaggcccaggtcaacaaggtgcgcaaggtggagcggcagacggggtccttctacgacgagaccgtcgccaagaagtccgccagccagaagctgttcccccgcaagaacggcctggacccggtgaagtacggcgggtaccagcgggccaacgagggctacagcctcctcttccgcgcggacatgctgaacaagcgggggaagaccaagtccgtgaagaccctggtcaagatccccatcatcgagagcgcccagtacctcgccgaccccacggagtacctggccaagcgcggctactacaacgtgtccgagcacagcctgctcctgcccaagttctccctgctcgagaacaacaacgggctgcggcgctacctggccagcagcaacgagttccagaaggcgaacgagctcatcctgccgaagcacctggtgcggctcctgtactggtcccagagcaagcagcgcaaggaggagctgaacaagcaccgggccgagttcgccgagctgttcacctacatcatggacttcgccgacaagtacgtcgtggcgcccaagaactccgagaagatcaagaacatctacgagaacaacaaggacagctccgtggaggtcctcggcaagaacttcatcgagctgctcaagtacaccgccgacggcgccgccagcgacttcaccttcttcgacacgaagatcccccgcaagcggtacaactccgccggggacctgctggacggcaccctcatctaccagagcaagaccgggctgtacgagacccgcatcgacctgggcgcgatctga

SEQ ID NO: 1769 - RNA, 3957 nt, synthetic construct
  misc_feature 1..3957: note = Cas9 variant
  source 1..3957: mol_type = other RNA
atgatgatcaagctgaacaacatgaagaagatcctcggcctggacctggggaccaacagcatcggctgggccgtggtcgagaccgaggacaacaagaagttcgagctcctggacaagggggtgcgcatcttccaggagggcgtgaagatcgagaaggggatcgagtccagcaaggccgcggagcggacgggctaccgctccgcccggcgcatcaagttccggcgccggctgcgcaagatcgagaccctcaaggtcctgatcgagaacaacatgtgccccctgagcatggacgagctcatcgtgtggaaggagaacaagaacaactacccgaagaacaagatcttctacaactggctgaagaccaaggaccccaaggagggcaccaacgggacgtacatcaacccctactacttccggaccgaggccatcaagcgcaagctggagaacaccaacgacgtgggccgggccctctaccacctggcccagcgccgggggttcaagtccaaccgcctggagagcaccgacgagaagtcccggggcatcgtcaagacggagatcaacaagctcagctccgagctgaacgggcgctacctgggcgagtacttctacgagctctacctgaagggcgagaagatccggaagcgccacatcagccgggaggagcactacctgaacgagttcaagaagatctgcgaggtgcagaacttcaacaaggagctcgcggagaagctggagcgcgccatcttctaccagcggcccctgaagtcccagaaggggctcgtgggcaagtgcaccctgcagaacaacaagcaccgctgcccgatcagccgccccgagttcgaggagttccggatgtggcagttcatcaactccatcaagtacaagaacagcgacgggaagttcgacttcctgaacaaggagcagcgcgagaacatcatccccgccttcgtctccaacaagaacgccaccttcgagttcagcaagatcgagaagatcctcaacaagggcgtgcacatctaccagttcaactacaagtccaaccacaccatcggcagcaaccagacgatgatcaacttcatggacgtgttcgacatcgaccggaagctgaccaacgcgtggctgctctgcgtcaacaagatctacgagctgtacaccgccaagaccaagaaggacgggtccctcaagagcaagagcgaggtgatcacggacgtgtggcacgtcctgttcaccttcgacaacgaggagaacctgaaggagttcgcccgcaacaagctgctcctggacgagtccagcgcccagaagttctccaagatcaacctgaagcaggactacagccagctctccctgaaggccatcaacaagatcctgccctacctccaggagggcctgatctacagctacgcggtgttcatcgccaacatcgagaacgtgatcgggaagtccatctggaacatcaaggagaaccagcagatcatccggaccagcatcaagaagatcatcgacaaccacaagaccgagctggacatcaacacgatcaccaactccctcatcaacgacttcaaggtcaactacaacaacgcccacaaggagtacaaggtggacgacatcgacctgaagaacatccgcgagaagatcatcaagtactacggcaacaagacctggaactgcctgccggaggacgagaagctctacgtgaaggagaaggtcgagaagctgtacgagaagcagctcaagagcgggaagcggggcatcttcatcgagaagatccgcctggacgaccggatcgagaacttcctgaaggacaacttcgactccagcgagctgaacctgaagaagctctaccacccctccgacgtgagcgtgtacaagtccgtcaagatcaccgacctgggcctgcgcctcctggggagccccatgatcccctccatcaagaacccgatggccatgcgggccatgcaccagctgcgcaagctcatcaaccacctgatcatcgagggcgtgatcgacgacagcacgatcatcaacgtcgagatgtcccgggagctgaacgacgcgaacatgcgcaaggccatcgagcggtaccagcgccagcgggccaccgagaacgaggagttcaagaccaagatcaaggagctctacaagaaggagtgcgggaccgacttcgagcccaacaacgacgacatcatgaagtaccgcctgtgggaggagcagaaccacaagtgcctgtacacgggcaagagcatcgggatctgcgacttcatcggcagcaaccccgccttcgagatcgagcacaccatcccccggtccctcagctacgacaactccctggagaacaagaccctgtgcgagaaggagttcaaccagcaggtcaagaagaaccgcatcccgttcgagctcagcaactacaaggagatcatctcccgcatcaacaactgggagatcaaggccgaggagctgttcaagcagatccagaaggtgaagatccagagccggatggcggccaccaaggagatcaaggacaacgccatccagcgcaagcacctcctgcagatggagttcaactactggaacggcaagctgtcccggttcacgcgcgaggacgtgcccgaggggttcaagaacagccagctggtggacatcggcatcatcaccaagtacgcccgggcctacctcaagaccgtgttcaacaacgtcaacaccgtgaaggggtccacggtggcggagttccgcaacatctggggcctgcaggagtacttcgagaagaaggaccggagcaaccacatccaccactgcatcgacgccatcaccatcgcctgcctgaccaaggacaagtacgacttcctcgcccacctgtaccacctggacgagcagaacaaccgcgacgcggtccaccgggccatgatcaagtccaagccctgggagaacttcgtgcaggacgtgaaggagatcgagaaccagatcctcgtcagccactacacccccgacaacctgccgaagcagtccaagaagatcctgcgcaagcgggggaagatccagaagaacgagaacggcgacctcatctacgagaagggcgacgccgtgcgcgggagcctgcacaaggagtccttctacggcgccatcaagcgggagatcatcaacaagaagggggagaccgaggagaaggtgctgtacgtcaagcgcaagcccctcgagttcagcgacctgggcttcaagacgatctccgagctggagaacatcgtggacgacgccgtgcgggacaaggtcctcaacgcggtgaaggacaagggcctgaagcaggccctgaacgagcccatctggatgaacgaggagaagcagatccccatcaagaaggtgcgctgctacaccccgagcgtcaccaaccccatcaacctcaagaagcaccgggacaagagcaagcacgagtacaagcagtcctaccacgtgaccaacgacgggaactacctgatggtgatctacgagggcaaggacagccaggagaaggtcaagcgcgactacgagatcgtgtccaacctgcaggccggggagtacttcaagcagagcgtgcacggcgtcctcaaggcccaggggatcaacaacctggagggcctgatccccaagttcaaggagtccggcaagaacatcctccccctgaagtacatcctgaagacggggaccatggtgatcttctgggagaactacccggaggagatctgggacatcgacaagaaccagctctacaagcggctgttcaaggtgacccagttcgagagcgacggccgcatccaggcccggttccaccagatcgcgaagcccgacaacgagctgaccaaggtctccgagctcgacttcagcaacatcgccgagaagatccgcctgtccaaggggaacctgaacatgctcgtgaacggctacgacttcaagatcaacgtgctggggcacatcgagaagctgagctga

SEQ ID NO: 1770 - RNA, 3957 nt, synthetic construct
  misc_feature 1..3957: note = Cas9 variant
  source 1..3957: mol_type = other RNA
atgggcagcaacatgctgaagaaggactactccatcgggctcgacatcggcaccaacagcgtggggcacgccgtcgtgaccgacgactacaaggtgcccacgaagaagatgaaggtcttcggcgacacctccaagaagaccatcaagaagaacatgctgggggtgctgctgttcaacgagggccagaccgccgcggacacgcgcctgaagcggggcacccgccggcgctacacccggcgcaagaaccggctgcgctacctccaggagatcttcgccccggagctggccaaggtggaccccaacttcctgtaccggctcgaggagagctccctggtcgccgaggacaagaagtacgacgtgtaccccatcttcgggaagcgcgaggaggagctgctctaccacgacacctacaagacgatctaccacctccggagcgccctggcgaacaacgaccagcccgccgacctccgcctggtgtacctggccctcgcccacatcatcaagtaccggggcaacttcctgctggagggggagatcgacctccgcaccaccgacatcaacaaggtcttcgcggagttctccgagaccctgaacgagaacagcgacgagaacctgggcaagctcgacgtggccgacatcttcaagaacaacacgttctccaagaccaagaagtccgaggagctgctgaagctcagcggggccaagaagaaccagctggcccaccagctgttcaagatgatggtgggcaacatgggcagcttcaagaaggtcctcgggaccgacgaggagcacaagctgtccttcggcaaggacacctacgaggacgacctgaacgacctcctggccgaggcgggggaccagtacctggacatcttcgtggccgccaagaaggtgtacgacgccgccatcctcgcgagcatcctggacgtcaaggacacgcagaccaagaccgtgttctcccaggccatgatcgagcggtacgaggagcaccagaaggacctgatcgagctcaagcgcgtgttcaagaagtacctgccggagaagtgccacgacttcttcagcgagcccaagatctccggctacgccggctacatcgacgggaaggtcagcgaggaggacttctacaagtacaccaagaagacgctgaagggcatccccgagaccgaggagatcctccagaagatcgacgccaacaactacctgcggaagcagcgcaccttcgacaacggggccatcccccaccaggtgcacctgaaggagctcgtggcgatcgtcgagaaccagggcaagtactacccgttcctgcgggagaacaaggacaagttcgagaagatcctgaacttccgcatcccctactacgtggggcccctcgcccggggcaactccaagttcgcctggctgacccgcgccggcgaggggaagatcacgccctacaacttcgacgagatgatcgacaaggagaccagcgccgaggacttcatcaagcacatgaccatcaacgacctgtacctgccgaccgagcccgtgctccccaagcacagcctgctgtacgagcgctacacgatcttcaacgagctcgcgggcgtccggtacgtgaccgagaacggggaggccaagtacttcgacgcccagaccaagcgctccatcttcgagctgttcaagctggaccggaaggtcagcgagaagatggtgatcaagcacctcaaggtggtcatgcccgccatccgcatccaggcgctgaagggcctggacaacgggaagttcaacgcctcctacggcacctacaaggacctcgtggacatgggcgtggccccggagctgctgaacgacgaggtcaacagcgagaagtgggaggacatcatcaagacgctcaccatcttcgaggggcggaagctgatcaagcgccggctggagaactaccgcgacttcctcggcgaggacatcctgcggaagctgtcccgcaagaagtacaccgggtggggccggctcagcgccaagctgctggacgggatctacgacaagaagacccacaagacgatcctcgactgcctgatgaccgaggactactcccagaacttcatgcagctgatcaacgacgacaactacagcttcaaggagaccatcaagaacgcccaggtgatcgagaaggaggagaccctcgcgaagaccgtgcaggagctgcccggctcccccgccatcaagaagggcatcctgcagagcctcgagatcgtcgacgagatcatcaaggtgatggggtacaagcccaagtccatcgtggtcgagatggcccgcgagacgcagaagacccacggcacccggaagcgcgaggaccgggtgcagcagatcgtggagaacctgaaggacgccaacgagctgccggagaagctccccagcaacgccgagctgtccgacgagcgcaagtacctgtactgcctccagaacgggcgggacatgtacaccggcgcgcccctggactacgaccacctccagttctacgacgtcgaccacatcatcccccagagcttcctcaaggacgactccatcgagaacaaggtgctgacgatcaagaaggagaacgtgcgcaagaccaacggcctgccgagcgaggccgtcatccagaagatggggtccttctggaagaagctcctggacgccggcgccatgaccaacaagaagtacgacaacctgcggcgcaacctccacgggggcctgaacgagaagctgaaggagcgcttcatcgagcggcagctcgtggagacccgccagatcacgaagtacgtggcccagctgctggaccagcggctcaactacgacgggaacggcgtcgagctggacgagaagatcgcgatcgtgaccctgaaggcccagctcgccagccagttccgctccgagttcaagctgcggaaggtgcgcgccctgaacaacctccaccacgcgcacgacgcctacctgaacgccatcgtcgccaacctgatcatggccaagtaccccgagctcgagcccgagttcgtgtacggcaagtaccggaaggcgaagttcaaggggctgggcaaggccaccgccaagaacaccctgtacgccaacgtgctctacttcctgaaggagaacgaggtctaccccttctgggacaaggcccgcgacctgccgacgatcaagcggtacctctaccgcgcccaggtgaacaaggtgcggaaggcggagcgccagatcgggggcttcagcgacgagatgctggtccccaagagcgactccgggaagctgctcccccggaaggagggcctggacccggtgaagtacggcgggtacgccaaggccgtggagagctacgccgtcctgatcaccgcggacgaggtgaagaagggcaagaccaagaaggtgaagaccctcgtcaacatccccatcatcgactccaagaagtacgaggccgaccccacggcctacctggccagccgcgggtacaccaacgtgaccaactccttcatcctgcccaagtacagcctcctggaggacccggagggccggcgccggtacctggcgtccttcaaggagttccagaaggccaacgagctcatcctgccccagcacctggtggagctcctgtactgggtcaacgccaaggacggggagcagaagctggaggaccacaaggccgagttcaaggagctgttcgacaagatcatggagttcgccgacaagtacgtggtggcgcccaagaacagcgagaagatccgccggctgtacgaggagaaccaggacgccacccccatggagctgggcaagaacttcgtcgagctcctgcgctacacggccgacggcgccgcctccgacttcaagttcttcggggagaacatcccgcggaagcgctacaacagcgcgggctccctgctcaacgggaccctgatctaccagagcaagaccggcctgtacgagacccgcatcgacctcgggaagctgtga

SEQ ID NO: 1771 - RNA, 3960 nt, synthetic construct
  misc_feature 1..3960: note = Cas9 variant
  source 1..3960: mol_type = other RNA
atgttcagccagcgcaacaacccctactgcgagctcctgttcaagatcatcgtgaccaacatcgaggagaagaacctggaggtcatcatgggcatccggaactccgacatcttcttcatcagcaacttcatgtggtaccagaagctgatcatgatgatcaagaacatcctcgggctggacctgggcaccaactccatcgggtgggccctcatcgaggtggacgagaacaacatcccgatccgcatcatcgccatgggcagccggatcatccccctgtccacgagcgacaaggaggagttccagcgcgggctgtccatcaccaagaaccagaaccggaccgtgagccgcacccagcggaagggctacgaccgcaagcagctccggcgctccgacctgaagaagatcctgaagaagtacaacatcttccccagcgaggagctcctgaagctgcccatgctcgacctgtggaagctgcggtccgacagcgcgaacccgaacgaggacatctccgccgagcagctcggccgcatcctgtacatgctgaaccagaagcgggggtacaagagcgcccgctccgaggccaacagcgacaagaaggacacggactacgtccaggccgtgaagggccggtacgcgcagctcaaggaccgccggcagaccatcgggcagtacttctacgaggagctgtccaccgccttcagcgacaagaacaaccagcagtacttccgcgtgaaggaggaggtctacccccgggaggcctacatcgaggagttcgacaccatcatcaacgcccagaaggacaagcacggcttcctgacggacaaggtgatccaccagctccgcaacgagatcatctacttccagcggaagctgaagtcccagaaggggctggtgagcatctgcgagctcgagggcttcgagaagaccgtctacgacaaggagaagaacaagaacaaggtggtgttcgtcggccccaaggtggcgcccaagaccagcccgctgttccagctgtgccgcatctgggaggtggtcaacaccatctccctcaagatcaagaaccccgaggggagcaagtacaagtggggcgagaaggtgcccaacctgaagcagaaggagatcctggccgactacctcttcaagaacgagaacctgtccttcagcacgctgctcgagatcctggagctgaagaaggaggacgtgtacgtcaacaagcagatcctcaaggggatcaagggcaacgaggcctacgccgccctgcacaacgtgctgggcgaccacgagctcctgaacttcgacgtgtccatcatcaccagcgaccacaccgcgatcctggtcgacaagaagaccggggagatcctcgaggagcgcgccggcctggagctggacgcctccctcgagcgggagcccctgtaccagttctggcacacgatctacagcctgaaggacctggacgagtgcaagaacgccctcatcaagcgcttcgggctggacgaggacatcgccgagaagctgtcccacatcgacttcaacaagcaggcgttcggcagcaagtccaacaagagcatgcggaagatcctcccgttcctgatggaggggtacaactactccgagagctgctccctggccggctacaaccacagcaactccctcaccaaggacgagcgcgagagccagatcaccctggagcggctggagctcctgcccaagaacaacctgcgccagcccatcgtggagaagatcctcaaccagatgatcaacgtggtcaacaccatcctggagaagtacggcaagccctccgagatccgggtggagctggcccgcgagctcaagcagagcaaggacgagcggaacgacacggacctgcagaacagccgcaacaagaagctgaacgaggagatcgggaagcggctcgccgagctgggcctgccggtcaccaagcgctacatccagaagtacaagttcatcttcccctccctcagcaagaacctgaaggacgcccacgtgaacaaccagtgcatctactgcggggagaccttcaacctgaccgaggcgctcaacggcgacgcctacgacgtggaccacatcgtccccaaggccctgctgttcgacgactcccagacgaacaaggtgctcgtgcaccggaagtgcaacagcaccaagaccaaccagaccgcctacgactacatcacggccaagggggaggaggaggtccgcatctactccgagcgggtggacgactggttcaagaagggcatcatcagctactccaagatgcagcgcctgaaggtgagccacaaggagtacctggagcggaagaagctcggcaaggagaccgagaccgacaagaagctgtgggagaacttcatcgaccgccagctgcgggacacccagtacatctcccgcaagagccgcgagatcctccagaaggtctgcaacaacgtgacgaccaccgagggcggggtgaccgcgaagctgcggaacctgtgggggtgggacgacatcctcatgaacctgcagatgcccaagtacaaggagctgggccagacgatcaccaaggagtggacctccgagcacgggaagcgcaagcaccagaaggaggagatcgagaactggaccaagcgggacgaccaccgccaccacgccatcgacgccctcgtcgtggcctgcaccaagcagggcttcatccagcggatcaacacgctgaacagctccgagaccaaggacctgatgatcaaggaggtggaggaggcgaagatcgagttcaacgagaagaccaccctcctggagaagtacctgaagacgcagaagccgttcaccacccgcgaggtcatgaaggaggccgacaagatcctcatcagcttcaaggccggcaagaaggtggccaccatcacgaagttcaaggccaccgggaagaacaaggagaccggcgtgatcgtcccccgcggggcgctgcacgagcagtccgtgtacggcaagatcaaggtgatcgagaaggacaagcccctgaagtacctcttcgagaaccccgacaagatcgtcaacagccggatccgggacctggtggagacccgcctgtccgagaacgagaacaacagcaagaaggccctcagcacggtgaagaagaacccgatcttcttcaacgaggagaagaacgagatcctggagaaggcctcctgctacaacgacgccaccgtcctgaagtacaagctccagaacctgaaggccaaccaggtggacgacatcgtggacgagcgggtcaagttcctggtgaaggagcgcctcacccagttcggcagcaaggagaaggaggcgttcaaggacatcctgtggttcaaccaggagaagcagatccccatcatcaccgtgcggctgttcgcccgccccgacgccaacaacctccagatcatcaagaaggacaagaacgggaaggacatcggcttcgtcctgacggggaacaaccaccacatcgccatctacgaggacaaggactccaagctggtgcagcacagctgcgccttctggcacgcggtggagcggaagaagtacaacatccccgccgtcatcaagaactccgccgacgtgtggagcctcctgctggacaaggagctcccggtgctgttcctggacaagctccccgccgacgagctgaacctgaagttctccatgcagcagaacgagatgttcatcctcggcctgagccaggaggggttcgacgaggcgatcaagaacaacgacaagtccctgctcagcaagcacctgtacctggtctggtccatcagcaacaacgactactacttccgccaccacctcgagaccaagaacaccgagctgaagaacatccccaccgccaaggactccaagcggtacttccgcttcaagagcgtgggcgccctggtgggcatcaacccgatcaaggtccggctcaaccacctgggggagatcacgaagatcggcgagtga

SEQ ID NO: 1772 - RNA, 3960 nt, synthetic construct
  misc_feature 1..3960: note = Cas9 variant
  source 1..3960: mol_type = other RNA
atgggctacaacatcgggctggacatcggcaccgggagcgtgggctgggccgccctcaccgacgaggggaagctggcgcgcgccaagggcaagaacctgatcggcgtccgcctcttcgactccgcccagagcgccgcccagcggcggtcctaccgcacgacccggcgccggctgagccgccggaagtggcgcctgcggctcctggagaacatcttctccgacgagatggggatgatcgacgagaacttcttcgcgcgcctgaagtacagctacgtgcaccccaaggacgaggtgaacaacgcccactactacggcgggtacctcttcccgacccagcaggagacccacgacttccacgagaagttccagacgatctaccacctccggctgaagctcatgatcgaggactgcaagttcgacctgcgcgagatctacctggccatgcaccacatcgtcaagtaccggggccacttcctcaactcccagagcaagatgaccatcggggactcctacaacccccgcgacttccagcaggccatccagaactacgcggaggccaagggcctgatctggagcctgaacgacgcccaggagatgaccgacgtgctcgtgggccaggccgggttcggcctgtccaagaaggccaaggcggagcggctgctcagcgccttctccttcgacaccaaggaggacaagaaggccatccaggccatcctggccgggatcgtcggcaacacgaccgacttcaccaagatcttcaaccgcgagcggagcggcgacgagctgaagaagtggaagctcaagctggactccgaggcgttcgacgagcagagccaggccatcgtggacgagctggacgacgacgagatggagctgttcaacgccatccgccaggccttcgacgggttcaccctgatggacctgctcggcgaccagacgtccatcagcgccgcgatggtgaagcggtaccagcagcaccacgacgacctgaagatggtcaaggagatcgccaagaagcaggggctgtcccaccaggacttcagcaagatctacaccgccttcctcaaggacgacaccgacaagggcatgaaggccctgctggacaaggccgacctcgcggacgacgtgctggtggagatccagcagcgcatcgagagccacgacttcctgcccaagcagcgcaccaaggccaactccgtcatcccctaccagctccacctggccgagctggagaagatcatcgagaaccaggggaagtactacccgttcctcctggacacgttcaccaacaaggccggcgagaccatcaacaagctggtggagctcgtgaagttccgggtcccctactacgtgggccccatggtgaccgcggccgacgtcgagaaggccgggggcgacgccacgaaccactgggtgaagcgcaacgaggggtacgagaagtcccccgtgaccccgtggaacttcgaccaggtcttcaaccgggaccaggccgcgcaggacttcatcgaccgcctgaccggcaccgacacgtacctgatcggggagcccaccctcctgaagaacagcctgaagtaccagctgttcaccgtgctcaacgagctgaacaacgtgaagatcaacggccacaagatcgacgagaagaccaagcacgtcctgatccaggacctcttcaagagcaagaagacggtgtccgagaaggccatcaaggactactacctgagccagggcatgggggagatccagatcgtcggcctggccgacaagaccaagttcaactccaacctcagctcctacatcgacctgagcaagaccttcgacgccgagttcatggagaaccccgccaaccaggagctgctcgagaacatcatccagatccagaccgtgttcgaggacgtgaagatcgcggagcgggagctgcagaagctggccctccccgacgagcaggtccagcagctggccaagacgcactacaccgggtggggcaacctgtccgacaagctcctgagcaccccgatcatccaggaggggtcccagaaggtgagcatcctgaacaagctccagaccacgtccaagaacttcatgagcatcatcaccgacaacaagttcggcgtgcagcagtggatccaggagcagaacaccgccgagaccgccgactccatccaggaccgcatcgacgagctgaccacggcgcccgccaacaagcggggcatcaagcaggccttcaacgtcctgttcgacatccagaaggccatgggggaggagcccaaccgcgtgtacctcgagttcgcgaaggagacccagaacagcgtgcggaccaactcccgctacaaccggctgaaggacctgtacaagagcaagaccctcagcgacgacgtcaaggccctgaaggaggagctggagtcccagaagtccagcctccagagcgagcgcatcggcgaccggctgtacctgtacttcctccagcaggggaaggacatgtacacgggccagcccatcaacatcgacaagctgtccaccgactacgacatcgaccacatcatcccgcaggcctacaccaaggacgacagcatcgacaaccgcgtgctggtgtcccggcccgagaacgcccgcaagagcgactccgccacctacacgaccgaggtccagcagagcgcgggcgggctctggaagtccctgaagaacgccggcttcatcagccagaagaagtacgaccggctgaccaagggcggggactactccaaggggcagaagaccggcttcatcgcccgccagctcgtggagacgcggcagatcatcaagaacgtggccagcctgatcgagtccgagttcagccagaccaaggccgtcgcgatccgctccgagatcaccgccgacatgcgccggctggtggccatcaagaagcaccgcgagatcaacagcttccaccacgccttcgacgccctcctgatcaccgcggccggccagtacatgcaggcccggtaccccgaccgcgacggggccaacgtgtacaacgagttcgactactacacgaacacctacctgaaggagctccggcagagctccagctccagccaggtccgccggctgaagcccttcggcttcgtggtggggaccatggcgaagggcaacgagaactggtccgaggacgacacccagtacctgcgccacgtcatgaacttcaagaacatcctcacgacccggcgcaacgacaaggacaacggggccctgaacaaggagaccatctacgccgtggacccgaaggccaagctgatcggcaccaacaagaagcggcaggacgtgagcctctacggcgggtacatctacccctactccgcctacatgacgctggtccgcgcgaacggcaagaacctgctcgtgaaggtgaccatcagcgccgccgagaagatcaagtccgggcagatcgagctgagcgagtacgtccagcagcggcccgaggtgaagaagttcgagaagatcctgatcaacaagctcgccatcggccagctggtgaacaacgacgggaacctgatctacctcacctcctacgagttctaccacaacgccaagcagctgtggctgcccaccgaggaggcggacctcatcagccagctgaacaaggactccagcgacgaggacctgatcaagggcttcgacatcctcacgtccccggccatcctgaagcgcttccccttctacgagctggacctcaagaagctggtcaacatccgggacaagttcatcgccgtggagaacaagttcgacatcctgatggtgatcctcaaggccctgcagctggacgccgcgcagcagaagcccgtcaagatgatcgacaagaagtccgccgactggaaggactaccgccagcggggcgggatcaagctcagcgacaccagcgagatcatctaccagtccaccaccggcatcttcgagaagcgcgtgaagatcagcaacctgctgtga

SEQ ID NO: 1773 - RNA, 3963 nt, synthetic construct
  misc_feature 1..3963: note = Cas9 variant
  source 1..3963: mol_type = other RNA
atgaccgagcagcagcgcccctacaacatcggcctggacatcgggaccagctccatcggctgggccgtgacggaccagaacgacaagctcctgcacatccgggggcacaacggcatcggggtccgcctgttcaaggagggcgagagcgccgcggagcggcgcggcttccggaccacccgccggcgcctctcccggcgccggtggcgcctgcggttcctggaccgcatcttcgacgccgagctcgccaaggtggacccgaacttcctggcccggctgaagcagagcaacatcagccccctcgaccccaacaagcagatgttcgggaacatcctgttcgacgacgcccagttcgacgaccagaagttccaccagcagtaccccaccatctaccacctccgcagcgcgctggcccagccggacgcgccccaggccgacgtgcggctgatctacctggccctccaccacatgatcaagttccgcggccacttcctgaacggggccgccgtcgagaagttccacggcgggcagctgcacctcgaggccgagttccaggagctgaaccagatcttctccaaccagcagcgggaccacgtgcagctgcagacgagctccctcgacgaggtggccaccatcctgaaggacaaccagcgcacccccagcgaccggcagcgcgagctgtccgcgcgcctcttcgtccccgtggacaagaccatcgacaaggagaacaagaagctggccacggagctgctcaaggccgtgctgggcctgaaggccaagttcgacgtcatcctcggcgtggaggccaccgacccgcaggcgttcaagctgcagttcagctccgacgacttcgacgacaagatcgccgagctggccagcgagctcaccgacgaggccaacgagatcctgaccgtgctgcagcggctctacttctccctgaacctggccgacatcctcacgaaccgccagaccaagcaggtcgcggacagcatctccaccgccatgatcaaccggtacgacgaccacaagcaccacctgaagatgctgaaggagctcgagacccaggtgacgcaggagcagcgcgacgggctgaagaaggcctacgacgagtacatcgacggcgacaagcccaccatcgacaccttctacaccaacgtgaagaagaacctggacgacagcgagctcgccaaccagatcaagtccctgatcgacctgcaggccttcatgcccaagcagcggagcaaggagaacgggagcatcccccaccagctccaccagcgcgagctggaccagctgatcgaggtccagggcaagtactacccgtggctgctcgcggccaaggacaagctggacgccctgatcgccttccgggtgccctactacgtgggccccatgatcgaccccaacgagtccgacgacccgcagaacacgaagttcgcgtggatggtccgcaaggaggccggggagatcaccccctggaacttcgaggagaaggtggacaagaccggcagcgccaccaacttcatcaagcggatgacgaccaccgacacctacctcctgggggagcccgtgctgcccaagaactccctcctgtaccagcagttcacggtcctgaacgagctcaacaagctgaaggtggacggcaaggccctgaccgtggaccagaagaagtacctctacgagcacgtctgcaagaagcagcgccgggtgaccctgaagaagctgagcgactgcctcatggcccgcggggacttcccgatgggcgcgatcttcaccggcacgaccgaccagaagaacatgaacaacaccctgaagacctaccaggacttccaggagatcttcggggacgagatcgacaaccccgaccggcaggtcgacttcgagaagatgatcgagtggtccacgatcttcgaggaccgcgagatcttcaagctgaagctcgccgagctgaactggctgaccagcgagcagctcgagcgggtgtccaagaagcgctaccagggctgggggcggctgagccagaagctgctcacccacatcgtgaacgagaacggcgagcgcatcatcgaccagctgtggaacaccaaccagaacttcatggagatcatggggcaggacggcgtcaagcaggccatccaggagcacaacggcgccaacgtggcccagaccgggatcaacgagacgatcgacgagctgtacaccagcccccagaacaagaaggcgatccggcagatcctcctggtggtcgacgacatcaagaaggccgtgggctacgcccccgccaacatcatgatggagttcgcccgcgaggaccgcgacgaccaccggctgatcgcgtcccgcgcccggcagctcgagaagacctaccaggagatctccaagaactggttcgacaacgagagcgtgacccaggagctgaaggaccagatcaagaacaagacgaagttcaccgaccgcctgtacctctacttcatccagggcgggatcgacctgtacaccgggcacccgctgaacatcgaccagctctccagctacgacatcgaccacatcctgccccagtccttcctgctcgacaacagcctgaacaaccgggtcctgacctcccagagcgagaaccgcgtgcacaaggaggaccggctccccggcgagacggtggccaacaagatgcgccccacctggaagatgatgcgggagcagggcctgatgacccagcgcaagtacaacaacctgaccctcaagccggaccagatctccaagttcaacaaccgggggcagttcatcaaccgccagctggtcgagacgcgccaggtgatcaagctggccgcggacatcatgaaccagaagtaccaggccgaccagaccaaggtggtcaccgtgaaggccaacctcacccaccacatgcgggagaagttcaacttctacaagagccggaacgtgaacgactaccaccacgccttcgacgcctacctgacggtcttcgtgggcaactggctgctcaaggagtaccccaagctgcagccctacttcgtgtacggggacttcgcgaagaccggcaccaacaacctgaagtccttcaacttcctctaccgcttcgagcgggaccacaagctgaacgacaagggcgccatcgacaccgacaaggaccagcagctggggtacatgaagcgcatctaccggttcaagaagatgctcgtcacgaagcagctggagaccaacgagggcgccctgtacaagcagaccatctacaaggccccggccaacgagaagaacaccaagaagaaccgctccctcatcaacacgaagaagaaccggcccagcgacatctacgggggctactcccagagcgtgaccgcgtacatgtccctggtgttcttcaagaacaccttcaagctgatcaagatgcccctcgtcgccgccaacgccatcaagaacagcctgtccagctaccacgacaccatcctgaagatcctcgggtccaacgagttcaaggtgctgatccccaaggtgaagatgaaccagctgatcaaggagggcgacagcctctacacggtcgtgggcgtgtacaagcacaacgcccagcagctgatcctgtccgacaacagcatggggatcatcaccaagccgatccgcgagatctgcgactccgacctcgacagcgtcttcaacgagctggtggacaacatcgacaagtacctgaacctctacaagatcgaggacaagctgaccatcaaggagaagttctacgcgctgaagaacaaggagtccaagttcaagtgcatcagcgacatcctcgtgggcacccactgcaacgccgggcgctccaacctgaagatcatcggcctgagcagctactgggggatgttctccggcaacaacgacggcctcaagatcaacgagaacagccagctgatctaccagtcccccacggggctgttcgagcaccgggtcaaggtgagcgacctctga

SEQ ID NO: 1774 - RNA, 3972 nt, synthetic construct
  misc_feature 1..3972: note = Cas9 variant
  source 1..3972: mol_type = other RNA
atgaaggacttctacatcgggctggacatggggaccgacagcgtgggctgggccgtcgccgacgaggactacaacctctgcaagttcaaggggaaggcgatgtggggcgtgcgcctgttcgacgagtccgccaccgccgccgagcggcgcgggttccggacggcccgccggcgcgcgcagcggaagcgccagcggatcctgtggctccagatgctgttcaacgaggagatcagcaagaaggacatcgccttcttccagcgcctgaacgagtccaagctctacctggaggacaagagcaccaacgtgccctacgccgtcttcgccgacgagtccttcaccgacgtggactaccacaagctgtacccgaccatctaccacctccggaaggagctggtgcagagcgacgagccccacgacgtccgcctggtgtacctcgcgctgcaccacctgatcaagaaccggggccacttcctcttcgagaacgtgggctccgacttcgagaaggagagctccttcgaggtcctgttcaagaacctgcagaactacatcctcggggagtacgagctggccctggagtgcatcagccccctccagatcgccgacatcctgaaggacaagtccaagcgcaagacgaccaagagctccgagatctgcaagctgctcggcatcagcaagaaggggcagccccggctgaacgccatcgtgctgctcatgtgcggccagtccgtgaagctggccgacctgtacggggacgagaactacaacaaggaggagaagtccagcatcagcttcgagaagggctacgaggacaacgaggagacctaccgcgagctcctgctggagcggttcgagctcatcgagaagatcaaggcgctgtacgactgggccatcctggccgacatcctcaagggcgagacctacatctccttcgccaaggtcaagacgtacgacgagcaccgccacgacctgcagcagctgaaggccttcgtgaaggagcggtgccgcagcgactacaacgagatcttccgggagaccagcgacaagctcaacaactacaccgcgtactgcgggaagttcaaggagaacggccgcaacggggtgatcctgcactccgccaaccagaccgacttctgcaagtacctcaagagcaagttcgacaagctcgacaagtccggctacgaggacatgttcgagaagatcgagaacggcagcttcatgccgaagatcgtcgtgaaggacaacggggtgatccccatgcaggtcaacgagtccgaggtgcgcgccatcctgaagaacgccagcggctacctggacttcctcaacaaccaggacaaggacgggatcacggtggccgacaagatcctgcagatcttcgagttccggatcccctactacgtcggccccctgaacgtgcactccgacaacagctggctcgtgcgcaaggacgggaagatctacccgtggaacttcaacaagatcgtcgacgtggacaagtccgcggaggagttcatcaacaagctgaccgccaagtgcacctacctgcccgaccgggacgtcatccccaagaacagcatcctgtactcccgctacatggtgctcaacgagctgaacaacctgaagctcgacggcaagaagcccgacgtgagcttcaagcaggccgtcttcaacgacctgttcatgcaccggcgcaaggtgacccagaaggccctgcgggagtacatcaaggcccagacgggcaccgagccggagatcaccgggatcgacggcgacttcaaggcgaacatgcgccccgccatcgagctcgccgggtacaacctgtccgagcccgacaaggaggagatcatcaaggccatcaccatcttcggcgacgacaagaagctgctcaagcggcgcatcaaggacaagtacagcgagatgctgtccgaggacgagatcaagaagatctgcaagctgaagtacaaggactgggggcggctcagccgcgagttcctgacggagatcttcgacgtggacaccgcgaccggcgagtgcaaggacaacatcatcaacaccctgtggaacacgaacgacaacctcatggagctgctgggcgccaagtacaacttcacccagtccatcgagcaggccatcagcaagtccacccacaaggccagcatcgagaagatggtcgaggacatgtacgtgagccccaaggtgaagcggaccgtcttccagtccctcaagatcatgaaggagatcgtgaagatcaaggggcacgccccgaagaaggtgttcgtcgagatgacgcgccacgacggcaccaagggggacaacggccggaccaagagccgcaagaagcagctggaggagctgtacaagaagtgcaaggaggactccaccgagctctgggacgagctggagaagacggacgacgacgagttccggcaggacaagctgttcctctactacacccagatggggcgctgcatgtacagcggcgagcggatcgagctgcgcgacctgttcaacaagaacctctacgacatcgaccacatcttcccccgctccaaggtgaaggacgacagcatcgacaaccgggtgctggtcaagaagcagatcaactcccacaaggacaacgactaccccctggacagcaccgtgcgcgagaagatgcggggccactggcagtacctcctgcgccacgggttcatctccaagaagaagtacgaccggctgacccgcgtgacgcccctcaccgacgacgagctggcggacttcatcgcccggcagctggtcgagaccagccagtccaccaaggccgtggccaccctcctgaagacgctgtacccgaccaccgagatcgtgtacgtcaaggccgagctcgtgagccgcttccggaccgagtacaagttcatcaagtgccgcgaggtgaacgacctgcaccacgcgaaggacgcctacctgaacatcgtcgtgggcaacgtgtacaacgtccggtacacgcactccaaggccatcttcatcaaggggctccagaccaagaagtacagcctgaaccgcatgttcgccttcgacacccccggcgcctggaacatcgagaacgagaagtccctgagcatcgtgaagaagaccgtgatgaagaacaacatcctctacacgcggtactcctacatgaagaagggcgggctgttcaagatccagcccctgaagaagggcaacgggcaggcgcccctcaagaaggacctgccgctgagcgacatcggcaagtacgggggctacgacaagcccaccgccagctacttctcctacatcaagtacgagggcaagaaggggaaggagtgccgccagctcgtcgccatcgacaactacctgaagaagtactacgaggagaaccccatcgagtacctgaccaaccggctcggcctgaagaaccccgccgtgctgatcccggtgatcaagtacaacagctgcatcgagatcgacgggttccgcatgaacatctccagcaagtccaacgagggcaagaccatcgtctacaagcccgcggtgcagctcgtgctgggggccgagaaggaggcctacgtcaagaagatcagcaaggtgctgtccaagcccgaggagcagaagatcacgagctacgacggcgtgtccgccgaggagaacatcgagctgttcgacgccctgaccgcgaagatgaccaacaccatcttcaagatcaagctggaggacatcggcaacaagatcaagagcgggcgggacaagttcgtcacgctcgacgtgaagaagcagtgctacgtgatcaacgagatcctgaagatcatgcactgcaacgtcgtgaccggcgacctgtccctcatcggggccgccaagaaggccggcatcgtgagcaccaactccgccctgagcgagatcaagaaggtctccagcatcatgctgatcaaccagtccgtgaccggcctcttcgagacgaagatcgacctgctgaacatctga

SEQ ID NO: 1775 - RNA, 3975 nt, synthetic construct
  misc_feature 1..3975: note = Cas9 variant
  source 1..3975: mol_type = other RNA
atgcgcgccaagggcaagaccctgatcgggaccagcctcttccgggagggcaacacggccgcggagcgccgggggtaccgcaccacccagcggcgcctgaagcggcgcaagcggcgcctgaagctcctggaggccttcttcgacccctacatcttcgaggtggacgagaacttcctggcccggctccacgaggccgacatctccccgaaggacgagaacaagcgcttctggggcagcctgctgttccccaacgagaaggacgccaacttctaccggaagtaccccaccatctaccacctccgcaaggcgctgatggaggaggaccggaagttcgacgtccgcgccatcttcctggccatccaccacatcatgaagtaccgggggaacttcctcagccccctgagcgtggactccttcaagcaggagggcctggagctcaaggagcagctggaccgccagctgaagcgggtggccgagctctacaacgagctgaacacggacgtcaagatcaacgtgagcgacgtggagaccatccaggacatcatcatcgacaagaacaagtcccgccgggacaaggcgggcgccctgaagaagctcctggccgtcagctccgaccgcaaggagatcaacaagctgaacgccagcctcgccaaggagctgtccaacgcgatcctggggatgaaggcccagttcgccaacctcctgctggccgacgacctcgagatcgacaagaacaagaagaacttcagcctgctggacaccaacgccgaggagaacgtgtccggcctcctggagctggtgaacgagaagcaggcggagctgttcgacgccatcaagaccatccacgaccagatcatcctgaacgagatcgtcccggacggcaagagcatctcccagagcatggtggacaagtacgaggcccaccgcgagcagctccaggtgctcaaggccctgtacgagaagatggacgccaagcagatcaaggcgatcaagaaggcctactccctgtacatcgacgggaaggaccccaaggccaagaaggtcgacaagcgggcccaccagaaccgcgccgacttctacaaggaggtgaagaaggtgctcgtcgagctggacgacagccgggcggagaagctgctcgggctgatcgagatgggccagttcctgcccaagcagcgcacggccatgaacggcgtgatccccaaccagctccaccaggtggagctggacaagatcatcgagatgcagtccaagtactacccgtggctggccgagaagaaccccgtcaagagccaccagaagcgggccccctacaagctggacgagctcctgaccttccgcgtgccctactacgtggggccgatggtcaccagcaagaagcagcagcagacctccaacagcaacttcgcgtggatggtgcggaagcaggagggcgagatcacgccctggaacttcgaggagaaggtggacaccatcgcctccgccaacgacttcatcaagcgcatgaccgccaaggacacctacctggtcggggaggacgtgctccccgccaacagcctgctgtaccagcggtacaaggtcctcaacgagctgaacaacatcaaggtgaacggccgccggctgcccgtggagctcaagcgcgaggcgtacgtcgccctgttcgagaacggcgactccaagacggtgagcgccaagtgcttcaagaactggctgaacgtgaagctcaagaacctgaactccctgaagctcgaggggctgagcaccggcaccaagttcgacaacaacctgtccacctaccacgacctcaagaagatcttcgggaaggccgtcgacgacgccggccggcagaaggacttcgagcagatcatcgagtggctgacgatcttcgaggacaagaagatcctgcgcatcaagctcaaggagatcgagtggctgaccgaggagaacatcacccagctgacccggctcaactacaacgggtggggccgcctgagccggcgcctgctcacgggcatctgcgactccaacgggcagcggatcatggactggctgtgggacaccaccaacaacttcatgcagatccagagccagccggacttccagaaggcgatcgtggagtacaactccgacaagctggagcagggcgacatcgagcagatcctcggggaggcctacaccagcccccagaacaagaaggccatccgcaaggtgatcaaggtcgtgcaggacgtggagaaggccatgggcgccaagcccacgtccatcagcatcgagttcacccgctccgacgggcggagcgagctgaccaactcccgcatgacccagctgcagaagacgctcatgagcctgagcgaggagatgaccgaccaggcgctgctcgccgagttcaaggacttccaggcctccaagaagaagctgaccaacaagtactacctgtacttcacccagctcggccgggacatgtacacgggcgagcccctgaacatcgaccagctgagcctctactccgacggggaccacatcctgccgcgcagcttcatcaaggacgactccctggacaaccgggtcctcaccaagcgcgccgtgaacaacgagaagtccgacaccgtgcccgtctgcgagtacggcgcgaagatgaaggacttctggaacgacctgtacgacaacgggctgatctccaagcagaagctcgccaacctgctgaccgaccccgacgagatcggcccctacaaggccaacgggttcatccggcgccagctcgtggagaccagccaggtgatcaagctgtccgccgagatcctgcagacgctctaccaggacaccaagatcatcgaggtccggcagaagtacacccacgagctgcgcgagcacttcaacttcgtgaagatccggcagctgaacgactaccaccacgccttcgacgcgtacctcaccgccttcagcggccgctacctgtaccagcggtacccgaagctgcgcggctacttcgtgtacggggactacaacaagttcgacgccaagaaggaccggaactacctcaagtcctacaacttcctgtacgacctggaggagggcaagacggaccagatcgtcgacaacgtggagcacaaggtgttcatgaaccgccaggacgccatcaaccagctcaagaaggcctacgagtacaagtacatgctggtcagccaggagacctacaccaactccggggcgatgttcaaggagaccatctaccccgtgaaccccaagcagaagctgatccagaagaagaacgacaagcccgtggacatctacggcggctacagcaacaactacgacgcctacctctccatcgtccggctggaggacaagaaggggatcaagttccgcgtggtgggcatcccgatgcggaacaaggccgagctggacaacctcgccaaggaggaccacaacgggtacatgcagcgcctgaacgagatcgtcgacgagcagatcaacagctccggcaagaagaagacgttccggatcatcctgcccaaggtgcacttcaagcagctcgtggaggacgacagcgggaagttcatgctgggcagcgccgcgtacccctacaacgccaagcagctggtcctctccgtcaagagcatcgagtccctggccaacaaggacgccagcgaccgcgagctggtggcggtgtacgaggagatcctcaacgtggtgaacgacaagttcaccctgtacgacgcccgccagttccggaacaagctgacctccagcaaggacaagttcgtcgagctcaacaccgccgacaaggtgacggagctgctggacatcctcgacggcctgcacgccaacccggtggtcaagaagctgaagatcatctccgggagccccttcggcttcctccagcgcccctccgggatcgtgctgaccgagaacgccaagctgatctaccagagccccaccggcatcttcgagcgggtggtctacctccgcgacctgtga

SEQ ID NO: 1776 - RNA, 3984 nt, synthetic construct
  misc_feature 1..3984: note = Cas9 variant
  source 1..3984: mol_type = other RNA
atggagggccagatgaagaacaacgggaacaacctgcagcagggcaactactacctcgggctggacgtgggcaccagctccgtcgggtgggccgtgaccgacacggactacaacgtgctgaagttccgcggcaagagcatgtggggcgcccgcctcttcgacgaggcgtccaccgccgaggagcggcggacccaccgcgggaaccggcgccggctggcccgccggaagtaccgcctgctcctgctggagcagctgttcgagaaggagatccggaagatcgacgacaacttcttcgtccgcctccacgagagcaacctgtgggccgacgacaagtccaagcccagcaagttcctcctgttcaacgacaccaacttcacggacaaggactacctgaagaagtacccgaccatctaccacctccggtccgacctgatccacaacagcaccgagcacgacatccgcctggtgttcctcgccctgcaccacctgatcaagtaccggggccacttcatctacgacaactccgcgaacggggacgtgaagaccctcgacgaggccgtcagcgacttcgaggagtacctgaacgagaacgacatcgagttcaacatcgagaacaagaaggagttcatcaacgtgctgtccgacaagcacctcacgaagaaggagaagaagatcagcctgaagaagctgtacggcgacatcaccgactccgagaacatcaacatcagcgtgctcatcgagatgctgtccgggagctccatcagcctgtccaacctcttcaaggacatcgagttcgacggcaagcagaacctgagcctggacagcgacatcgaggagaccctcaacgacgtcgtggacatcctgggcgacaacatcgacctgctcatccacgccaaggaggtgtacgacatcgccgtcctgacctccagcctggggaagcacaagtacctctgcgacgcgaaggtggagctgttcgagaagaacaagaaggacctgatgatcctcaagaagtacatcaagaagaaccaccccgaggactacaagaagatcttctccagccccacggagaagaagaactacgccgcctactcccagaccaacagcaagaacgtgtgctcccaggaggagttctgcctgttcatcaagccctacatccgcgacatggtcaagagcgagaacgaggacgaggtgcggatcgccaaggaggtggaggacaagtccttcctgaccaagctcaagggcaccaacaacagcgtcgtgccgtaccagatccacgagcgcgagctgaaccagatcctgaagaacatcgtggcctacctccccttcatgaacgacgagcaggaggacatctccgtcgtggacaagatcaagctgatcttcaagttcaagatcccctactacgtggggcccctgaacaccaagagcacgcggtcctgggtctaccgcagcgacgagaagatctacccgtggaacttctccaacgtgatcgacctggacaagaccgcgcacgagttcatgaaccggctcatcggccgctgcacctacacgaacgaccccgtcctgcccatggacagcctgctctactccaagtacaacgtgctgaacgagatcaaccccatcaaggtgaacggcaaggccatcccggtcgaggtgaagcaggccatctacaccgacctgttcgagaacagcaagaagaaggtgacccgcaagtccatctacatctacctcctgaagaacgggtacatcgagaaggaggacatcgtcagcggcatcgacatcgagatcaagagcaagctgaagtcccaccacgacttcacccagatcgtgcaggagaacaagtgcacgcccgaggagatcgagcggatcatcaaggggatcctcgtgtacagcgacgacaagtccatgctgcgccggtggctgaagaacaacatcaagggcctcagcgagaacgacgtcaagtacctggccaagctgaactacaaggagtgggggcgcctctccaagaccctgctgaccgacatctacaccatcaaccccgaggacggcgaggcctgcagcatcctcgacatcatgtggaacacgaacgcgaccctgatggagatcctgtccaacgagaagtaccagttcaagcagaacatcgagaactacaaggccgagaactacgacgagaagcagaacctccacgaggagctggacgacatgtacatcagccccgccgcccggcgctccatctggcaggccctgcggatcgtggacgagatcgtggacatcaagaagtccgcgccgaagaagatcttcatcgagatggcccgcgagaagaagtccgccatgaagaagaagcggaccgagagccgcaaggacaccctcctggagctgtacaagagctgcaagagccaggccgacggcttctacgacgaggagctgttcgagaagctctccaacgagagcaactcccggctgcgccgggaccagctctacctgtactacacgcagatggggcgcagcatgtacaccggcaagcggatcgacttcgacaagctgatcaacgacaagaacacctacgacatcgaccacatctacccccgcagcaagatcaaggacgactccatcaccaaccgggtcctcgtggagaaggacatcaacggggagaagacggacatctaccccatcagcgaggacatccgccagaagatgcagcccttctggaagatcctgaaggagaagggcctgatcaacgaggagaagtacaagcggctcacccgcaactacgagctgaccgacgaggagctgtccagcttcgtggcccgccagctcgtcgagacccagcagtccaccaaggcgctggccacgctgctcaagaaggagtacccgagcgccaagatcgtgtactccaaggccgggaacgtgagcgagttccggaaccgcaaggacaaggagctgcccaagttccgggagatcaacgacctgcaccacgcgaaggacgcctacctcaacatcgtcgtgggcaacgtgtacgacaccaagttcaccgagaagttcttcaacaacatccgcaacgagaactactccctgaagcgggtcttcgacttcagcgtgcccggcgcctgggacgccaaggggtccaccttcaacacgatcaagaagtacatggccaagaacaaccccatcatcgcgttcgccccgtacgaggtgaagggcgagctgttcgaccagcagatcgtccccaaggggaagggccagttccccatcaagcaggggaaggacatcgagaagtacggcggctacaacaagctcagctccgccttcctgttcgccgtggagtacaaggggaagaaggcccgcgagcggagcctggagaccgtgtacatcaaggacgtcgagctctacctgcaggaccccatcaagtactgcgagtccgtgctgggcctcaaggagccgcagatcatcaagcccaagatcctgatggggagcctgttctccatcaacaacaagaagctcgtggtcaccggccgcagcggcaagcagtacgtgtgccaccacatctaccagctgtccatcaacgacgaggacagccagtacctgaagaacatcgcgaagtacctccaggaggagcccgacgggaacatcgagcggcagaacatcctgaacatcaccagcgtgaacaacatcaagctgttcgacgtcctctgcacgaagttcaactccaacacctacgagatcatcctgaacagcctgaagaacgacgtgaacgagggccgcgagaagttctccgagctcgacatcctggagcagtgcaacatcctgctccagctgctgaaggccttcaagtgcaaccgggagagctccaacctcgagaagctgaacaacaagaagcaggccggggtgatcgtcatcccgcacctgttcaccaagtgcagcgtgttcaaggtgatccaccagtccatcaccggcctcttcgagaaggagatggacctgctgaagtga

SEQ ID NO: 1777 - RNA, 3984 nt, synthetic construct
  misc_feature 1..3984: note = Cas9 variant
  source 1..3984: mol_type = other RNA
atgaagaactacagcatcggcctggacatcgggaccggctccgtggggtgggtctgcatcgacgagaactaccagatcctccgctacaacaaccgggccgccttcggcgtgcacgagttcgagaccgcgcacgtggccgaggagcgccggatcaagcgcggggcccggcgccggtacaaccgccggaagaagcgcatccagctgctgcagagcctcttcgtcccccacatgcagcagaaggccttcttcgccccgacgatcaccgagcactactggaagaacgacaaccagttcgagaaccggaccctgtccgaggtgctgatgagcctcggcatgaaccccaacacctaccccacgatcttccacctccgccacgagctgatcgagtccagcgtgaagaaggacgcgcggctgatctacctggccctgcacaacctcgtcaagttccgcggccacttcctgcaggaggggtccacctggaacgccaacatgagcgacgccaacctgtccgagcagttcgagcagctcctgcacatctacaccgagatggaggagctgccccaggtgagcctcaccgcgcagcagtccacggacgtggagcacatcctgctgaacaaccacatcagcaaggccgagcgggcccgccagctcaccgccctgttcgagcggacctacgagccgttcttcaagctgatcgtcggcctcgacatcgccgcggcccagctgttcaagcagtccgagcagcagctgctctacaaggagagcaagaccaaggtgaacctgacggccgagaccctgcccgaggtgctccagaccatgctggagcccgaggtcgccttcatcgaggccgtgcagcccttctaccagcagaccgtgctgttcgacctcctgaaggggcagtcctacgtcgcggccgccaaggtggaggccttcaaccagtacgagcgcgacctggccctcctcaagagcgtgatcaacgaggtcggctccgagaagcagtaccgggcgttcttcatcacgagcaagcagaagaagcgccagttcgagcagaagccgaacatggagctgctgtgccacctggaccggttcaaccgcgagaagaagtacgaggagaccttctacaaggaggtgtccaagctgctcaccgccctgatcaaggaggccaccggggaggtgaaggagcacatcgagcagatcatccaggccatggagagccagagcttcctggtcaagcagaagggcatccagaacgcctccatcccctaccagaacagcctctacgaggcggagatgatcctgcgcaaccagcaggcctactacccctggatcacggacgagttcatcgagaaggtgaagcagctgatcgccttccggatcccctactacatcggcccgctcgtgcagggggacgagcagcccttcggctggctgcagcgccaggccgacgggaacatcaccccctggaacttcgacgagaaggtcaacaaggcggcctccgccgagagcttcatcacccggatgaccaagaactgcacgtacctgaaggaggagaaggtgctgcccaagcagtccctcatgtacgagaagttcaccctgctgaacgagctcaacagcgtccagatccgctccagcctggagcagccgcacaagaagcaccggctgtgcgaggacatgaagcagtggatcatcgagcacgtgttcaagaagaccaagaccgtgacgcacaagaccctcatccaggccctgaagaagtccccctacaaggacgagctgtacgacgagagcaccggcaactggaaggacgtctacggcacccagaaggaggaccgcttcgcctccagcctctccacgtacatcagcctgaaggagatcgtgggggacatcgtggacaacgcgttcatggaggagatcatctactggctgaccgtcttcaccgaccgggacatcatcaccctcaagatgaacgacaagtaccccttcatcacggagcagcagatccagcgcctgctgtccctcaacatcagcggctgggggcagctgtcccagcggctgctccagagcatccccgtggacgacatgaaccgctccgtgatcgagtacatggagaagcacgccgtcaacttcatggagctgctgagcccgcggcagagcgacctcgcctacaagatcgagcaggtcaacaagcagcactccaagaagatccacaagatccgctacgaggacatcgagcagctgaccggcagccccgccctgaagcgggggatctggcgctccgtgaagatcatcgaggagctcaccgccatcttcggcgagcccaagaacatcatgatcgaggtggcgcgggaggaccaggccagccaccgcaccaagtcccggaaggagcagtgggagagcatcggcaagtccctggccaaggaggagaaggagctgaaggccttcttcaaggagatggcccagtaccccaagcagcagttcgaccgcacccggttctggctctacgtgacgcagcaggggaagtgcctgtacaccggcaagaccctgcgcctcgaggacctgagctcctacgagatcgaccacatcctgccgcgcaacttcgtgaaggacgacagcatcgacaacctcgcgctggtctaccccatggccaaccaggagaagaacaaggccgggaacaacaagatgcccctggagatcatcgacgccaagcagcagcccgcgatgatggcccactggaagcggctcaaccagctgaagctgatctccgacagcaagctccacaagctgatgaagccgtccttcaacgacgtggacaaggagaacttcatcgcccgccagctggtggagacccggcagatcatcaagcacgtccgcgacctcctgcaggagcggttcgagcacacggacatccacgtggtgaaggccaagatggtcagccagttccgcaagttctcccggatccccaagatccgcgactacaacaacaagcaccacgccatggacgcgctgttcaccaccgtgctcatccagttcatcctgcagaagtacggcaagaacttcctgcagttcgacctccagcacaaggacatcagcaagaagtggtccaagatcgcccagagcaccaagcacttcttcctgttccagcagttcgccgagcagcagatcaagagccccgtgacgaaggagctggtctccggggtgcagtacttcgagcacatcttctacgagcagagctggcagaccaccaagatgacccagacgatcgactccaacttctacaaggagaccatcttcagcccgaagctcaagaccgccaagtacacctccgccaaggcggagaagttcgtgcacgacgccatcgtcaagtacgccgtgtgcggcatccagtacacgagcctgaagaagaacaaggagcagcaccacgtgctgctcaccgacatcaacgtcatcgagcactaccagctgaaggaggcctccctgaacgagctcgccctgcacctggcgaagcgggagagcaaggacgacgtgatcgacgcccagatgctcgtggtcatccccaagtacaagaagatcatgctgaacggctccccctactactgcatcagctccgacgagcgccacatcgccacccagttcgtgctgcggaaggacctcctggaggccgtgctgcacgtcaacgacgagaccagcgtggacgagctccgcacgctgttccggtccatcgtggaggagatgatgacccagtacaaggtctacaacaaggacaccatccgcaacaagatcgacgcgttcatcgagaccgagctgatcgacgtggagacgttccaggtggggttcaccgagatcaagaagatggtcgccgccaacgcccagcggagcgacaagttcggcgggcgcctccgccaggtgatgaaggtggaggacatctacatcatcgacgagtccatcaccggcctgcggtaccggaagccccgcaagctggtcaagtga

SEQ ID NO: 1778 - RNA, 3984 nt, synthetic construct
  misc_feature 1..3984: note = Cas9 variant
  source 1..3984: mol_type = other RNA
atgaagaagaactacaccatcggcctggacatcgggaccgccagcgtgggctgggccgtcctcacggaggactacgagctgatcaagcgcaagatgaagatctccgggaacacccagaagaaggcggtgaagaagaacttctggggcgtgcggctgttcgagcagggggagaccgccgagggccgccggctcaagcgcaccacgcggcgccggatcgcccgccggcgccagcggatccagtacctgcgcaccatcttcgacgagggcatgaaccaggtcgacgccaacttcttcgcccggctggacgagagcttctccatcatcgacgagaaggagaacgagcgccaccccatcttcgggaacgtggcggaggaggccgcctaccacgagcagttcccgaccatctaccacctccgggagcacctggccaacagctccgagcaggcggacctgcgcctcgtgtacctggccctggcccacatcatcaagttccggggccacttcctcatcgagggggagctgaacaccgagaacagctccgtcagcggcacgttcgagcagttcatcaaggtgtacaacgagaccttcaacgtggagaaggccctggacctcaccgtcgacctggacgggatcgccgagcagaagatctcccgcatgaagcgggcggagctgatcctcagcctgttccccgaggagaagtccaccggcgacttcgcccagttcatcaagatgatcgtgggcaaccaggggaacgtgaagaagacgttcagcctgaacgaggacgccaagatccagttctccaaggaggagtacgaggagaacctcgagaccctgctggccgagatcggcgaggacttccgcagcgtcttcgacgccgcgaagtccgtgtacgacgccatcagcctcgccaacatcctgaaggtgaccgacgccaccacgcgggccaagctgtccagctccatggtcgtgcgcttcaccgaccacaaggaggacctcaagaccctgaagcgcttcgtgcgggagaacctgcccgacgagtacgacgacctcttcaagaacaagaaggtcgcggggtacgccggctacatcgacggcaacgagacccaggaggccttctacaagtacctgaagaagacgctggccaaggccaccggggcggagggcttcctcgccaagatggagcaggaggacttcctgcgcaagcagcggaccttcgacaacggggtgatcccctaccagctgcacctcgaggagctgaaggccatcatcaagaaccagaagtcctactacagcttcctggacgaggagaagatcagccagctcatgaccttccgcatcccgtactacgtgggccccctggccaaggagaaggggcagttcgcgtggctgacgcggaaggagatgggcaagatcaccccctggaacctcaacgagaaggtcgacatcgagaagtccgccaccgacttcgtggagcgcatgaccaacaacgacagctacctgcccatggagaaggtgctgccgaagcacagcctcctgtacgagacgttcaccgtctacaacgagctgaccaaggtgcggtacatcgacgacaacggccgcgcccagaacttctccagcaaggagaagcggcagatcatcaacgagctgttcaagcagcagcgcaaggtcaagaaggagatgctggaggccttcctgaagaacgagtacgggatcgagaaccccaaggtggagggcatcgagaagtccttcaacgcctgcctggggacctaccacgacctcatcaagctgggcatccggcccgagctgttcgagcagcccgagcacgagcagcagttcgagcagatcgtgaagatcctcacggtcttcgaggaccgcaagatgcggcgcaagcagctggagaagttcagcaacatcctgaccgaggaggagcagaagcagctcgagcggaagcactacaaggggtggggccgcctgtccgcgaagctgatccacggcatcgtggaccagaagacccagaagaccatcctcgactacctgatcgacgacgacgacctgccgaagaaccggaaccgcaacttcatgcagctcatcaacgacgagaacctgagcttcaaggaggagatcgagaagatcgccttcgacaacgacaagtccacggaggagatcgtgcaggagctggccgggagccccgccatcaagaagggcatcctccagtccctgaagatcgtcgaggagatcatcgacatcatgggggagctgcccaccaacatcgtggtggagatggcccgggagaaccagaccaccgcgcagggcaaccgcgccagcaaggcccgcatgaagtacctcgaggagtccatcaagaagctggggagctccatcctggaggacgagcccatcagcaaggacgccaacctcctgcggaacgaccgcctgttcctctactacctgcagaacggccgggacatgtacaccggcaacgagctggacatcaacaacctctccagctacgacatcgaccacatcgtcccgcagagcttcgtgaaggacgactccatcgacaaccgcgtgctgacgaccagctccatgaaccggggcaagagcaacaccgtccccgccgagtccgtggtgaagaagatgcgccccacctgggagcggctgctcgcgagcgggctgatctccaagaagaagttcagctacctgacgaaggccaccaacgggggcctcaccgaggaggacaaggcccacttcatccagcgccagctggtcgagacccggcagatcacgaagaacgtggcccagatcctgcaccagaagtacaacaacgagcagctctccgagaagcccgtgcgcgtcatcaccctcaagagcgcgctggcctcccagttccggaaggacttcagcctctacaagatccgcgagctgaacgactaccaccacgcccaggacgcctacctgaacggcgtgatcgcccaggcgctcctgaaggtgtacccgaagctggagcccgagttcgtctacggggagtaccagaaggtgtccatccgggccctcaacaaggccaccgccaagaaggagttctacagcaacatcatgaacttcttcacctccgacgagatggtggccaacgaggagacgggcgaggtcctgtggaaccgccagcgggacatcaagaccatcaagaaggtgatgaactaccaccagatgaacatcgtgaagaaggtcgagatccagaccggggcgttcaccaaggagagcatcctgcccaagggcccctccaagaagctcatcgcccgcaagaacaactgggccccggtgaactacgggggcgtggacagccccacggtcgcctacagcgtgatcatcacccacgagaagggcaaggccgcgaaggtggtccagcagctggtggggatcaagatcctggagcggcaggccttcgagcaggacgaggtggccttcctcgaggagaagggcttcatccaccccaaggtccagctgaagctgcccaagtactccctctaccagttcgccgacgggcgccggcgcctgctggcgagcgccgaggagtcccagaagggcaaccagatggtgctcccggtgcacctgatcgagctgctctaccacgccaagcacgtcagcgactccagcgggaagtccctggagtacctgaacgagcaccggcacgagttcgccgagctcctggaggccatcctgcagttcaccgagcagtacatcgacgcgggcaagaaccagaagaaggtgcgcgacctctacgagaagaaccaggacgccgacatgcgcgagctggccagctccttcatccagctgctccagctgaacaagcagggcgcccccgccgacttcaagttcttcggggagaccatcccccggcgccggtacaagaacacggcggagatcgtggacgccaccttcatcaaccagagcatcaccggcctgtacgagacccagaagcgcctcgtctga

SEQ ID NO: 1779 - RNA, 3984 nt, synthetic construct
  misc_feature 1..3984: note = Cas9 variant
  source 1..3984: mol_type = other RNA
atgaccgagcagcagcagccctacaacatcggcctggacatcgggaccagctccatcggctgggccgtgacggaccagaacgacaagctcctgcacatccgcgggcacaacggcatcggggtccggctgttcaaggagggcgagagcgccgcggagcgccggggcttccgcaccacccggcgccggctctcccgccggcgctggcggctgcgcttcctggaccggatcttcgacgccgagctcgccaaggtggacccgaacttcctggcccgcctgaagcagagcaacatcagccccctcgaccccaacaagcagatgttcgggaacatcctgttcgacgacccccagttcgacgaccagaagttccaccagcagtacccgaccatctaccacctccggagcgccctcgcgcagcccgacgcgccccaggccgacgtgcgcctgatctacctggccctccaccacatgatcaagttccggggccacttcctgaacggggcggccgtcgagaagttccacggcgggcagctgcacctcgagtccgagttccaggagctgaaccagatcttcagcaaccagcagcgcgaccacgtgcagctgcagacgtccagcctcgacgaggtggccaccatcctgaaggacaaccagcggaccccctccgaccgccagcgggagctgagcgcccgcctcttcgtcccggtggacaagaccatcgacaaggagaacaagaagctggccacggagctgctcaaggcggtgctgggcctgaaggccaagttcgacgtcatcctcggcgtggaggccaccgacccccaggccttcaagctgcagttctccagcgacgacttcgacgacaagatcgccgagctggcgtccgagctcaccgacgaggccaacgagatcctgaccgtgctgcagcgcctctacttcagcctgaacctggccgacatcctcacgaaccggcagaccaagcaggtcgccgactccatcagcaccgccatgatcaaccgctacgacgaccacaagcaccacctgaagatgctgaaggagctcgaggcccaggtgacccaggagcagcgggacgggctgaagaaggcctacaacgagtacatcgacggcgacaagcccacgatcgacaccttctacaccaacgtgaagaagaacctggacgactccgagctcgccaaccagatcaagagcctgatcgacctgcaggccttcatgcccaagcagcgcagcaaggagaacgggtccatcccgcaccagctccaccagcgggagctggaccagctgatcgaggtccagggcaagtactacccctggctgctcgccgcgaaggacaagctggacgccctgatcgccttccgcgtgccctactacgtgggccccatgatcgacccgaaccagagcgacgacccccagaacaccaagttcgcctggatggtccggaaggaggcgggggagatcacgccctggaacttcgaggagaaggtggacaagacctccagcgccaccaacttcatcaagcgcatgaccacgaccgacacctacctcctgggcgagcccgtgctgccgaagaactccctcctgtaccagcagttcaccgtcctgaacgagctcaacaagctgaaggtgaacgggaaggccctgacggtggaccagaagaagtacctctacgaccacgtctgcaagaagcagcggcgcgtgaccctgaagaagctgagcgactgcctcgtcgcccggggcgacttccccatgggggccatcttcaccggcaccacggaccagaagaacatgaacaacaccctgaagacctaccaggacttccaggagatcttcggcgacgagatcgacaaccccgaccgccaggtggacttcgagaagatgatcgagtggtccaccatcttcgaggaccgggagatcttcaagctgaagctcgcggagctgaactggctgacgagcgagcagctcgagcgcgtgtccaagaagcggtaccaggggtggggccgcctgagccagaagctgctcacccacatcgtcaacgagaacggggagcggatcatcgaccagctgtggaacaccaaccagaacttcatggagatcatgggccaggactccgtgaagcaggccatccaggagcacaacggggccaacgtggcccagaccggcatcaacgagaccatcgacgagctgtacacgagcccccagaacaagaaggccatccgccagatcctcctggtcgtggacgacatcaagaaggcggtgggctacgccccggccaacatcatgatggagttcgcccgggaggaccgcgacgaccaccgcctgatcgcctcccgggcgcgccagctcgagaagacctaccaggagatcagcaagaactggttcgacaacgagtccgtcacccaggagctgaaggaccagatcaagaacaagaccaagttcacggaccggctgtacctctacttcatccagggcgggatcgacctgtacaccgggcaccccctgaacatcgaccagctcagctcctacgacatcgaccacatcctgccccagagcttcctgctcgacaactccctgaacaaccgcgtgctgaccagccaggccgagaaccgggtgcacaaggaggaccgcctccccggcgagaccgtcgccaacaagatgcggccgacgtggaagatgatgcgcgagcaggggctgatgacccagcggaagtacaacaacctgaccctcaagcccgaccagatcagcaagttcaacaaccgcggccagttcatcaaccggcagctggtggagacccgccaggtgatcaagctggccgcggacatcatgtcccagaagtaccaggccgaccagacgaaggtcgtgaccgtgaaggccaacctcacccaccacatgcgggagaagttcaacttctacaagagccgcaacgtcaacgactaccaccacgccttcgacgcctacctgaccctgttcgtgggcaactggctcctgaaggagtaccccaagctgcagccgtacttcgtgtacggggacttcgcgaagacgggcaccaacaacctcaagtccttcaacttcctgtaccggttcgagcgcgaccacaagctgaacgacaagggggccatcgacaccgacaaggaccagcagctcggctacatgaagcggatctaccgcttcaagaagatgctggtcaccaagcagctggagacgaacgagggcgccctctacgggcagaccctgtaccccgcccccaagaacgacaagaagacccggaacctgatcaacagcaagaagaaccgcccctccgacatctacggcgggtacagcaacgagaacggctccttcctcaccctggtgaagctgaagaaggggagcaagtacgactaccggctcgtggccgtcccggtgtccaagatcagcgagatcaaggagtccgagctggcgacgatcgagaaggccatcgcgccccagttcctgaagtcctccggcaagtaccgcgacttccaggtggtcctcagcaagatcctgatcaaccagaaggtgatcgacgacggcatgatcttcaccatcgggtccaagagctacaagcacaacgccaagcaggtcgtgctgtccgacaacagcatccagatcgtgagcaccctctcccgcatcagcgacaaggagaagctgatcaccgtgttcgacgagatcgtcgacatcacgtccaagtacctgccctggtacaaggtgaacgacgtggagaagaccaagatgctgttccggcagatgcaggacatcgacgagatgaagaagatcatcgacaacagcctgatcggcctgcactgcaacgcctccatcaccgacctcgggaaggtcggcctgagcaagtactgggggcgcttcgtgctgaccgccggcatctccctcacggtggacgcccagctgatctaccagagccccaccggcctgttcgagcaccgggtcaaggtgtccgacctctga

SEQ ID NO: 1780 - RNA, 3990 nt, synthetic construct
  misc_feature 1..3990: note = Cas9 variant
  source 1..3990: mol_type = other RNA
atgaacaagcagccctacaacatcggcctggacatcgggaccagctccgtgggctggagcgccaccgagctcgacaaccgcctgctgcacatcaaggggcacaacggcatcggggtccggctgttcaaggagggcgagtccgccgcggaccgccggggcttccgcacgacccggcgccggctggcccgccggaagtggcgcctgcggctcctgaacgagatcttcgccaccgagatcgccaaggtggacccgagcttcttcgcccgcctgaagcagtccaacgtgagccccaaggaccccaacaagaccatgttcgggaacatcctcttcgacgacgagaacctggacgaccagaagttccaccacgactacaagacgatctaccacctccggcaggcgatcatcaaccaccccgagcagaagttcgacatccgcctcatctacctggccatgcaccacatcatcaagtaccggggccacttcctgaaccaggccaacgtccaggacttcaagggcgggaagatcgacctcgagaagtccttcaaggccctgaacgacatcttcgagaaccaggggcgcgacctgcggctcgtgaccgacgaggcgaaccagtacgtgaaggtcctgagcgacaacgccaagacccgctccgaccggaagaaggagctgagcaagctcctgtacgtgccgatcgacaaggacaccgacaagaactccaagaaggtgacgggcgagatcctgaaggccatcctcggcaacaaggccaagttcgacgtcatcttcgggatcgaggtggagaaccccaaggagtgggtgctgaccttcaacagcgacgacttcgacgacaagatcgagggcctgtccagccagatgaccgacgaggactccgagatcctcctgatcctgaaggagctctacttcgccctgaacctgagcgacatcctcaacaactccgtcaccgacaagaacgcgaagacgctgagcgaggccatgatcaaccgctacgacgaccacaagaaccagctggccatgctcaagaaggtgatcgactccagcgacaagaagcacgccaaggagctgaaggaggcctacagcgcgtacatcgacggggagaacaacaagaagatctccttcgaggacctgaagaagcggatccagaagaacctcgtggacagcgagctgtcccagaagatcaacgacctgctcgaccacgactacttcctgcccaagcagcgcagcaaggagaacggcgccatcccccaccagctgcagcagcaggagctcgaccagatcatcgagtcccagaagcagtactacccgttcctggccgagctgaaccccaacgagaagcgcagccggcaggccaagtacaagctcgacgagctggtcgccttccgcgtgtcctactacgtgggccccatggtcgaggtgaccgacagcaaccaggagaacaacgggaagttcgcgtggatgatccggaaggagcagggcgagatcaccccctggaacttcgacgagaaggtggaccgcaccgagacggccaccaagttcatcacccggatgaccacgaccgacacctacctgatcggggagccggtcctgcccaagaactccctcctgtaccagaagttcgtggtgctgaacgagctcaacaacctgaagatcaaccaggagaccatcacgcccggccagaagcagtacctgtacgagcacgtcatgaagaagaacaagcgcgtgaccctcaagaagatcgccgacgccctggtcatcaagggggactacccctacgccccggaggtgaagggcaccaccgaccagaagaacctgaacaacggcctcacgacctacatcgacctggcgaagatcttcgggaacgagctggacgacgtggaccgggaggccgacttcgagaagatcatcgagtggagcaccatcttcgaggaccagcacatcttcgtcctcaagctgcaggagctgaagtggctcaccgagaagcagcgcaaccaggtggtgaagctgcggtaccagggctgggggaagctgtccaaggagctcctggccggcctggtcgacgacaacgggcagcgcatcatcgacctcctgtggagcgacaaccagaacttcatgcagatcgtgaaccagaagtccttcaaggagagcatcgccgaccacaacggcgcgcacctggaggagaagaacctcaaggacgtgatcaacgacctgtacacgagcccccagaacaagaaggccatccggcaggtcatcctggtggtggacgacatcatcaacgccgtcggctacgagcccgccaacatcatgatggagttcgcccgcgaggactccaacgaccaccggctcaccaactcccgcagccggcagctggagaacgtgtacaaggacatcaccaactcctggttcgacaacgacagcgtgaaggacgagctggaggacaagatcaagaacaaggacaagttcaccgaccgcctctacctgtacttcacgcagggcgggaaggacctgtacaccggggagcccctcaacatcgacgacctgagctcctacgacatcgaccacatcctgccgcagagcttcatcctcgacaactccctggacaaccgggtcctgaccagccagcgcaacaaccgggtgtccaaggaggaccagctccccggcgagctgttcgggaccaagatgcacgcgttctggaagcgcctgaaggccgcccacctcatcagcaacaagaagtactacaacctgaccctgacgcccaactccatcagcaagttcaacaaccagggccgcttcatcaaccggcagctcgtggagacccgccaggtcatcaagctggccgccgagatcctgcacaaccggtactccgaggagaagggcaccaacatcgtgaccatcaaggcgaacctcacgcaccacatgcgcgagaagttcaacttctacaagaaccggaacgtgaacgactaccaccacgccttcgacgcctacctgaccgccttcgtcgggaactggctgctccagcagtaccccaagctgaagccgtacttcgtgtacggcgacttcgccaagaccgagatcaacaacctcaagagcttcaacatgctctacaagttcgagcaggcgcaccagctgaacgagaaggacgggaagatcgccaaggacaccgacgccctgctcggctacatgaagaacgtgtaccacttcaagaagatgctggtcacgaaggagctggagaccaaccacggcgccctcttcaaccagaccctgtacccctcccccgcgcacgacatcaagaagcgccagctgatcaagcccaaggacaaccggccgaccgacatctacgggggctacacgcacgaggagcgcaagtacatgagcctcgtgaaggtgatcgggaagaaggacaacgagtaccggatggccaacgtccccctgctgaagatcaacaagaacaacgacatcaaggagatcctcaagtcccagttcagcaacaagaagttcgagatcgtgctgcccaaggtgctgaagaaccagctgttctccgagaacggcgccctgttcgtcatcgggagcaagggctacaagtacaacgccaaccagctggtgctctccgacctggacatgaagctgctcaacgacctgagcaacaacaagagcatcgacgaggtgaccatcaaccagctgttcaagaacatcgtcgactccaccaacaagtacatgccgctctacgagatcaagaacctgaacgaggtggtggagaagttcaacaacctggagttcaacgacaagaagaagaccatcacggacttcctcctggccacccacgcgaaccccaccatgagcaacctgaagaacatcggcctcccctacttcgggcgcttcatccggaacaccggcatcaagctgtccgagaacgccaacgtcatctaccagagccccacggggctgttctcccgcaagatcaagatcagcgacttctga

SEQ ID NO: 1781 - RNA, 3993 nt, synthetic construct
  misc_feature 1..3993: note = Cas9 variant
  source 1..3993: mol_type = other RNA
atgaagaacgactacaccatcggcctggacatcgggaccaacagcgtgggctactccgtcgtgacggacgactacaaggtgatcagcaagaagatgaacgtcttcgggaacaccgagaagaagtccatcaagaagaacttctggggcgtgcgcctcttcgagagcgggcagaccgcccaggaggcccggatgaagcgcacctcccggcgccggatcgcgcgccggaagaaccgcatctgctacctgcaggagatcttccagcccgagatgaaccacctggacaacaacttcttctaccggctcaacgagagcttcctggtggccgacgacgccaagtacgacaagcacccgatcttcggcacgctggacgaggagatccacttccacgagcagttccccaccatctaccacctccgcaagtacctggccgacggcgacgagaaggccgacctgcggctcgtctacctggcgatcgcccacatcatcaagttccgcgggaacttcctgatcgagggcgagctcaacaccgagaacaactccgtgatcgagctgagcaaggtgttcgtccagctgtacaaccagaccctctccgagctggaggggttccagttcatcgacgagagcatcgacttctccgaggtgctgacgcagcagctcagcaagtccgagcgggccgacaacgtgctgaagctgttccccgacgagaagggcaccgggatcttcgcccagttcatcaagctcatcgtcggcaaccagggcaacttcaagaaggtgttccagctggaggaggaccagaagctgcagctcagcaccgacgactacgaggagaacatcgagaacctgctggcgatcatcggggacgagtacggcgacatcttcgtggccgcccagaacctctaccaggccatcctgctggccgggatcctcacctccacggagaagacccgcgcgaagctgagcgcctccatgatccagcggtacgaggagcacgccaaggacctgaagctcctgaagcgcttcgtcaaggagcacatccccgacaagtacgccgagatcttcaacgacgccaccaagaacggctacgcgggctacatcgacgggaagaccaaggaggaggagttctacaagtacctgaagacgaccctcgtgcagaagtccggctaccagtacttcatcgagaagatcgagcaggagaacttcctgcggaagcagcgcatctacgacaacggggtgatcccgcaccaggtccacgccgaggagctgcgggccatcctccgcaagcaggagaagtactacagcttcctgaaggagaaccacgagaagatcgagcagatcttcaaggtgcggatcccctactacgtgggccccctggccaagcacaacgagcagagccgcttcgcctggaacatccgcaagagcgacgagcccatccggccgtggaacatgaacgacgtcgtggacgagaacgcgtccgccgtggccttcatcgagcgcatgaccatcaaggacatctacctcaacgagaacgtcctgccccggcacagcctgatctacgagaagttcaccgtgttcaacgagctcacgaaggtcctgtacgccgacgaccgcggggtgttccagcggttctccgccgaggagaaggaggacatcttcgagaagctgttcaagagcgagcgcaaggtgaccaagaagaagctcgagaactacctgcggatcgagctgtccatcagctcccccagcgtcaagggcatcgaggagcagttcaacgcgaacttcggcacctacctggacctcaagaagttcgacgagctgcacccctacctggacgacgagaagtaccaggacaccctcgaggaggtgatcaaggtgctgacggtcttcgaggaccgctccatgatccagaaccagctggagcagctcccgctgaacctgagcaccaagaccatcaaggccctctcccggcgcaagtacaccgggtggggccggctgagcgcccgcctgatcgacgggatccacgacaagaactccggcaagacgatcctcgactacctgatcgaggacgagagcgactcctacatcgtgaaccggaacttcatgcagctgatcaacgacgaccacctcagcttcaagaagatcatcgaggactcccagccctacaaggagcagcagagcgccgaggagatcgtgtccgagctgagcgggagccccgcgatcaagaagggcatcctgcagtccctcaagatcgtcgacgagctggtggccatcatgggctacaagcccaagaacatcgtggtcgagatggcccgcgagaaccagaccaccgggcggggcaagcagaacagcaagccgcgcctgaaggggatcgagaacggcctcaaggagttctccgacagcgtgctgaaggggtccagcatcgacaacaagcagctgcagaacgaccggctctacctgtactacctgcagaacggcaaggacatgtacaccggccacgagctcgacatcgaccacctgtccacgtacgacatcgaccacatcatcccccagagcttcctgaccgacaactccatcgacaaccgcgtgctcaccaccagcaagtccaaccggggcaagagcgacaacgtcccctccgaggaggtggtgcgcaagatggaccgcttctggcggaagctgctgaacgccaagctcatcagcgagcgcaagtacacgaacctgaccaagaaggagctgaccgagtccgacaaggccgggttcctcaagcggcagctggtcgagacccgccagatcaccaagcacgtggcgacgatcctggacagcaagttcaacgaggactccaacaaccgggacgtgcagatcatcaccctcaagagcgccctggtcagcgagttccgcaagaccttcaacctgtacaaggtgcgggagatcaacgacctccaccacgcccacgacgcctacctgaacgccgtggtcgcgctgtccctcctgcgcgtgtacccccagctgaagccggagttcgtgtacggggagtacggcaagaacagcatccacgaccagaacaaggccaccatcaagaagcagttctactccaacatcacgcggtacttcgccagcaaggactacatcatcaacgacgacggcgagatcctctggaacaagcaggagaccatcgcccaggtcatcaagaccctggggatgcaccaggtgaacgtggtcaagaaggtggagatccagaagggcgggttctccaaggagagcatccagcccaagggcgagtcccagaagctgatccgccggaagcagcagtggaacaccaagaagtacgggggcttcgacagccccgtggtcgcctacgcgatcctcctgtccttcgacaagggcaagcgcaaggcccggagcttcaagatcgtggggatcacgatccaggaccgcgagtccttcgagggcaaccccatcctgtacctcagcaagaaggactaccacaacccgaaggtggaggccatcctgcccaagtactccctgttcgagttcgagaacgggcggcgccggatggtcgccagcgcgtccgagacccagaagggcaaccagctcatcatccccgggcacctgatggagctgctctaccacagcaagaagatcatcaacggcaagaactccgacagcgtgtcctacatccagaacaacaaggagaagttccgcgagatcttcgagtacatcgtggacttcagcagcaagtacatctccgccgacgccaacctgaacaagatcgagaagatcttcgagaacaacttccacaaggccagcgagcaggagatcgccaagtccttcatcaacctgctcaccttcaccgcgatgggcgcccccgccgacttcgagttcttcggggagaagatcccgcggaagcgctacgtcagcatctccgagatcatcgacgccgtgttcatccaccagagcatcacgggcctgtacgagacccgggtgcgcctgaccgaggtctga

SEQ ID NO: 1782 - RNA, 3993 nt, synthetic construct
  misc_feature 1..3993: note = Cas9 variant
  source 1..3993: mol_type = other RNA
atggagaaggagtacaccatcggcctggacatcgggaccaacagcgtgggctgggccgtcctcacggacgactaccgcctggtggcccggaagatgtccatccagggggacagcaaccgcaagaagatcaagaagaacttctggggcgcgcggctgttcgaggaggggaagaccgcccagttccgccggatcaagcgcaccaaccggcgccggatcgcccgccggcgccagcgggtgctcgccctgcaggacatcttcgccgaggagatccacaagaaggaccccaacttcttcgcgcgcctggaggagggcgaccgggtcgaggccgacaagcgcttcgccaagttcccggtgttcgccaccctctccgaggagaagaactaccaccggcagtaccccacgatctaccacctccgccacgacctggcgaacagcaaggagcaggccgacatccggctcgtgtacctggccatcgcccactgcctgaagtaccgcggccacttcctcttcgagggggagctggacaccgagaacacctccgtcaccgagaactaccagcagttcctgcaggcctaccagcagttcttccccgagcccatcggcgacctcgacgacgcggtgccgatcctgacggagcggctgagcaaggccaagcgcgtggagaaggtcctcgcctactacccctccgagaagtccaccgggaacttcgcccagttcctgaagctgatggtgggcaaccaggccaacttcaagaagaccttcgacctcgaggaggagatgaagctgaacttcacccgcgactgctacgaggaggacctgaacgagctcctggagaagacgtccgacgactacgcggagctgttcctcaaggccaagggggtgtacgacgccatcctgctgagccagatcctctccaagagcgacgacgagaccaaggccaagctgtccgccaacatgaagctgcggttcgaggagcaccagcgcgacctcaagcagctgaaggagctggtccggcgcgacctccccaagaagtacgacgacttcttcaagaaccggagcaagaacggctacgcgggctacgtgaaggggaaggccacccaggaggacttctacaagttcctgcgcaccgagctggccggcctcgaggagtcccagagcatcatggagaagatcgacctggagatctacctgctcaagcagcggacgttcgccaacggggtgatcccccaccagatccacctggtcgagatgcgcgagatcatggaccggcagaagcgcttctacccgttcctgaagggcgcccagggcaagatcgagaagctcctgaccttccggatcccctactacgtggggcccctggcgcaggagggccagtcccccttcgcctggatcaagcgcaagagcccgtcccagatcaccccctggaacttcgccgaggtggtcgacaaggagaacagcgccatcgagttcatcgagcggatgaccaaccaggacacgtacctccccaaggagaaggtgctgcccaagcagagcctgatctaccagcgcttcatgatcttcaacgagctgaccaaggtgtcctacaccgacgagcggggcaagagccactacttctccagcgagcagaagcgcaagatcttcaacgagctgttcaagcagcacccgcgggtcaccgagaagcagctgcgcaagttcctggagctcaacgagcagatcgactccacggagatcaaggggatcgagaccagcttcaacgcgtcctacagcacctaccacgacctgctgaagctctccgaccagatggacaccctgctggacgaccccgacatgacgaccatgttcgaggagatcatcaagatcctcaccatcttcgaggaccgggagatgatccgcgagcagctgaagccctacgagaccgtgctggggctccccgccatcaagaagctggccaagaagcactacacgggctggggccgcctgagcgagaagatgatccaggggatgcgggagaagcagtcccgcaagaccatcctcgactacctgatcgacgacgacgacttcccgtgcaaccggaaccgcaacttcatgcagctgatcaacgacgaccacctcagcttcaaggagaccatcgccaacgagctgatcatgtccgacagcaacgtgctgctcgaccaggtcaaggccatccccggctcccccgcggtgaagaaggggatctggcagagcatcaagatcgtcgaggagatcatcggcatcatcgggaaggcccccaagaacatcgtgatcgagatggcccgggagaaccagcgcacctcccggagccgcccgcggctgaaggccctggaggaggccctcaagaacatcgacagccccctgctgaaggactaccccacggacaaccaggcgctccagaaggaccgcctgtacctgtactacctccagaacggcaaggacatgtacaccggcgagcccctggagatccaccggctgagcgagtacgacatcgaccacatcatcccgcgcagcttcatcgtggacaactccctcgacaacaaggtcctggtgagctccaaggtgaaccgggggaagctggacaacgcccccgaccccctcgtcgtgaagcgcatgcggagccactgggagaagctgcaccaggccaagctgatctccgacaagaagctcgccaacctgaccaagcagaacctgaccgaggccgacaaggcgcgcttcatccagcggcagctcgtggagacccgccagatcacgaagcacgtcgccaacctgctgcaccagcacttcaacctcccggaggaggtgagcgccaccgagaagacctccatcatcaccctcaagagcacgctgacctcccagttccggcagatgttcgacatctacaaggtgcgcgagatcaaccaccaccaccacgcccacgacgcgtacctgaacggcgtcgtggccatgaccctgctgaagaagtaccccaagctcgcccccgagttcgtgtacgggagctacatcaagggcgacatcaaccagatcaacaaggccaccgccaagaaggagttctactccaacatcatgaagttcttcgagagcgaggagatcatctgcgacgagcagggggaggtcatctggaacaagaagcgggacctgtccacgatcaagaagaccatcggcgcgcaccaggtgaacatcgtgaagaaggtcgagaagcagaagggcgggttctacaaggagaccatcaacagcaaggccaaccccgagaagctgatcccgcgcaaggcctccctcgaccccctgaagtacggcgggtacggcagccccctggtggcctacaccgtgatcttcatcttcgagaagggcaagcagaagaaggtcacgaaggggatcgagggcatcaccgtgatggagcagctccgcttcgagcaggacccccgggagttcctgaagaccaaggggtacgagggcgtgaagcagtggctgatcctcccgaagtacatcctgttcgaggcccagggcgggtaccgccggatgatcgcgtcccaccaggagacccagaaggccaacagcctgatcctccccgagaacctggtcacgctgctctaccacgcccgccactacgacgagatcaaccacaaggtgagcttcgactacgtgaacgcccacaaggagggcttcaacgacatcttcgacttcatctccgacttcggggtccggtacatcctggcgccccagcacctggagaagatcaaggtggcctacgagaagaacaaggaggtggacctcaaggagatgatcgacgccatcctgagcctgctcaagttcaccctgttcggcgcctccgtcgagttcaagttcttcgacatcaagatcctgaagcgctacaagagcctcaccgacatctgggaggccaccatcatctaccagtccgtgacggggctgtacgagcggcgcgtggaggtccggaagctgtgggacggcgagcgcctctga

SEQ ID NO: 1783 - RNA, 3996 nt, synthetic construct
  misc_feature 1..3996: note = Cas9 variant
  source 1..3996: mol_type = other RNA
atgaacaagcagccctacaacatcggcctggacatcgggaccagctccgtgggctggagcgccaccgagctcgacaaccgcctgctgcacatcaaggggcacaacggcatcggggtccgcctcttcaaggagggcgagtccgccgcggaccggcggggcttccgcacgacccggcgccggctggcccgccggaagtggcgcctgcggctcctgaacgagatcttcgccaccgagatcgccaaggtggacccgagcttcttcgcccgcctgaagcagtccaacgtgagccccaaggaccccaacaagaccatgttcgagaacatcctcttcgacgacgagaacctggacgaccagaagttccaccacgactacaagacgatctaccacctccggcaggcgatcatcaaccaccccgagcagaagttcgacatccgcctcatctacctggccatgcaccacatcatcaagtaccgggggcacttcctgaaccaggccaacgtccaggacttcaagggcgggaagatcgacctcgagaagtccttcaaggccctgaacgacatcttcgagaaccagggccgcgacctgcggctcgtgaccgacaaggcgaaccagtacgtgaaggtcctgagcgacaacgccaagacccgctccgaccggaagaaggagctgagcaagctcctgtacgtgccgatcgacaaggacaccgacaagaactccaagaaggtgacgggggagatcctgaaggccatcctcggcaacaaggccaagttcgacgtcatcttcggcatcgaggtggagaaccccaaggagtgggtgctgaccttcaacagcgacgacttcgacgacaagatcgaggggctgtccagccagatgaccgacgaggactccgagatcctcctgatcctgaaggagctctacttcgccctgaacctgagcgacatcctcaacaactccgtcaccgacaagaacgcgaagacgctgagcgaggccatgatcaaccgctacgacgaccacaagaaccagctggccatgctcaagaaggtgatcgactccagcgacaagaagcacgccaaggagctgaaggaggcctacagcgcgtacatcgacggcgagaacaacaagaagatctccttcgaggacctgaagaagcggatccagaagaacctcgtggacagcgagctgtcccagaagatcaacgacctgctcgaccacgactacttcctgcccaagcagcgcagcaaggagaacggggccatcccccaccagctgcagcagcaggagctcgaccagatcatcgagtcccagaagcagtactacccgttcctggccgagctgaaccccaacgagaagcgcagccggcaggccaagtacaagctcgacgagctggtcgccttccgcgtgccctactacgtgggccccatggtcgaggtgaccgactccaaccaggagaacaacggcaagttcgcgtggatgatccggaaggagcagggggagatcaccccgtggaacttcgacgagaaggtggaccgcaccgagacggccaccaagttcatcacccggatgaccacgaccgacacctacctgatcggcgagcccgtcctgcccaagaacagcctcctgtaccagaagttcgtggtgctgaacgagctcaacaacctgaagatcaaccaggagatcatcacccccgggcagaagcagtacctgtacgagcacgtcatgaagaagaacaagcgcgtgacgctcaagaagatcgccgacgccctggtcatcaagggcgactacccgtacgcccccgaggtgaaggggaccaccgaccagaagaacctgaacaacggcctcaccacgtacatcgacctggcgaagatcttcggcaacgagctggacgacgtggaccgggaggccgacttcgagaagatcatcgagtggtccaccatcttcgaggaccagcacatcttcgccctcaagctgcaggagctgaagtggctcaccgagaagcagcgcaaccaggtcgtgaagctgcggtaccaggggtggggcaagctgagcaaggagctcctggccgggctggtggacgacaacggccagcgcatcatcgacctcctgtggtccgacaaccagaacttcatgcagatcgtcaaccagaagtccttcaaggagagcatcgcggaccacaacggggcccacctggaggagaagaacctcaaggacgtgatcaacgacctgtacaccagcccccagaacaagaaggccatccgccaggtgatcctggtcgtggacgacatcatcaacgccgtgggctacgagcccgccaacatcatgatggagttcgcgcgggaggactccaacgaccaccggctcacgaacagccgctcccggcagctggagaacgtctacaaggacatcaccaacagctggttcgacaacgactccgtgaaggacgagctggaggacaagatcaagaacaaggacaagttcaccgaccgcctctacctgtacttcacccagggcgggaaggacctgtacacgggcgagccgctcaacatcgacgacctgagcagctacgacatcgaccacatcctgccccagtccttcatcctcgacaacagcctggacaaccgggtgctgacctcccagcgcaacaaccgggtcagcaaggaggaccagctccccggggagctgttcggcaccaagatgcacgccttctggaagcgcctgaaggccgcccacctcatctccaacaagaagtactacaacctgaccctgacccccaacagcatctccaagttcaacaaccaggggcgcttcatcaaccggcagctcgtggagacgcgccaggtgatcaagctggccgcggagatcctgcacaaccggtacagcgaggagaagggcaccaacatcgtcaccatcaaggccaacctcacccaccacatgcgcgagaagttcaacttctacaagaaccggaacgtgaacgactaccaccacgccttcgacgcctacctgacggccttcgtgggcaactggctgctccagcagtacccgaagctgaagccctacttcgtctacggggacttcgcgaagaccgagatcaacaacctgaagtccttcaacatgctctacaagttcgagcaggcccaccagctgaacgagaaggacggcaagatcgccaaggacgccgacgcgctgctcgggtacatgaagaacgtgtaccacttcaagaagatgctggtgaccaagaagctggagaccaaccacggcgccctcttcaagcagacgctgtaccccagccccgcccacgacatcaagaagcgccagctgatcaagccgaaggacaaccggcccaccgacatctacggcgggtacacccacgaggagcgcaagtacatgtccctcgtcaaggtgatcggcaagaaggacaacgagtaccggatggccaacgtgcccctgctgaagatcaacaagaacaacgacatcaaggagatcctcaagagccagttctccaacaagaagttcgagatcgtcctgccgaaggtgctgaagaaccagctgttcagcgagaacggggccctgttcgtgatcggctccaaggggtacaagtacaacgcgaaccagctggtcctcagcgacctggacatgaagctgctcaacgacctgtccaacaacaagagcatcgacgaggtgaccatcaaccagctgttcaagaacatcgtggacagcacgaacaagtacatgcccctctacgagatcaagaacctgaacgaggtcgtggagaagttcaacaacctggagttcaacgacaagaagaagaccatcaccgacttcctcctggccacccacgccaaccccacgatgtccaacctgaagaacatcggcctccccagctacttcggccgcttcacctccgggaacgccggcatcaagctgagcgagaacgccaacgtgatctaccagtccccgaccgggctgttcagccggaaggtcaagatctccgacttctga

SEQ ID NO: 1784 - RNA, 3999 nt, synthetic construct
  misc_feature 1..3999: note = Cas9 variant
  source 1..3999: mol_type = other RNA
atgaagaaccgcgagaacatcaagtactacatcggcgtggacatcgggaccaacagcgtcggctgggccgtgatcgacgagaacgggaacctgctcaagaagggcaagcaccacctgtgggggtcccggctgttcgaccaggcccagaccgcgcagaaccgccggaactaccgcagctcccggcgccggtacaacaagcgccggcagcgcatcggcctcctgcggctgatcatgagcgacatggtgctcgaggtcgacccctccttcttcatccgcctggagaagacgaccttcctggacaaggaggacaagaaggccatcctcaaggacaactacaagatgaactacaacctgttctgcgacgaggactacaacgacaagaagtacttcaaggactacccgaccatctaccacctccggaagaagctctgcgagagcgacgagaaggccgacccccgcctgatctacctggccctccaccacatcgtgaagtaccggggcaacttcctgtacgaggggcaggagctgcacctcgagccctccaacaaggaggaggacctgaagatcctgttcgacatcctcggcaagaacaacgacaccgtgtacgacatcagcgaggagcagatccagttcatcctgaagacggtcgtggagaacatctccaagaccgccaaggtggacgagtgcatgagccagctgaagctcaactccgaggacaagaagatcgtcaaggagttcatgcgcgggctggtgggcaacaagttcaacgtgagcaagctgtacatgcacgaggacctccagttcgacgacgaggacctgaagctgcagttctccgacaagagctacgaggagaagatcaccgagtacgagaacgtcctcgaggagaagatggagttcatcgacctgatgcagcggttctactcctggatcgagctgagcaagatcgtggggtccgacagccagcacgcgtccatcagcggcgccatggtgaacatctacgagagccaccgcgaggacctccggaccctgaaggaggtcatgctgaagatcggcaagaaggagtacgacgagatgttcaagcccacgtccaagaacgtggtgaactactacaactacgtcaacccggtggcctgcagcggggacaagaccgacggcttctacaagtacgtgaagaaggccatcgagaagtccgacgacagccgcaaggacgagatcctccagaagatcgcgaacgagacctacatgctgaagcagacctccaagaacaacgcctacatcccctaccagatgcagaaggacgagctgatcaagatcctcgaccaccaggagaagtactaccccgtcctgaaggagaaccgggacaagatcatcagcatcctggagttccgcatcccctactactacgggccgctcgacggcaacaagcagttcggctggctgatcaagaagaaggggaaggagaacgagcgcatcctgccctggaaccaccaggagatcgtggacgtgcaggagacggccgcccagttcatcaagaagctcaccaactactgcacctacctgcccatcgagaaggtcatgccccagaagtccctgacctgcagcatgtacgaggtgctctccgaggtcaacaagatccggatcgacggcaagctgctgccgatcgacacgaagaaccgcctgatcgaggacctcttcttcaagcggaagaccgtgaaggagaaggacctgatcaactggctgaagcagaaccagctcaccgtgggggagatcaccggctaccagaaggagaaggccttcagctccagcctggcgccctggatcgacttcaaggagatcttcgacgagatcaacgactccaactacgacctgatcgagaagatcatcgaggacatgacgatcttcaacgaggggagcatcctcaaggagcgcctgaagaaggcctacaacctggaccagaacaaggtcaagaagatcatgaagctcaagtactccggctggagccggctgtccaagaagctgatcaacggcatccgcgccgacaacaagttcgggagctccgtgagcatcctcgacgtgatgaaggagagccacatggccctgatggagatcatcaacgaccaggacctgggcttcaagcagatcatcgagaaggagaacttcaagaacgagaccgggtccttcgagtacgaggacatcgagaacctcgccggcagccccgcgctgaagcgggggatctggcagaccctgcaggtcatcgaggagatcaagaactacatgggccacgagcccaagaacatctacatcgagttcgcccgcgaggagcaggagaaggtgcggaccacgacccgcgtgaagaagctcaagtccatctacaacgacatcaagaaccagctggacgtccacggcaaggaggtgtacagcaacctgaacaagcaggacgagaagtccagcatcgagaagcggctctacctgtactacacccagctggggaagtgcatgtactccggcgagagcctcgacatcgacaagctgtccaactacgagatcgaccacatcttcccgcgcaccctgacgagcgacgactccctcgacaacctggtgctggtcaagaagaaggagaaccagcggaagctcgacgacctggtgctgcccctcgagatccgcaacaagatggaggtgttctggaagaagctgtacgacaacgggctgatcacccagaccaagtactaccggctcatgcgcgacgagttccggcgcgaccagatcgacaagttcatcaaccggcagctggtcgagacccgccagatcatcaagcacgtggccaacatcatcgagaaccactacgaggacacgaaggtgttcaccgtccgcgccaacctgagccacgagttccgggagaagtacggcatctacaagaaccgcaacgtgaacgacttccaccacgcccacgacgcgtacatcgcctgcatcatcgggcggtacatccagatccgcttccccggcctcgaggccaagtacgtgtacggccagtacatgcagaacgtcaagaagaccaagaacaacatcgacaaggagaaccacgggttcatcatcaactccatgaagtacgagtgcatcgacgaggacaccggcgaggtgatctggaaccccgagcggatcctggactacatcaagtgcttcaactaccgcgacgtgtacatcacgaagaagctggacaccaacaaccgggagctgttcaacgtcaccatcctgccgaacgacaagaacagcgagaaggggaagaccaaggccaccatccccgtgaacaagctgcgctccaacgtgcggaagtacggcggcttcagcgggctccagtccgacatcgtcgccatcgagggcaagaaggggaagaagatcgaccgccggctgatcaacctgcccatcctcctgcgctacgtgagcatcgaggaccagtgcaagtacatcatggagaacaacaagtacagcgacgtgaagatcatcaagaagatcaagaagaaccagctgatcgagatcgacggcatctgctactacctcaagtccgcggacgagctggacacggcctaccagctgatcctcagccgggacgacaacgagatgatctaccgcatcgaccgggccatccagaacaacgacttctcctacttcgacaacaagaaggagaacatcgacgagctgtaccgcctgatctgccacaagatgatcgagaactaccccaagtacaagaagaaggtctacgagttcatcaaggagcgggaggaggagttcttcgagctcgacaacagccagaagtgcatcgtgatcttcgagatgatccgcgtgatgaagcgcggggagcagtacatcaacatcccgttcgagccctacaacctgaagaacgaccggaagggccggctgaactgccagtccatcctcctggacaacacctacttctacgacgtcagcatcaccggcatctactccaagaagtacaagctgtga

SEQ ID NO: 1785 - RNA, 3999 nt, synthetic construct
  misc_feature 1..3999: note = Cas9 variant
  source 1..3999: mol_type = other RNA
atgcagaagaactacaccatcggcctggacatcgggaccaacagcgtgggctgggccgtcatgaaggacgactacacgctcatccgcaagcggatgaaggtgctggggaacaccgacatcaagaagatcaagaagaacttctggggcgtgcgcctgttcgacgagggggagaccgccaaggagacccggctcaagcgcggcacgcggcgccggtaccagcgccggcgcaaccggctgatctacctgcaggacatcttccagcagcccatgctcgcgatcgacgagaacttcttccaccgcctggacgactccttcttcgtcccggacgacaagagctacgaccggcaccccatcttcggctccctggaggaggaggtggcctaccacaacacctaccccaccatctaccacctccgcaagcacctggccgacaaccccgagaaggccgacctgcggctcgtgtacaccgccctggcgcacatcgtcaagtaccgcgggcacttcctgatcgagggcgagctcaacacggagaacaccagcatctccgagaccttcgagcagttcctggacacctacagcgacatcttcaaggagcagctggtgggggacatctccaaggtggaggagatcctcagctccaagcagagccggtcccgcaagcacgagcagatcatggccctgttcccgaacgagaacaagctgggcaacttcgggcggttcatgatgctcatcgtcggcaacacgagcaacttcaagcccgtgttcgacctggacgacgagtacaagctgaagctctccgacgagacctacgaggaggacctggacaccctgctcggcatgaccgacgacgtgttcctggacgtcttcatggccgccaagaacgtgtacgacgcggtggagatgagcgccatcatctccacggacaccgggaacagcaaggccgtcctgtccaaccagatgatcaacttctacgacgagcacaaggtggacctcgcccagctgaagcagttcttcaagacccacctccccgacaagtactacgagtgcttcagcgacccctccaagaacggctacgccgggtacatcgacggcaagaccaaccaggaggacttctacaagtacatcgagaaggtgatgaagacgatcaagagcgacaagaaggactacttcctcgacaagatcgaccgcgaggtcttcctgcggaagcagcgcagcttctacaactccgtgatcccgcaccagatccacctccaggagatgcaggcgatcctggaccgccagagccagtactaccccttcctggccgagaaccgggacaagatcgagtccctggtgaccttccgcatcccctactacgtcggccccctcaccgtgagcgaccagtccgagttcgcctggatggagcggcagagcgacgagccgatccgcccctggaacttcgacgagatcgtgaacaaggagcggtccgccgagaagttcatcgagcgcatgaccaacatggacacgtacctgctggaggagaaggtcctccccaagcggagcctgctgtaccagaccttcgaggtgtacaacgagctcaccaaggtccgctacaccaacgagcaggggaagacggagaagctgaaccggcagcagaaggccgagatcatcgagaccctgttcaagcagaagaaccgcgtgcgggagaaggacatcgcgaactacctcgagcagtacggctacgtggacgggaccgacatcaagggcgtcgaggacaagttcaacgcctccctgagcacctacaacgacctggccaagatcgacggggccaaggcctacctggacgaccccgagtacgcggacgtgtgggaggacatcatcaagatcctcacgatcttcgaggacaaggccatgcgcaagaagcagctgcagacctactccgacaccctgagcccggagatcctcaagaagctggagcggaagcactacaccggctggggccgcttctccaagaagctgatcaacgggctccgggacgagggcagcaacaagacgatcctggactacctgaagtccgacgaggggagctccggccccaccaaccgcaacttcatgcagctcatccgggacaacaccctgagcttcaagaagaagatcgaggacgcccagaccatcgaggacaccacgcacatctacgacaccgtggccgagctgcccgggtcccccgccatcaagaagggcatccgccaggcgctcaagatcgtcgaggagatcatcgacatcatcggctacgagccggagaacatcgtggtggagatggcccgggagagccagaccaccaagaaggggaaggacctgagcaaggagcgcctggagaagctcacggaggccatcaaggagttcgacggcccctccgacgtcaaggtgaaggacctgaagaacgagaacctgcgcaacgaccggctctacctgtactacctgcagaacgggcgcgacatgtacaccaacgagcccctcgacatcaacaacctgagcaagtacgacatcgaccacatcatcccccagtccttcaccaccgacaacagcatcgacaacaaggtgctggtctcccggacgaagaaccagggcaacaagagcgacgacgtgccgtccatcaacatcgtgcacaagatgaagcccttctggcgccagctccacaaggccgggctgatcagcgaccggaagttcaagaacctgaccaaggcggagcacggcggcctcaccgaggccgaccgcgcccacttcctgaaccggcagctggtcgagacccgccagatcacgaagcacgtggccaacctcctggactcccagtacaacaccgccgaggagcagcggatcaacatcgtgctgctcaagagctccatgaccagccgcttccggaaggagttcaagctgtacaaggtccgcgagatcaacgactaccaccacgggcacgacgcgtacctgaacgccgtggtggccaccacgatcatgaaggtctaccccaacctcaagccccagttcgtgtacggccagtacaagaagacctccatgttcaaggaggagaaggccaccgcccggaagcacttctacagcaacatcaccaagttcttcaagaaggagaaggtggtcaacgaggagacgggggagatcctgtgggacaccgagcgccacctgtccaccatcaagcgggtgctcagctggaagcagatgaacatcgtgaagaaggtcgagaagcagaagggccagctgtggaaggagaccatctacccgaagggcgactccagcaagctgatccccgtgaaggaggggatggacccccagaagtacggcgggctcagccaggtgtccgaggcgttcgccgtcgtgatcacgcacgagaagggcaagaagaagcagctcaagagcgacctgatctccatcccgatcgtggaccagaaggcctacgagcagcaccccaccgcctacctggaggaggccgggtacaacaaccccaccgtcctgcacgagctgttcaagtaccagctgttcgagctggaggacggcagccgccggatgatcgcgtccgccaaggagttccagaagggcaaccagatggtgctgcccctcgagctggtggagctgctctaccacgccaaccgctacgacaaggtcaagttcccggacagcatcgagtacgtgcacgacaacctggccaagttcgacgacctgctcgagtacgtgatcgacttctccaacaagtacatcaacgcggacaagaacgtccagaagatccagaagatctacaaggagcacgggaccgaggacgtggagctgacggtggagagcttcgtcaacctgatgaccttcaccgccatgggcgcccccgccaccttcaagttctacggggagtccatcacgcggagccgctacacctccatcaccgagttccggggcagcaccctcatcttccagtccatcacggggctgtacgagacccgctacaagctggaggacaactga

SEQ ID NO: 1786 - RNA, 3999 nt, synthetic construct
  misc_feature 1..3999: note = Cas9 variant
  source 1..3999: mol_type = other RNA
atgatgaaggagtacagcatcggcctggacatcgggtccagctccgtgggcttcgtcgccgtggacgaccagtaccgcgtggtccgggccaaggggaagaacgtgatcggcacccgcctcttcgacgaggggaagaccgcggccgaccggcgcggcctgcggacgacccgccggcgcctgagccggcgcaagtggcggctccgcctgctgcggggcatcttcgagccccacatcaacgagatcgacgagtccttcttcatgcgcctcaaggagagcaacatctccccgaaggacagcaacaagcacttccccggggacatcctgttcaacgaccggtccgaccgcgagttctacgagaactaccccaccatctaccacctccggcaggccctcaagaccgagaagcgccagttcgacatccgggagatctacctggccatgcaccacatcgtgaagtaccgcggccacttcctggagggcgggacggtcaccgacttcgaggtgggggagctcgacctggccggcaagttcagccggctgaacgagctgttcgagtccatcaacctggaggtgcccttcgtcctgcgcctcgacaacctggaggacgtgaaggcggtgctgatcgacagccagcgctccgcccaggaccggcagcgcaccctcaccccggacatctacgtccccagcacggacaagatcaccgagaagcggttcaagggcatcgccaccgagctgctgaaggccatcgtggggaacaaggcgaagttcgacgtgctcgccggcctggagctggacaaggaggaggccaagctctgggccctgaccttcgactccgagacgttcgacgaggacatcgagcagctggagggggacatgaccgaggccacccaggacctcatcgagatcctcaagagcctgcgctccctcatccggctggcggtcaacatgcccgagggcgtgagcctgtccgagatgatgatccagcgctacgaggaccacgccgaccacctcaagctgctgcgggacatcatccacaacaccgacgccgagaaggccgccggcctccaggcggcctacgacgggtacatcgacggcgtgaaggggaagaagacgcccgtcgacgacttctacaaggccatcaagaagaacctggacgacagcgaggccgcccaccagatcctggcgctcatcgacaagaacgagttcatgccgaagcagcgcagcaagtccaacggctggatcccccaccagatccagcagaaggagctggaccggatcatcgagaaccagaagcagtactacccctggctggccgacgtgaaccccaacgagagccgccggaaggtggccccgtacaagatcgacgagctcgtcaccttccgcgtgccctactacgtggggcccctggtcacctccgaggagcagaagaagtacggcagcaagttcgcctggatggtgcggaaggaggagaagggcgagatcaccccctggaacttcgaccagaaggtcgaccgcgccgcgtccgccacggagttcatcaaccggatgaccaccatggacacctacctgctcaacgaggacgtgctgccggcccacagcctgatctaccagaagtacgaggtgctgaacgagctcaacaaggtcaagatcaacggggacgccatcacgcccgagctgaagcagaagatctaccacgacctgttcgagaagcagaccaccgtgtccatcaagaacctccagacctacctggtgagcgagtccgaggcgagcgaggtccccgagatcaagggcctggccgacgagaagaagttcctctccgggctgacgacctaccacgacctgatgaagatcttcgaccgcaacgtggtgaacgaccccgagcgggccgaggacttcgagaagatcatccgctggagcaccgtcttcgaggacaagcacatctaccgggagaagctcgactccctgagctggctgaccacggaccagaaggaccgcctcgccgtgaagcgctaccggggctgggggcgcctgtccgagaagctgctcatcggcctgcgggacgagggccaccgcagcatcatggactacctgtgggagaccacctccaacttcatgcagatccaggcccagaacgacttcagcgagaagatcgcggccgagaacaaggagttcctcgacaacacccagtccgtgcaggggatcatcaacgagctgtacacgagcccgcagaacaagaaggccatccggcagaccctgctcgtcgtggaggacatcaagaaggccttccacggcgaggcccccaagcgcatcttcgtggagttcgcgcgggagaacgagagcacgccccagcgctccatccagcggcagcgccaggtcgagaacgcctacgagaaggtgacccagaacctgctggtggacgacaagatccgggccgagctcaaggacagcatcaacgagaagcgcctgttccacgaccggctgttcctctacttcatgcagggcgggatcgacatgtactccgggaagaagatcaacatcgacaacctgagcgcctacgacatcgaccacatcctgccccagtccttcaccgtcgacaacagcctcgacaaccgcgtgctgaccaaccagaaggacaaccgggagaagggcaactccctgccgagcgagctctaccgcggctccatgaaggagacctgggagatgatgcggaaccaggggctgctgagcaagggcaagttccaccgcctcatgatgacccccaactccatgaccgcctacgaccagcaggggttcatcaaccggcagctggtggagacgcgccaggtcatcaagctggcggtggagatcctcgccagcgagttcgaccaggccgacgagaaggtggagatcgtctccgtgaaggccggcctgacccaccagatgcggcaggacttcagcctgatcaagaaccgcgacgtgaacgactaccaccacgcgttcgacgcctacctcaccgccttcgtcggcacctacctgctgaagcgctaccccaagctccggccctacttcgtgtacggggagttcaagaagttctcccagaagcaggccaacctgacgaacttcaacttcctgtgggccctcaagcacaaggaccaggtggcggtcgaggacaccggcgagaagatctggaacaagccgcaggacctggcctacatccgccacctgttcgccttcaagaagatcctcatcagccgggaggtgtccgagcgccacggggccctgttcgaccagaccctgtacaaggccagcgacgacaaggcgagcggccaggggtccaagaagctcatccccgccaaggacaaccggcccaccgagctgtacggcggctacagcgggcagacgtccgccttcatggccatcgtgaaggtcaccaagggcaagaagaccaagtacctggtggtgggggtcccgaccgccgcgatcagccagctccagggcatggacgtgaagtccagccagtacacggagaagatctacaacatcctgtcccccaagctgctcagcaagaacgacgacttcgaggtgatcgtccccaaggtgcgctaccggcagctgatcctggacaacaaccagctgttcaccctggggtccgacacctacaagtacaacgcccgccagctggtgctcagcaacgaggtcctggccgtgatcaaccgggacaagtccttcatcgacaagaagctgagcgaggaggccgagaaccaggcgctcaacgacgccttcgacgagatcgtggtcgccatggacaagcacttcgacctgtacgacaagaacggcttccgcgagaaggtgaaggccggcaagcagcggttcgaggagctgcccgtgtccctcttcagcgaggacaaggagaacgaggggatcaccaagcgcacggtcctgaagcggatcctgcagggcctccacgccaacgcgaccacctccgacctgaaggtgctggacgggaagttctacaactga

SEQ ID NO: 1787 - RNA, 4002 nt, synthetic construct
  misc_feature 1..4002: note = Cas9 variant
  source 1..4002: mol_type = other RNA
atgaagaactacaccatcggcctggacatcggggtggccagcgtcggctgggtgtgcatcgacgagaactacaagatcctcaactacaacaaccgccacgccttcggggtgcacgagttcgagtccgcggagagcgccgccggccggcgcctgaagcgggggatgcgccggcgctacaaccggcgcaagaagcggctgcagctcctgcagtccctgttcgacagctacatcaccgactccggcttcttcagcaagacggactcccagcacttctggaagaacaacaacgagttcgagaaccgcagcctcaccgaggtcctgtccagcctgcggatctccagccgcaagtaccccaccatctaccacctccggtccgacctgatcgagagcaacaagaagatggacctgcgcctcgtgtacctggccctgcacaacctcgtgaagtaccggggccacttcctgcaggaggggaactggtccgaggccgcgagcgccgagggcatggacgaccagctgctcgagctggtcacccgctacgccgagctggagaacctctccccgctggacctgagcgagtcccagtggaaggccgcggagacgctcctgctgaaccggaacctcaccaagaccgaccagagcaaggagctgaccgccatgttcgggaaggagtacgagcccttctgcaagctggtggccggcctcggggtgagcctgcaccagctgttcccctccagcgagcaggccctcgcctacaaggagacgaagaccaaggtccagctgtccaacgagaacgtggaggaggtgatggagctgctcctggaggaggagagcgcgctgctcgaggccgtccagcccttctaccagcaggtcgtgctgtacgagctgctcaagggcgagacctacgtggccaaggccaaggtgtccgccttcaagcagtaccagaaggacatggcgagcctgaagaacctgctcgacaagaccttcggcgagaaggtgtaccgctcctacttcatcagcgacaagaactcccagcgggagtaccagaagtcccacaaggtcgaggtgctgtgcaagctggaccagttcaacaaggaggccaagttcgccgagacgttctacaaggacctcaagaagctgctggaggacaagagcaagaccagcatcgggaccaccgagaaggacgagatgctgcgcatcatcaaggccatcgactccaaccagttcctccagaagcagaagggcatccagaacgccgcgatcccgcaccagaacagcctgtacgaggccgagaagatcctgcggaaccagcaggcccactaccccttcatcacgaccgagtggatcgagaaggtgaagcagatcctcgccttccgcatcccctactacatcgggcccctggtcaaggacaccacccagtccccgttcagctgggtggagcgcaagggcgacgcccccatcacgccctggaacttcgacgagcagatcgacaaggcggcctccgccgaggccttcatcagccggatgcgcaagacctgcacctacctgaagggccaggaggtgctccccaagtccagcctgacctacgagcggttcgaggtcctgaacgagctcaacgggatccagctgcgcacgaccggcgcggagagcgacttccggcaccgcctgtcctacgagatgaagtgctggatcatcgacaacgtgttcaagcagtacaagaccgtcagcaccaagcggctcctgcaggagctgaagaagtccccgtacgccgacgagctctacgacgagcacacgggggagatcaaggaggtgttcggcacccagaaggagaacgccttcgccaccagcctgtccgggtacatcagcatgaagtccatcctgggcgccgtggtcgacgacaaccccgcgatgaccgaggagctcatctactggatcgccgtgttcgaggaccgcgagatcctgcacctgaagatccaggagaagtaccccagcatcacggacgtgcagcggcagaagctcgccctggtcaagctgcccggctgggggcgcttctcccggctcctgatcgacggcctgccgctcgacgagcaggggcagagcgtgctggaccacatggagcagtactccagcgtgttcatggaggtcctgaagaacaagggcttcgggctcgagaagaagatccagaagatgaaccagcaccaggtggacggcaccaagaagatccgctacgaggacatcgaggagctggccggctcccccgccctgaagcgggggatctggcgcagcgtgaagatcgtcgaggagctcgtgtccatcttcggcgagcccgcgaacatcgtgctggaggtcgcccgggaggacggggagaagaagcgcaccaagagccggaaggaccagtgggaggagctgaccaagacgaccctcaagaacgaccccgacctgaagtccttcatcggcgagatcaagagccagggggaccagcgcttcaacgagcagcggttctggctgtacgtgacccagcagggcaagtgcctctacaccggcaaggccctggacatccagaacctgagcatgtacgaggtggaccacatcctcccgcagaacttcgtcaaggacgactccctggacaacctggccctcgtgatgcccgaggccaaccagcgcaagaaccaggtggggcagaacaagatgcccctggagatcatcgaggcgaaccagcagtacgccatgcgcaccctgtgggagcggctccacgagctgaagctgatcagctccggcaagctcgggcgcctgaagaagcccagcttcgacgaggtcgacaaggacaagttcatcgcccggcagctggtggagacgcgccagatcatcaagcacgtgcgggacctcctggacgagcgcttctccaagagcgacatccacctggtcaaggccggcatcgtgtccaagttccggcgcttcagcgagatcccgaagatccgggactacaacaacaagcaccacgcgatggacgccctcttcgccgccgccctgatccagtccatcctgggcaagtacgggaagaacttcctcgcgttcgacctgagcaagaaggaccgccagaagcagtggcggtccgtgaagggcagcaacaaggagttcttcctgttcaagaacttcgggaacctccgcctgcagtcccccgtcaccggcgaggaggtgagcggggtggagtacatgaagcacgtctacttcgagctgccctggcagaccaccaagatgacgcagaccggcgacggcatgttctacaaggagtccatcttcagccccaaggtgaagcaggccaagtacgtgtccccgaagaccgagaagttcgtccacgacgaggtgaagaaccacagcatctgcctcgtggagttcaccttcatgaagaaggagaaggaggtccaggagacgaagttcatcgacctgaaggtgatcgagcaccaccagttcctgaaggagcccgagtcccagctcgccaagttcctggccgagaaggagaccaacagccccatcatccacgcccggatcatccgcaccatcccgaagtaccagaagatctggatcgagcacttcccctactacttcatcagcacccgggagctgcacaacgcgcgccagttcgagatctcctacgagctcatggagaaggtgaagcagctgagcgagcggtccagcgtcgaggagctgaagatcgtgttcgggctcctgatcgaccagatgaacgacaactaccccatctacacgaagtccagcatccaggaccgcgtgcagaagttcgtcgacacccagctgtacgacttcaagtccttcgagatcggcttcgaggagctcaagaaggccgtggccgccaacgcccagcggagcgacaccttcgggtcccgcatcagcaagaagcccaagccggaggaggtggcgatcggctacgagtccatcaccgggctgaagtaccggaagccccgcagcgtcgtgggcacgaagcgctga

SEQ ID NO: 1788 - RNA, 4002 nt, synthetic construct
  misc_feature 1..4002: note = Cas9 variant
  source 1..4002: mol_type = other RNA
atgagccagaacatcgtggactactgcatcggcctggacctcgggaccggctccgtcgggtgggccgtggtggacatgaaccaccgcctgatgaagcggaacggcaagcacctgtgggggagccgcctcttctccaacgccgagaccgcggccaaccggcgcgccagccggtccatccgccggcgctacaacaagcggcgcgagcggatccgcctgctgcgggccatcctccaggacatggtcctggagaacgaccccacgttcttcatccgcctggagcacaccagcttcctcgacgaggaggacaaggccaactacctgggcgcggactacaaggacaactacaacctgttcatcgacgaggacttcaacgactacacctactaccacaagtacccgaccatctaccacctccggaaggccctgtgcgagtccacggagaaggccgacccccgcctgatctacctcgccctgcaccacatcgtgaagtaccggggcaacttcctgtacgaggggcagaagttcaacatggacgcgagcaacatcgaggaccgcctctccgacgtgttcacccagttcgccgacttcaacaacatcccctacgaggacgacgagaagaagaacctggagatcctggagatcctcaagaagcccctgagcaagaaggccaaggtcgacgaggtgatggccctgatcgccccggagaaggacttcaagtccgcgtacaaggagctcgtgaccggcatcgccgggaacaagatgaacgtcaccaagatgatcctgtgcgagcccatcaagcagggcgacagcgagatcaagctgaagttctccgacagcaactacgacgaccagttctccgaggtggagaacgacctcggggagtacgtggagttcatcgacagcctgcacaacatctactcctgggtcgagctgcagacgatcatgggcgccacccacacctacaacgccagcatctccgaggccatggtgagccggtacaacaagcaccacgaggacctccagctgctgaagaagtgcatcaaggacaacgtgcccaagaagtacttcgacatgttccgcaacgacagcgagaagctcaagggctactacaactacatcaaccacccctccaaggcgccggtcgacgagttctacaagtacgtgaagaagtgcatcgagaaggtggacacccccgaggccaagcagatcctgcacgacatcgagctggagaacttcctcctgaagcagaacagccggacgaacgggtccgtcccctaccagatgcagctggacgagatgatcaagatcatcgacaaccaggccaagtactaccccgtgctcaaggagaagcgcgagcagctgctgagcatcctcaccttcaagatcccgtactacttcggccccctgaacgagacctccgagcacgcctggatcaagcgcctggaggggaaggagaaccagcggatcctcccctggaactaccaggacatcgtggacgtcgacgccaccgcggagggcttcatcaagcgcatgcggagctactgcacgtacttccccgacgaggaggtgctgccgaagaactccctgatcgtgagcaagtacgaggtctacaacgagctcaacaagatccgcgtggacgacaagctgctggaggtcgacatcaagaacgacatctacaacgagctgttcatgaacaacaagaccgtgaccgagaagaagctcaagaactggctggtgaacaaccagtgctgcaacaagaacgccgagatcaagggcttccagaaggagaaccagttctccaccagcctgacgccctggatcgacttcaccaacatcttcggggagatcaaccagtccaacttcgacctcatcgaggacatcatctacgacctgaccgtcttcgaggacaagaagatcatgaagcggcgcctgaagaagaagtacgccctccccgacgacaagatcaagcagatcctgaagctgaagtacaaggactggagccggctctccaagaagctgctggacggcatcgtggccgacaacaagttcgggagctccgtgaccgtcctcgacgtgctggagatgagccgcctgaacctcatggagatcatcaacgaccgggacctgggctacgcccagatgatcgaggcggccgcctcctgccccgaggacgggaagttcacgtacaaggaggtgcagcgcctggccggcagcccggcgctcaagcggggcatctggcagtccctgcagatcgtcgaggagatcaccaaggtgatgaagtgccgccccaagtacatctacatcgagttcgagcggagcgaggagaccaaggagcgcaccgagagcaagatcaagaagctggagaacgtgtacaaggacctcgacgagcagacgaaggtcgagtacaagaccgtgctggaggagctgaaggggttcgacaacaccaagaagatctccagcgactccctcttcctgtacttcacccagctgggcaagtgcatgtacagcgggaagaagctcgacatcgactccctggacaagtaccagatcgaccacatcgtgccccagagcctggtcaaggacgactccttcgacaaccgggtgctcgtggtccccagcgagaaccagcgcaagctggacgacctggtggtgccgtccgacatccgggtcaagatgaacagcttctggaagctcctgttcgaccacgagctgatctcccccaagaagttctacagcctcatcaagacggagtacaccgagcgcgacgaggagcggttcatcaaccgccagctggtggagacccgccagatcaccaagaacgtgacgcagatcatcgaggaccactactccaccaccaaggtcgccgccatccgggccaacctgagccacgagttccgcgtgaagaaccacatctacaagaaccgggacatcaacgactaccaccacgcccacgacgcgtacatcgtggccctcatcggcgggttcatgcgcgaccggtaccccaacatgcacgactccaaggccgtctacagcgagtacatgaagatgttccgcaagaacaagaacgacaagaagcggtggaaggacggcttcgtgatcaactccatgaactacccctacgaggtggacggcgagctgatctggaacccggacatcatcaacgagatccgcaagtgcttctactacaaggactgctactgcaccaccaagctggaccagaagtccgggcagatgttcaacctcacggtcctgcccaacgacgcccacagccccaagggcaccaccgaggccgtgatcccggtgaacaagaaccggaaggacgtcaacaagtacgggggcttcagcgggctgcagtacgtgatcgtggcgatcgagggcaagaagaagcgcggcaagaagaccaagctcgtcaagaagatcagcggggtgcccctgcacctgaaggccgcctccctcgacgagaagatcaagtacatcgaggagaaggagaacctgacggacgtgaagatcatcaaggacagcatccccgtcaaccagatgatcgagatggacggcggggagtacctgctcacctcccccatcgagttcgtgaacggccggcagctggtgctgaacgagaagcagtgcgccctcatcgccgacatctacaacgcgatctacaagcaggactgcgacaacctggacgacgtcctgatgatccagctctacatcgagctgatcaacaagatgaaggccctgtacccggcctaccagagcatcgccgagaagttcgagtccatgaccgaggactacgtggcggtgagcaaggaggagaaggccgacatcatcaagcagatgctcatcatcatgcaccgcggcccccggaacgggaagatccagtacgccgacttcaacgtcggcgaccgcatcgggcggaagaacaagatgtccctggacctggagcgcgtgaccttcgtgagccagtcccccacgggcatctacaccaagaagtacaagctctga

SEQ ID NO: 1789 - RNA, 4002 nt, synthetic construct
  misc_feature 1..4002: note = Cas9 variant
  source 1..4002: mol_type = other RNA
atgggcaaggagtactacctggggctcgacatcggcaccgacagcgtggggtgggccgtctgcgacaccaactacaagatccccaagttcaagggcaacgccatgtgggggatccgcctgttcgagaagtccaacagcgcggaggagcggcgcggcttccggtccagccgccggcgcacgcagcggaagcgcgagcggctgaagctcctggagatgctgttcgacgaggagatctccaagatcgacccggccttcttcatcaagctccgcgagagcaacctgtacctggaggacaagtccaccaagatcccctactgcgtgttcagcgacgagaactacaccgacaaggacttccaccgggactaccccaccatctaccacctccgcaacgagctgatcaagtccaacaagccccacgacgtgcggctggtctacctcgccctgcaccacatcatcaagaaccgcggccacttcctgttcgactacagctacaagaacgacaagtccggggacttcatgccgatctacaacgacctcaagaactacttctacgacaactacgagatcgagctggactgcagcgacgtggacgagttcgccaacacgctgaaggacaagtccaagggcaagaccaagaagaacgccgagatcgcggagctgttcggggtgagcaagaagtacgacaaggtcctgtactccgccctgagcctcctgtccggcagctccgtgaagctgttcgacatcttcgacgacgaggccctcaaggacgtggagaagaagtccgtcagcttctccagcgggttcgacgacaacgccaacgacttccagtcctacctgggcgagcggttcgagctgctcgagaagctgaaggcggtgtacgactgggccgtgctggccgacatcctcgacggcaaggagtacatcagcgaggccaaggtcgccatctacgagaagcacaagcgcgacctgaagaccctgaagaagtacatcaagatctacatgcccgagaagaaggcggagatcttcaacatctccagcaaggacaacaactacgtggcctactccaagcacatcaagaccagcaacgggacgggcgtgctcatctccacgtgcacccaggaggagttctgcgcctacctgaagaagaccctggggatctgcaaggacgccagctacgaggagatgttcaaggagatcgagaactccaccttcatgcccaagcaggtcaccaaggacaacggcgtggtgcccatgcaggtcaacgagaaggagctcgtggccatcctggacaacgcgaaggagtacctgccgttcctcctgaacaaggacaacgacggcaagaccgtgtacgacaagatcaaggccctgttcgagtaccggatcccctactacatcgggcccctcaacacccacagcacgaagtcctggctggtccgcagcaacgagaagatctacccctggaacatcgaggacgtggtggacttcgacaagtccgccgagaagttcatcgagaacctgaccagcaagtgcacctacctcccgcagtacgacgtcatccccaagcactccctgctgtacaacaagttctgcgtgctcaacgagctgaacaacctgaagatcgacggcgagaagatcagcgtccagctgaagcaggacatctacaacgacctcttcaagaagtactacaaggtgaccaacaagaagctgtgcgactacctgaagtcccggaacatcgccttcgacgagatcagcgggatcgacaacgacttcaagagctccctcaagagctacaaggacctggtggcctacaacctgacggacgagcagaaggaggagatcgtcaaggcgatcaccatcttcggcgacgacaagaagctcctgaagaagcgcctgaagaacgagttcgggggctgcctctccgacgacgagatcaagaagatctgcaagctgaagtacaccggctggagcaagctgtcccgggagttcctcaccgacgtgacggccgtgtacaaggagaccggggagctgatcaacatcatctgcgccctgtgggagaccaactacaacctcaccagcctgctgtactccgacgagttctgctgcgacgacaaggagaacaagacgttcaacgacaagatcaacgagctcaacagcttcggcaacgacaagaccctgaaccagatcgtcgaggagctgtacgtgagccccctcgtgaagcgccccatctaccagagcctgctgatcaccaaggagctcgagaagatcatgaagtgcccgcccaagaagatcttcgtcgaggtggcccgcggggccgaggagaagaagcggaccgtgtcccgccggaacaagctgctggacctctacaagagctgcaagaacgactaccccctgctgttcgacgagctccagaacaacacgaccgacgacgagctgaagtccgacaagctgtacctctacttcacccagttcggcaagtgcatgtacaccggggagaacatcgagctgggcgacctgttcaacaagaacctctacgacatcgaccacatctacccccagagcaagatcaaggacgactccctggacaaccgcgtcctggtgaagaagacgaccaacgcgaagaaggacaacgagtacccgctcagctcccagatccgggagaagatgacgccccactggaaggccctgctggacaagggcctcatcaacaagaagaagtacgagcgcctggtgcggaactaccccctgagcgacgaggagctcagccagttcatctcccgccagctggtcgagacccggcagagcaccaaggccgtggccaacatcctggagcagctctacccccgcccggacaccgagatcgtgtacgtcaaggcggccctggcctccgagttccggcaccagtacgacatgctgaagtgccgcgaggtgaacgacctccaccacgccaaggacgcctacctgaacatcgtggtcgggaacgcgtacaacggcaagttcacccacaacaaggccaacttcatcaaggggctgcagaacaacgacaaggcctacaccgtgaagctcgacagcatgctgaagcacaacatcgacggcgcctggatcgccgacaacaacgagtccctgaacatcgtcaagagcaccatgaacaagaacaacatccggtacacgcgctacgcgttcgagaagaagggcggcctcttcaaggtgaccatcctgaagaaggggaacgggcaggcctccatcaagaagaacgacaagcggaacagcatcgagaagtacggcgggtacaaccaggtgtccagcacctacttctcctgcgtggagcacggcaaggacaacaaccgcatgatcagcatgttctccgtcaacctgtacgacaagaacaagtacgaggagaaccccatcgcctacctcatcgagaactacggcctgatcaaccccatcatcaaggtgaagaaggtgaagatccagagctgcatctccttcgacaacatgctgtgccacctcgggggcaaggacagcgggggctcccagatcagctaccggcccggggtccagctggtgctgggctacgacaacgagcgctacatccggaacgtgatccgctgcgccggcggggacctccacctccagacctccaagaacgagaaggacatcgtcacggccgagaagaacatcgagctgttcaacctcctgatcgagaagatgaagaacaacatctacggcgtgctgtacagcaacctcggggacaagctgtactgcagcaaggagaagttcgagaagctggacatcgtggagcagtgcaacgtcatcaagaacgtgctcaccatcctgaagaacaacgcgtccaagggcgacctcaagagcatcgggatcaaggccaacggcgccatccgcctgaacaacaacatctccgagatcaagaaggtcaagagcatcaagctgatcaaccagtccgtgaccggcctgttcgagcaggagatcgagctcctgaacctgtga

SEQ ID NO: 1790 - RNA, 4002 nt, synthetic construct
  misc_feature 1..4002: note = Cas9 variant
  source 1..4002: mol_type = other RNA
atgagccagaacatcgtggactactgcatcggcctggacctcgggaccggctccgtcgggtgggccgtggtggacatgaaccaccgcctgatgaagcggaacggcaagcacctgtgggggagccgcctcttctccaacgccgagaccgcggccacgcggcgcagctcccggagcatccgccggcgctacaacaagcggcgcgagcggatccgcctgctgcgggccatcctccaggacatggtcctggagaaggaccccaccttcttcatccgcctggagcacacctccttcctcgacgaggaggacaaggccaagtacctgggcaccgactacaaggacaactacaacctgttcatcgacgaggacttcaacgactacacgtactaccacaagtacccgaccatctaccacctccggaaggccctgtgcgagagcaccgagaaggcggacccccgcctgatctacctcgccctgcaccacatcgtgaagtaccggggcaacttcctgtacgaggggcagaagttcaacatggacgcctccaacatcgaggacaagctcagcgacgtgttcacccagttcgccgacttcaacaacatcccctacgaggacgacgagaagaagaacctggagatcctggagatcctcaagaagcccctgtccaagaaggcgaaggtcgacgaggtgatggccctgatcagcccggagaaggagttcaagtccgcctacaaggagctcgtgacgggcatcgccgggaacaagatgaacgtcaccaagatgatcctgtgcgagagcatcaagcagggcgactccgagatcaagctgaagttcagcgactccaactacgacgaccagttcagcgaggtggagaacgacctcggggagtacgtggagttcatcgactccctgcacaacatctacagctgggtcgagctgcagaccatcatgggcgccacccacacggacaacgcgagcatctccgaggccatggtgagccgctacaacaagcaccacgaggacctccagctgctgaagaagtgcatcaaggacaacgtgcccaagaagtacttcgacatgttccggaacgactccgagaaggtcaagggctactacaactacatcaaccgccccaacaaggcccccgtggacgagttctacaagttcgtgaagaagtgcatcgagaaggtcgacaccccggaggccaagcagatcctccacgacatcgagctggagaacttcctgctcaagcagaacagccggaccaacgggtccgtgccctaccagatgcagctggacgagatgatcaagatcatcgacaaccaggccaagtactaccccgtgctgaaggagaagcgcgagcagctcctgagcatcctgaccttccgcatcccctactacttcggcccgctcaacgagacgtccgagcacgcgtggatcaagcggctggaggggaaggagaaccagcgcatcctgccctggaactaccaggacaccgtcgacgtggacgccaccgccgagggcttcatcaagcggatgcgcagctactgcacctacttccccgacgaggaggtgctccccaagaactccctgatcgtcagcaagtacgaggtgtacaacgagctgaacaagatccgggtcgacgacaagctcctggaggtggacgtgaagaacgacatctacaacgagctgttcatgaagaacaagacggtcaccgagaagaagctgaagaactggctcgtgaacaaccagtgctgccgcaaggacgccgagatcaagggcttccagaaggagaaccagttctccaccagcctgaccccgtggatcgacttcacgaacatcttcgggaagatcgaccagtccaacttcgacctgatcgagaagatcatctacgacctcaccgtgttcgaggacaagaagatcatgaagcggcgcctgaagaagaagtacgccctgcccgacgacaagatcaagcagatcctcaagctgaagtacaaggactggagccggctgtccaagaagctcctggacggcatcgtcgcggacaaccgcttcgggagctccgtgaccgtgctggacgtcctcgagatgagccggctgaacctgatggagatcatcaacgacaaggagctcggctacgcccagatgatcgaggaggcctccagctgccccaaggacgggaagttcacctacgaggaggtggccaagctggccggcagccccgcgctgaagcgcggcatctggcagtccctccagatcgtggaggagatcacgaaggtcatgaagtgccggccgaagtacatctacatcgagttcgagcgcagcgaggaggccaaggagcggaccgagtccaagatcaagaagctggagaacgtgtacaaggacctggacgagcagaccaagaaggagtacaagagcgtgctcgaggagctgaaggggttcgacaacaccaagaagatctccagcgactccctgttcctctacttcacgcagctgggcaagtgcatgtacagcgggaagaagctggacatcgactccctcgacaagtaccagatcgaccacatcgtcccccagagcctggtgaaggacgactccttcgacaaccgcgtgctggtcctccccagcgagaaccagcggaagctggacgacctggtggtgcccttcgacatccgcgacaagatgtaccggttctggaagctcctgttcgaccacgagctgatctccccgaagaagttctacagcctcatcaagaccgagtacaccgagcgcgacgaggagcgcttcatcaaccggcagctggtcgagacccgccagatcacgaagaacgtgacccagatcatcgaggaccactactccaccaccaaggtggccgccatccgggcgaacctgagccacgagttccgcgtcaagaaccacatctacaagaaccgggacatcaacgactaccaccacgcccacgacgcctacatcgtggccctcatcggcgggttcatgcgcgaccggtaccccaacatgcacgactccaaggccgtgtacagcgagtacatgaagatgttccgcaagaacaagaacgaccagaagaagtggaaggacggcttcgtcatcaacagcatgaactacccctacgaggtggacggcaagctgatctggaaccccgacctgatcaacgagatcaagaagtgcttctactacaaggactgctactgcaccacgaagctcgaccagaagtccgggcagatgttcaacctgaccgtgctgccgaacgacgcgcacagcgccaagggcaccaccgaggccgtcatccccgtgaacaagaaccggaaggacgtgaacaagtacgggggcttctccgggctccagtacgtcatcgccgccatcgagggcacgaagaagaagggcaagaagctggtgaaggtgcgcaagctgagcgggatccccctctacctgaagcaggcggacatcaaggagcagatcgagtacgtcgagaaggaggagaagctgtccgacgtgaagatcatcaagaacaacatcccgctcaaccagctgatcgagatcgacggccggcagtacctgctcaccagccccaccgagtgcgtgaacgccatgcagctggtcctgaacgaggagcagtgcaagctcatcgccgacatctacaacgccatctacaagcaggacttcgacgggctggacaacatgctgatgatccagctctacctgcagctgatcgacaagctcaagaccctgtaccccatctacatgggcatcgtggagaagttcgagaagctgacggaggacttcgtgtccatcagcaaggaggagaaggccaacgtcatcaagcagatgctcatcatcatgcacaagggcccccagaacgggaacatcatctacgacgacttcaacgtgggcaagcgcatcgggcggctgaacggccgcaccttctacctggacaacatcgagttcatctcccagagcccgaccgggatctacaccaagaagtacaagctctga

SEQ ID NO: 1791 - RNA, 4002 nt, synthetic construct
  misc_feature 1..4002: note = Cas9 variant
  source 1..4002: mol_type = other RNA
atgtacacctactacttcaaggagagcgagatggtgtacgacgtcggcctggacatcgggaccggctccgtggggtgggtggccctcgacgagaacggcaagctggcccgcgcgaaggggaagaacctggtcggcgtgcggctgttcgacacggcccagaccgccgccgaccgccggggcttccgcaccacccggcgccggctgagccgccggaagtggcgcctgcggctcctggacgagctgttctccgccgagatcaacgagatcgacagctccttcttccagcgcctcaagtacagctacgtgcaccccaaggacgaggagaacaaggcgcactactacgggggctacctgttcccgacggaggaggagaccaagaagttccaccggtcctaccccaccatctaccacctccgccaggagctcatggcccagcccaacaagcggttcgacatccgcgagatctacctggccatccaccacctggtcaagtaccgggggcacttcctcagctcccaggagaagatcaccatcggcagcacgtacaaccccgaggacctggccaacgcgatcgaggtgtacgccgacgagaaggggctgtcctgggagctcaacaacccggagcagctgaccgagatcatcagcggcgaggccggctacgggctgaacaagtccatgaaggccgacgaggccctcaagctgttcgagttcgacaacaaccaggacaaggtggcgatcaagaccctgctcgccggcctgaccgggaaccagatcgacttcgccaagctgttcggcaaggacatcagcgacaaggacgaggccaagctctggaagctgaagctggacgacgaggccctcgaggagaagtcccagacgatcctgagccagctgaccgacgaggagatcgagctgttccacgcggtcgtgcaggcctacgacggcttcgtgctgatcgggctgctcaacggcgccgactccgtcagcgccgccatggtgcagctgtacgaccagcaccgcgaggaccggaagctgctcaagtccctggcgcagaaggccgggctgaagcacaagcgcttcagcgagatctacgagcagctcgccctggccaccgacgaggccaccatcaagaacggcatcagcacggcgcgggagctggtggaggagtccaacctcagcaaggaggtcaaggaggacaccctgcgccgcctggacgagaacgagttcctccccaagcagcggaccaaggccaactccgtgatcccccaccagctgcacctggccgagctgcagaagatcctccagaaccaggggcagtactaccccttcctgctggacaccttcgagaaggaggacggccaggacaacaagatcgaggagctcctgcgcttccggatcccgtactacgtgggccccctggtcacgaagaaggacgtggagcacgccgggggcgacgcggacaaccactgggtggagcgcaacgaggggttcgagaagtcccgggtcaccccctggaacttcgacaaggtgttcaaccgcgacaaggccgcccgggacttcatcgagcgcctcaccggcaacgacacctacctgatcggggagaagacgctgccccagaacagcctccggtaccagctgttcaccgtgctgaacgagctcaacaacgtccgcgtgaacggcaagaagttcgacagcaagaccaaggccgacctgatcaacgacctgttcaaggcccggaagaccgtctccctcagcgcgctgaaggactacctgaaggcccagggcaagggggacgtgacgatcaccggcctcgccgacgagtccaagttcaacagctccctgagctcctacaacgacctgaagaagaccttcgacgccgagtacctcgagaacgaggacaaccaggagaccctggagaagatcatcgagatccagacggtgttcgaggacagcaagatcgcctcccgcgagctgagcaagctcccgctggacgacgaccaggtcaagaagctgtcccagacccactacaccgggtggggccggctcagcgagaagctgctggactccaagatcatcgacgagcgcgggcagaaggtgagcatcctcgacaagctcaagagcacctcccagaacttcatgagcatcatcaacaacgacaagtacggcgtgcaggcgtggatcacggagcagaacaccggctccagcaagctgaccttcgacgagaaggtcaacgagctcaccacctcccccgccaacaagcgggggatcaagcagagcttcgccgtgctgaacgacatcaagaaggccatgaaggaggagccccgccgggtgtacctggagttcgcccgcgaggaccagacgtccgtccggagcgtgccccgctacaaccagctcaaggagaagtaccagtccaagagcctgtccgaggaggcgaaggtgctgaagaagaccctcgacggcaacaagaacaagatgagcgacgaccgctacttcctgtacttccagcagcaggggaaggacatgtacaccggccggccgatcaacttcgagcgcctgtcccaggactacgacatcgaccacatcatcccccaggccttcaccaaggacgacagcctcgacaaccgggtcctggtgtcccgccccgagaacgcccgcaagagcgactccttcgcctacacggacgaggtgcagaagcaggacggcagcctgtggaccagcctcctgaagtccgggttcatcaaccggaagaagtacgagcggctgaccaaggcgggcaagtacctcgacgggcagaagaccggcttcatcgcccgccagctggtcgagacgcggcagatcatcaagaacgtggccagcctgatcgagggggagtacgagaactccaaggccgtggccatccgcagcgagatcaccgcggacatgcggctcctggtcggcatcaagaagcaccgcgagatcaactccttccaccacgccttcgacgccctgctcatcaccgccgccggccagtacatgcagaaccggtaccccgaccgcgacagcaccaacgtgtacaacgagttcgaccggtacacgaacgactacctgaagaacctgcgccagctctccagccgggacgaggtgcgccggctgaagtccttcgggttcgtcgtgggcaccatgcgcaaggggaacgaggactggagcgaggagaacacctcctacctgcggaaggtgatgatgttcaagaacatcctcaccacgaagaagaccgagaaggaccgcggcccgctgaacaaggagaccatcttcagccccaagtccgggaagaagctgatccccctcaacagcaagcgctccgacaccgcgctgtacggcggctacagcaacgtctactccgcctacatgacgctggtgcgggccaacgggaagaacctcctgatcaagatccccatcagcatcgccaaccagatcgaggtgggcaacctgaagatcaacgactacatcgtcaacaacccggccatcaagaagttcgagaagatcctcatctccaagctgcccctggggcagctcgtgaacgaggacggcaacctgatctacctggcgagcaacgagtaccgccacaacgccaagcagctctggctgagcaccaccgacgccgacaagatcgcctccatcagcgagaactccagcgacgaggagctgctcgaggcgtacgacatcctgacctccgagaacgtgaagaaccggttccccttcttcaagaaggacatcgacaagctgagccaggtccgcgacgagttcctcgactccgacaagcggatcgccgtgatccagacgatcctgcgcgggctgcagatcgacgccgcctaccaggcccccgtgaagatcatcagcaagaaggtctccgactggcacaagctccagcagagcggcggcatcaagctgtccgacaacagcgagatgatctaccagtccgcgaccgggatcttcgagacccgggtgaagatcagcgacctgctctga

SEQ ID NO: 1792 - RNA, 4005 nt, synthetic construct
  misc_feature 1..4005: note = Cas9 variant
  source 1..4005: mol_type = other RNA
atgaagaacccctacaccatcggcctggacatcgggaccaacagcgtgggctgggccgtcctcacgaaccagtacgacctggtgaagcgcaagatgaaggtggccgggaactccgacaagaagcagatcaagaagaacttctggggcgtccggctgttcgacgacgggcagaccgcggtggaccgccggatgaaccgcaccgcccggcgccggatcgagcgccggcgcaaccggatcagctacctccaggagatcttcgccgtggagatggccaacatcgacgccaacttcttctgccgcctgaacgactccttctacgtcgacagcgagaagcggaactcccgccacccgttcttcgcgaccatcgaggaggaggtggcctaccacaagaactaccggacgatctaccacctccgcgaggagctcgtgaacagctccgagaaggccgacctgcggctggtctacctcgccctggcgcacatcatcaagtaccgcggcaacttcctgatcgagggcgccctcgacaccaagaacaccagcgtggacggggtgtacgagcagttcatccagacctacaaccaggtcttcatgtccaacatcgaggagggcacgctggccaaggtggaggagaacatcgaggtggccaacatcctggccgggaagttcacccggcgcgagaagttcgagcggatcctccagctgtaccccggcgagaagtccaccgggatgttcgcgcagttcatcagcctgatcgtcggcagcaagggcaacttccagaaggtgttcgacctcatcgagaagaccgacatcgagtgcgccaaggactcctacgaggaggacctggaggccctgctcgccatcatcggggacgagtacgccgagctgttcgtggcggccaagaacacgtacaacgccgtcgtgctgagctccatcatcaccgtgaccgccaccgagacgaacgccaagctcagcgcgtccatgatcgagcgcttcgacgcccacgagaaggacctgggcgagctgaaggccttcatcaagctccacctccccaagcagtaccaggagatcttcaacaacgccgccatcgacgggtacgcgggctacatcgacggcaagaccaagcaggtcgacttctacaagtacctgaagaccatcctcgagaacatcgagggggccgactacttcatcgccaagatcgaggaggagaacttcctgcgcaagcagcggaccttcgacaacggcgccatcccccaccagctgcacctcgaggagctggaggcgatcatccaccagcaggccaagtactacccgttcctgcgcgaggactacgagaagatcaagagcctcgtgacgttccggatcccctacttcgtggggcccctggccaagggccagtccgagttcgcctggctgacccgcaaggccgacggggagatccggccctggaacatcgaggagaaggtcgacttcggcaagagcgcggtggacttcatcgagaagatgaccaacaaggacacctacctcccgaaggagaacgtcctgcccaagcacagcctgtgctaccagaagtacatggtgtacaacgagctcacgaaggtgcgctacatcgacgaccagggcaagaccaactacttctccgggcaggagaagcagcagatcttcaacgacctgttcaagcagaagcggaaggtcaagaagaaggacctggagctgttcctgcgcaacatcaaccacatcgagagccccaccatcgagggcctggaggactccttcaacgccagctacgccacctaccacgacctcctgaaggtggggatgaagcaggagatcctggacaaccccctgaacacggagatgctcgaggacatcgtgaagatcctgaccgtcttcgaggacaagccgatgatcaaggagcagctgcagcagttctccgacgtgctcgacggcggggtgctgaagaagctggagcggcgccactacaccggctggggccggctcagcgccaagctgctggtcgggatccgcgagaagcagtcccacctcaccatcctggactacctgatgaacgacgacggcctcaaccggaacctgatgcagctgatcaacgacagcaacctctccttcaagagcatcatcgagaaggagcaggtctccacgaccgacaaggacctgcagagcatcgtggccgacctggcggggtcccccgccatcaagaagggcatcctccagagcctgaagatcgtcgacgagctggtgtccatcatggggtacccgccccagaccatcgtggtcgagatggcccgcgagaaccagaccacgggcaagggcaagaacaacagcaagccccggtacaagtccctcgagaaggccatcaaggagttcgggagcaagatcctgaaggagcaccccaccgacaaccaggagctgaagaacaaccgcctctacctgtactacctgcagaacggcaaggacatgtacaccgggcaggagctcgacatccacaacctgtccaactacgacatcgaccacatcgtgccccagagcttcatcaccgacaacagcatcgacaacctggtgctcacctccagcgccggcaaccgggagaagggcggggacgtgcccccgctggagatcgtgcgcaagcggaaggtgttctgggagaagctgtaccagggcaacctcatgtccaagcgcaagttcgactacctgacgaaggcggagcgcgggggcctgaccgacgccgacaaggcccggttcatccaccgccagctcgtcgagacccggcagatcaccaagaacgtggccaacatcctgcaccagcgcttcaacaacgagacggacaaccacgggaacaccatggagcaggtccggatcgtgaccctcaagagcgcgctggtgtcccagttccgcaagcagttccagctgtacaaggtgcgggaggtcaacgactaccaccacgcccacgacgcctacctgaacggcgtggtggccaacaccctcctgaaggtctacccccagctggagcccgagttcgtgtacggcgagtaccaccagttcgactggttcaaggccaacaaggcgacggccaagaagcagttctacaccaacatcatgctgttcttcgggcagaaggagcgcatcatcgacgagaacggcgagatcctgtgggacaagaagtacctggagaccatcaagaaggtgctcgactaccggcagatgaacatcgtcaagaagaccgagatccagaagggggagttcagcaaggccacgatcaagcccaagggcaactccagcaagctgatcccgcgcaaggagaactgggaccccatgaagtacgggggcctggactcccccaacatggcctacgccgtgatcatcgagcacgcgaagggcaagaagaagctcatcttcgagaagaagatcatccggatcaccatcatggagcgcaagatgttcgagaaggacgaggaggccttcctggaggagaaggggtaccggcaccccaaggtgctgaccaagctcccgaagtacaccctgtacgagtgcgagaagggccgccggcgcatgctggccagcgccaacgaggcccagaaggggaaccagctcgtcctgtccaaccacctggtgagcctcctgtaccacgcgaagaactgcgaggcctccgacggcaagagcctgaagtacatcgaggcccaccgggagacgttctccgagctcctggcccaggtgagcgagttcgcgacccgctacaccctggccgacgccaacctctccaagatcaacaacctgttcgagcagaacaaggagggggacatccaggccatcgcccagagcttcgtcgacctgatggcgttcaacgccatgggcgcccccgccagcttcaagttcttcgaggccaccatcgaccggaagcgctacacgaacctcaaggagctgctgtccagcaccatcatctaccagtccatcaccggcctctacgagagccggaagcgcctggacgactga

SEQ ID NO: 1793 - RNA, 4005 nt, synthetic construct
  misc_feature 1..4005: note = Cas9 variant
  source 1..4005: mol_type = other RNA
atgaagaagccctacaccatcggcctggacatcgggaccaacagcgtgggctgggccgccctcacggaccagtacgacctggtcaagcgcaagatgaaggtggcggggaactccgagaagaagcagatcaagaagaacctgtggggcgtgcggctcgtcgacgaggggaagaccgccgcccaccgccgggtgaaccgcaccacccggcgccggatcgagcgccggcgcaaccggatcagctacctgcaggagatcttcacggccgagatgttcgaggtggacgccaacttcttctaccgcctggaggactccttctacatcgagagcgagaagcggcagtcccgccacccgttcttcgcgaccatcgaggaggaggtcgcctaccacgagaactaccggaccatctaccacctccgcgagaagctggtgaacagctccgacaaggccgacctgcggctcgtgtacctggccctggcgcacatcatcaagtaccgcggcaacttcctcatcgagggcaagctggacaccaagaacacgagcgtcgacgaggtgttcaagcagttcatcaagacctacaaccaggtgttcgcctccgacatcgaggaggggagcctgacccggatcgaggagaacaacgaggtcgccaagatcttctccgagaagctcaccaagcgcgagaagctggacaagatcctgaacctctaccccaacgagaagtccacggacctgttcgcccagttcatcagcctgatcatcggcagcaaggggaacttcaagaagttcttcaacctcaccgagaagaccgacatcgagtgcgccaaggactcctacgaggaggacctggaggtgctgctcgcgcgggtgggcgacgagtacgccgagatcttcgtcgccgccaagaacgcctacaacgcggtggtgctgagctccatcatcaccgtcagcaacacggagaccaaggccaagctgtccgccagcatgatcgagcgcttcgacaagcacgacaaggacctcaagcgcatgaaggccttcttcaaggtgcggctgcccgagaacttcaacgaggtgttcaacgacgtcgagaaggacgggtacgccggctacatcgagggcaagaccaagcaggaggcgttctacaagtacatgaagaagatgctggagcacgtggagggggccgactacttcatcaaccagatcgaggaggagaacttcctccgcaagcagcggaccttcgacaacggcgccatcccccaccagctgcacctggaggagctcgaggccatcctgcaccagcaggccaagtactacccgttcctgaaggtggactacgagaagatcaagagcctcgtcacgttccgcatcccctacttcgtggggcccctggcgaacggccagtccgagttcagctggctgacccggaaggccgacggcgagatccgcccctggaacatcgaggagaaggtcgacttcgggaagtccgccatcgacttcatcgagaagatgaccaacaaggacacctacctcccgaaggagaacgtgctgcccaagcacagcatgtgctaccagaagtacatggtgtacaacgagctgacgaagatccggtacaccgacgaccagggcaagacccactacttctccgggcaggagaagcagcagatcttcaacgacctcttcaagcagaagcgcaaggtcaagaagaaggacctggagctgttcctctacaacatgaaccacgtggagagccccaccgtggagggcgtcgaggacgccttcaactccagcttcacgacctaccacgacctgcagaaggtgggggtgccccaggagatcctggacgacccgctcaacaccgagatgctggaggagatcatcaagatcctgaccgtcttcgaggacaagcggatgatcaacgagcgcctgcaggagttctccaacgtgctcgacgaggcggtgctgaagaagctggagcggcgccactacacgggctggggccggctcagcgccaagctgctgatcgggatccgcgacaaggagtcccacctcaccatcctggactacctgatgaacgacgacaagcacaaccggaacctcatgcagctgatcaacgacagcaacctgtccttcaagagcatcatcgagaaggagcaggtctccaccgccgacaaggacatccagagcatcgtggccgacctcgccggctcccccgcgatcaagaaggggatcctgcagagcctgaagatcgtggacgagctcgtcggcatcatggggtacccgccccagaccatcgtggtggagatggcccgcgagaaccagacgaccggcaagggcaagaacaactccaagccccggttcaccagcctggagaaggccatcaaggagctggggagccagatcctcaaggagcaccccaccgacaaccagggcctgaagaacgaccgcctgtacctctactacctgcagaacgggaaggacatgtacaccggccaggagctggacatccacaacctctccaactacgacatcgaccacgtcgtgccccagagcttcatcacggacaactccatcgacaaccgggtgctggccagctccgccgcgaaccgcgagaagggggacaacgtccccagcctggaggtggtgcgcaagcggaaggtctactgggagaagctctaccaggccaagctgatgtccaagcgcaagttcgactacctgaccaaggccgagcggggcggcctcaccgaggccgacaaggcccgcttcatccaccggcagctggtggagacccgccagatcacgaagaacgtggcgaacatcctgcaccagcggttcaactgcaagaaggacgagagcgggaacgtcatcgagcaggtccgcatcgtgaccctcaaggccgccctggtgtcccagttccggaagcagttccagctgtacaaggtgcgcgaggtgaacgactaccaccacgcccacgacgcgtacctcaactgcgtcgtggccaacaccctgctgaaggtgtacccgcagctcgagcccgagttcgtctacggcgactaccaccagttcgactggttcaaggccaacaaggccaccgccaagaagcagttctacacgaacatcatgctgttcttcgcgaagaaggaccggatcatcgacgagaacggggagatcctgtgggacaagaagtacctcgacaccatcaagaaggtgctgaactaccgccagatgaacatcgtgaagaagaccgagatccagaagggcgagttcagcaacgccaccgccaaccccaagggcaactccagcaagctgatcccccggaaggccgactgggacccgatcaagtacgggggcttcgacgggtccaacatggcctacgcgatcgtcatcgagcacgagaagcgcaagaagaagacggtgatcaagaaggagctcatccagatcaacatcatggagcggaccgccttcgagaaggaccagaaggagttcctggagggcaaggggtaccgcaaccccaaggtgatcaccaagatccccaagtacaccctgtacgagtgcgagaacggccggcgccggatgctcggcagcgccaacgaggcccagaaggggaaccagatggtcctgcccaaccacctgatgacgctcctgtaccacgccaagaactgcgaggcgtccgacggcaagagcctggcctacatcgagtcccaccgcgagatgttcgccgagctcctggacagcatcagcgagttcgcctcccggtacaccctggcggacgccaacctcgagaagatcaacaccatcttcgagcagaacaagagcggggacgtgaaggtgatcgcccagtccttcgtcaacctgctggagttcaacgccatgggcgccccggcgagcttcaagtacttcgagaccaacatcgagcgcaagcgctacaacaacctcaaggagctgctgaacgccacgatcatctaccagtccatcaccgggctctacgaggcccggaagcgcctggacgactga

SEQ ID NO: 1794 - RNA, 4005 nt, synthetic construct
  misc_feature 1..4005: note = Cas9 variant
  source 1..4005: mol_type = other RNA
atgaagaacccctacaccatcggcctggacatcgggaccaacagcgtgggctgggccgtcctcacggaccagtacgacctggtgaagcgcaagatgaaggtggccgggaactccgacaagaagcagatcaagaagaacttctggggcgtccggctgttcgacgacgggcagaccgcggtggaccgccggatgaaccgcaccgcccggcgccggatcgagcgccggcgcaaccggatcagctacctccaggagatcttcgccgtggagatggccaacatcgacgccaacttcttctgccgcctgaacgactccttctacgtcgacagcgagaagcggaactcccgccacccgttcttcgcgaccatcgaggaggaggtggcctaccacaagaactaccggacgatctaccacctccgcgaggagctggtgaacagctccgagaaggccgacctgcggctggtctacctcgccctggcgcacatcatcaagtaccgcggcaacttcctgatcgagggcgccctcgacaccaagaacaccagcgtggacgaggtgtacaagcagttcatccagacctacaaccaggtcttcatgtccaacatcgaggagggggccctggccaaggtggaggagaacacggaggtggccagcatcctggcgggcaagttcacccggcgcgagaagttcgagcggatcctccgcctgtaccccggggagaagtccaccggcatgttcgcccagttcatcagcctgatcgtcgggaacaagggcaacttccagaaggtgttcaacctcgtggagaagaccgacatcgagtgcgccaaggactcctacgaggaggacctggaggccctgctcgccatcatcggcgacgagtacgcggagctgttcgtcgccgccaagaacacgtacaacgccgtggtgctgagctccatcatcaccgtcaccgccaccgagacgaacgcgaagctcagcgcctccatgatcgagcgcttcgacgcccacgagaaggagctgggggagctgaaggccttcatcaagctccacctccccaagcagtaccaggagatcttcaacaacgccgagatcgacggctacgcggggtacatcgacggcaagaccaagcaggtcgacttctacaagtacctgaagaccaccctggagaacgtggagggcgccgactacttcatcacgaagatcgaggaggagaacttcctgcggaagcagcgcaccttcgacaacggggtgatcccccaccagctgcacctcgaggagctggaggccatcctgcaccagcaggccaagtactacccgttcctccgggagggctacgacaagatcaagagcctggtgaccttccgcatcccctacttcgtcgggcccctggcgaacggccagtccgagttcgcctggctcacccggaaggacgacggggagatccgcccctggaacatcgaggagaaggtggacttcggcaagagcgccgtggacttcatcgagaagatgacgaacaaggacacctacctgccgaaggagaacgtcctgcccaagcacagcctctgctaccagaagtacatggtgtacaacgagctgaccaagatccggtacatcgacgaccagggcaagaccaactacttctccgggcgcgagaagcagcagatcttcaacgacctgttcaagcagaagcggaaggtgaagaagaaggacctcgagctgttcctgcgcaacatcaaccacatcgagagccccacgatcgagggcctcgaggactccttcaacgccagctacgccacctaccacgacctgctgaaggtcgggctgaagcaggagatcctcgacaaccccctgaacaccgagatcctggaggacatcgtgaagatcctcaccgtgttcgaggacaagcggatgatcaaggagcagctggagcagttctccgacgtcctggacggcgtggtgctcaagaagctggagcgccggcactacacggggtggggccgcctgagcgcgaagctcctggtcggcatccgggacaagcagtcccacctgaccatcctcgactacctgatgaacgacgacgggctgaaccgcaacctcatgcagctgatcaacgacagcaacctgtccttcaagagcatcatcgagaaggagcaggtctccaccaccgacaaggacctccagagcatcgtggccgacctggccggctccccggccatcaagaaggggatcctgcagagcctcaagatcgtggacgagctggtgtccatcatgggctacccgccccagacgatcgtggtcgagatggcccgggagaaccagaccaccgggaagggcaagaacaacagcaagccccgctacaagtccctggagaaggcgatcaaggacttcggcagccagatcctcaaggagcaccccaccgacaaccaggagctgaagaacaaccggctgtacctctactacctgcagaacgggaaggacatctacaccggccaggagctggacatccacaacctctccaactacgacatcgaccacatcgtgccccagagcttcatcacggacaacagcatcgacaacctggtgctgacctccagcgccgggaaccgcgagaagggcggcgacgtcccgcccctcgagatcgtgcgcaagcggaaggtgttctgggagaagctgtaccaggggaacctgatgtccaagcgcaagttcgactacctcaccaaggccgagcggggcgggctgaccgaggccgacaaggcccgcttcatccaccggcagctggtcgagacgcgccagatcaccaagaacgtggcgaacatcctccaccagcggttcaacaaggagaccgacaaccacggcaacaccatggagcaggtccgcatcgtgacgctcaagagcgccctggtgtcccagttccggaagcagttccagctgtacaaggtgcgcgaggtcaacgactaccaccacgcccacgacgcctacctgaacggggtggtggcgaacaccctgctcaaggtctacccccagctggagcccgagttcgtgtacggcgagtaccaccagttcgactggttcaaggccaacaaggccaccgccaagaagcagttctacaccaacatcatgctgttcttcgcccagaaggagcggatcatcgacgagaacggcgagatcctctgggacaagaagtacctggagacgatcaagaaggtgctggactaccgccagatcaacatcgtcaagaagaccgagatccagaagggggagttcagcaaggcgaccatcaagcccaagggcaactccagcaagctcatcccccggaaggagaactgggacccggtgaagtacgggggcctggactcccccaacatggcctacgccgtgatcatcgagcacgccaaggggaagaagaagatcgtcatcgagaagaagctgatccagatcaacatcatggagcgcaagatgttcgagaaggacgaggaggccttcctcgaggagaagggctaccaccagcccaaggtgctgaccaagctgcccaagtacacgctctacgagtgcgagaagggccggcgccggatgctgagctccgcgaacgaggcccagaaggggaaccagctggtgctcagcaaccacctggtctccctgctctaccacgccaagaactgcgaggccagcgacggcaagtccctgaagtacatcgaggcccaccgcgagaccttcagcgagctgctcgcccaggtgtccgagttcgcgaccaagtacaccctggccgacgccaacctgagcaagatcaacaacctcttcgagcagaacaaggagggggacatcaaggcgatcgcccagagcttcgtggacctgatggccttcaacgccatgggcgccccggcgtccttcaagttcttcgaggccacgatcgaccggaagcgctacaccaacctgaaggagctcctgagctccaccatcatctaccagagcatcaccgggctgtacgagtcccggaagcgcctcgacgactga

SEQ ID NO: 1795 - RNA, 4005 nt, synthetic construct
  misc_feature 1..4005: note = Cas9 variant
  source 1..4005: mol_type = other RNA
atgggccgcaagccgtacatcctgagcctcgacatcgggaccggctccgtggggtacgcctgcatggacaagggcttcaacgtcctgaagtaccacgacaaggacgccctgggggtgtacctcttcgacggcgcgctgaccgcccaggagcggcgccagttccggacgagccgccggcgcaagaaccggcgcatcaagcggctgggcctcctgcaggagctgctcgccccgctggtgcagaaccccaacttctaccagttccagcgccagttcgcctggaagaacgacaacatggacttcaagaacaagtccctgagcgaggtcctctccttcctggggtacgagagcaagaagtaccccaccatctaccacctccaggaggccctcctgctgaaggacgagaagttcgaccccgagctcatctacatggcgctgtaccacctggtgaagtaccggggccacttcctcttcgaccacctgaagatcgagaacctgaccaacaacgacaacatgcacgacttcgtggagctcatcgagacctacgagaacctgaacaacatcaagctgaacctcgactacgagaagacgaaggtcatctacgagatcctgaaggacaacgagatgaccaagaacgaccgcgccaagcgggtgaagaacatgcagaagaagctggagcagttctccatcatgctcctggggctgaagttcaacgagggcaagctgttcaaccacgccgacaacgccgaggagctgaagggggcgaaccagagccacaccttcgccgacaactacgaggagaacctgaccccgttcctcacggtggagcagtccgagttcatcgagcgcgccaacaagatctacctgagcctgaccctccaggacatcctgaagggcaagaagtccatggccatgagcaaggtcgccgcgtacgacaagttccggaacgagctgaagcaggtcaaggacatcgtgtacaaggccgactccacccgcacccagttcaagaagatcttcgtgagctccaagaagtccctcaagcagtacgacgccacgcccaacgaccagaccttcagcagcctgtgcctgttcgaccagtacctcatccggcccaagaagcagtactccctgctgatcaaggagctcaagaagatcatcccccaggacagcgagctgtacttcgaggccgagaacgacaccctgctgaaggtgctcaacaccacggacaacgccagcatcccgatgcagatcaacctgtacgaggcggagaccatcctgcgcaaccagcagaagtaccacgccgagatcaccgacgagatgatcgagaaggtgctctccctgatccagttccggatcccctactacgtcggccccctggtgaacgaccacaccgccagcaagttcgggtggatggagcgcaagtccaacgagagcatcaagccctggaacttcgacgaggtggtcgaccggtccaagagcgccacgcagttcatccgccgcatgaccaacaagtgctcctacctcatcaacgaggacgtgctgccgaagaacagcctgctctaccaggagatggaggtgctgaacgagctgaacgccacccagatccggctccagaccgaccccaagaaccgcaagtaccggatgatgccccagatcaagctgttcgcggtcgagcacatcttcaagaagtacaagacggtgtcccacagcaagttcctggagatcatgctcaactccaaccaccgcgagaacttcatgaaccacggcgagaagctgagcatcttcgggacccaggacgacaagaagttcgcctccaagctgagctcctaccaggacatgaccaagatcttcggcgacatcgagggcaagcgggcccagatcgaggagatcatccagtggatcaccatcttcgaggacaagaagatcctcgtgcagaagctgaaggagtgctaccccgagctgacgagcaagcagatcaaccagctcaagaagctgaactactccgggtggggccgcctgagcgagaagctcctgacccacgcctaccaggggcactccatcatcgagctgctccggcacagcgacgagaacttcatggagatcctgaccaacgacgtctacggcttccagaacttcatcaaggaggagaaccaggtgcagagcaacaagatccagcaccaggacatcgccaacctgaccacgtccccggcgctcaagaaggggatctggagcaccatcaagctggtccgcgagctgacctccatcttcggcgagcccgagaagatcatcatggagttcgccaccgaggaccagcagaagggcaaggagcagaagtcccggaagcagctctgggacgacaacatcaagaagaacaagctcaagagcgtggacgagtacaagtacatcatcgacgtggccaacaagctgaacaacgagcagctgcagcaggagaagctgtggctgtacctcagccagaacgggaagtgcatgtactccggccagagcatcgacctggacgccctgctctcccccaacgcgacgaagcactacgaggtcgaccacatcttcccccgcagcttcatcaaggacgactccatcgacaacaaggtgctggtgatcaagaagatgaaccagaccaagggggaccaggtcccgctgcagttcatccagcagccctacgagcggatcgcctactggaagtccctcaacaaggccggcctgatcagcgacagcaagctgcacaagctcatgaagcccgagttcaccgccatggacaaggaggggttcatccagcgccagctggtggagacccggcagatctccgtgcacgtccgcgacttcctgaaggaggagtaccccaacaccaaggtgatcccgatgaaggccaagatggtgagcgagttccggaagaagttcgacatccccaagatccgccagatgaacgacgcgcaccacgccatcgacgcctacctcaacggcgtcgtgtaccacggcgcccagctggcctaccccaacgtggacctgttcgacttcaacttcaagtgggagaaggtccgggagaagtggaaggcgctcggggagttcaacacgaagcagaagtcccgcgagctgttcttcttcaagaagctggagaagatggaggtgagccagggcgagcggctcatcagcaagatcaagctggacatgaaccacttcaagatcaactactcccgcaagctggccaacatcccccagcagttctacaaccagaccgccgtgagcccgaagaccgccgagctcaagtacgagtccaacaagagcaacgaggtcgtgtacaaggggctgaccccctaccagacgtacgtggtcgccatcaagtccgtgaacaagaagggcaaggagaagatggagtaccagatgatcgaccactacgtgttcgacttctacaagttccagaacgggaacgagaaggagctggcgctctacctggcccagcgcgagaacaaggacgaggtcctggacgcccagatcgtgtacagcctcaacaagggcgacctgctgtacatcaacaaccacccctgctacttcgtgtcccggaaggaggtcatcaacgccaagcagttcgagctcaccgtggagcagcagctgagcctgtacaacgtgatgaacaacaaggagaccaacgtcgagaagctcctgatcgagtacgacttcatcgcggagaaggtgatcaacgagtaccaccactacctgaactccaagctcaaggagaagcgcgtgcggaccttcttcagcgagtccaaccagacgcacgaggacttcatcaaggccctggacgagctgttcaaggtcgtgaccgccagcgccacccgctccgacaagatcggcagccggaagaactccatgacccaccgcgccttcctcgggaagggcaaggacgtgaagatcgcgtacacgagcatctccgggctgaagaccaccaagcccaagagcctgttcaagctcgccgagtcccggaacgagctgtga

SEQ ID NO: 1796 - RNA, 4005 nt, synthetic construct
  misc_feature 1..4005: note = Cas9 variant
  source 1..4005: mol_type = other RNA
atgaagaacccctacaccatcggcctggacatcgggaccaacagcgtgggctgggccgtcctcacggaccagtacgacctggtgaagcgcaagatgaaggtggccgggaactccgacaagaagcagatcaagaagaacttctggggcgtccggctgttcgacgagggggagaccgcggccgaccgccggatgaaccgcaccgcccggcgccggatcgagcgccggcgcaaccggatcagctacctccaggagatcttcgccctggagatggccaacatcgacgcgaacttcttctgccgcctgaacgactccttctacgtggacagcgagaagcggaactcccgccacccgttcttcgccaccatcgaggaggaggtggcctaccacaagaactaccggacgatctaccacctccgcgaggagctggtcaacagctccgagaaggccgacctgcggctcgtgtacctggcgctggcccacatcatcaagtaccgcggcaacttcctcatcgagggcgccctggacaccaagaacaccagcgtggacggggtctacaagcagttcatccagacctacaaccaggtgttcatctccaacatcgaggagggcacgctggccaagatggaggagaacaccaccgtggccgacatcctcgcggggaagttcacccggaaggagaagctggagcgcatcctgcagctctaccccggcgagaagtccacggggatgttcgcccagttcatcagcctgatcgtcggcagcaagggcaacttccagaaggtgttcgacctggtggagaagaccgacatcgagtgcgccaaggactcctacgaggaggacctcgaggccctgctggccatcatcggggacgagtacgcggagctgttcgtcgccgccaagaacacctacaacgccgtggtgctcagctccatcatcaccgtcacggacaccgagaccaacgccaagctgagcgcgtccatgatcgagcggttcgacgcccacgagaaggacctccgcgagctgaaggccttcatcaagctgcacctccccaagcagtacgaggagatcttcagcaacgtggccatcgacggctacgccgggtacatcgacggcaagaccaagcaggtcgacttctacaagtacctgaagacgctgctcgagaacatcgagggcgcggactacttcatcgccaagatcgaggaggagaacttcctgcgcaagcagcggaccttcgacaacggggccatcccccaccagctgcacctcgaggagctggaggccatcctgcaccagcaggcgaagtactacccgttcttcaaggaggcctacgacaagatcaagtccctcgtgaccttccgcatcccctacttcgtgggccccctggccaacgggcagagcgacttcgcctggctgacccggaaggccgacggcgagatccgcccctggaacatcgaggagaaggtggacttcggcaagagcgcggtcgacttcatcgagaagatgacgaacaaggacacctacctcccgaaggagaacgtgctgcccaagcactccctgtactaccagaagtacatggtctacaacgagctcaccaaggtgcggtacatcgacgaccaggggaagaccaactacttcagcggccaggagaagcagcagatcttcaacgactacttcaagaagaagcgcaaggtgtccaagaaggacctggagcagttcctgcggaacatgagccacatcgagtcccccacgatcgaggggctcgaggacagcttcaactccagctacgccacctaccacgacctgctgaaggtcggcatcaagcaggaggtgctggagaaccccctcaacaccgagatgctggaggacatcgtgaagatcctgaccgtcttcgaggacaagcgcatgatcaaggagcagctccagcagttctccgacgtgctggacggggccgtgctgaagaagctcgagcggcgccactacacgggctgggggcggctgagcgccaagctgctcgtcggcatccgcgacaagcagtcccacctgaccatcctggactacctcatgaacgacgacggcctgaaccggaacctgatgcagctcatcaacgacagcaacctgtccttcaagagcatcatcgagaaggagcaggtctccaccaccgacaaggacctgcagagcatcgtggccgacctcgcggggtccccggccatcaagaagggcatcctgcagagcctgaagatcgtggacgagctcgtgtccatcatggggtacccgccccagacgatcgtggtcgagatggcccgcgagaaccagaccaccgtgaagggcaagaacaacagccggccccgctacaagagcctggagaaggccatcaaggagttcgggtcccagatcctgaaggagcaccccaccgacaaccaggagctccggaacaaccgcctgtacctgtactacctccagaacggcaaggacatgtacaccggccaggagctggacatccacaacctgagcaactacgacatcgaccacatcgtgccccagtccttcatcacggacaacagcatcgacaacctcgtcctgacctccagcgccgggaaccgggagaagggcgacgacgtgccgcccctggagatcgtgcgcaagcgcaaggtcttctgggagaagctgttccaggggaacctcatgtccaagcggaagttcgactacctgaccaaggcggagcgcggcggcctcaccgaggccgacaaggccacgttcatccaccggcagctggtggagacccgccagatcaccaagaacgtggccaacatcctgcaccagcggttcaacaacgagaccgacaaccacgggaacaacatggagcaggtccgcatcgtgatgctcaagagcgcgctggtgtcccagttccggaagcagttccagctgtacaaggtccgcgaggtgaacgactaccaccacgcccacgacgcctacctcaacggcgtggtcgccaacacgctgctgaaggtgtacccccagctcgagcccgagttcgtgtacggggagtaccaccagttcgactggttcaaggccaacaaggcgaccgccaagaagcagttctacaccaacatcatgctgttcttcgcccagaaggagcggatcatcgacgagaacggcgagatcctgtgggacaagaagtacctcgagaccatcaagaaggtcctggactaccgccagatgaacatcgtgaagaagacggagatccagaagggggagttcagcaaggccaccatcaagcccaagggcaactccagcaagctgatcccccggaaggagaactgggacccgatgaagtacggcgggctcgactcccccaacatggcctacgcggtgatcatcgagcacgccaagggcaagaagaaggtcgtgttcgagaagaagatcatccgcatcaccatcatggagcggaaggccttcgagaaggacgagaagtccttcctggagaagcaggggtaccgccagcccaaggtgctgaccaagctccccaagtacacgctgtacgagtgcgagaacggccggcgccggatgctggccagcgccaacgaggcgcagaaggggaaccagcaggtcctcaagggccagctgatcaccctgctccaccacgccaagaactgcgaggccagcgacggcaagtccctggactacatcgagagcaaccgcgagatgttcggggagctgctcgcccacgtgagcgagttcgcgaagcggtacaccctggccgacgccaacctgtccaagatcaaccagctgttcgagcagaacaaggacaacgacatcaaggtgatcgcccagagcttcgtcaacctcatggccttcaacgcgatgggcgccccggcctccttcaagttcttcgaggccaccatcgagcgcaagcggtacacgaacctgaaggagctcctgagcgccaccatcatctaccagtccatcaccgggctgtacgaggcgcgcaagcgcctcgacggctga

SEQ ID NO: 1797 - RNA, 4005 nt, synthetic construct
  misc_feature 1..4005: note = Cas9 variant
  source 1..4005: mol_type = other RNA
atgaagaacccctacaccatcggcctggacatcgggaccaacagcgtgggctgggccgtcctcacgaaccagtacgacctggtgaagcgcaagatgaaggtggccgggaactccgacaagaagcagatcaagaagaacttctggggcgtccggctgttcgacgacgggcagaccgcggtggaccgccggatgaaccgcaccgcccggcgccggatcgagcgccggcgcaaccggatcagctacctccaggagatcttcgccgtggagatggccaacatcgacgccaacttcttctgccgcctgaacgactccttctacgtcgacagcgagaagcggaactcccgccacccgttcttcgcgaccatcgaggaggaggtggcctaccacgacaactaccggacgatctaccacctccgcgaggagctggtgaacagctccgagaaggccgacctgcggctggtctacctcgccctggcgcacatcatcaagtaccgcggcaacttcctgatcgagggcgccctcgacaccaagaacaccagcgtggacgaggtgtacaagcagttcatccagacctacaaccaggtcttcatgtccaacatcgaggagggggccctggccaaggtggaggagaacctggaggtggccagcatcctcgcgggcaagttcacgcggcgcgagaagttcgagcggatcctgcgcctgtaccccggggagaagtccaccggcatgttcgcccagttcatcagcctcatcgtcgggaacaagggcaacttccagaaggtgttcaacctggtggagaagaccgacatcgagtgcgccaaggactcctacgaggaggacctggaggccctcctggccatcatcggcgacgagtacgcggagctgttcgtcgccgccaagaacacctacaacgccgtggtgctcagctccatcatcacggtcaccgccaccgagaccaacgcgaagctgagcgcctccatgatcgagcgcttcgacgcccacgagaaggacctgggggagctcaaggccttcatcaagctgcacctccccaagcagtaccaggagatcttcaacaacgccgcgatcgacggctacgccgggtacatcgacggcaagacgaagcaggtcgacttctacaagtacctgaagaccaccctggagaacgtggagggcgccgactacttcatcaccaagatcgaggaggagaacttcctgcggaagcagcgcacgttcgacaacggggtgatcccccaccagctccacctggaggagctggaggccatcctccaccagcaggcgaagtactacccgttcctgcgggaggactacgagaagatcaagagcctggtgaccttccgcatcccctacttcgtcggccccctcgccaaggggcagtccgagttcgcctggctgacccggaaggccgacggcgagatccgcccctggaacatcgaggagaaggtggacttcggcaagagcgccgtggacttcatcgagaagatgaccaacaaggacacgtacctgccgaaggagaacgtcctccccaagcacagcctgtgctaccagaagtacatggtgtacaacgagctgaccaaggtgcggtacatcgacgaccaggggaagaccaactacttctccggccaggagaagcagcagatcttcaacgacctcttcaagcagaagcgcaaggtcaagaagaaggacctggagctgttcctccggaacatcaaccacatcgagagccccaccatcgaggggctggaggactccttcaacgcgagctacgccacgtaccacgacctgctgaaggtgggcatgaagcaggagtccctcgacagccccctgaacgccgagatgctggaggacatcgtgaagatcctcaccgtcttcgaggacaagcgcatgatcaaggagcagctgcagcagttctccgacgtgctggacggggtggtcctcaagaagctggagcggcgccactacaccggctgggggcggctgagcgccaagctcctggtgggcatccgcgacaagcagtcccacctgaccatcctcgactacctgatgaacgacgacggcctgaaccggaacctcatgcagctgatcaacgacagcaacctgtccttcaagagcatcatcgagaaggagcaggtctccacgaccgacaaggacctccagagcatcgtggccgacctggcggggtccccggccatcaagaagggcatcctgcagagcctcaagatcgtggacgagctggtgtccatcatggggtacccgccccagaccatcgtcgtggagatggcccgcgagaaccagaccacggtgaagggcaagaacaacagccggccccgctacaagtccctggagaaggccatcaaggagttcgggagccagatcctcaaggagcaccccaccgacaaccaggagctgaagaacaaccggctgtacctctactacctgcagaacggcaaggacatctacaccggccaggagctggacatccacaacctcagcaactacgacatcgaccacatcgtcccccagtccttcatcaccgacaacagcatcgacaacctggtgctgacctccagcgccgggaaccgcgagaagggcggggacgtgccgcccctcgagatcgtccgcaagcggaaggtgttctgggagaagctgtaccagggcaacctgatgtccaagcgcaagttcgactacctcacgaaggcggagcggggcgggctgaccgacgccgacaaggcccgcttcatccaccggcagctggtggagacccgccagatcaccaagaacgtcgccaacatcctccaccagcggttcaacaacgagacggacaactacggcaacaccatggagcaggtccgcatcgtgaccctcaagagcgcgctggtgtcccagttccggaagcagttccagctgtacaaggtgcgcgaggtgaacgactaccaccacgcccacgacgcctacctgaacggggtcgtggccaacaccctgctcaaggtgtacccccagctggagcccgagttcgtctacggcgagtaccaccagttcgactggttcaaggccaacaaggcgacggccaagaagcagttctacaccaacatcatgctgttcttcgcccagaaggagcggatcatcgacgagaacggggagatcctctgggacaagaagtacctggagaccatcaagaaggtgctggactaccgccagatgaacatcgtgaagaagaccgagatccagaagggcgagttcagcaaggccacgatcaagcccaagggcaactccagcaagctcatcccccggaaggagaactgggacccgatgaagtacgggggcctggactcccccaacatggcctacgcggtcatcatcgagcacgccaaggggaagaagaagatcgtgatcgagaagaagctgatccagatcaacatcatggagcgcaagatgttcgagaaggacgaggaggccttcctcgaggagaagggctaccggcaccccaaggtgctgaccaagctgcccaagtacaccctctacgagtgcgagaaggggcgccggcgcatgctggccagcgccaacgaggcgcagaagggcaaccagctggtcctctccaaccacctggtgagcctgctctaccacgccaagaactgcgaggcctccgacggcaagagcctgaagtacatcgaggcccaccgggaggcgttctccgagctgctcgcccaggtgagcgagttcgccacccgctacacgctggccgacgccaacctgagcaagatcaacaacctcttcgagcagaacaaggagggggacatcaaggcgatcgcccagtccttcgtcgacctgatggtgttcaacgccatgggcgccccggccagcttcaagttcttcgaggcgaccatcgaccggaagcgctacaccaacctgaaggagctcctgtccagcaccatcatctaccagtccatcacggggctgtacgagagccgcaagcggctcgacgactga

SEQ ID NO: 1798 - RNA, 4005 nt, synthetic construct
  misc_feature 1..4005: note = Cas9 variant
  source 1..4005: mol_type = other RNA
atgaagaacccctacaccatcggcctggacatcgggaccaacagcgtgggctgggccgtcctcacggaccagtacgacctggtgaagcgcaagatgaaggtggccgggaactccgacaagaagcagatcaagaagaacttctggggcgtccggctgttcgacgagggggagaccgcggccgaccgccggatgaaccgcaccgcccggcgccggatcgagcgccggcgcaaccggatcagctacctccaggagatcttcgccctggagatggccaacatcgacgcgaacttcttctgccgcctgaacgactccttctacgtggacagcgagaagcggaactcccgccacccgttcttcgccaccatcgaggaggaggtggcctaccacaagaactaccggacgatctaccacctccgcgaggagctggtcaacagctccgagaaggccgacctgcggctcgtgtacctggcgctggcccacatcatcaagtaccgcggcaacttcctcatcgagggcgccctggacaccaagaacaccagcgtggacggggtctacaagcagttcatccagacctacaaccaggtgttcatctccaacatcgaggagggcacgctggccaagatggaggagaacaccaccgtggccaacatcctcgcggggaagttcacccggaaggagaagctggagcgcatcctgcagctctaccccggcgagaagtccacggggatgttcgcccagttcatcagcctgatcgtcggcagcaagggcaacttccagaaggtgttcgacctggtggagaagaccgacatcgagtgcgccaaggactcctacgaggaggacctcgaggccctgctggccatcatcggggacgagtacgcggagctgttcgtcgccgccaagaacacctacaacgccgtggtgctcagctccatcatcaccgtcacggacaccgagaccaacgccaagctgagcgcgtccatgatcgagcggttcgacgcccacgagaaggacctcagcgagctgaaggccttcatcaagctgcacctccccaagcagtacgaggagatcttctccaacgtggccatcgacggctacgccgggtacatcgacggcaagaccaagcaggtcgacttctacaagtacctgaagacgctgctcgagaacatcgagggcgcggactacttcatcgccaagatcgaggaggagaacttcctgcgcaagcagcgcaccttcgacaacggggccatcccccaccagctgcacctcgaggagctggaggccatcctgcaccagcaggcgaagtactacccgttcctcaaggaggcctacgacaagatcaagagcctggtgaccttccggatcccctacttcgtgggccccctggccaacgggcagagcgacttcgcctggctcacccgcaaggccgacggcgagatccggccctggaacatcgaggagaaggtggacttcgggaagtccgcggtcgacttcatcgagaagatgacgaacaaggacacctacctgccgaaggagaacgtgctgcccaagcacagcctctactaccagaagtacatggtctacaacgagctgaccaaggtgcgctacatcgacgaccagggcaagaccaactacttctccggccaggagaagcagcagatcttcaacgactacttcaagcagaagcggaaggtgagcaagaaggacctggagcagttcctccgcaacatgtcccacatcgagagccccacgatcgaggggctggaggactccttcaacagctcctacgccacctaccacgacctgctgaaggtcggcatcaagcaggaggtgctcgagaaccccctgaacatggagatgctggaggacatcgtgaagatcctcaccgtcttcgaggacaagcggatgatcaaggagcagctgcagcagttcagcggggtgctggacggcgccgtgctcaagaagctggagcgccggcactacaccgggtggggccgcctgtccgccaagctcctggtcggcatccgggacaagcagagccacctgacgatcctcgactacctgatgaacgacgacgggctgaaccgcaacctcatgcagctgatcaacgactccaacctgagcttcaagtccatcatcgagaaggagcaggtcagcaccaccgacaaggacctccagtccatcgtggccgacctggcgggcagcccggccatcaagaaggggatcctgcagtccctcaagatcgtggacgagctggtgagcatcatgggctacccgccccagaccatcgtggtcgagatggcccgggagaaccagacgaccgtgaaggggaagaacaacagccgcccccggtacaagtccctggagaaggccatcaaggagttcggcagccagatcctcaaggagcaccccaccgacaaccaggagctgcgcaacaaccggctgtacctctactacctgcagaacggcaaggacatgtacaccgggcaggagctggacatccacaacctctccaactacgacatcgaccacatcgtgccccagagcttcatcaccgacaactccatcgacaacctggtcctgacgagctccgccggcaaccgcgagaagggggacgacgtgccgcccctcgagatcgtgcggaagcgcaaggtcttctgggagaagctgttccagggcaacctgatgagcaagcgcaagttcgactacctcaccaaggcggagcggggcgggctgaccgaggccgacaaggccaccttcatccaccgccagctggtggagacgcggcagatcaccaagaacgtggccaacatcctccaccagcgcttcaacaacgagaccgacaaccacggcaacaacatggagcaggtccggatcgtgatgctgaagtccgcgctggtgagccagttccgcaagcagttccagctctacaaggtccgggaggtgaacgactaccaccacgcccacgacgcctacctgaacggggtggtcgccaacaccctgctcaaggtgtacccccagctggagcccgagttcgtgtacggcgagtaccaccagttcgactggttcaaggccaacaaggcgacggccaagaagcagttctacaccaacatcatgctgttcttcgcccagaaggagcgcatcatcgacgagaacggggagatcctctgggacaagaagtacctggagaccatcaagaaggtcctggactaccggcagatgaacatcgtgaagaagaccgagatccagaagggcgagttctccaaggccacgatcaagcccaagggcaacagctccaagctcatcccccgcaaggagaactgggacccgatgaagtacgggggcctggacagccccaacatggcctacgcggtgatcatcgagcacgccaaggggaagaagaagatcgtcttcgagaagaagatcatccggatcaccatcatggagcgcaaggccttcgagaaggacgagaagtccttcctggagaagcagggctaccggcagcccaaggtgctcaccaagctgcccaagtacaccctgtacgagtgcgagaacgggcgccggcgcatgctcgccagcgccaacgaggcgcagaagggcaaccagcaggtcctgaagggccagctgatcacgctcctgcaccacgccaagaactgcgaggcctccgacggcaagagcctggactacatcgagagcaaccgggagatgttcggggagctcctggcccacgtgtccgagttcgcgaagcgctacaccctggccgacgccaacctcagcaagatcaaccagctgttcgagcagaacaaggacaacgacatcaaggtgatcgcccagtccttcgtgaacctgatggccttcaacgcgatgggggccccggccagcttcaagttcttcgaggccaccatcgagcggaagcgctacaccaacctcaaggagctgctgcgggccacgatcatctaccagtccatcaccggcctctacgaggcgcgcaagcgcctggacgggtga

SEQ ID NO: 1799 - RNA, 4005 nt, synthetic construct
  misc_feature 1..4005: note = Cas9 variant
  source 1..4005: mol_type = other RNA
atgaagaacccctacaccatcggcctggacatcgggaccaacagcgtgggctgggccgtcctcacggaccagtacgacctggtgaagcgcaagatgaaggtggccgggaactccgacaagaagcagatcaagaagaacttctggggcgtccggctgttcgacgagggggagaccgcggccgaccgccggatgaaccgcaccgcccggcgccggatcgagcgccggcgcaaccggatcagctacctccaggagatcttcgccctggagatggccaacatcgacgcgaacttcttctgccgcctgaacgactccttctacgtggacagcgagaagcggaactcccgccacccgttcttcgccaccatcgaggaggaggtggcctaccacaagaactaccggacgatctaccacctccgcgaggagctggtcaacagctccgagaaggccgacctgcggctcgtgtacctggcgctggcccacatcatcaagtaccgcggcaacttcctcatcgagggcgccctggacaccaagaacaccagcgtggacggggtctacaagcagttcatccagacctacaaccaggtgttcatctccaacatcgaggagggcacgctggccaagatggaggagaacaccaccgtggccgacatcctcgcggggaagttcacccggaaggagaagctggagcgcatcctgcagctctaccccggcgagaagtccacggggatgttcgcccagttcatcagcctgatcgtcggcagcaagggcaacttccagaaggtgttcgacctggtggagaagaccgacatcgagtgcgccaaggactcctacgaggaggacctcgaggccctgctggccatcatcggggacgagtacgcggagctgttcgtcgccgccaagaacacctacaacgccgtggtgctcagctccatcatcaccgtcacggacaccgagaccaacgccaagctgagcgcgtccatgatcgagcggttcgacgcccacgagaaggacctcagcgagctgaaggccttcatcaagctgcacctccccaagcagtacgaggagatcttctccaacgtggccatcgacggctacgccgggtacatcgacggcaagaccaagcaggtcgacttctacaagtacctgaagacgctgctcgagaacatcgagggcgcggactacttcatcgccaagatcgaggaggagaacttcctgcgcaagcagcgcaccttcgacaacggggccatcccccaccagctgcacctcgaggagctggaggccatcctgcaccagcaggcgaagtactacccgttcctcaaggaggcctacgacaagatcaagagcctggtgaccttccggatcccctacttcgtgggccccctggccaacgggcagagcgacttcgcctggctcacccgcaaggccgacggcgagatccggccctggaacatcgaggagaaggtggacttcgggaagtccgcggtcgacttcatcgagaagatgacgaacaaggacacctacctgccgaaggagaacgtgctgcccaagcacagcctctactaccagaagtacatggtctacaacgagctgaccaaggtgcgctacatcgacgaccagggcaagaccaactacttctccggccaggagaagcagcagatcttcaacgactacttcaagcagaagcggaaggtgagcaagaaggacctggagcagttcctccgcaacatgtcccacatcgagagccccacgatcgaggggctggaggactccttcaacagctcctacgccacctaccacgacctgctgaaggtcggcatcaagcaggaggtgctcgagaaccccctgaacaccgagatgctggaggacatcgtgaagatcctcaccgtcttcgaggacaagcggatgatcaaggagcagctgcagcagttcagcgacgtgctggacggggccgtgctcaagaagctggagcgccggcactacacgggctgggggcgcctgtccgccaagctcctggtcggcatccgggacaagcagagccacctgaccatcctcgactacctgatgaacgacgacggcctgaaccgcaacctcatgcagctgatcaacgactccaacctgagcttcaagtccatcatcgagaaggagcaggtcagcaccaccgacaaggacctccagtccatcgtggccgacctggcggggagcccggccatcaagaagggcatcctgcagtccctcaagatcgtggacgagctggtgagcatcatggggtacccgccccagacgatcgtggtcgagatggcccgggagaaccagaccaccgtgaagggcaagaacaacagccgcccccggtacaagtccctggagaaggccatcaaggagttcgggagccagatcctcaaggagcaccccaccgacaaccaggagctgcgcaacaaccggctgtacctctactacctgcagaacggcaaggacatgtacaccggccaggagctggacatccacaacctctccaactacgacatcgaccacatcgtgccccagagcttcatcacggacaactccatcgacaacctggtcctgaccagctccgccgggaaccgcgagaagggcgacgacgtgccgcccctcgagatcgtgcggaagcgcaaggtcttctgggagaagctgttccaggggaacctgatgagcaagcgcaagttcgactacctcaccaaggcggagcggggcggcctgaccgaggccgacaaggccacgttcatccaccgccagctggtggagacccggcagatcaccaagaacgtggccaacatcctccaccagcgcttcaacaacgagaccgacaaccacgggaacaacatggagcaggtccggatcgtgatgctgaagtccgcgctggtgagccagttccgcaagcagttccagctctacaaggtccgggaggtgaacgactaccaccacgcccacgacgcctacctgaacggcgtggtcgccaacacgctgctcaaggtgtacccccagctggagcccgagttcgtgtacggggagtaccaccagttcgactggttcaaggccaacaaggcgaccgccaagaagcagttctacaccaacatcatgctgttcttcgcccagaaggagcgcatcatcgacgagaacggcgagatcctctgggacaagaagtacctggagaccatcaagaaggtcctggactaccggcagatgaacatcgtgaagaagacggagatccagaagggggagttctccaaggccaccatcaagcccaagggcaacagctccaagctcatcccccgcaaggagaactgggacccgatgaagtacggcgggctggacagccccaacatggcctacgcggtgatcatcgagcacgccaagggcaagaagaaggtcgtgttcgagaagaagatcatccggatcaccatcatggagcgcaaggccttcgagaaggacgagaagtccttcctggagaagcaggggtaccggcagcccaaggtgctcaccaagctgcccaagtacacgctgtacgagtgcgagaacggccgccggcgcatgctcgccagcgccaacgaggcgcagaaggggaaccagcaggtcctgaagggccagctgatcaccctcctgcaccacgccaagaactgcgaggcctccgacggcaagagcctggactacatcgagagcaaccgggagatgttcggggagctcctggcccacgtgtccgagttcgcgaagcgctacaccctggccgacgccaacctcagcaagatcaaccagctgttcgagcagaacaaggacaacgacatcaaggtgatcgcccagtccttcgtcaacctgatggccttcaacgcgatgggcgccccggccagcttcaagttcttcgaggccaccatcgagcggaagcgctacacgaacctcaaggagctgctgtccgccaccatcatctaccagagcatcaccgggctctacgaggcgcggaagcgcctggacggctga

SEQ ID NO: 1800 - RNA, 4005 nt, synthetic construct
  misc_feature 1..4005: note = Cas9 variant
  source 1..4005: mol_type = other RNA
atgaagaacccctacaccatcggcctggacatcgggaccaacagcgtgggctgggccgtcctcacgaaccagtacgacctggtgaagcgcaagatgaaggtggccgggaactccgacaagaagcagatcaagaagaacttctggggcgtccggctgttcgacgacgggcagaccgcggtggaccgccggatgaaccgcaccgcccggcgccggatcgagcgccggcgcaaccggatcagctacctccaggagatcttcgccgtggagatggccaacatcgacgccaacttcttctgccgcctgaacgactccttctacgtcgacagcgagaagcggaactcccgccacccgttcttcgcgaccatcgaggaggaggtggcctaccacgacaactaccggacgatctaccacctccgcgaggagctggtgaacagctccgagaaggccgacctgcggctggtctacctcgccctggcgcacatcatcaagtaccgcggcaacttcctgatcgagggcgccctcgacaccaagaacaccagcgtggacgaggtgtacaagcagttcatccagacctacaaccaggtcttcatgtccaacatcgaggagggggccctggccaaggtggaggagaacctggaggtggccagcatcctcgcgggcaagttcacgcggcgcgagaagttcgagcggatcctgcgcctgtaccccggggagaagtccaccggcatgttcgcccagttcatcagcctcatcgtcgggaacaagggcaacttccagaaggtgttcaacctggtggagaagaccgacatcgagtgcgccaaggactcctacgaggaggacctggaggccctcctggccatcatcggcgacgagtacgcggagctgttcgtcgccgccaagaacacctacaacgccgtggtgctcagctccatcatcacggtcaccgccaccgagaccaacgcgaagctgagcgcctccatgatcgagcgcttcgacgcccacgagaaggacctgggggagctcaaggccttcatcaagctgcacctccccaagcagtaccaggagatcttcaacaacgccgcgatcgacggctacgccgggtacatcgacggcaagacgaagcaggtcgacttctacaagtacctgaagaccaccctggagaacgtggagggcgccgactacttcatcaccaagatcgaggaggagaacttcctgcggaagcagcgcacgttcgacaacggggtgatcccccaccagctccacctggaggagctggaggccatcctccaccagcaggcgaagtactacccgttcctgcgggaggactacgagaagatcaagagcctggtgaccttccgcatcccctacttcgtcggccccctcgccaaggggcagtccgagttcgcctggctgacccggaaggccgacggcgagatccgcccctggaacatcgaggagaaggtggacttcggcaagagcgccgtggacttcatcgagaagatgaccaacaaggacacgtacctgccgaaggagaacgtcctccccaagcacagcctgtgctaccagaagtacatggtgtacaacgagctgaccaaggtgcggtacatcgacgaccaggggaagaccaactacttctccggccaggagaagcagcagatcttcaacgacctcttcaagcagaagcgcaaggtcaagaagaaggacctggagctgttcctccggaacatcaaccacatcgagagccccaccatcgaggggctggaggactccttcaacgcgagctacgccacgtaccacgacctgctgaaggtgggcatgaagcaggagtccctcgacagccccctgaacgccgagatgctggaggacatcgtgaagatcctcaccgtcttcgaggacaagcgcatgatcaaggagcagctgcagcagttctccgacgtgctggacggggtggtcctcaagaagctggagcggcgccactacaccggctgggggcggctgagcgccaagctcctggtgggcatccgcgacaagcagtcccacctgaccatcctcgactacctgatgaacgacgacggcctgaaccggaacctcatgcagctgatcaacgacagcaacctgtccttcaagagcatcatcgagaaggagcaggtctccacgaccgacaaggacctccagagcatcgtggccgacctggcggggtccccggccatcaagaagggcatcctgcagagcctcaagatcgtggacgagctggtgtccatcatggggtacccgccccagaccatcgtcgtggagatggcccgcgagaaccagaccacggtgaagggcaagaacaacagccggccccgctacaagtccctggagaaggccatcaaggagttcgggagccagatcctcaaggagcaccccaccgacaaccaggagctgaagaacaaccggctgtacctctactacctgcagaacggcaaggacatctacaccggccaggagctggacatccacaacctcagcaactacgacatcgaccacatcgtcccccagtccttcatcaccgacaacagcatcgacaacctggtgctgacctccagcgccgggaaccgcgagaagggcggggacgtgccgcccctcgagatcgtccgcaagcggaaggtgttctgggagaagctgtaccagggcaacctgatgtccaagcgcaagttcgactacctcacgaaggcggagcggggcgggctgaccgacgccgacaaggcccgcttcatccaccggcagctggtggagacccgccagatcaccaagaacgtcacgaacatcctccaccagcggttcaacaacgagaccgacaactacggcaacaccatggagcaggtccgcatcgtgaccctcaagagcgccctggtgtcccagttccggaagcagttccagctgtacaaggtgcgcgaggtgaacgactaccaccacgcgcacgacgcctacctgaacggggtcgtggccaacacgctgctcaaggtgtacccccagctggagcccgagttcgtctacggcgagtaccaccagttcgactggttcaaggccaacaaggccaccgcgaagaagcagttctacaccaacatcatgctgttcttcgcccagaaggagcggatcatcgacgagaacggggagatcctctgggacaagaagtacctggagaccatcaagaaggtgctggactaccgccagatgaacatcgtgaagaagacggagatccagaagggcgagttcagcaaggccaccatcaagcccaagggcaactccagcaagctcatcccccggaaggagaactgggacccgatgaagtacgggggcctggactcccccaacatggcctacgccgtcatcatcgagcacgcgaaggggaagaagaagatcgtgatcgagaagaagctgatccagatcaacatcatggagcgcaagatgttcgagaaggacgaggaggccttcctcgaggagaagggctaccggcaccccaaggtgctgaccaagctgcccaagtacaccctctacgagtgcgagaaggggcgccggcgcatgctggccagcgccaacgaggcccagaagggcaaccagctggtcctctccaaccacctggtgagcctgctctaccacgcgaagaactgcgaggcctccgacggcaagagcctgaagtacatcgaggcccaccgggaggccttctccgagctgctcgcccaggtgagcgagttcgcgacgcgctacaccctggccgacgccaacctgagcaagatcaacaacctcttcgagcagaacaaggagggggacatcaaggccatcgcgcagtccttcgtcgacctgatggtgttcaacgccatgggcgccccggccagcttcaagttcttcgaggccaccatcgaccggaagcgctacaccaacctgaaggagctcctgtccagcacgatcatctaccagtccatcaccgggctgtacgagagccgcaagcggctcgacgactga

SEQ ID NO: 1801 - RNA, 4005 nt, synthetic construct
  misc_feature 1..4005: note = Cas9 variant
  source 1..4005: mol_type = other RNA
atgaagaaggagtacaccatcggcctggacatcgggaccaacagcgtgggctgggccgtcctcacggagaactacgacctggtgaagaagaagatgaaggtgtacgggaacaccgagaccaagtacctgaagaagaacctctggggcgtccgcctgttcgacgagggggagaccgccgcggaccggcgcctgaagcggacgacccgccggcgctactcccggcgccggaaccgcatctgccggctccaggacctgttcaccgaggagatgaaccaggtggacgccaacttcttccaccgcctgcaggagagcttcctcgtgcccgacgagaaggagttcgagcggcacgccatcttcggcaagatggaggaggaggtctcctactaccgcgagttcccgaccatctaccacctccggaagcacctggccgacacgagcgagcaggccgacctccgcctggtgtacctggcgctcgcccacatcgtgaagtaccggggccacttcctgatcgagggggagctgaacaccgagaactccagcgtctccgagaccttccgcaccttcatccaggtgtacaaccagatcttccgggagaacgaggtgcccctcgccgtccccgacaacatcgaggagctgttcagcgagaaggtgtcccgcgcccggaaggtggaggcgatcctgagcgtctactccgaggagaagtccacgggcaccctcgcccagttcctgaagctgatggtggggaaccagggccgcttcaagaagaccttcgacctcgaggaggacgggatcatccagatccccaaggaggagtacgaggaggagctggagaccctgctcgccatcatcggcgacgagtacgccgagatcttcagcgccaccaagagcgtgtacgacgcggtcgccctgtccggcatcctgagcgtgacggacggggacaccaaggccaagctctccgccagcatggtggagcgctacgaggcccaccagaaggacctggtccagttcaagcagttcatccggaaggagctgccggagatgtacgcgcccatcttccgcgacaactccgtgagcggctacgccgggtacgtggagaacagcaaggtcgtgacccaggccgagttctacaagtacatcaagaaggccatcgagaaggtccccggcgccgagtacttcctcgagaagatcgagcaggagacgttcctggacaagcagcggaccttcaacaacggcgtgatcccccaccagatccacctggaggagctcgaggcgatcatccagaagcaggccacctactacccgttcctggccgacaacaaggaggagatgaagcagctggtgaccttccgcatcccctactacgtcgggcccctcgccgacggcaactcccccttcgcctggctggagcggatcagctccgagccgatccgccccgggaacctggcggaggtggtggacatcaagaagtccgccacgaagttcatcgagcggatgaccaacttcgacacctacctccccaccgagaaggtcctgcccaagcacagcatgatctacgagaagtacatggtgtacaacgagctgacgaaggtgagctacgtcgacgagcgcggcatgaaccagcggttctccggggaggagaagaagcagatcgtggaggagctgttcaagcagagccgcaaggtgaccaagaagctgctggagaagttcctctccaacgagttcggcctggtcgacgtggccatcaagggcatcgagaccagcttcaacgccgggtacggcacctaccacgacttcctgaagatcgggatcacgcgggagcagctggacaaggaggagaactccgagaccctcgaggagatcgtgaagatcctgaccgtcttcgaggaccgcaagatgatccgggagcagctgaagaagtacacctacctcttcgacgaggaggtgctgaagaagctggagcgccggcactacacgggctgggggcgcctcagcgcgaagctgctgatcggcatcaaggagaagcggacccacaagaccatcctcgactacctgatcgaggacgacggcgggaagcagccgatcaaccgcaacctgatgcagctcatcaacgactccgacctgagcttcaagtccgagatcgccgaggcccagagcgacatgaacaccgaggacctgcacgaggtggtccagaacctcgccggctcccccgccatcaagaaggggatcctgcagagcctgaagatcgtggacgagctcgtggacatcatgggctccctgcccaagaacatcgtcgtggagatggcgcgggagaaccagaccacgagccgcgggcgcaccaacagcaacccccggatgaaggccctggaggaggccatgcgcaacctccggtccaacctgctgaaggagtacccgaccgacaaccaggccctccagaacgaccgcctgtacctgtactacctccagaacggcaaggacatgtacaccggcctggacctgagcctccacaacctgtccagctacgacatcgaccacatcgtgccccagtccttcacgaccgacaacagcctggacaaccgggtcctcgtgtccagcaaggagaaccgcgggaagaaggacgacgtgccctccaaggaggtcgtgcagaagaacatcaccctgtgggagaccctgaagaacagcaacctcatctcccagaagaagtacgacaacctgacgaagggcctgcgcgggggcctcaccgaggacgaccgggcccacttcatcaagcggcagctggtggagacccgccagatcaccaagcacgtcgcgcggatcctggaccagcgcttcaacagccagaaggacgaggagggcaagacgatccgggccgtgcgcgtggtcaccctcaagtccagcctgacctcccagttccggaagcagttcgccatccacaaggtgcgcgagatcaacgactaccaccacgggcacgacgcctacctgaacggcgtggtcgccaacagcctcctgcgggtgtacccccagctgcagccggagttcgtgtacggggactaccccaagttcaacgcgtacaaggccaacaaggccaccgccaagaagcagctctacacgaacatcatgaagttcttcgcggaggacgccgtcatcatcgacgagaacggcgagatcctgtgggacaagaagaacatcgccaccgtgaagaaggtgatgtcctacccccagatgaacatcgtcaagaagcccgagatccagaccgggagcttcagcaaggagaccatcaagccgaagggcgactccgacaagctgatcagccgcaagacgaactggtcccccaagctctacggcgggttcgacagcccccaggtggcctactccgtgatcatcacctacgagaagggcaagaagaaggtccgggccaaggcgatcgtggggatcaccatcatggagcagagcctgttcaagaaggacccggtgtccctgctcgaggagaagggctacgccaaccccgaggtcctgatccacctccccaagtacaccctgtacgagctggagaacgggcgccggcgcctgctcgccagcgccaacgaggcccagaagggcaaccagctggtgctgcccgcgtccctcgtgacgctgctgtaccacgccaagcaggtcgacgaggacagcggcaagtccgaggagtacgtgcgcgagcaccgggccgagttcgccgagatcctcaactacgtccaggccttcagcgagaccaagatcctggcgaacaagaacctgcagaccatcctcaagctgtacgaggagaacaaggaggccgacatcaaggagatcgccgagtccttcgtgaacctgatgaagttcagcgcctacggggcgccgatggacttcaagttcttcggcaagaccatcccccgctcccggtacacgagcgtgggggagctcctgtccgccaccatcatcaaccagagcatcaccggcctgtacgagacccgccggaagctcgtcgactga

SEQ ID NO: 1802 - RNA, 4005 nt, synthetic construct
  misc_feature 1..4005: note = Cas9 variant
  source 1..4005: mol_type = other RNA
atgcgcaagccctacaccatcggcctggacatcgggaccaacagcgtgggctgggccgtcctcacggaccagtacaacctggtgaagcggaagatgaaggtggccgggtccgccgagaagaagcagatcaagaagaacttctggggcgtccgcctgttcgacgagggggaggtggccgccggccggcgcatgaaccggaccacccgccggcgcatcgagcggcgccggaaccgcatcgcctacctccaggagatcttcgccgcggagatggccgaggtggacgccaacttcttctaccggctggaggacagcttctacatcgagtccgagaagcgccacagccggcacccgttcttcgccaccatcgaggaggaggtcgcgtaccacgaggagtacaagacgatctaccacctccgcgagaagctggtgaactccagcgacaaggccgacctgcggctggtgtacctcgccctggcccacatcatcaagtaccgcggcaacttcctgatcgaggggatgctcgacaccaagaacacctccgtcgacgaggtgttcaagcagttcatccagacctacaaccagatcttcgccagcgacatcgaggagggctccctgacgcggctggaggagaacaaggaggtggcggagatcctcagcgagaagctgacccgccgggagaagctggacaagatcctcaagctgtacaccggggagaagtccaccggcatgttcgcccgcttcatcaacctgatcatcgggagcaagggcgacttcaagaaggtcttcgacctcgacgagaaggccgagatcgagtgcgccaaggacacgtacgaggaggacctggaggccctgctcgcgaagatcggcgacgagtacgccgagatcttcgtggccgccaagtccacctacaacgccgtggtcctgagcaacatcatcaccgtgaccgacacggagaccaaggcgaagctgtccgccagcatgatcgagcgcttcgacaagcacgccaaggacctcaagcggctgaaggccttcttcaagatgcagctgcccgagaagttcaacgaggtgttcaacgacatcgagaaggacgggtacgccggctacatcgacgggaagaccacccaggagaagttctacaagtacatgaagaagatgctcgcgaacatcgacggcgccgactacttcatcgaccagatcgaggaggagaacttcctgcgcaagcagcggacgttcgacaacggcaccatcccccaccagctgcacctcgaggagctggaggccatcctgcaccagcaggccaagtactaccccttcctccgcaaggactacgagaagatccggtccctggtcaccttccgcatcccgtacttcatcgggcccctggcgaacggccagagcgacttcgcctggctcacccggaaggccgacggggagatccgcccctggaacatcgaggagaaggtggacttcggcaagtccgccatcgacttcatcgagaagatgacgaacaaggacacctacctgcccaaggagaacgtgctgccgaagcacagcctctgctaccagaagtacatggtctacaacgagctgaccaagatccggtacatcgacgaccaggggaagacccaccacttcagcggccaggagaagcagcagatcttcaacggcctgttcaagcagcagcgcaaggtgaagaagaaggacctcgagcggttcctgtacacgatcaaccacatcgagtcccccaccatcgagggggtggaggacgccttcaacagctccttcgcgacctaccacgacctgcagaagggcggggtcacccaggagatcctcgacaaccccctgaacgccgacatgctggaggagatcgtgaagatcctgacggtcttcgaggacaagcgcatgatcaaggagcagctccagagcttctccgacgtgctggacggcaccatcctgaagaagctcgagcggcgccactacaccgggtggggccggctgagcgccaagctgctcaccggcatccgcgacaagcactcccacctgacgatcctggactacctcatgaacgacgacgggctgaaccggaacctgatgcagctcatcaacgacagcaacctgtccttcaagagcatcatcgagaaggagcaggtctccaccgccgacaagggcatccagagcatcgtggccgagctggcggggtcccccgccatcaagaagggcatcctccagagcctgaagatcgtggacgagctggtggggatcatgggctacccgccccagaccatcgtcgtggagatggcccgcgagaaccagaccaccggcaaggggaagaacaactccaagccccggttcatcagcctcgagaaggccatcaaggagttcggctcccagatcctgaaggagcaccccacggacaaccagtgcctgaagaacgaccgcctctacctgtactacctgcagaacgggaaggacatgtacaccggcaaggagctcgacatccacaacctgagcaactacgacatcgaccacatcatcccgcagtccttcatcaccgacaacagcatcgacaaccgcgtgctggtcagctccaccgccaaccgggagaagggcgacaacgtgcccctcctggaggtggtccgcaagcggaaggcgttctgggagaagctgtaccaggccaagctcatgagcaagcgcaagttcgactacctgacgaaggccgagcgcgggggcctgaccgaggccgacaaggcgaacttcatccagcggcagctcgtggagacccggcagatcaccaagaacgtggccaacatcctgtaccagcgcttcaactgcaagcaggacgagaacgggaacgaggtcgagcaggtccggatcgtgacgctgaagtccaccctcgtgagccagttccgcaagcagttccagctgtacaaggtgcgggaggtgaacgactaccaccacgcccacgacgcctacctgaacggcgtcgtggccaacaccctcctgaaggtgtacccccagctggagcccgagttcgtctacggggactaccaccagttcgactggttcaaggcgaacaaggccaccgccaagaagcagttctacacgaacatcatgcgcttcttcgccaaggagaaccagatcatcgacaagaacggcgagatcctctgggacaaccggtacctggacaccatcaagaaggtgctgtcctaccgccagatgaacatcgtgaagaagaccgagatccagaagggcgagttcagcaacgccaccgtcaacccgaaggggaactccagcaagctcatctcccggaaggcggactggaaccccatcaagtacggcgggttcgacggcagcaacatggcctactccatcgtgatcgagtacgagaagcgcaagaagaagacggtgatcaagaaggagctgatccagatcaacatcatggagcgggtcgccttcgagaaggaccagaaggccttcctggaggagaaggggtactacagccccaaggtgctcaccaagatccccaagtacaccctgtacgagtgcgagaacggccgccggcgcatgctgggctccgccaacgaggcgcagaaggggaaccagatggtgctcccgaaccacctgatgaccctgctctaccacgccaagaactgcgaggccaacgacggcgagagcctggcctacatcgagatgcaccgggagatgttcgcggagctgctcgcctacatctccgagttcgccaagcgctacacgctggccaacgaccgcctggagaagatcaacatgttcttcgagcagaacaagaagggggacatcaaggtcatcgccaagagcttcgacaagctcaaggtgttcaacgcgttcggcgcgccccgggacttcgagttcttcgagaccaccatcaagcgcaagcggtactacaacatcaaggagctgctgaacgccaccatcatctaccagtccatcacggggctctacgaggcccgcaagcggctggaggactga

SEQ ID NO: 1803 - RNA, 4008 nt, synthetic construct
  misc_feature 1..4008: note = Cas9 variant
  source 1..4008: mol_type = other RNA
atgaagaactacaccatcggcctggacatcgggaccaacagcgtgggctgggccgtcatcaaggacgacctcacgctggtgcgcaagaagatcaagatctccgggaacaccgacaagaaggaggtgaagaagaacctgtggggcagcttcctcttcgagcagggggacaccgcccaggacacccgggtcaagcgcatcgcgcggcgccggtacgagcgccggcgcttccggatccgcgagctgcagaagatcttcgacaagtccatgggcgaggtggacagcaacttcttccaccggctggacgagtccttcctcgtggaggaggacaaggagtacagcaagtaccccatcttctccaacgagaaggaggacaagaactactacgacaagtacccgacgatctaccacctccgcaaggacctggccgacagcaaccagaaggccgacctccggctgatctacctggccctcgcccacatgatcaagtaccgcggccacttcctgatcgagggggacctgaagatggacggcatctccatcagcgagtccttccaggagttcatcgacagctacaacgaggtctgcgcgctcgaggacgagaacctggagatcatctacaacgacgagctgctcacccagatcgagaacatcttcaagcaggacatctcccggagcaagaagctggaccaggccatcgccctgttccagggggtgaagcgccagtccctcttcggcatcttcctgaccctgatcgtggggaacaaggccaacttccagaagatcttcaacctcgaggacgacatcaagctggacctgaaggaggaggactacgacgagaacctcgaggagctgctgagcaacatcgacgagggctaccgggacgtcttcctccaggcgaagaacgtgtacaacgccatcgagctgtccaagatcctgaagaccgacggcaaggagacgaaggcgcccctcagcgcccagatggtggagctgtacaaccagcaccgcgaggacctgaagaagtacaaggactacatcaaggcctacctccccgagaagtacggggagaccttcaaggacgccaccaagaacggctacgccgggtacatcgacggcaagacctcccaggaggacttctacaagttcgtcaaggcccagctgaagggcgaggagaacggggagtacttcctggaggccatcgagaacgagaacttcctccggaagcagcgcagcttctacaacggcgtgatcccctaccagatccacctccaggagctgacggccgtgctggaccagcaggagaagcactacagcttcctgaaggagaaccgggacaagatcatctccctgctcaccttccgcatcccgtactacgtcgggcccctggcgaagggcgagagccgcttcgcctggctggagcggtccaacagcgaggagaagatcaagccctggaacttcgacaagatcgtggacatcgacaagtccgccgagctgttcatcgagaacctgaccagccgcgacacctacctgcccgacgagccggtgctgcccaagcggtccctcatctaccagaagttcacgatcttcaacgagctgaccaagatcagctacatcgacgagcgcgggatcctgcagaacttctccagccgggagaagatcgccatcttcaacgacctcttcaagaacaagtccaaggtcaccaagaaccagctggtgaagtacatcgagaacaaggagcagatcatcgcccccgagatcaagggcatcgaggacagcttcaactccaactacagcacctacatcgacctgtccaagatccccgacatgaagaagctcctggagaaggacgaggacgagatcctggaggagatcatcaagatcctcacgatcttcgaggaccgcaagatgcggaagcgccagctgatgaagttcaaggacaagctgagcgagaaggcgatcaaccagctctccaagaagcactacaccggctgggggcagctgagcgagaagctgatcaacggcatccgggacgagcagtccaacaagaccatcctcgactacctgatcgaggacaacgggtgcccgaagaacatgaaccgcaacttcatgcagctgatcaacgacgacaccctcagcttcaaggagaagatccggaaggcccaggacatcaaccaggtgaacgacatcaaggagatcgtcaaggacctgcccggcagccccgccatcaagaaggggatctaccagtccatccgcatcgtggacgagatcatccggaagatgaaggaccgccccaagaacatcgtgatcgagatggcccgggagaaccagacgacccaggagggcaagaacaagagcaaggcccgcctgaagaagatccaggagggcctcgagaacctggactccgtccacgtggagaagcaggcgctggacgaggagatgctcaagagcccgaagtactacctgtactgcctgcagaacgggaaggacatctacaccggcaaggacctcgacatcgggcagctgcagacctacgacatcgaccacatcatcccccggtccttcatcacggacaacagcttcgacaacctggtcctcacctccagcaccgtgaaccgcggcaagctggacaacgtgccctcccccgacatcgtccggcagcagaaggggttctggaagcagctgctccgcgccggcctgatgagccagcgcaagttcaacaacctgaccaagggcaagctcacggaccgggaccgccagcagttcatcaaccggcagctggtggagacccgccagatcaccaagcacgtggccaacctgctctcccaccacctgaacgagaagaaggaggtcggggagatcaacatcgtgctgctcaagagcgccctgacctcccagttccggaagaagttcgacttctacaaggtgcgcgaggtcaacgactaccaccacgcgcacgacgcctacctgaacggcgtgatcgccctcaagctgctggagctctacccgtacatggccaaggacctgatctacgggaagtacagctaccaccggaagatcgagggcgacaaggccacgcaggcgaagtacaagatgtccaacatcatcgagcgcttcagccaggacctgctcgccaaccccgacggcgagatcgcctgggagaaggacaaggacctgaacaccatccggaaggtgctgtccagcaagcagatcaacatcatcaagaaggccgaggaggggaagggccgcctcttcaaggagaccatcaacagccggccctccaagaagaccgagaagcgcatccccatcaagaacaacctggacccgaacatctacgggggctacatcgaggagaagatggcctactacatcgcgatcaactacctggagaacgggaagaccaagaaggccatcgtcggcatcagcatcaaggacaagaaggacttcgagggccagacgaccgagtacctcgggaagatcggcttcaacaaggcctccatcatcaacagcttcaagaactacaccctgttcgagctggagaacgggtcccggcgcatgatcgtgggcgccagcaaggagaacgactccaagggggagctccagaagggcaaccagatgtacctgccccagaacctgctcgagttcgtgtaccacctgaagcactacaacgaggacgagaccagccacaagttcatcgtcgagcacaaggcctacttcgacgagctgctcaactacatcgtggagttcgcgaacaagtacctggagctggagaactccatcgagaagatcaaggacctctaccacggcaaggggcccgacgtggaggagaaggagctggtcgagagcttcatcaacctgctcgccatcacgaagtgcggccccgccgccgacatcaccttcctgggggagaagatctcccggaagcgctaccggagcaccaactgcctgtggggctccgaggtgatcttccagagcccgaccgggctctacgagacgcgcctgcggctggagtga

SEQ ID NO: 1804 - RNA, 4011 nt, synthetic construct
  misc_feature 1..4011: note = Cas9 variant
  source 1..4011: mol_type = other RNA
atggacgacaactaccagctgatgcacgccaagggcaagtacgggtacggcacccgcatctacagcgaggggcagaccgccgcggaccggcgcggcttccggacgacccgccggcgcctcaaccggcgcaagtggcggctgcgcctgctccaggacttcttcgagccctacatcctgccgcaggacgaggccttcttcatccggcagaagcagtccaacctggtgccccaggacaccaagaagcagtaccccgagagcgtcctcttcgacgacacctccgacaaggacttctacacggagtaccccaccatctaccacctccgccaggccctgatgaccgagaaccggcagttcgacatccgcgaggtgtacctggccatccaccacatcgtgaagtaccgggggcacttcctgaacaacgccccggtcaagaccttcaagagcggcaacctggacctcgcgatcaagttcaacgagctgaacgaggagttcaagtccgtgtaccccgacctggagctccagttcaacctggaccagatcgacgagatcaagaagatcctgctcgacagcacgaagtcccgcttcgaccggcagggcgaggccgtgaagctgatctacaccgtcagcgaggtgaagaccatcgagaagctgcagaacaagatcgtgaagcagttcctctccgggatcctgggcctgaacacccgcttcgacgtcctcacgaacaccgagagcgacgactccatgtggaagttcagcctggactccgagagctccgacgacgccctggacgagatcatcgcccagctcgacgaccccgcgatccacgtggtggagctggtcaacgagatccacagctccatcaccctggccgggatcgtgcccgagggccaggggctcagcgagtccatggtggagaagtacgaggcccacaaggcccacctccagctgctgaaggccgtcgagaagctggtggacaagaaggcggccgacaagctggaggtggcctacgaccagtacatcaacggcaaggacagcaagcagttcatcaaggaggacttctacaaggccgtccagagcgagatcaagggcgtggccggggacgaggtggcggagatcaaccagctcatcgagctggaccagttcatgccgaagcagcggaccaaggagaacggcgccatcccccaccagctgcaccagcacgagctcgacgtcatcatcgagaaccagtccaagtactacgactggctgggggagaaggtgggcaacgagtacaagctggacaagctcgtgagcttccgcgtcccctactacgtgggccccctggtcgacacggcctccaaggagaagaaggacgagacccggttcgcctggatggtgcgcaagaacccggagagcaccgaggccatcaccccctggaacttcgaggacatcgtggacaagaacgcgtccgccgagaacttcatcaagcgcatgacgaccaaggacaagtacctgctcaacgaggacgtcctgcccaagtgcagcctgctcacccaggacttcgaggtgtacaacgagctgaacaacatccgggtgaacggggagaagttcaccgccgagcagaagcagctgatccacgacgagctgttcacgaagcacgcctccgtcagcatcaagcagctcaaggacttcctggtgtccgagctgatgtacgtgcgcgacaacctcaaggtcgagggcctggccgacgagaagaagctgatgagctccctcagcacccagttcgactaccagaagatcatccccgaccagatcaacgacgtgaagtaccgggaggacatcgagcagatcatcgagtggtccaccatcttcgaggacgcggccatcttcaagaccaagctgaaggagatcgactggctgacggacgagcagcgcaacaagctcgccaacaagcggtaccgcgggtggggcagcctgtccaagcggctgctcgcctgcctggtggacgagaacgggcagcgcatcatcgacatcctgcgggacagctccgacaacttcatgatgatcgtcaaccgcccggagttcaagcaggcgatcttcgacgagaacgccaacctcaccgagaccaacagcaagaaggacatgttcgagatgatcgacaacttctacaccagcccccagaacaagaaggccatccgccaggtgctgctggtggtccaggacatccagaacgccatgggcggcgtggcgccccagaagatcttcatcgagttcgcccgggaggacgaggtgaacgggcggcgcacgaactcccggtacagccagatccgcgagatgtactccaaggtcaccgacgacgtgatcaacaagaccgtgcggggcgagctcgaggccaacaaggggagcctgaacaaggagaagctgttcctctacttcctgcagggcgggatcgacctgtactccggcaagaccatcaacatcgacaacatcagctcctacgacgtcgaccacgtgctcccccagagcttcatcaaggacgactccatcaacaacaaggtgctggtcaacgccaagggcaaccgcgtgaagaacgacaacgtgccgatggagctgttcggggccaagatgtaccccacgtggaagcggatggtcgacaccggcatcatgagcaaggccaagttcaagaacctcaccctgaaccccgacaacgtggacaagttcaaggcggaggggttcatcaaccgccagctggtggagacccgccagatcatcaagctcgtcgcccagatcctgaacgacaagctgggcgacgacaccaagatcgtgtccgtgaaggccaacctcacgcacgacatgcgggtcttcttcgacttccccaagaaccgcaacgtgaacaactaccaccacgccttcgacgcctacctgagcgcgttcgtggggacctacctgtacaagcggtacccgaagctccagccctacttcgtctacggcgagttcaagaagatggacaagctgaagaacatgacctccttcgacttcctgcgcgacctcaagcacaccgacaaggtggtggacaaggacacgggcgagatcatcgccgacaagctggccgtcatcaccaacatgaacaagatctacgacttcaagaaggtgctggtgacccacgaggtccacgagaacagcggggccatgtacgaccagaccctctaccccgcgaagctggacaagtccctgggccggaagggggccaagcagctcatccccaagaaggacgacatgccgacggccctgtacggcggctacaccgggagcaaggacgccttcatgtccatcgtgcgcctgaagaagaaggacgaggtgtactacaaggtcatcggcatccccgtgcggatcgccgacagcgtgcagcacgggaaggaggtcgacgtggaggcgctcacccagttcatcgagaccaagttcacgaaggagaacctgaacaagaagaccggcgagatcacccgcaaggtggagtggttcgagctggtcctccccaaggtgctgttcgggcaggccgtcttcgacggcggccagccgttcatgctggggtccagcacctacccccacaacctccgggagctggtgctgacgaaggacagcgtgaagaagatcgccggcaaggagtccaacaagagctacctcgacgcctacgacgagatcatggaggccatgaacaagtacttccccctgtacgacaccaacaagttccgcgagaaggtcatcgaggggcggtccaagttcatcgacctgcccgacaaggacgagtacgagaacaacaagctcgtccaggtgggcaagagcaccatcatcgaccgcatgttcatcgggctgcacgcgaacgccgcccggaccgacctgaagaacatcggcatcacgaccccgttcggcttcatgcagcaggcctccgggatcaagctcaccaaggacaccgtggtgctgttccagagctccacgggcctgttcgagcgcaaggtggccctcaaggacctgtga

SEQ ID NO: 1805 - RNA, 4011 nt, synthetic construct
  misc_feature 1..4011: note = Cas9 variant
  source 1..4011: mol_type = other RNA
atgaccaaggactacaccatcggcctggacatcgggacgaacagcgtgggctgggccgtcctcaccgacgactaccagctgatgaagcgcaagatgtccgtgcacgggaacaccgagaagaagaagatcaagaagaacttctggggcgcccggctgttcgacgaggggcagaccgcggagttccgccggacgaagcgcaccaaccggcgccggctcgcccgccggaagtaccgcctgagcaagctgcaggacctcttcgccgaggagctgtgcaagcaggacgactgcttcttcgtgcggctggaggagtccttcctcgtccccgaggagaagcagtacaagccggccagcatcttccccaccctggaggaggagaaggagtactaccagaagtaccccaccatctaccacctccgccagaagctggtggactccacggagaaggaggacctgcggctggtgtacctcgccctggcgcacctcctgaagtaccgcggccacttcctgttcgagggctacctggacaccgagaacaccagcatcgaggagtccttccgggtcttcctcgagcagtacgggaagcagagcgaccagcccctgatcgtgcaccagccggtgctgaccatcctcacggacaagctgtccaagaccaagaaggtcgaggagatcctgaagtactaccccaccgagaagatcaacagcttcttcgcccagtgcctcaagctgatcgtgggcaaccaggccaacttcaagcgcatcttcgacctggaggccgaggtgaagctccagttctccaaggagacctacgaggaggacctggagagcctgctcgagaagatcggggacgagtacctggacatcttcctgcaggcgaagaaggtccacgacgccatcctcctgtccgagatcatcagctccacggtgaagcacacccaggccaagctgagctccggcatggtggagcggtacgagcgccacaaggccgacctcgccaagttcaagcagttcgtcaaggagaacgtgccccagaaggcgaccgtgttcttcaaggacaccacgaagaacgggtacgccggctacatcaagggcaagaccacccaggaggagttctacaagttcgtcaagaaggagctgagcggggtggtgggctccgagcccttcctggagaagatcgaccaggagaccttcctcctgaagcagcggacgtacaccaacggggtcatcccgcaccaggtgcacctgatcgagctcaaggccatcatcgaccagcagaagcagcactaccccttcctggaggaggccggccccaagatcatcgccctgttcaagttccgcatcccctactacgtgggcccgctcgcgaaggagcaggaggccagcagcttcgcctggatcgagcggaagaccgccgagaagatccacccctggaacttctccgaggtcgtggacatcgagaagtccgccatgcgcttcatccagcgcatgaccaagcaggacacgtacctgcccaccgagaaggtcctgcccaagaacagcctgctctaccagaagtacatgatcttcaacgagctgaccaaggtgagctacaaggacgagcgcggggtgaagcagtacttctccggcgacgagaagcagcagatcttcaagcagctgttccagaaggagcgggggaagatcaccgtcaagaagctccagaacttcctgtacacgcactaccacatcgagaacgcgcacatcttcggcatcgagaaggccttcaacgccagctactccacctaccacgacttcatgaagctggccaagaccaaccagaagtccatgcaggagtggctcgagcagccggagatggagcccatcttcgaggacatcgtgaagatcctgaccatcttcgaggaccggcagatgatcaagcaccagctgagcaagtaccaggaggtgttcggggagaagctcctgaaggagttcgcccgcaagcactacacgggctggggccggttcagcgcgaagctgatccacgggatccgcgaccggaagaccaacaagaccatcctcgactacctgatcaacgacgacgacgtccccgccaaccgcaaccggaacctgatgcagctcatcaacgacgagcacctgtccttcaaggaggagatcgccaaggccaccgtgttcagcaagcacaagtccctggtggacgtcatccaggacctccccggcagcccggcgatcaagaaggggatctggcagtccctgaagatcgtggaggagctgatcgccatcatcggctacaagcccaagaacatcgtgatcgagatggcccgcgagaaccagaagacccaccggacgaagccccgcctcaaggccctggagaacgggctgaagcagatcggcagcaccctcctgaaggagcagcccaccgacaacaaggccctgcagaaggagcggctctacctgtactacctgcagaacggccgcgacatctacaccggggagccgctcgacatcgagaacctgcaccagtacgaggtcgaccacatcatcccccggtccttcatcgtggacaacagcatcgacaacaaggtgctggtcgcgtccaagcagaaccagaagaagcgcgacgacgtgcccaacaagcagatcgtgaacgagcagcggatcttctggaaccagctcaaggaggccaagctgatcagccccaagaagtacgcctacctgacgaagatcgagctcaccccggaggacaaggcccgcttcatccagcggcagctggtcgagacccgccagatcaccaagcacgtggccaacatcctgcaccagagcttccaccaggaggaggagggcacggactgcgacggggtgcagatcatcaccctcaaggcgaccctgacctcccagttccgccagacgttcggcctgtacaaggtccgggagatcaacccccaccaccacgcccacgacgcctacctcaacgggttcatcgccaacgtgctgctgaagcgctaccccaagctcgccccggagttcgtgtacggcaagtacgtcaagtacagcctggcgcgggagaacaaggccaccgccaagaaggagttctactccaacatcctgaagttcctcgagagcgacgagcccttctgcgacgagaacggcgagatctactgggagaagtcctaccacctcccccgcatcaagaaggtgctgagctcccaccaggtgaacgtcgtgaagaaggtggagcagcagaagggcgggttctacaaggagaccgtcaacagcaaggagaagcccgacaagctgatcgagcggaagaacaactgggacgtgaccaagtacgggggcttcggctccccggtgatcgcctacgcgatcgccttcgtctacgccaaggggaagacgcagaagaagacccgcgccatcgagggcatcaccatcatggagcaggccgcgttcgagaaggaccccaccacgttcctgaaggacaaggggttcccccaggtgaccgagttcatcaagctgcccaagtacaccctcttcgagttcgacaacggccggcgccggttcctggccagccacaaggagtcccagaaggggaacccgttcatcctgagcgaccagctcgtgaccctgctgtaccacgcccagcactacgacaagatcacgtaccaggagtccttcgactacgtcaacacccacctcagcgacttctccgccatcctgaccgaggtgctggccttcgcggagaagtacaccctcgccgacaagaacatcgagcgcatccaggagctgtacgaggagaacaagtacggcgagatcagcatgatcgcccagtccttcctgcagctcctgcagttcaacgccatcggcgcccccgcggacttcaagttcttcggggtgacgatcccccggaagcgctacaccagcctgaccgagatctgggacgccaccatcatctaccagagcgtcacgggcctctacgagacccggatccgcatgggggacctgtgggccggcgagcagtga

SEQ ID NO: 1806 - RNA, 4011 nt, synthetic construct
  misc_feature 1..4011: note = Cas9 variant
  source 1..4011: mol_type = other RNA
atgaccaaggactacaccatcggcctggacatcgggacgaacagcgtgggctgggccgtcctcaccgacgactaccagctgatgaagcgcaagatgtccgtgcacgggaacaccgagaagaagaagatcaagaagaacttctggggcgcccggctgttcgacgaggggcagaccgcggagttccgccggacgaagcgcaccaaccggcgccggctcgcccgccggaagtaccgcctgagcaagctgcaggacctcttcgccgaggagctgtgcaagcaggacgactgcttcttcgtgcggctggaggagtccttcctcgtccccgaggagaagcagtacaagccggccagcatcttccccaccctggaggaggagaaggagtactaccagaagtaccccaccatctaccacctccgccagaagctggtggactccacggagaaggaggacctgcggctggtgtacctcgccctggcgcacctcctgaagtaccgcggccacttcctgttcgagggcgacctggacaccgagaacaccagcatcgaggagtccttccgggtcttcctcgagcagtacagcaagcagtccgaccagcccctgatcgtgcaccagccggtgctgaccatcctcacggacaagctgagcaagaccaagaaggtcgaggagatcctgaagtactaccccaccgagaagatcaactccttcttcgcccagtgcctcaagctgatcgtggggaaccaggccaacttcaagcgcatcttcgacctggaggccgaggtgaagctccagttcagcaaggagacctacgaggaggacctggagtccctgctcgagaagatcggcgacgagtacctggacatcttcctgcaggcgaagaaggtccacgacgccatcctcctgagcgagatcatctccagcacggtgaagcacaccaaggccaagctgtccagcgggatggtggagcggtacgagcgccacaaggccgacctcgccaagttcaagcagttcgtcaaggagaacgtgccccagaaggcgaccgtgttcttcaaggacaccacgaagaacggctacgccgggtacatcaagggcaagaccacccaggaggagttctacaagttcgtcaagaaggagctgtccggcgtggtggggagcgagcccttcctggagaagatcgaccaggagaccttcctcctgaagcagcggacgtacaccaacggcgtcatcccgcaccaggtgcacctgatcgagctcaaggccatcatcgaccagcagaagcagcactaccccttcctggaggaggccgggcccaagatcatcgccctgttcaagttccgcatcccctactacgtgggcccgctcgcgaaggagcaggaggccagctccttcgcctggatcgagcggaagaccgccgagaagatcaacccctggaacttcagcgaggtcgtggacatcgagaagtccgccatgcgcttcatccagcgcatgaccaagcaggacacgtacctgcccaccgagaaggtcctgcccaagaacagcctgctctaccagaagtacatgatcttcaacgagctgaccaaggtgtcctacaaggacgagcggggcgtgaagcagtacttcagcggggacgagaagcagcagatcttcaagcagctgttccagaaggagcgcggcaagatcaccgtcaagaagctccagaacttcctgtacacgcactaccacatcgagaacgcgcagatcttcgggatcgagaaggccttcaacgcctcctacagcacctaccacgacttcatgaagctggccaagaccaaccagaaggccatgcaggagtggctcgagcagccggagatggagcccatcttcgaggacatcgtgaagatcctgaccatcttcgaggaccggcagatgatcaagcaccagctgtccaagtaccaggaggtgttcggcgagaagctcctgaaggagttcgcgcgcaagcactacacggggtggggccggttcagcgccaagctgatccacggcatccgcgaccggaagaccaacaagaccatcctcgactacctgatcaacgacgacgacgtccccgccaaccgcaaccggaacctgatgcagctcatcaacgacgagcacctgtccttcaaggaggagatcgccaaggcgaccgtgttcagcaagcacaagtccctggtggacgtcatccaggacctccccgggagcccggccatcaagaagggcatctggcagtccctgaagatcgtggaggagctgatcgccatcatcgggtacaagcccaagaacatcgtgatcgagatggcccgcgagaaccagaagacccaccggacgagcccccgcctcaaggccctggagaacggcctgaagcagatcgggtccaccctcctgaaggagcagcccaccgacaacaaggcgctgcagaaggagcggctctacctgtactacctgcagaacggccgcgacatgtacaccggcgagccgctcgagatcgagaacctgcaccagtacgaggtcgaccacatcatcccccggagcttcatcgtggacaactccatcgacaacaaggtgctggtcgccagcaagcagaaccagaagaagcgcgacgacgtgcccaagaagcagatcgtgaacgagcagcggatcttctggaaccagctcaaggaggccaagctgatcagccccaagaagtacgcctacctgacgaagatcgagctcaccccggaggacaaggcccgcttcatccagcggcagctggtcgagacccgccagatcaccaagcacgtggcgaacatcctgcaccagtccttcaaccaggaggaggaggggacggactgcgacggcgtgcagatcatcaccctcaaggccaccctgaccagccagttccgccagacgttcgggctgtacaaggtccgggagatcaacccccaccaccacgcccacgacgcctacctcaacggcttcatcgccaacgtgctgctgaagcgctaccccaagctcgcgccggagttcgtgtacgggaagtacgtcaagtactccctggcccgggagaacaaggccaccgccaagaaggagttctacagcaacatcctgaagttcctcgagtccgacgagcccttctgcgacgagaacggcgagatctactgggagaagtcccaccacctcccccgcatcaagaaggtgctgagcagccaccaggtgaacgtcgtgaagaaggtggagcagcagaagggcgggttctacaaggagaccgtcaactccaaggagaagcccgacaagctgatcgagcggaagaacaactgggacgtgaccaagtacggcgggttcggcagcccggtgatcgcgtacgccatcgccttcgtctacgccaagggcaagacgcagaagaagacccgcgccatcgaggggatcaccatcatggagcaggcggccttcgagaaggaccccaccacgttcctgaaggagaagggcttcccccaggtgaccgagttcatcaagctgcccaagtacaccctcttcgagttcgacaacgggcggcgccggttcctggcctcccacaaggagagccagaagggcaacccgttcatcctgtccgaccagctcgtgaccctgctgtaccacgcccagcactacgacaagatcacgtaccaggagagcttcgactacgtcaacacccacctctccgacttcagcgccatcctgaccgaggtgctggcgttcgccgagaagtacaccctcgccgacaagaacatcgagcgcatccaggagctgtacgaggagaacaagtacggggagacgtccatgatcgcccagagcttcctgcagctcctgcagttcaacgccatcggcgcgcccgccgacttcaagttcttcggcgtgaccatcccccggaagcgctacaccagcctgaccgagatctgggacgccacgatcatctaccagtccgtcaccgggctctacgagacccggatccgcatgggcgacctgtgggccggggagcagtga

SEQ ID NO: 1807 - RNA, 4014 nt, synthetic construct
  misc_feature 1..4014: note = Cas9 variant
  source 1..4014: mol_type = other RNA
atgaagaacatgaagaagccctacaccatcggcctggacatcgggaccaacagcgtgggctgggccgtcctcacggaccagtacgacctggtgaagcgcaagatgaagatcgccggggactccgagaagaagcagatcaagaagaacttctggggcgtgcggctgttcgacgaggggcagaccgcggccgaccgccggatggcccgcaccgcccggcgccggatcgagcgccggcgcaaccggatcagctacctccagggcatcttcgccgaggagatgtccaagaccgacgcgaacttcttctgccgcctgagcgactccttctacgtcgacaacgagaagcggaacagccgccacccgttcttcgccacgatcgaggaggaggtggagtaccacaagaactaccccaccatctaccacctccgggaggagctggtgaactccagcgagaaggccgacctgcgcctggtctacctcgccctggcgcacatcatcaagtaccggggcaacttcctgatcgagggggccctcgacacccagaacacctccgtggacggcatctacaagcagttcatccagacgtacaaccaggtgttcgccagcgggatcgaggacggctccctgaagaagctggaggacaacaaggacgtcgccaagatcctcgtggagaaggtgacccgcaaggagaagctggagcggatcctgaagctctaccccggggagaagtccgccggcatgttcgcgcagttcatcagcctgatcgtcggcagcaaggggaacttccagaagcccttcgacctgatcgagaagtccgacatcgagtgcgccaaggacagctacgaggaggacctcgagtccctgctggccctcatcggcgacgagtacgccgagctgttcgtggccgcgaagaacgcctacagcgccgtggtcctgtccagcatcatcaccgtggccgagaccgagacgaacgccaagctcagcgcgtccatgatcgagcgcttcgacacccacgaggaggacctgggggagctgaaggccttcatcaagctccacctcccgaagcactacgaggagatcttcagcaacaccgagaagcacggctacgccggctacatcgacgggaagaccaagcaggccgacttctacaagtacatgaagatgacgctggagaacatcgagggcgccgactacttcatcgcgaagatcgagaaggagaacttcctgcggaagcagcgcaccttcgacaacggggccatcccccaccagctgcacctggaggagctcgaggccatcctgcaccagcaggccaagtactaccccttcctgaaggagaactacgacaagatcaagtccctcgtgaccttccgcatcccctacttcgtcggcccgctggcgaacgggcagagcgagttcgcctggctgacccggaaggccgacggcgagatccgcccctggaacatcgaggagaaggtggacttcggcaagtccgccgtggacttcatcgagaagatgacgaacaaggacacctacctccccaaggagaacgtcctgcccaagcacagcctgtgctaccagaagtacctcgtgtacaacgagctgaccaaggtgcggtacatcaacgaccaggggaagacctcctacttcagcggccaggagaaggagcagatcttcaacgacctgttcaagcagaagcgcaaggtcaagaagaaggacctcgagctgttcctgcggaacatgtcccacgtggagagcccgacgatcgaggggctggaggactccttcaacagctcctacagcacctaccacgacctcctgaaggtcggcatcaagcaggagatcctggacaaccccgtgaacaccgagatgctcgagaacatcgtgaagatcctgaccgtcttcgaggacaagcgcatgatcaaggagcagctgcagcagttctccgacgtgctcgacggggtggtcctgaagaagctggagcggcgccactacacgggctggggccggctcagcgccaagctgctgatggggatccgcgacaagcagtcccacctcaccatcctggactacctgatgaacgacgacggcctcaaccggaacctgatgcagctgatcaacgacagcaacctctccttcaagagcatcatcgagaaggagcaggtcaccaccgcggacaaggacatccagagcatcgtggccgacctggccgggtcccccgccatcaagaagggcatcctgcagagcctcaagatcgtggacgagctggtgtccgtgatggggtacccgccccagacgatcgtcgtggagatggcccgcgagaaccagaccaccggcaagggcaagaacaacagccggccccgctacaagtccctggagaaggcgatcaaggagttcgggagccagatcctcaaggagcaccccaccgacaaccaggagctgcggaacaaccgcctgtacctctactacctgcagaacggcaaggacatgtacacggggcaggacctggacatccacaacctctccaactacgacatcgaccacatcgtgccccagagcttcatcaccgacaactccatcgacaacctggtcctgaccagctccgccggcaaccgggagaagggcgacgacgtgccgcccctcgagatcgtgcgcaagcggaaggtcttctgggagaagctgtaccaggggaacctgatgagcaagcgcaagttcgactacctcaccaaggccgagcgcggcgggctgaccgaggccgacaaggcccggttcatccaccgccagctggtggagacgcggcagatcaccaagaacgtggcgaacatcctccaccagcgcttcaactacgagaaggacgaccacggcaacaccatgaagcaggtccggatcgtgaccctgaagtccgccctggtgagccagttccgcaagcagttccagctctacaaggtccgggacgtgaacgactaccaccacgcccacgacgcctacctgaacggggtggtcgcgaacacgctgctcaaggtgtacccccagctggagcccgagttcgtgtacggcgactaccaccagttcgactggttcaaggccaacaaggccaccgccaagaagcagttctacaccaacatcatgctgttcttcgcccagaaggaccgcatcatcgacgagaacggcgagatcctctgggacaagaagtacctggacaccgtcaagaaggtgatgtcctaccggcagatgaacatcgtgaagaagacggagatccagaagggggagttcagcaaggcgaccatcaagccgaagggcaactccagcaagctgatcagccgcaagaccaactgggaccccatgaagtacgggggcctcgactcccccaacatggcctacgccgtcgtgatcgagtacgccaaggggaagaacaagctggtgttcgagaagaagatcatccgggtcaccatcatggagcgcaaggccttcgagaaggacgagaaggcgttcctggaggagcagggctaccggcagcccaaggtgctcgccaagctgccgaagtacacgctgtacgagtgcgaggagggccgccggcgcatgctcgccagcgccaacgaggcccagaaggggaaccagcaggtcctgcccaaccacctggtgaccctcctgcaccacgtggcgaactgcgaggtgtccgacggcaagagcctggactacatcgagtccaaccgggagatgttcgccgagctcctggcccacgtcagcgagttcgccaagcgctacaccctggcggaggccaacctcaacaagatcaaccagctgttcgagcagaacaaggagggggacatcaaggccatcgcccagtccttcgtggacctgatggccttcaacgcgatgggcgcccccgccagcttcaagttcttcgagaccacgatcgagcggaagcgctacaacaacctcaaggagctgctgaactccaccatcatctaccagagcatcaccgggctctacgagtcccggaagcgcctggacgactga

SEQ ID NO: 1808 - RNA, 4014 nt, synthetic construct
  misc_feature 1..4014: note = Cas9 variant
  source 1..4014: mol_type = other RNA
atgaagaagttcgagaactactacctgggcctcgacatcgggaccagctccatcggctgggccgtgaccaacagccagtacgacatcctgaagttcaacgggaagtacatgtggggcacgcgcctgttccccgaggccaacaccgcgcaggagcggcgcatccaccggtccagccgccggcgcctcaagcggcgcaaggagcggatccagatcctgcagatgctgttcgacaaggagatcgccaagatcgactccgggttcttccagcgcctcaaggacagcaagtactacaaggaggacaagaccgagaagcagaccaactccatcttccacgacaaggactacagcgacaaggagtaccaccaggacttcccgacgatctaccacctccggaagttcctgctggagggcaacaagcccaaggacatccgcttcgtctacctggccctgcaccacatcctcacccaccggggccacttcctgttccccgacatggaggtgtccaacgtgaccgagttcagcaacatcttctccgagctgaagcagtacctctacgacgagatggacctggacttcgagtggaagaacgggaagctgaacgaggtcgagaacatcctcaaggaccgcaacctggccaagagcgagaaggagaagaagctgtgcggcatcatcgagctcgaggggaagatcgacaaccagcggaaggccatgatcggcatgatgtgcgggtgcaagaagaagttctccgacctgttccagaacgagaactaccgcgagctggagatcagctccttcagcttcgcggactccagctacgaggagaagcgggacgagctcgagggcatcctggccgagaacatcctgtgcctcgactacctgaagaccatctacgactggggcaagctgtccgacatcctccagggggaggagagcatcagcgtggccaaggtgaagtcctacgaggagcaccagctggacctgaagtacctcaagaacatcctgaagctgtacagccacaaggagaaggagaacgtcttccgcaagaaggagggcaagtaccccaagtacatctccgggaagctcagccaggaggagttcaacaagtccatcaagaagatcctggaggagatcaagagcgtgaagcaggaggaccggaaggtgttcgacacgctgctcaagcgcgcctccaacaacctgctgtgcccgaagcaggtcatcaaggagaacggcgtgatcccctaccagatccacaagttcgagctcgagaagatcctgcggaacatggcggacttcttccccatgctgaaggagaagaaggacggcaagaccctcagcgagaagatcatctccgtgttcaccttccgcatcccctactacgtcgggccgctgaaccagaacagcgaccgcgcctggctggtgaagaacaaggacgagaagatctacccctggaacttcgaggagatcgtgaacctcgaggagtccgccgagaagttcatccagaacctgaccaacaagtgcacgtacctggtcctggaggacgtgctccccaagagctccatcctgtacagcaagttcatggtgctgaacgagctcaacaacctgaagatcgacggcgaggccatctccgtcgacctgaagcagaagatctacctcaacctgttccagaagtacaagaaggtgaccctgaagaagctcaaggggtacctcaagagcgagaacatcctgatcgacacctccacccagatcacgggcatcgacggggacttcaagagctccctgggcagctacctggacttctacaacatcctgggcgacaaggtgaagaccgacttcgggaagaagctcatcgagaactgcatcctgtggatcaccctgtacaccggcgagaagaagctcctgaagaacaagatcatcgccaactacaagggggagctgagcgaggaggagatcaagaagatcgtcaacctcaagtacaaggactggggccggctgtcctacgcgttcctggaggagatccagagcgcctccctcgagacgggggagctgcgcaacatcatccagatgatgtgggagaccaacaacaacctgatggagctcctgagctccaactaccagttcctgagcgagatcgagaagcggaactccgtggtggccatcggcaaggagttcaactacgagaccatcctcggcgacagctacgcctcccccagcgtcaagcgcatgatctggcagtccctgagcgtggtcgacgagatcaagaagatcatgaagaaggccccgaagaagatcttcatcgagatggcgcggcaggaggacatgaagaaggagcgcaaggagtcccgcaagagcaccttcctgacgctctacaagtccatcaaggaggaggggcgggactggatcaaggagatcgagaactggagcgactccgagttccggagcaagaagctgtacctgtactacacccagatgggcaagtgcatgtacaccggggagaagatcagcctcgaccagctgttcaacaagaacatctacgacatcgaccacatctacccccgctccaagaccaaggacgacagcatcgagaacatcgtgctggtgaagcggaacatcaacgccaagaagacggacgagtaccccctcgagcgcaacatccagcagaagcagcacgacttctggaagatgctgcactccaagaagctgatcggcgacaagaagtacgagcggctcacccgcaccaccgagttcacggacgaggagctgagcgacttcatcgcccggcagctggtcgagacccgccagtccaccaagatcgtggccgacatcctcaagaacctgttccccgagaccaagatcgtgtacgtcaaggccaacctgacgagcgacttccggaagaacttcaagatcctcaagtcccgcgacatcaacgactaccaccacgcgcacgacgcctacctgaacatcgtgaccgggaacgtgtacaacatcaagttcaccgacaacccgcggaacttcatcaaggacaagaagctggagggcaagaagtacaacctcaaggtcgagaagatcttcgagtaccgcaaggagaacgagagcttctggaaccccaagaccatggtgaccaagatcgagaactacatcttcaagaagcgcccccagttcacgcggtactccttcgagcagcacggcgggttcttcgaccagaacatcgtggacaaggagagctgcaagaagggcaccgggtacatccccatcaagtccagcaacgccatcctgtacaacacctccaagtacggcggctacgggagcgtcaccggcacgtacttcttcctggtggagcacaccatgaaggggaagcgcatccggaccatcgagatgatgccgctctacctgtccaagaagatccacagcaaggaggagctggagaagtactgcaaggagaagctcgagctgcagaagccctccgtgcgcctggcccggatcaagtacaacagcctcctgaagatcaacggcttcccctaccacatcaccgggaagacgaacgactcctactggatcatgagcgccatccagctgctcctgagcaagaactactacgagtacctgcgcaagctctacatcttctgcaaggaggagcggctggaggaggagatcgtcggcgagaagaacatcaagctgtacacgtgcatcctcgagaagctggagaagtccatctacagccacaagctgctcaacatcaactacaacggcaagtccaagaacctgaaggacatcctggagagcgagaaggagaacttcctcctgctgtccgagaagaagcaggcgcagatcctcatcgagatcttcaccctgctggagagcaacaacttcggggccaacctcgagtccttcggctgcgggaagaagtgcggcatcaccaagatcaacaagaacatcgacaagctggaggaggtgctgctcatcaaccagagccccaccgggctgttcgagaactccatcgacctgaagaaggtgtga

SEQ ID NO: 1809 - RNA, 4014 nt, synthetic construct
  misc_feature 1..4014: note = Cas9 variant
  source 1..4014: mol_type = other RNA
atgaagaaggactacgtgatcggcctggacatcgggaccaacagcgtcggctgggccgtgatgaccgaggactaccagctcgtgaagaagaagatgcccatctacgggaacacggagaagaagaagatcaagaagaacttctggggcgtccgcctgttcgaggaggggcacaccgccgaggaccggcgcctgaagcggaccgcgcgccggcgcatctcccggcgccggaaccgcctccggtacctgcaggccttcttcgaggaggccatgaccgacctggacgagaacttcttcgcccgcctccaggagagcttcctggtgccggaggacaagaagtggcaccggcaccccatcttcgccaagctggaggacgaggtggcgtaccacgagacgtaccccaccatctaccacctccgcaagaagctggccgactccagcgagcaggccgacctgcggctcatctacctggccctggcgcacatcgtcaagtaccgcggccacttcctcatcgagggcaagctgtccaccgagaacatcagcgtgaaggagcagttccagcagttcatgatcatctacaaccagaccttcgtgaacggggagtcccggctggtcagcgcgcccctcccggagtccgtgctgatcgaggaggagctgacggagaaggccagccgcaccaagaagtccgagaaggtgctccagcagttcccccaggagaaggccaacggcctgttcgggcagttcctgaagctcatggtcggcaacaaggccgacttcaagaaggtgttcgggctggaggaggaggccaagatcacctacgccagcgagtcctacgaggaggacctggagggcatcctcgccaaggtgggcgacgagtacagcgacgtcttcctggccgccaagaacgtgtacgacgcggtggagctgtccaccatcctcgccgacagcgacaagaagtcccacgccaagctgagctccagcatgatcgtccggttcacggagcaccaggaggacctgaagaagttcaagcgcttcatccgggagaactgccccgacgagtacgacaacctcttcaagaacgagcagaaggacgggtacgccggctacatcgcccacgcggggaaggtgagccagctgaagttctaccagtacgtgaagaagatcatccaggacatcgccggcgccgagtacttcctggagaagatcgcccaggagaacttcctccgcaagcagcgcaccttcgacaacggcgtcatcccccaccagatccacctggccgagctgcaggcgatcatccaccggcaggccgcctactacccgttcctcaaggagaaccaggagaagatcgagcagctggtgaccttccgcatcccctactacgtggggcccctgtccaagggcgacgccagcaccttcgcgtggctcaagcggcagtccgaggagcccatccgcccgtggaacctgcaggagacggtcgacctggaccagagcgccaccgccttcatcgagcggatgaccaacttcgacacctacctcccctccgagaaggtgctgcccaagcacagcctgctctacgagaagttcatggtcttcaacgagctgacgaagatctcctacaccgacgaccgcgggatcaaggccaacttcagcggcaaggagaaggagaagatcttcgactacctgttcaagacccggcgcaaggtgaagaagaaggacatcatccagttctaccggaacgagtacaacaccgagatcgtgacgctgtccgggctcgaggaggaccagttcaacgccagcttctccacctaccaggacctgctgaagtgcggcctcacccgcgcggagctggaccaccccgacaacgccgagaagctggaggacatcatcaagatcctcaccatcttcgaggaccggcagcgcatccggacgcagctgagcaccttcaagggccagttctccgccgaggtcctgaagaagctcgagcgcaagcactacaccgggtggggccggctgagcaagaagctgatcaacgggatctacgacaaggagtccggcaagaccatcctcgggtacctgatcaaggacgacggcgtgagcaagcactacaaccgcaacttcatgcagctgatcaacgactcccagctcagcttcaagaacgccatccagaaggcccagtccagcgagcacgaggagacgctgagcgagaccgtgaacgagctggcgggctccccggccatcaagaaggggatctaccagagcctcaagatcgtcgacgagctggtggccatcatgggctacgcccccaagcggatcgtggtcgagatggcccgcgagaaccagaccacctccacggggaagcggcgcagcatccagcgcctgaagatcgtggagaaggcgatggccgagatcggctccaacctcctgaaggagcagcccaccaccaacgagcagctgcgggacacccgcctcttcctgtactacatgcagaacgggaaggacatgtacaccggcgacgagctgagcctccaccggctgtcccactacgacatcgaccacatcatcccccagagcttcatgaaggacgactccctggacaacctcgtgctggtcggcagcacggagaaccgcgggaagtccgacgacgtgccgagcaaggaggtggtcaaggacatgaaggcctactgggagaagctgtacgccgcgggcctcatctcccagcggaagttccagcgcctgaccaagggggagcagggcggcctgaccctcgaggacaaggcccacttcatccagcggcagctggtggagacccgccagatcacgaagaacgtggccgggatcctggaccagcggtacaacgccaacagcaaggagaagaaggtccagatcatcaccctcaaggcctccctgaccagccagttccgctccatcttcggcctgtacaaggtgcgggaggtgaacgactaccaccacgggcaggacgcgtacctcaactgcgtcgtggccaccacgctgctgaaggtgtaccccaacctcgcccccgagttcgtctacggcgagtaccccaagttccagaccttcaaggagaacaaggccaccgccaaggcgatcatctacaccaacctgctgcgcttcttcacggaggacgagccgcggttcaccaaggacggggagatcctctggagcaacagctacctgaagaccatcaagaaggagctgaactaccaccagatgaacatcgtgaagaaggtggaggtccagaagggcggcttctccaaggagagcatcaagcccaaggggccctccaacaagctcatccccgtgaagaacggcctggacccgcagaagtacgggggcttcgacagccccatcgtggcctacaccgtcctgttcacgcacgagaaggggaagaagcccctcatcaagcaggagatcctgggcatcaccatcatggagaagacccgcttcgagcagaacccgatcctgttcctcgaggagaagggcttcctgcggccccgcgtgctgatgaagctccccaagtacaccctgtacgagttccccgaggggcggcgccggctgctcgcctccgccaaggaggcccagaagggcaaccagatggtgctgccggagcacctcctgacgctgctgtaccacgcgaagcagtgcctcctgcccaaccagagcgagtccctgacctacgtcgagcagcaccagcccgagttccaggagatcctcgagcgcgtggtggacttcgccgaggtccacaccctggccaagagcaaggtgcagcagatcgtgaagctgttcgaggccaaccagaccgcggacgtcaaggagatcgccgcctccttcatccagctcatgcagttcaacgccatgggggcccccagcacgttcaagttcttccagaaggacatcgagcgggcgcgctacacctccatcaaggagatcttcgacgccaccatcatctaccagagcaccacgggcctgtacgagacccgccggaaggtggtggactga

SEQ ID NO: 1810 - RNA, 4014 nt, synthetic construct
  misc_feature 1..4014: note = Cas9 variant
  source 1..4014: mol_type = other RNA
atgaagaaggactacgtgatcggcctggacatcgggaccaacagcgtcggctgggccgtgatgaccgaggactaccagctcgtgaagaagaagatgcccatctacgggaacacggagaagaagaagatcaagaagaacttctggggcgtccgcctgttcgaggaggggcacaccgccgaggaccggcgcctgaagcggaccgcgcgccggcgcatctcccggcgccggaaccgcctccggtacctgcaggccttcttcgaggaggccatgaccgacctggacgagaacttcttcgcccgcctccaggagagcttcctggtgccggaggacaagaagtggcaccggcaccccatcttcgccaagctggaggacgaggtggcgtaccacgagacgtaccccaccatctaccacctccgcaagaagctggccgactccagcgagcaggccgacctgcggctcatctacctggccctggcgcacatcgtcaagtaccgcggccacttcctcatcgagggcaagctgtccaccgagaacaccagcgtgaaggaccagttccagcagttcatggtgatctacaaccagacgttcgtcaacggggagtcccggctggtgagcgcgcccctcccggagtccgtgctgatcgaggaggagctgaccgagaaggccagccgcaccaagaagtccgagaaggtcctccagcagttcccccaggagaaggccaacggcctgttcgggcagttcctgaagctcatggtgggcaacaaggccgacttcaagaaggtgttcgggctggaggaggaggccaagatcacctacgccagcgagtcctacgaggaggacctggagggcatcctcgccaaggtcggcgacgagtacagcgacgtgttcctggccgccaagaacgtgtacgacgcggtcgagctgtccacgatcctcgccgacagcgacaagaagtcccacgccaagctgagctccagcatgatcgtgcggttcaccgagcaccaggaggacctgaagaagttcaagcgcttcatccgggagaactgccccgacgagtacgacaacctcttcaagaacgagcagaaggacgggtacgccggctacatcgcccacgcggggaaggtgagccagctgaagttctaccagtacgtcaagaagatcatccaggacatcgccggcgccgagtacttcctggagaagatcgcccaggagaacttcctccgcaagcagcgcaccttcgacaacggcgtgatcccccaccagatccacctggccgagctgcaggcgatcatccaccggcaggccgcctactacccgttcctcaaggagaaccaggagaagatcgagcagctggtgaccttccgcatcccctactacgtcgggcccctgtccaagggcgacgccagcacgttcgcgtggctcaagcggcagtccgaggagcccatccgcccgtggaacctgcaggagaccgtggacctggaccagagcgccaccgccttcatcgagcggatgaccaacttcgacacgtacctcccctccgagaaggtcctgcccaagcacagcctgctctacgagaagttcatggtgttcaacgagctgaccaagatctcctacaccgacgaccgcgggatcaaggccaacttcagcggcaaggagaaggagaagatcttcgactacctgttcaagacccggcgcaaggtgaagaagaaggacatcatccagttctaccggaacgagtacaacacggagatcgtcaccctgtccgggctcgaggaggaccagttcaacgccagcttctccacctaccaggacctgctgaagtgcggcctcacccgcgcggagctggaccaccccgacaacgccgagaagctggaggacatcatcaagatcctcacgatcttcgaggaccggcagcgcatccggacccagctgagcaccttcaagggccagttctccgccgaggtgctgaagaagctcgagcgcaagcactacaccgggtggggccggctgagcaagaagctgatcaacgggatctacgacaaggagtccggcaagacgatcctcgactacctgatcaaggacgacggggtgagcaagcactacaaccgcaacttcatgcagctgatcaacgactcccagctcagcttcaagaacgccatccagaaggcccagtcctgcgagcacgaggagaccctgagcgagaccgtcaacgagctggcgggcagcccggccatcaagaagggcatctaccagtccctcaagatcgtggacgagctggtggccatcatggggtacgcccccaagcggatcgtcgtggagatggcccgcgagaaccagaccacgagcaccggcaagcggcgctccatccagcgcctgaagatcgtggagaaggcgatggccgagatcgggagcaacctcctgaaggagcagcccaccaccaacgagcagctgcgggacacccgcctcttcctgtactacatgcagaacggcaaggacatgtacacgggggacgagctgtccctccaccggctgagccactacgacatcgaccacatcatcccccagtccttcatgaaggacgacagcctggacaacctcgtcctggtgggctccaccgagaaccgcggcaagagcgacgacgtgccgtccaagaaggtcgtgaaggacatgaaggcctactgggagaagctgtacgccgcggggctcatcagccagcggaagttccagcgcctgaccaagggcgagcagggcgggctgaccctcgaggacaaggcccacttcatccagcggcagctggtggagacgcgccagatcaccaagaacgtcgccggcatcctggaccagcggtacaacgccaagtccaaggagaagaaggtgcagatcatcaccctcaaggccagcctgacctcccagttccgcagcatcttcgggctgtacaaggtgcgggaggtcaacgactaccaccacggccaggacgcgtacctcaactgcgtggtggccacgaccctgctgaaggtctaccccaacctcgcccccgagttcgtgtacggggagtaccccaagttccaggccttcaaggagaacaaggccaccgcgaagaccatcatctacacgaacctgatgcgcttcttcaccgaggacgagccgcggttcaccaaggactccgagatcctgtggagcaacagctacctcaagaccatcaagaaggagctgaactaccaccagatgaacatcgtgaagaaggtcgaggtgcagaagggcgggttctccaaggagagcatcaagcccaagggcccctccaacaagctgatccccgtgaagaacggcctcgacccgcagaagtacgggggcttcgacagccccgtcgtggcctacacggtgctgttcacccacgagaaggggaagaagcccctgatcaagcaggagatcctcggcatcaccatcatggagaagacccgcttcgagcagaacccgatcctgttcctggaggagaaggggttcctccggccccgcgtcctgatgaagctgcccaagtacacgctctacgagttccccgagggccggcgccggctgctggcctccgccaaggaggcccagaagggcaaccagatggtgctcccggagcacctcctgaccctgctgtaccacgcgaagcagtgcctgctccccaaccagagcgagtccctggcctacgtggagcagcaccagcccgagttccaggagatcctggagcgcgtcgtggacttcgccgaggtgcacaccctcgccaagagcaaggtccagcagatcgtgaagctgttcgaggcgaaccagaccgccgacgtgaaggagatcgccgcctccttcatccagctgatgcagttcaacgccatgggggcgcccagcacgttcaagttcttccagaaggacatcgagcgggcccgctacacctccatcaaggagatcttcgacgccaccatcatctaccagagcaccacgggcctctacgagacccgccggaaggtcgtggactga

SEQ ID NO: 1811 - RNA, 4014 nt, synthetic construct
  misc_feature 1..4014: note = Cas9 variant
  source 1..4014: mol_type = other RNA
atgaagaaggactacgtgatcggcctggacatcgggaccaacagcgtcggctgggccgtgatgaccgaggactaccagctcgtgaagaagaagatgcccatctacgggaacacggagaagaagaagatcaagaagaacttctggggcgtccgcctgttcgaggaggggcacaccgccgaggaccggcgcctgaagcggaccgcgcgccggcgcatctcccggcgccggaaccgcctccggtacctgcaggccttcttcgaggaggccatgaccgccctggacgagaacttcttcgcccgcctccaggagagcttcctggtgccggaggacaagaagtggcaccggcaccccatcttcgcgaagctggaggacgaggtggcctaccacgagacgtaccccaccatctaccacctccgcaagaagctggccgactccagcgagcaggccgacctgcggctcatctacctggcgctggcccacatcgtcaagtaccgcggccacttcctcatcgagggcaagctgtccaccgagaacatcagcgtgaaggagcagttccagcagttcatgatcatctacaaccagaccttcgtgaacggggagtcccggctggtcagcgcgcccctcccggagtccgtgctgatcgaggaggagctgacggagaaggccagccgcaccaagaagtccgagaaggtgctccagcagttcccccaggagaaggccaacggcctgttcgggcagttcctgaagctcatggtcggcaacaaggccgacttcaagaaggtgttcgggctggaggaggaggccaagatcacctacgccagcgagtcctacgaggaggacctggagggcatcctcgccaaggtgggcgacgagtacagcgacgtcttcctggccgcgaagaacgtgtacgacgccgtggagctgtccaccatcctcgccgacagcgacaagaagtcccacgccaagctgagctccagcatgatcgtccggttcacggagcaccaggaggacctgaagaacttcaagcgcttcatccgggagaactgccccgacgagtacgacaacctcttcaagaacgagcagaaggacgggtacgccggctacatcacccacgcggggaaggtgagccagctgaagttctaccagtacgtgaagaagatcatccaggacatcgccggcgccgagtacttcctggagaagatcgcccaggagaacttcctccgcaagcagcgcaccttcgacaacggcgtcatcccccaccagatccacctggccgagctgcaggcgatcatccaccggcaggccgcctactacccgttcctcaaggagaaccaggagaagatcgagcagctggtgaccttccgcatcccctactacgtggggcccctgtccaagggcgacgccaacacgttcgcgtggctcaagcggcagagcgaggagcccatccgcccgtggaacctgcaggagaccgtcgacctggaccagtccgccaccgccttcatcgagcggatgaccaacttcgacacgtacctccccagcgagaaggtgctgcccaagcactccctgctctacgagaagttcatggtcttcaacgagctgaccaagatcagctacaccgacgaccgcgggatcaaggccaacttctccggcaaggagaaggagaagatcttcgactacctgttcaagacccggcgcaaggtgaagaagaaggacatcatccagttctaccggaacgagtacaacacggagatcgtgaccctgagcgggctcgaggaggaccagttcaacgcctccttcagcacctaccaggacctgctgaagtgcggcctcacccgcgcggagctggaccaccccgacaacgccgagaagctggaggacatcatcaagatcctcacgatcttcgaggaccggcagcgcatccggacccagctgtccaccttcaagggccagttcagcgccgaggtcctgaagaagctcgagcgcaagcactacaccgggtggggccggctgtccaagaagctgatcaacgggatctacgacaaggagagcggcaagacgatcctcgactacctgatcaaggacgacggggtgtccaagcactacaaccgcaacttcatgcagctgatcaacgacagccagctctccttcaagaacgccatccagaaggcccagagctccgagcacgaggagaccctgagcgagaccgtgaacgagctggcgggcagcccggccatcaagaagggcatctaccagtccctcaagatcgtcgacgagctggtggccatcatggggtacgcccccaagcggatcgtggtcgagatggcccgcgagaaccagaccacgagcaccggcaagcggcgctccatccagcgcctgaagatcgtggagaaggcgatggccgagatcgggagcaacctcctgaaggagcagcccaccaccaacgagcagctgcgggacacccgcctcttcctgtactacatgcagaacggcaaggacatgtacacgggggacgagctgtccctccaccggctgagccactacgacatcgaccacatcatcccccagtccttcatgaaggacgacagcctggacaacctcgtgctggtcggctccaccgagaaccgcggcaagagcgacgacgtgccgtccaaggaggtggtcaaggacatgaaggcctactgggagaagctgtacgccgcggggctcatcagccagcggaagttccagcgcctgaccaagggcgagcagggcgggctgaccctcgaggacaaggcccacttcatccagcggcagctggtggagacgcgccagatcaccaagaacgtggccggcatcctggaccagcggtacaacgccaagtccaaggagaagaaggtccagatcatcaccctcaaggccagcctgacctcccagttccgcagcatcttcgggctgtacaaggtgcgggaggtgaacgactaccaccacggccaggacgcgtacctcaactgcgtcgtggccacgaccctgctgaaggtgtaccccaacctcgcccccgagttcgtctacggggagtaccccaagttccagaccttcaaggagaacaaggccaccgccaaggcgatcatctacacgaacctgctgcgcttcttcaccgaggacgagccgcggttcaccaaggacggcgagatcctctggtccaacagctacctgaagaccatcaagaaggagctgaactaccaccagatgaacatcgtgaagaaggtggaggtccagaagggcgggttcagcaaggagtccatcaagcccaagggccccagcaacaagctcatccccgtgaagaacgggctggacccgcagaagtacggcgggttcgactcccccatcgtggcctacacggtcctgttcacccacgagaagggcaagaagcccctcatcaagcaggagatcctggggatcaccatcatggagaagacccgcttcgagcagaacccgatcctgttcctcgaggagaagggcttcctgcggccccgcgtgctgatgaagctccccaagtacacgctgtaccagttccccgagggccggcgccggctgctcgccagcgccaaggaggcccagaaggggaaccagatggtgctgccggagcacctcctgaccctgctgtaccacgcgaagcagtgcctcctgcccaaccagtccgagagcctggcctacgtcgagcagcaccagcccgagttccaggagatcctcgagcgcgtggtggacttcgccgaggtccacaccctggccaagtccaaggtgcagcagatcgtgaagctgttcgaggcgaaccagaccgccgacgtcaaggagatcgccgccagcttcatccagctcatgcagttcaacgccatgggcgcgccctccacgttcaagttcttccagaaggacatcgagcgggcccgctacaccagcatcaaggagatcttcgacgccaccatcatctaccagtccaccacggggctgtacgagacccgccggaaggtggtggactga

SEQ ID NO: 1812 - RNA, 4014 nt, synthetic construct
  misc_feature 1..4014: note = Cas9 variant
  source 1..4014: mol_type = other RNA
atgaagaaggactacgtgatcggcctggacatcgggaccaacagcgtcggctgggccgtgatgaccgaggactaccagctcgtgaagaagaagatgcccatctacgggaacacggagaagaagaagatcaagaagaacttctggggcgtccgcctgttcgaggaggggcacaccgccgaggaccggcgcctgaagcggaccgcgcgccggcgcatctcccggcgccggaaccgcctccggtacctgcaggccttcttcgaggaggccatgaccgacctggacgagaacttcttcgcccgcctccaggagagcttcctggtgccggaggacaagaagtggcaccggcaccccatcttcgccaagctggaggacgaggtggcgtaccacgagacgtaccccaccatctaccacctccgcaagaagctggccgactccagcgagcaggccgacctgcggctcatctacctggccctggcgcacatcgtcaagtaccgcggccacttcctcatcgagggcaagctgtccaccgagaacatcagcgtgaaggagcagttccagcagttcatgatcatctacaaccagaccttcgtgaacggggagtcccggctggtcagcgcgcccctcccggagtccgtgctgatcgaggaggagctgacggagaaggccagccgcaccaagaagtccgagaaggtgctccagcagttcccccaggagaaggccaacggcctgttcgggcagttcctgaagctcatggtcggcaacaaggccgacttcaagaaggtgttcgggctggaggaggaggccaagatcacctacgccagcgagtcctacgaggaggacctggagggcatcctcgccaaggtgggcgacgagtacagcgacgtcttcctggccgccaagaacgtgtacgacgcggtggagctgtccaccatcctcgccgacagcgacaagaagtcccacgccaagctgagctccagcatgatcgtccggttcacggagcaccaggaggacctgaagaagttcaagcgcttcatccgggagaactgccccgacgagtacgacaacctcttcaagaacgagcagaaggacgggtacgccggctacatcgcccacgcggggaaggtgagccagctgaagttctaccagtacgtgaagaagatcatccaggacatcgccggcgccgagtacttcctggagaagatcgcccaggagaacttcctccgcaagcagcgcaccttcgacaacggcgtcatcccccaccagatccacctggccgagctgcaggcgatcatccaccggcaggccgcctactacccgttcctcaaggagaaccaggagaagatcgagcagctggtgaccttccgcatcccctactacgtggggcccctgtccaagggcgacgccagcaccttcgcgtggctcaagcggcagtccgaggagcccatccgcccgtggaacctgcaggagacggtcgacctggaccagagcgccaccgccttcatcgagcggatgaccaacttcgacacctacctcccctccgagaaggtgctgcccaagcacagcctgctctacgagaagttcatggtcttcaacgagctgacgaagatctcctacaccgacgaccgcgggatcaaggccaacttcagcggcaaggagaaggagaagatcttcgactacctgttcaagacccggcgcaaggtgaagaagaaggacatcatccagttctaccggaacgagtacaacaccgagatcgtgacgctgtccgggctcgaggaggaccagttcaacgccagcttctccacctaccaggacctgctgaagtgcggcctcacccgcgcggagctggaccaccccgacaacgccgagaagctggaggacatcatcaagatcctcaccatcttcgaggaccggcagcgcatccggacgcagctgagcaccttcaagggccagttctccgccgaggtcctgaagaagctcgagcgcaagcactacaccgggtggggccggctgagcaagaagctgatcaacgggatctacgacaaggagtccggcaagaccatcctcgggtacctgatcaaggacgacggcgtgagcaagcactacaaccgcaacttcatgcagctgatcaacgactcccagctcagcttcaagaacgccatccagaaggcccagtccagcgagcacgaggagacgctgagcgagaccgtgaacgagctggcgggctccccggccatcaagaaggggatctaccagagcctcaagatcgtcgacgagctggtggccatcatgggctacgcccccaagcggatcgtggtcgagatggcccgcgagaaccagaccacctccacggggaagcggcgcagcatccagcgcctgaagatcgtggagaaggcgatggccgagatcggctccaacctcctgaaggagcagcccaccaccaacgagcagctgcgggacacccgcctcttcctgtactacatgcagaacgggaaggacatgtacaccggcgacgagctgagcctccaccggctgtcccactacgacatcgaccacatcatcccccagagcttcatgaaggacgactccctggacaacctcgtgctggtcggcagcacggagaaccgcgggaagtccgacgacgtgccgagcaaggaggtggtcaaggacatgaaggcctactgggagaagctgtacgccgcgggcctcatctcccagcggaagttccagcgcctgaccaagggggagcagggcggcctgaccctcgaggacaaggcccacttcatccagcggcagctggtggagacccgccagatcacgaagaacgtggccgggatcctggaccagcggtacaacgccaacagcaaggagaagaaggtccagatcatcaccctcaaggcctccctgaccagccagttccgctccatcttcggcctgtacaaggtgcgggaggtgaacgactaccaccacgggcaggacgcgtacctcaactgcgtcgtggccaccacgctgctgaaggtgtaccccaacctcgcccccgagttcgtctacggcgagtaccccaagttccagaccttcaaggagaacaaggccaccgccaaggcgatcatctacaccaacctgctgcgcttcttcacggaggacgagccgcggttcaccaaggacggggagatcctctggagcaacagctacctgaagaccatcaagaaggagctgaactaccaccagatgaacatcgtgaagaaggtggaggtccagaagggcggcttctccaaggagagcatcaagcccaaggggccctccaacaagctcatccccgtgaagaacggcctggacccgcagaagtacgggggcttcgacagccccatcgtggcctacaccgtcctgttcacgcacgagaaggggaagaagcccctcatcaagcaggagatcctgggcatcaccatcatggagaagacccgcttcgagcagaacccgatcctgttcctcgaggagaagggcttcctgcggccccgcgtgctgatgaagctccccaagtacaccctgtacgagttccccgaggggcggcgccggctgctcgcctccgccaaggaggcccagaagggcaaccagatggtgctgccggagcacctcctgacgctgctgtaccacgcgaagcagtgcctcctgcccaaccagagcgagtccctggcctacgtcgagcagcaccagcccgagttccaggagatcctcgagcgcgtggtggacttcgccgaggtccacaccctggccaagagcaaggtgcagcagatcgtgaagctgttcgaggcgaaccagaccgccgacgtcaaggagatcgccgcctccttcatccagctcatgcagttcaacgccatgggggcgcccagcaccttcaagttcttccagaaggacatcgagcgggcccgctacacgtccatcaaggagatcttcgacgccaccatcatctaccagagcaccaccggcctgtacgagacgcgccggaaggtggtggactga

SEQ ID NO: 1813 - RNA, 4017 nt, synthetic construct
  misc_feature 1..4017: note = Cas9 variant
  source 1..4017: mol_type = other RNA
atgcaggactactacctgggcctcgacatcgggaccaacagcgtgggctgggccgtcaccgacgagaactacaacctgctgcgcaagaaggggaaggacctctggggcgtgcggctgttcaaggaggcccagcccgcgacggagcgccgggggcaccgctccagccggcgccggaccatccgcaagtccctgcggaagcagctcctgcgcgagctgttcgaggaggagatcaacgccatcgacaaggacttcttcctccggctggacgagagcaagtactggctggaggacaagaagatcgagggcaagtactccctcttcaacgacgagaacttcaccgacaaggactactacgagaagttcccgaccatcttccacctccgcaaggccctgatcgagagcgacgacaaggaggacatccggctctacttcctggccatcaaccagatgatgaagcgccggggccacttcctgatcgacgggaagctctccaacgtggaggacatcacgcccttcaaggagtgcatccagaacctgatcaacgaggagctggacaccgagatcgagaccgagttctacgacaaggccatcaagatcgtcagcgactactccctcaagaagaccgagaagaagaacctgatcaaggacctggtgaaggagacggacagcatcgaggactccaagaagatcatcaacatcttcaacctcctgatcagcggcaagtccaaggtgaacgggatcttcgacgacgaggagatcctggagaagatcaaggaggacaacaaggaggacttctacctcaccagcgagaagtacgaggagaacctggagtacttctcccagctgctcgactaccgcttcgagctgatcagctccctcaagagcatctacgactacatcatcctgcaggaggtcctgaagggcaagaagtacctgtcctacgcccaggtggagcggtacaagaaccacaaggaggacctccgcaagctgaagcagctgatcaagaagtacgacaagaacgggaagatctactaccagatcttccgggacgagaacttcaagaagggctacgtggcgtacctcggctactacaagaagaacaagaagaacgtccccgtgaagaagtgcgactacgacaccttcagcaagaacatcaagagcaccctggacaagatctgcgacaaggaggaccccctgtacatcgagctcatcgacaagatcgagaagggcgggttcctgctgaagcagatcgtgtccacgaacagcgtcatcccgcaccaggtgcacgagctcgagctggacaagatcctggagaacctcgagaagaactacccctccttcaaggagatcagcgacggggtgtccaagatcgacaagatcaagatgatcttcaacttccgcatcccctactacgtcggccccctgaacgactaccacaaggacaaggtgaacagcaacacctggatcgtgaagaacgagggcttcgagaacgagaacatccggccgtggaacttctccaagatcgtcgacgagcacgcctgcgaggaggagttcatcaagcgcatgatcaacgagtgcagctacatccccggggagaaggtgctgcccaagtccagcctgctctactccgagtacatggtgctgaacgagctgaacaacctccgcgtcaacggcgacaagctgaaccccaagatcaagaaggagatcgtggagaacatctacaagaaggagcggaaggtgaccctgaagaagatccgcaacttcctcatcatcaacaactacgtcgacagcaaggtggagttctccgggctgagcgacggcatcaaggccaacatgtccagctacatcgacttcgcggagatcctggacgacaacttcgacaacaacatggtcgaggacctcatcgagcagatcaccatccacgtggggaacgtgaagctgctgacggagaagatctccaacaagtacccgaacctcgagaagaagcagatcaacaagatcgtcaacctgaagttcaaggactgggcccggttcagccgcaagctgctcgtgggcatcgagggcaccgagaaggagaccggggagatcaacaccatcatcggcttcctgcgggagacgaacgagaacttcatggagctgatgtccaaccgctacaccttcagcgaggagatcagcgagatcaagaagaagtacatccccaacaagctctccaagcagatcgtggacgacctgtacgtcagccccgccgtgaagaagatgatctggcaggtcctgaacatcaacgacgagctcatcaaggtgctggggaagcagcccaagaagatcttcatcgagatggcccggggcaaggaggagaagccggaggtgaaggactcccgcaagaacaagctgatcgagctctacaagaacctggggaaggagggcaaggagtggctgaaccggatcgaggacaagaccgaggccgacttccgcaaccgggcgctctacctgtactacacccagatgggccgctgcatgtacacgggggagatcatcgacatcgagcggctgtacgacaaggagctctacgacctggaccacatcatcccccgcaagatgaagaaggacgacagcatccacaagaacctggtgctcgtcacccggaactccaaccagtacgagaagaaggacaactaccccgtgcccgaggtgatcaagagccgcgagaacgtccggcacctgtggtacgccctgaagaagaagggcctcatcaccgaggagaagtacaaccgcctgacccggatcaacccgctgtccgacaaggagctcagcgagttcatcgagcgccagctggtggagacgcgccagaccaccaaggtggtcaaggacctgttcgagaactactacaccgactccaagatcgtgacggtgaaggccgggctcgtcagcgagctgcggcgcgacttcgaggtgctgaagtgccgggagatcaacgacctcaaccacgcccacgacgccttcctgaacatcatcgtgggcgacgtctggtccaagaagttcaccagcaacccctacaacttcgtgaagaagaaccgcgagaagtacaccctgaacaacatcttcaccaagaaccagaaggacctccgggggaacgagatctggaactgcgcggagggcaagaagcgcatcatcaagacgctgaacaagccctccgtgctgttcagcgtcgagaacttcgagcagaccggccagctgttcgaccagaacatcatcgggaagcaggactacaaggagaagacctcctacgtgcccatcaagggcgacgagcggctgcaggacatcagcaagtacgggggctaccgcggcatctccggggcctacttcttcatcgtggagcacaccgagaagaacaagcgggtcaagaccatcgagagcctgccgatctacatgaagtcctacgtggaggagaacggcctcctggacttctgcacgaacgagatgaagctggtggaccccaagatcatcgtcaagaagctcaactacaagagcgagatcatcgtggacgggttcaagtacctgatcagcggcaagaccgagaaccgcctgtccctcgagaccaacgagtacctgtactggaaccacacccagacgaccgacatcaagaagatcctgaacatcaacgagaagatcgagctcgagaagtacaacggggacatcgagagcgagcgggagaacatcatcaagtacatccagatcatcctggagaagttcaagctgaagcccttcatcaagcgccggaacctccccaacatcgagatcaacttcgccgactacgagaccgagaagctgctgcagctcctggtgaacctgatcccgctcaccacgaagtacgtctcccccgtggacctgaccgtgatcagcggctccaagtacgccggcaaggtcctgatccccaagaagatcagcaacctcaacgaggtgatcttcatctccaagagcatcaccgggatctacgagtcccgccggcgcatcatctga

SEQ ID NO: 1814 - RNA, 4017 nt, synthetic construct
  misc_feature 1..4017: note = Cas9 variant
  source 1..4017: mol_type = other RNA
atgaagcaggagtacttcctgggcctcgacatggggaccggcagcctggggtgggccgtgaccgactccacgtaccaggtcatgcgcaagcacggcaaggccctgtgggggacccggctgttcgagagcgcgtccaccgccgaggagcgccggatgttccgcaccgcccggcgccggctggaccgccggaactggcgcatccaggtgctgcaggagatcttcagcgaggagatctccaaggtggaccccggcttcttcctccggatgaaggagagcaagtactacccggaggacaagcgcgacgccgagggcaactgccccgagctgccctacgccctgttcgtcgacgacaactacacggacaagaactaccacaaggactaccccaccatctaccacctccggaagatgctgatggagaccaccgagatcccggacatccgcctggtgtacctcgtgctgcaccacatgatgaagcaccgggggcacttcctgctctccggcgacatcagccagatcaaggagttcaagtccacgttcgagcagctgatccagaacatccaggacgaggagctggagtggcacatcagcctcgacgacgcggccatccagttcgtcgagcacgtgctgaaggaccgcaacctgacccggtccaccaagaagtcccgcctcatcaagcagctgaacgccaagagcgcctgcgagaaggcgatcctgaacctcctgagcgggggcaccgtgaagctgtccgacatcttcaacaacaaggagctcgacgagagcgagcggcccaaggtctccttcgccgacagcgggtacgacgactacatcggcatcgtggaggccgagctggccgagcagtactacatcatcgcctccgcgaaggccgtgtacgactggagcgtcctggtggagatcctcggcaacagcgtgtccatcagcgaggccaagatcaaggtctaccagaagcaccaggccgacctgaagacgctgaagaagatcgtgcgccagtacatgaccaaggaggactacaagcgggtgttcgtcgacaccgaggagaagctcaacaactactccgcctacatcgggatgaccaagaagaacggcaagaaggtggacctcaagagcaagcagtgcacgcaggcggacttctacgacttcctgaagaagaacgtgatcaaggtcatcgaccacaaggagatcacccaggagatcgagtccgagatcgagaaggagaacttcctccccaagcaggtcaccaaggacaacggggtgatcccctaccaggtgcacgactacgagctgaagaagatcctggacaacctcggcacccgcatgccgttcatcaaggagaacgccgagaagatccagcagctgttcgagttccgcatcccctactacgtgggccccctgaaccgggtcgacgacgggaaggacggcaagttcacgtggagcgtgcgcaagtccgacgcccggatctacccctggaacttcaccgaggtgatcgacgtcgaggccagcgccgagaagttcatccgccggatgaccaacaagtgcacctacctcgtgggggaggacgtgctgccgaaggactccctggtctacagcaagttcatggtgctcaacgagctgaacaacctgcgcctcaacggcgagaagatctccgtggagctgaagcagcggatctacgaggagctgttctgcaagtaccgcaaggtcacgcggaagaagctggagcgctacctcgtgatcgaggggatcgcgaagaagggcgtggagatcaccggcatcgacggggacttcaaggccagcctgaccgcctaccacgacttcaaggagcggctgaccgacgtccagctctcccagcgcgccaaggaggccatcgtgctgaacgtggtcctgttcggcgacgacaagaagctcctgaagcagcggctgagcaagatgtaccccaacctcacgaccgggcagctgaagggcatctgctccctgagctaccaggggtggggccgcctctccaagaccttcctggaggagatcaccgtgcccgcgcccggcacgggggaggtgtggaacatcatgaccgccctgtggcagaccaacgacaacctcatgcagctgctgagccggaactacggcttcaccaacgaggtcgaggagttcaacacgctcaagaaggagaccgacctgtcctacaagaccgtggacgagctgtacgtgagcccggccgtcaagcgccagatctggcagaccctcaaggtggtgaaggagatccagaaggtcatggggaacgcccccaagcgggtgttcgtggagatggcgcgcgagaagcaggagggcaagcggagcgactcccgcaagaagcagctggtcgagctgtaccgcgcctgcaagaacgaggagcgggactggatcaccgagctcaacgcccagagcgaccagcagctgcgctccgacaagctgttcctctactacatccagaaggggcggtgcatgtacagcggcgagacgatccagctggacgagctgtgggacaacaccaagtacgacatcgaccacatctacccccagtccaagaccatggacgacagcctcaacaaccgcgtgctggtgaagaagaactacaacgccatcaagtccgacacctaccccctgagcctcgacatccagaagaagatgatgtccttctggaagatgctgcagcagcagggcttcatcacgaaggagaagtacgtccggctggtgcgcagcgacgagctctccgccgacgagctggcggggttcatcgagcggcagatcgtggagacccgccagagcaccaaggccgtcgccaccatcctgaaggaggccctcccggacacggagatcgtgtacgtgaaggccggcaacgtctccaacttccggcagacctacgagctgctgaaggtgcgcgagatgaacgacctccaccacgcgaaggacgcctacctgaacatcgtggtcgggaacgcctacttcgtgaagttcaccaagaacgccgcctggttcatccggaacaaccccggccgcagctacaacctgaagcggatgttcgagttcgacatcgagcgctccggcgagatcgcgtggaaggccgggaacaagggcagcatcgtgaccgtcaagaaggtgatgcagaagaacaacatcctcgtgacgcggaaggcctacgaggtcaagggcgggctgttcgaccagcagatcatgaagaaggggaagggccaggtgcccatcaagggcaacgacgagcgcctggccgacatcgagaagtacgggggctacaacaaggcggccgggacctacttcatgctcgtgaagtccctggacaagaagggcaaggagatccggaccatcgagttcgtccccctgtacctcaagaaccagatcgagatcaaccacgagagcgccatccagtacctggcccaggagcgcgggctgaacagcccggagatcctcctgtccaagatcaagatcgacaccctgttcaaggtggacggcttcaagatgtggctcagcggccggacggggaaccagctgatcttcaagggcgccaaccagctgatcctctcccaccaggaggcggccatcctgaagggggtggtcaagtacgtgaaccgcaagaacgagaacaaggacgccaagctgagcgagcgggacggcatgaccgaggagaagctcctgcagctgtacgacaccttcctcgacaagctgtccaacaccgtctacagcatccgcctgtccgcccagatcaagacgctcaccgagaagcgcgccaagttcatcgggctgagcaacgaggaccagtgcatcgtgctgaacgagatcctccacatgttccagtgccagtccggcagcgcgaacctgaagctgatcggcgggcccggctccgccgggatcctcgtgatgaacaacaacatcaccgcctgcaagcagatcagcgtcatcaaccagtcccccaccggcatctacgagaaggagatcgacctgatcaagctgtga

SEQ ID NO: 1815 - RNA, 4017 nt, synthetic construct
  misc_feature 1..4017: note = Cas9 variant
  source 1..4017: mol_type = other RNA
atgaccaagccctacagcatcggcctggacatcgggaccaactccgtgggctgggccgtcgtgacggacgggtacaaggtgccggccaagaagatgaaggtcctcggcaacaccgacaagagccacatcaagaagaacctgctgggggcgctcctgttcgactccggcaacaccgccaaggaccgccggctgaagcgcaccgcccggcgccggtacacgcgccggcgcaaccggatcctctacctgcaggagatcttcgccgaggagatggccaaggcggacgagagcttcttccagcgcctgaacgagtccttcctcaccaacgacgacaaggagttcgacagccaccccatcttcggcaacaaggccgaggaggaggcccaccaccacaagttccccaccatcttccacctccggaagcacctggccgactccaccgagaagtccgacctgcgcctgatctacctggcgctcgcccacatgatcaagttccgggggcacttcctgatcgagggccagctgaaggccgagaacacgaacgtgcagaccctcttcgacgacttcgtggaggtctacgacaagaccgtggaggagagccacctgagcgagatctccgtgagctccatcctgaccgagaagatcagcaagtcccgccggctcgagaacctgatcaagtactaccccacggagaagaagaacaccctgttcgggaacctcatcgccctgagcctgggcctccagccgaacttcaagaccaacttcaagctgtccgaggacgccaagctgcagttcagcaaggacacctacgaggaggacctcggggagctgctgggcaagatcggcgacaactacgcggacctcttcatctccgccaagaacctgtacgacgccatcctgctcagcgggatcctgacgatcgacgacaacaccaccaaggcgcccctgagcgcctccatgatcaagcgctacgaggagcaccaggaggacctcgcccagctgaagaagttcatccggcagaacctgcccgaccagtacagcgaggtcttctccgacaagaccaaggacggctacgccgggtacatcgacggcaagacgaaccaggaggccttctacaagtacatcaagaacatgctcagcaagaccgagggcgccgactacttcctggacaagatcgaccgcgaggacttcctgcggaagcagcgcaccttcgacaacgggtccgtgccccaccagatccacctccaggagatgcacgccatcctgcggcgccagggcgagtactacccgttcctgaaggagaaccaggacaagatcgagaagatcctcaccttccgcatcccctactacgtggggcccctggcgcggaagggcagccgcttcgcctgggccgagtacaaggccgacaagaaggtcacgccctggaacttcgacgacatcctggacaaggagaagtccgccgaggagttcatcacccggatgaccctgaacgacctctacctgccggaggagaaggtgctgcccaagcacagcctcgtgtacgagaccttcaacgtctacaacgagctgacgaaggtgaagtacgtgaacgagcaggggaaggcgatcttcttcgacgccaacatgaagcaggagatcttcgaccacgtcttcaaggagaaccgcaaggtgaccaaggacaagctgctcaactacctgaacaaggagttcgaggagttccggatcgtgaacctgaccggcctcgacaaggagaacaaggccttcaactccagcctgggcacctaccacgacctgcgcaagatcctcgacaagtccttcctggacgacaaggtcaacgagaagatcatcgaggacatcatccagacgctgaccctcttcgaggaccgggagatgatccgccagcggctgcagaagtacagcgacatcttcaccacccagcagctgaagaagctcgagcgccggcactacacggggtggggccgcctgtccgccaagctgatcaacgggatccgggacaagcagagcaacaagaccatcctcggctacctgatcgacgacgggtactccaaccgcaacttcatgcagctgatcaacgacgacagcctccccttcaaggaggagatcgcgcgggcccaggtgatcggcgagaccgacgacctgaaccagctggtgtccgacatcgccggcagccccgccatcaagaaggggatcctccagtccctgaagatcgtcgacgagctggtgaaggtcatgggccacaacccggccaacatcgtgatcgagatggcgcgcgagaaccagaccaccgccaaggggcggcgcagcagccagcagcggtacaagcgcctcgaggaggccatcaagaacctggaccacgacctgaaccacaagatcctcaaggagcaccccacggacaaccaggccctgcagaacgaccgcctgttcctctactacctgcagaacggccgggacatgtacaccgaggaccccctggacatcaaccgcctctccgactacgacatcgaccacatcatcccccagagcttcatcaaggacgactccatcgacaacaaggtgctggtcagctccgccaagaaccggggcaagagcgacaacgtgccgtccgaggacgtggtcaaccgcatgcggcccttctggaacaagctgctcagctgcgggctgatctcccagcgcaagtacagcaacctgaccaagaaggagctcaagcccgacgacaaggcgggcttcatcaagcggcagctggtggagacccgccagatcacgaagcacgtggcccagatcctggacgcccggttcaacaccaagcgcgacgagaacaagaaggtcatccgggacgtgaagatcatcaccctcaagtccaacctggtgagccagttccgcaaggacttcaagttctacaaggtccgggagatcaacgactaccaccacgcccacgacgcctacctgaacgcggtgatcgggaaggccctcctggacgtgtacccccagctggagccggagttcgtctacggcgagtacccccacttccacgggtacaaggagaacaaggccaccgccaagaagttcttctactccaacatcatgaacttcttcaagaaggacgacatccgcacggacgagaacggcgagatcgtgtggaagaaggacgagcacatcagcaacatcaagcgggtgctctcctacccccaggtcaacatcgtgaagaaggtggagatccagaccgtcggccagaacgggggcctgttcgacgacaaccccaagagcccgctggaggtgaccccctccaagctcgtgcccctgaagaaggagctgaacccgaagaagtacgggggctaccagaagcccaccacggcgtaccccgtcctcctgatcaccgacaccaagcagctgatccccatcagcgtgatgaacaagaagcagttcgagcagaacccggtgaagttcctccgcgaccgggggtaccagcaggtcggcaagaacgacttcatcaagctgcccaagtacaccctggtggacatcggcgacgggatcaagcgcctctgggccagctccaaggagatccacaagggcaaccagctggtggtcagcaagaagtcccagatcctgctctaccacgcccaccacctggacagcgacctgtccaacgactacctccagaaccacaaccagcagttcgacgtgctgttcaacgagatcatcagcttctccaagaagtgcaagctggggaaggagcacatccagaagatcgagaacgtgtacagcaacaagaagaactccgccagcatcgaggagctcgccgagtccttcatcaagctgctgggcttcacgcagctcggggcgaccagccccttcaacttcctgggcgtcaagctgaaccagaagcagtacaagggcaagaaggactacatcctcccctgcaccgaggggaccctgatccggcagtccatcacgggcctgtacgagacccgcgtggacctcagcaagatcggggaggactga

SEQ ID NO: 1816 - RNA, 4017 nt, synthetic construct
  misc_feature 1..4017: note = Cas9 variant
  source 1..4017: mol_type = other RNA
atgcgcgactactacatcggcctggacctcgggaccggcagcctggggtgggccgtgaccgaccgggagtacgagatcatgcgcgcccacggcaaggcgctgtggggcgtccggctgttcgactccgccaacacggccgaggagcgccgggggttccgcaccgcccggcgccggctggaccgccggaactggcgcatcgagctgctccaggagctgttcggcgaggacatcgggaaggtggacagcggcttcttcctgcggatgaaggagtccaagtacatgcccgaggacaagcgcgacgtgaacgggaactgcccgaagctcccctacgccctgttcgtcgaggacggctacaccgacaaggactaccaccggcagttccccaccatctaccacctccgcaagtggctcatggagacggaggagacccccgacatccggctggtgtacctggcgctccaccacatgatgaagcaccgcgggcacttcctgttcagcggcaacatcgagaagatcaaggagttccaggagaccttccggcagtacatcggcaagatccgcgaggaggagctggacttccacctctgcatcgagggggaggagctgcgggagaccgagaacatcctgaaggacaagaacctcacgcgctccgccaagaagacccgcctgatcaagctgctcggcgcccacaccgcctgcgagaaggcggccctgaacctggtggccgggggcaccgtcaagctcagcgacatcttcggcaactccgagctggacgcctgcgagaagccgaagctgagcttcgccgacgcggggtacgacgactacgccggcatgatcgaggacgagctcggggagcagcacgtgatcatcgagacggccaaggccgtgtacgactggtccgtcctggccgacatcctgggcgactaccggtgcatcagcgaggcgaaggccgccgtgtacgagaagcaccagaaggacctccgccacctgaaggagctggtgaaggagaacctcgggcgggacgtctacaaggaggtgttcgtgaagaccaacgagaagctgcccaactactccgcctacatcggcatgaccaagaagaacggcgtcaagagcgagatggaggggaagcgctgcgaccggaaggccttctacgactacctgaagaagaccgtggtgaacgcgatccccgacgagtccaagacggagtacctccgcaaggagatggagaccgagaccttcctgccccggcaggtcaccaaggacaacggcgtgatcccgcaccaggtgcacctccaggagctggacgccatcctggagaacctgagcgggcgcatccccgccctcaaggagaacggctccaagatccgggacatcttcacgttccgcatcccctactacgtcgggcccctgaacggcatcgtgaagggcggggagcggaccaactgggtgcgccggaagaaggccggccgcatctgcccgtggaacttcgacgagatggtcgacaccggggccagcgcggaggagttcatccggcgcatgacctccaagtgcacgtacctgatccacgaggacgtgctccccaagaacagcatgctgtactccaagttcatggtcctgaacgagctgaacaacgtgcggctcaacggcgagcccatcagcgtggagctgaagcagaagacctacgaggacctgttccagcgccaccggaaggtcacccgccgccggctcaccgactacatccgccgggaggggatcgccggccgcgacgccgacatcacgggcatcgacggggacttcaagggcagcctgaccgcctaccacgacttcaaggagaagctgaccgggtgcgagctctcccaggcggacaaggagaacatcatcctgaacatcaccctgttcggcgaggacaaggccctcctgaagaagcggctgggcgccctctaccccgccctgacggagccgcagaagaaggccatctgcgcgctgagctacaaggggtggggccgcctctcccagcggctgctggaggggatcaccgcccccgcccccgagaccggcgagatctggaccgtgatccgcgccatgtgggagacgaacgacaacctcatgcaggtcctgagcgagaagtactgcttcgccgcggccatcgacgaggagaacgccggggaggagctgaaggagatcacctacaagaccgtggagcagatgaacgtgtcccccgccgtgcggcgccagatctggcagagcctccaggtcatcaaggagatctgcaaggtgatgggcggcccgcccaagcgggtgttcgtcgagatggcccgcgagaagatggagtccaagcggaccgagagccgcaagaagcggctgatcgacctgtacaagaagtgccgcgaggaggagcgggactggatcgaggagctcgggaacaccgaggagacgcgcctgcggtccgacaagctgtacctctactacacccagaagggccgctgcatgtacagcggggaggtgatcgagctggaggagctgtgggacaaccggaagtacgacatcgaccacatctacccccagtccaaggtgatggacgacagcctcgacaaccgcgtcctggtgaagaaggagtacaacgcggacaagaccgacgagtaccccatccgcgccgacatccggggcaagatgcgcgccttctggcggatcctgcgcgaggaggggttcatctccaaggagaagtacaaccggctcacccgcggcacgggcttcgagccgagcgagctggccgggttcatcgcgcggcagctggtggagacccgccagggcaccaaggccgtcgcctccgtgctcaagcaggtcttccccgagaccgacatcgtgtacgccaaggcccgggtggcgagccagttccgccaggagttcgacctgatcaaggtgcgggagatgaacgacctgcaccacgccaaggacgcctacgtcaacatcgtggtggggaacgtctactacacgaagttcacctccaacgccgcctggtacgtgaaggagcaccccggccgcagctacaacctcaagaagatgttcacctccgagcgggacgtggcgcgcaacggggagaccgcctggcgggccggcaacagcggcacgatcgccaccgtcaagcgcgtgatggggaagaacaacatcctggtgacccggcgcagctacgaggtcaagggcgggctgttcgaccagcagctcatgaagaagggcaagggccaggtgcccatcaaggggcgggacgagcgcctggccgacatcgacaagtacggcgggtacaacaaggcggccggcacctacttcatgctggccgagtccgaggacaagaagggggccaagatccgcagcgtggagtacgtcccgctctacctgtgcaactgcatcgagaaggacgaggaggcggccaagaagtacctgcagaaggagcggggcctcaagaacccccgcgtgctgatcgccaagatcaagatcgacacgctgttcaaggtggacggcttctacatgtggctctccgggcggaccggcaaccagctgatcttcaagggggccaaccagctgatcctcagcgagcccgacatgcgcatcctgaagaaggtcctgaagtacgtgaaccggaagaaggagaacaagaacgccgtgctcggcgagcacgaccagctgccggagaccgacctgatccgcctctacgacgtcttcctggacaagatcgagaacaccgtgtaccacgtgcggctgtccgcgcagcaggggacgctcaccaagaacaaggacaccttctgcgagctgagcaacgaggacaagtgcatcgtcctgtccgagatcctccacatgttccagtgccagagcggctccgccaacctgaagctgatcaagggccccgggagcgccggcatcctcgtgctgaacaacatcatctccaagtgcaaccaggtgagcatcatccaccagtcccccaccgggatctacgagcaggagatcgacctgaagaagatctga

SEQ ID NO: 1817 - RNA, 4020 nt, synthetic construct
  misc_feature 1..4020: note = Cas9 variant
  source 1..4020: mol_type = other RNA
atgaacaaggcctacaccctgggcctcgacatcgggaccaacagcgtgggctgggccgtcgtgacggacgactaccgcctgatggcgaagaagatgcccgtgcactccaagatggagaagaagaagatcaagaagaacttctggggcgcccggctgttcgacgaggggcagaccgccgaggagcgccggaacaagcgcgccacccggcgccggctccgccggcgcaagtaccggatcctggagctgcagaagatcttcagcgaggagatcctcaagaaggactcccacttcttcgcccgcctggacgagagcttcctgatcccggaggacaagcagtacgcgcggttccccatcttccccaccctcctggaggagaaggcctactaccagaactaccccacgatctaccacctccgccagaagctggccgactccaccgagaaggccgacatccggctggtctacctggcgctcgcccacatgatcaagtaccgcgggcacttcctgttcgagggcgagctggacaccgagaacaccagcgtggaggagacgttcaaggagttcatcgacatctacaacgagcagttcgaggagggcatcatcttctacaaggacatcccgctcatcctgaccgacaagctgtccaagagcaagaaggtggagaagatcctccagtactaccccaaggagaagaccaccgggtgcctggcccagttcctgaagctcatcgtcggcaaccaggggaacttcaagcaggccttccacctggacgaggaggtgaagatccagatctccaaggagacgtacgaggaggacctggagaagctcctgcgcaagagcaacgaggagatgatcgacgtgttcctgcaggtcaagaaggtgtacgacgccatcctcctgtccgacatcctgagcaccaagatgaaggacaccaaggcgaagctctccgccggcatgatcgagcggtaccagaaccacaagaaggacctggaggagctgaagcagttcgtgcgggcccacctccacgagaaggtcaccgtgttcttcaaggacagctccaaggacgggtacgccggctacatcgacggcaagacgacccaggccgacttctacaagttcctgaagaaggagctgaccggggtgcccggcagcgagcccatgctcgcgaagatcgaccaggagaacttcctgctgaagcagcgcaccccgacgaacggggtcatcccccaccaggtgcacctcaccgagttcaaggccatcatcgaccagcagaagcagtactaccccttcctggagaagtccaaggagaagatgatccagctgctcaccttccggatcccctactacgtgggcccgctggcccaggacaaggagaccagctccttcgcctggctggagcgcaagacgaccgagaagatcaagccctggaacgccaaggacgtcatcgactacggcgcgagcgccaccaagttcatccagcgcatgatcaactacgacacctacctccccacggagaaggtgctgcccaagtacagcatgctgtaccagaagtacaccatcttcaacgagctgaccaaggtggcctacaaggacgaccgggggatcaagcaccagttctccagcgaggagaagctccgcatcttccaggagctgttcaagaagcagcggcgcgtcaccaagaagaagctgcagcacttcctctccgccaactacaacatcgaggacgccgagatcctgggcgtggacaaggtgttcaacagctcctacgcgacgtaccacgacttcctggagctcgccaagccgtacaccgagaagatcatcgagctgctggagcagcccgagatggaggagatgttcgaggacatcgtcaagatcatcaccatcttcgaggaccgggagatggtgcgcacccagctcaagaagtaccagcggatcctgggggaggagatcttcaagaagctggtcaagaagaagtacacgggctgggggcgcctcagcaagcggctgatcaacggcatccgcgaccagaagaccaacaagaccatcctggactacctcatcaacgacgacgacttcccctacaaccggaaccgcaacttcatgcagctgatcaacgacgaccacctgtccttcaaggaggagatcgccaaggagctcaccctgagcgacaagcagtccctgctcgaggtggtggaggccatccccggcagcccggcgatcaagaaggggatctggcagaccctgaagatcgtcgaggagctgatcgccatcatcggctacaagcccaagaacatcgtgatcgagatggcccgggagaaccagacgaccaccgggggcaagaaccgctccaagccccggctcaagagcctggaggaggccctgaagaacttcgactcccagctcctgaaggagcgccccgtggacaaccagagcctgcagaaggaccggctctacctgtactacctgcagaacgggaaggacatgtacaccggcgagtccctcgacatcgaccgcctgagcgagtacgacatcgaccacatcatcccgcggtccttcatcgtcgaccacagcctggacaacaaggtgctcgtgtccagcaaggagaaccgcctgaagaaggacgacgtccccgacagcaaggtggtgaagcgcatgaaggcctactgggagaagctgctccgggcgaacctgatctccgagcgcaagttcagctacctgacgaagctcgagctgaccgacgacgacaaggcccggttcatccagcgccagctggtcgagacccggcagatcaccaagcacgtggccgccatcctccaccagtacttcaaccagacgcaggagctggagaaggagaaggacatccgcatcatcaccctgaagtccagcctcgtgtcccagttccggcaggtcttcggcatccacaaggtgcgcgagatcaaccaccaccaccacgcccacgacgcgtacctgaacgccgtggtcgccctggccctcctgaagaagtacccccggctggcccccgagttcgtgtacgggagcttcgcgaagttccacctcgtgaaggagaacaaggccaccgccaagaaggagttctactccaacatcctgaagttcttcgagaaggaggagcagttctgcgacgagaacggcgagatcttctgggacaagcgcaagcacatccagcagatcaagaaggtcatcagctcccaccaggtgaacatcgtgaagaaggtcgaggtgcagaccgggagcttctacaaggagacggtgaacaccaaggagaagccggacaagctgatcaagcggaagaacaactgggacgtcaccaagtacggcgggttcggctcccccgtggtggcctacgcggtcgtgttcacctacgagaagggcaagaaccacaagaaggccaaggccatcgaggggatcacgatcatggagcaggccctcttcgagaaggaccccatcagcttcctgatcgagaagggctactccaacgtgaaccagttcatcaagctgccgaagtacaccctcttcgagctggccaacgggcagcgccggatgctggcgagccaccaggagctccagaaggccaactccttcatcctgcccgagaagctggtcaccctcctgtaccacgccaaccactacgacgagatcgcctacaaggacagctacgactacgtgaacgagcacttctccaacttccaggacatcctggacaaggtgatcatcttcgccgagaagtacaccagcgcgccccagaagctcaaccagatcatcgccacgtacgagaagaaccaggaggccgaccgcaagatcatggcccacagcttcgtcaacctgatgcagttcaacgccctgggcgcgcccgccgacttcaagttcttcgacaccaccatcacccggaagcgctacacgtccctcaccgagatctggcagagcaccatcatctaccagtccgtgaccggcctgtacgagacgcggcgccggatggccgacctgtgggacggggtgcagtga

SEQ ID NO: 1818 - RNA, 4020 nt, synthetic construct
  misc_feature 1..4020: note = Cas9 variant
  source 1..4020: mol_type = other RNA
atggagcgctaccacatcggcctggacatcgggaccagctccatcggctgggccgtgatcggggacgacttcaagatcaagaagaagaagggcaagaacctcatcgggacccggctgttcaacgagggcgccacggcggccgagcgccggggcttccgcacccagcggcgccggctgaaccgccggaagtggcgcctcaagctgctggaggagatcttcgacccctacatggccgaggtcgacgagtacttcttcgcccggctcaagagctccaacctgagcccgaaggactccaacaagaagtacctggggagcctcctgttccccgacaagtccgacagcaacttctacgacaagtaccccaccatctaccacctccgccgggacctgatggagaaggacgagaagttcgacctgcgcgagatctacctggccatccaccacatcgtgaagtaccggggcaacttcctcgagaaggtgcccgcgaagaactacaagaactccggggccagcatcggcttcctgctggaggaggtcaactccctctacaaggacatcatcggggacgagagcatcgccatcctgaactccgagaagttcgaggacgtggagaagatcatcctggacgaggagacccgcaacctcgacaagcagaagtccgtgggcaagctgctggtcgaggacaagaagaagaagaacatcgtgacggccttctccaaggcgatcttcggctacaagttcaacatcgaggacctcctgctgatcgagaacgacgagaagaacaagctcaccttcaacgacgagaacatcgacgacatcttcaacgagctgagccactccctggacgacaagcagatggacctcctgaccaagacccgggagatctacttcaagttcaagctgaacatgatcgtgccgacggggtacaccctcagcgagtccatgatcgagaagtacgagatgcacaaggcccacctgaagatgtacaaggagttcatcaacaccctgaacaccaaggaccgcaagatcctcaagaacgcctacagcgactacatcaacacggagaaggccaaggccgcgaacgcccaggagaacttctacaagaccgtcaagaagatcatcaaggacaacaacagcgacaccgccaagaagatcatcgtgctgatcgacgagggcaacttcatgcccaagcagcggaccggggagaacggcgtgatcccccaccagctgcaccagatcgagctcgaccgcatcatcgagaaccaggccaagtactacccctggctggccgaggcgaacccggtcgagaagaaccggaagttcgccaagtacaagctggacgagctcgtgacgttccgcgtgccctactacgtcggccccctgatcgacaagaccgagtccaacaagaacgagaaggagaccaagttcgcctggatggtgcgcaaggccaaggggaccatcacgccctggaacttcgagaacctggtggaccggaccgagagcgccaaccgcttcatcaagcggatgacctccaaggacacctacatcatcggcgaggacgtcctcccggcgagctccctgctgtacgagaagttcaaggtgctcaacgagctgaacaacatcaaggtgaacgagaagaagctggacatcgagcagaagcaggacatctacctgaacctcttcacgaccgccaagaacgtcaccaagaagtccctggccacctacctgaactgcagcgccgacagcatctccgggctcagcgacggcgagaagttcaactccagcctgtccagctacatcgacctgaaggccatcctcgggaacatcgtggacgactgcaacaagaacgaggacctggagaagatcatcgagtactccacggtgttcgaggacggcaacatctacaaggagaagctgagcgagatctcctggctcaccgacgagcagatcgagaagctgagcaacatccacttcaagggctgggggcgcctgtccaagaagctcctgacccagatcaccaacgagaacggcgagcggatcatcgacgcgctgtggaacacgagcaacaacttcatgcagatcatcaacgacgagagcatccaggccaagctcgccgagatcaacgggaagtacgccggcaagtccgacctggaggacatcctgagcgaggcgtacaccagcccccagaacaagaaggccatccgccaggtcatgaaggtggtcgaggacatcgagaaggccatgcagtgcgagcccaccagcatctccatcgagttcacccggaagaagcagaagtcccgcctcacgaacacccggtacaagaagatcagcgacgtgtacgagaagatcgccgacgaggtgatcagcgagtacgagctgcgcaagctgcagtccgagctcgacagcaacgccaacaacatgcgggaccgctactacctgtacttcatgcagctggggcgggacatgtacaccggcgagaagatcaacatcgacgagctccaccagcgctacgacatcgaccacatcctgccccagtccttcatcaaggacgacagcatcaacaaccgggtcctgacccgcaaggacgtgaacaacaaggagaagtccgacaagaccgcggccgacctctacgccgtggagatgagcgacttctggcggaagctgcgcaagcagggcctgatcacggagcagaagtacaagaacctcctgaccaagtccgacagcatcgacaagtacgccaagaaggggttcatcaagcggcagctggtcgagacctcccaggtggtgaagctcgtcgccaacatcctgcaggacaagtacagcgacaccaagatcatcgaggtgcgcgcgaagctgaacagcaacctccgcgaggagtacaagctgatcaagaaccgggccgtgaacgactaccaccacgccatcgacggctacctgacgaccttcatcgggcagtacctctacaagacctacccgaagctgcgctcctacttcgtctacaacgacttcaagaagctggacagcaactacctcaagcacatgaagaagttcaacttcctgtggcagctgcaggacgacaagaccatcgacatctacgacaacgtgaacaacaagttcgtgctcaacgtccccgagatgaagaagtacatccagaagatctacaactacaagtacatgctggtgtccaaggaggtgacgaccaagaacggcgccttctacgaccagaccaagtacaacgccaagaccgtcaacctgatccccatcaagaagaacaagcccacgaacatctacgggggctacaagggcaaggtgagctcctacatgatgctcgtgaagatccggaagaagaaggaggtcatctacaagttcgtgggggtgccgcgcctgtggaccgacgagctggaccggctcaaggacaccaccgagcgcaagatcctgctgaacgagatcgcgaagaacagcctctccaagacggagcaggacttcgaggtcatcctggacaaggtgtactacggccagctgatcatcgacgggaaccagaagtacaccctcggcagctccgagtacaagtacaacgccatgcagctgcacctgagcaagcacgccctcgaggtgctggccaaggagaacgtcaaggacgcggagatcaccgacaaggacctggtgtccgtgtacgaggagatcctcagcgtcgtgaacaagtacttcgagctgtacgacatcaacaagttccggcagaagctgaacgagggcctcgagatcttccgcaagctgcccgtgtacaacgtctacgagtccaacaagatcaagcaggtcgggaagttcgaggtgctgaaccggatcctcatgggcctgcacgccaacgccatgatcaccgacctgaaggtgctcgggatcaagacgaagctgggccagatgcaggtcaacgggggcatcaagctgagccccgacgccaagctcatctaccagtcccccaccggcatcttcagccgcgccgtgcgggtgaaggacctggggtga

SEQ ID NO: 1819 - RNA, 4020 nt, synthetic construct
  misc_feature 1..4020: note = Cas9 variant
  source 1..4020: mol_type = other RNA
atgagcctgaacaccaacaagaagtacaacatcggcctcgacatcgggaccacgtccgtgggctgggccgtcaccgacgccgacgggcagaagctgctgaaggcgaagaacaagaacctctggggcgtgagcctgttcgaggccgggaagaccgccgccgagcgccggggctaccgctccacccggcgccggctgaaccaccgcaagttccggctccgcctgctggaggacatgttcgagaaggagatcctcagcaaggacccctccttcttcatccggctgaaggaggccttcctgagcccgaaggacgagcagaagcagttcaagggcaacatcctcttcaacgacaaggactacacggacgcggactactacgagcagtacaagaccatctaccacctccgctacgacctgatctcccagcaccggcagttcgacatccgcgaggtgtacctcgccatccaccacctgatcaagtaccgggggcacttcatctacgaggaccagaccttcaccacggacggcaaccagctgcagcaccacatcaaggccatcatcaccatgatcaacagcatcctcaaccgcatcatcatccccgagaccatcgacatcaacgtcttcgagaagaccctgctggaccggacgatgaaccgctccagcaaggtgaagttcctcatcgagctgaccggggaggacaagcaggacaagcccctgctcaaggagctgttcaacctgatcgtgggcctcaaggccaagcccgcgtccatcttcgagcaggagaacctggccaccatcgtcgagaccatgaacatgagcacggagcaggtccagctggacctcctgaccctggccgacgtgctcgccgacgaggagtacgacctgctgctcaccgcccagaagatctactccgcgatcatcctggacgagagcatggacgggtacgagtacttcgccgaggccaagaaggagtcctaccggaagcaccaggaggagctggtgctcgtgaagaagatgctcaagagcaacgccatcaccaacgacgagcgcgccaagttcgagtacttctacacggactacatcggcgcgaagtccagcaactacgaggagtccaagatcatcaagaagggcctgagcgccgcctacgggaagtacagcaaggaggagcggctgttcaagcacatcgagctgctgctcgccaaggagaacgtgctgaccaccgtcgagcacgacctgctcgagaagaacatcaccttcgcctccctgctgccgctgcagcgcagctcccggaacgcggtgatcccctaccaggtgcacgagaaggagctcgtcgccatcctggagaaccaggccacgtactaccccttcctgctcgagcagaaggacaacatccacaagctgctgaccttccgcatcccctactacgtgggcccgctcgccgaccagaaggacagcgagttcgcctggatggtgcgcaagcaggcggggaagatcacccccttcaacttcgaggagatggtcgacatcgacgcctccagcgaggccttcatcaagcggatgaccaacaagtgcacgtacctgatccacgaggacgtgatccccaagcactccttcagctacgccaagttcgaggtgctgaacgagctcaacaagatccgcctggacggcaagcccatcgacatcccgctgaagaagcggatcttcgagggcctcttcctggagaagaccaaggtcacccacacctccctgaagaagtggctcgcggagtacgagcacatgacggtgagcgtggtccaggggacccagaaggagaccgagttcgccacctccctgcaggccttccaccgcttcgtgaagatcttcgaccgggagacggtcagcaaccccgccaacgaggagatgttcgagaagatcatctactggtccaccgtgttcgaggacaagaagatcatgcgccggaagctgagcgagtacccccagctcaccgagcagcagcaggtccagctggcccaggtgcgcttccggggctgggggcgcctgtcccagcggctcatcaaccgcatcaagacccccgtgagcggcgacgaggaccacaagctgtccatcaacgagatcctgtggcagaccaacgagaacttcatgcagatcatccggaacaaggactacctcttcaagaagatcatcgaggagcagttcgagaacgagacggcgctgctgaacaagcagcgcatcgacgagctcgccaccagcccggccaacaagaaggggatctggcaggccatcaagatcgtgaaggagctggagaaggtcctgcagcagcccgccgagaacatcttcatcgagttcgcgcggtccgacgaggagagcaagcgcagcacgccccgggacaagttcatcgagaaggcctacgcccagctcaagaaggagaccgacaccttcaacctggagcacctgaaggagctcaagcagcgctccaagcagctgagctcccagcggctgttcctctacttcatccagaacggcaagtgcatgtacagcggcgagcacctggacatcgagcgcctggactcctacgaggtggaccacatcctcccccagagctacatcaaggacaactccatcgagaacctggccctggtgaagaaggtcgagaaccagcgcaagaaggacagcctcctgctgaactccagcatcatcaaccagaactactcccggtgggagcagctcaagaacgccgggctgatcggcgagaagaagttccgcaacctgacccggaccaagatcaccgaccgcgacaaggaggggttcatcgcgcggcagctcgtggagacgcgccagatcaccaagcacgtgacccagctgctgcagcaggagtacaaggacaccacgaaggtcttcgccatcaaggccaccctcgtgagcgacctgcggcgcaagttcgagttcatcaagaaccggaacgtgaacgactaccaccacgcccaggacgcgttcctggtcgccttcctcggcaccaacatcacctccaactacccgaagatcgagatggagtacctgttcaaggggtaccagcactacctgaacgaggtgggcaagagcgccgccaagcccaagttcacgttcatcgtggagaacctctccaagcagcagtacaacagcaccaccggcgaggtcaagtggaaccccgaggtggacatcgccaagctgaagcgcatcctgaacttcaagcagtgcaacatcgtgcggaaggtcgaggagcagtccggggcgctgttcaaggagaccatctaccccgtggaggagagcagctccaagacgatcccgctgaagaagcacctggacaccgccatctacggcgggtacaccgccgtgaactacgccagctacgccctcatccagttcaagaagggccgcaagctgaagcgggagatcatcgggatccccctggcggtccagacccgcatcgacaactccgagacgagcctccagacctacatcgccgagcagatcaagtccgaggtggagatcctgaacggccggatcctgaagtaccagctcatcagcaacaacggcaaccgcctgtacatcgccgggccccgggagcgccacaacgcccggcagctgatcgtgtccgacgaggccgcgaaggtcatctggctcatcagcaccaagcaggccgtggaggccaccttcctgaagcactacacgctggagcacctcgaggccgtgttcgaggagctgatccgcaagcaggcggccgactaccagatcttcgagaacctgatcaagaagatcgaggtcaacaaggcctacttctactcctgcacctacaacgagaaggtgaaggtgatcgaggagctcctgaagatcacccaggccaacgccaccaacggcgacctgaagctcctgaagatgacgaaccgggaggggcgcctgggcagcgtctccgtggcgctcgacttcaagatcatcaaccagagcgtgaccggcctgtaccagtccatcgaggactacaacaactga

SEQ ID NO: 1820 - RNA, 4020 nt, synthetic construct
  misc_feature 1..4020: note = Cas9 variant
  source 1..4020: mol_type = other RNA
atgagcctgaacaccaacaagaagtacaacatcggcctcgacatcgggaccacgtccgtgggctgggccgtcaccgacgccgacgggcagaagctgctgaaggcgaagaacaagaacctctggggcgtgagcctgttcgaggccgggaagaccgccgccgagcgccggggctaccgctccacccggcgccggctgaaccaccgcaagttccggctccgcctgctggaggacatgttcgagaaggagatcctcagcaaggacccctccttcttcatccggctgaaggaggccttcctgagcccgaaggacgagcagaagcagttcaagggcaacatcctcttcaacgacaaggactacacggacgcggactactacgagcagtacaagaccatctaccacctccgctacgacctgatctcccagcaccggcagttcgacatccgcgaggtgtacctcgccatccaccacctgatcaagtaccgggggcacttcatctacgaggaccagaccttcaccacggacggcaaccagctgcagcaccacatcaaggccatcatcaccatgatcaacagcatcctcaaccgcatcatcatccccgagaccatcgacatcaacgtcttcgagaagaccctgctggaccggacgatgaaccgctccagcaaggtgaagttcctcatcgagctgaccggggaggacaagcaggacaagcccctgctcaaggagctgttcaacctgatcgtgggcctcaaggccaagcccgcgtccatcttcgagcaggagaacctggccaccatcgtcgagaccatgaacatgagcacggagcaggtccagctggacctcctgaccctggccgacgtgctcgccgacgaggagtacgacctgctgctcaccgcccagaagatctactccgcgatcatcctggacgagagcatggacgggtacgagtacttcgccgaggccaagaaggagtcctaccggaagcaccaggaggagctggtgctcgtgaagaagatgctcaagagcaacgccatcaccaacgacgagcgcgccaagttcgagtacttctacacggactacatcggcgcgaagtccagcaactacgaggagtccaagatcatcaagaagggcctgagcgccgcctacgggaagtacagcaaggaggagcggctgttcaagcacatcgagctgctgctcgccaaggagaacgtgctgaccaccgtcgagcacgacctgctcgagaagaacatcaccttcgcctccctgctgccgctgcagcgcagctcccggaacgcggtgatcccctaccaggtgcacgagaaggagctcgtcgccatcctggagaaccaggccacgtactaccccttcctgctcgagcagaaggacaacatccacaagctgctgaccttccgcatcccctactacgtgggcccgctcgccgaccagaaggacagcgagttcgcctggatggtgcgcaagcaggcggggaagatcacccccttcaacttcgaggagatggtcgacatcgacgcctccagcgaggccttcatcaagcggatgaccaacaagtgcacgtacctgatccacgaggacgtgatccccaagcactccttcagctacgccaagttcgaggtgctgaacgagctcaacaagatccgcctggacggcaagcccatcgacatcccgctgaagaagcggatcttcgagggcctcttcctggagaagaccaaggtcacccacacctccctgaagaagtggctcgcggagcacgagcacatgacggtgagcgtggtccaggggacccagaaggagaccgagttcgccacctccctgcaggccttccaccgcttcgtgaagatcttcgaccgggagacggtcagcaaccccgccaacgaggagatgttcgagaagatcatctactggtccaccgtgttcgaggacaagaagatcatgcgccggaagctgagcgagtacccccagctcaccgagcagcagcaggtccagctggcccaggtgcgcttccggggctgggggcgcctgtcccagcggctcatcaaccgcatcaagacccccgtgagcggcgacgaggaccacaagctgtccatcaacgagatcctgtggcagaccaacgagaacttcatgcagatcatccggaacaaggactacctcttcaagaagatcatcgaggagcagttcgagaacgagacggcgctgctgaacaagcagcgcatcgacgagctcgccaccagcccggccaacaagaaggggatctggcaggccatcaagatcgtgaaggagctggagaaggtcctgcagcagcccgccgagaacatcttcatcgagttcgcgcggtccgacgaggagagcaagcgcagcacgccccgggacaagttcatcgagaaggcctacgcccagctcaagaaggagaccgacaccttcaacctggagcacctgaaggagctcaagcagcgctccaagcagctgagctcccagcggctgttcctctacttcatccagaacggcaagtgcatgtacagcggcgagcacctggacatcgagcgcctggactcctacgaggtggaccacatcctcccccagagctacatcaaggacaactccatcgagaacctggccctggtgaagaaggtcgagaaccagcgcaagaaggacagcctcctgctgaactccagcatcatcaaccagaactactcccggtgggagcagctcaagaacgccgggctgatcggcgagaagaagttccgcaacctgacccggaccaagatcaccgaccgcgacaaggaggggttcatcgcgcggcagctcgtggagacgcgccagatcaccaagcacgtgacccagctgctgcagcaggagtacaaggacaccacgaaggtcttcgccatcaaggccaccctcgtgagcgacctgcggcgcaagttcgagttcatcaagaaccggaacgtgaacgactaccaccacgcccaggacgcgttcctggtcgccttcctcggcaccaacatcacctccaactacccgaagatcgagatggagtacctgttcaaggggtaccagcactacctgaacgaggtgggcaagagcgccgccaagcccaagttcacgttcatcgtggagaacctctccaagcagcagtacaacagcaccaccggcgaggtcaagtggaaccccgaggtggacatcgccaagctgaagcgcatcctgaacttcaagcagtgcaacatcgtgcggaaggtcgaggagcagtccggggcgctgttcaaggagaccatctacagcgtggaggagagctccagcaagacgatccccctgaagaagcacctggacaccgccatctacggcgggtacaccgccgtgaactacgcctcctacgccctcatccagttcaagaagggccgcaagctgaagcgggagatcatcgggatcccgctggcggtccagacccgcatcgacaacagcgagacgtccctccagacctacatcgccgagcagatcaagagcgaggtggagatcctgaacggccggatcctgaagtaccagctcatctccaacaacggcaaccgcctgtacatcgccgggccccgggagcgccacaacgcccggcagctgatcgtgagcgacgaggccgcgaaggtcatctggctcatctccaccaagcaggccgtggaggccaccttcctgaagcactacacgctggagcacctcgaggccgtgttcgaggagctgatccgcaagcaggcggccgactaccagatcttcgagaacctgatcaagaagatcgaggtcaacaaggcctacttctacagctgcacctacaacgagaaggtgaaggtgatcgaggagctcctgaagatcacccaggccaacgccaccaacggcgacctgaagctcctgaagatgacgaaccgggaggggcgcctgggctccgtcagcgtggcgctcgacttcaagatcatcaaccagtccgtgaccggcctgtaccagagcatcgaggactacaacaactga

SEQ ID NO: 1821 - RNA, 4020 nt, synthetic construct
  misc_feature 1..4020: note = Cas9 variant
  source 1..4020: mol_type = other RNA
atgaagaaggagtacaccatcggcctggacatcgggaccaacagcgtgggctggtccgtcctcacggacgactaccgcctggtgagcaagaagatgaaggtggccgggaacaccgagaagtccagcaccaagaagaacttctggggcgtccggctgttcgacgaggggcagaccgccgaggcgcgccggtccaagcgcacggcccggcgccggctcgcccgccggcgccagcggatcctggagctgcagaagatcttcgcccccgagatcctcaagatcgacgagcacttcttcgcccgcctgaacgagagcttcctggtgctcgacgagaagaagcagtcccggcacccggtgttcgcgaccatcaagcaggagaagtcctaccaccagacctaccccaccatctaccacctccgccaggccctggccgacagcagcgagaaggccgacatccggctcgtctacctggcgatggcccacctcctgaagtaccgcggccacttcctgatcgagggcgagctgaacacggagaactccagcgtgaccgagaccttccggcagttcctctccacctacaaccagcagttcagcgaggccgacgacaagcagacggagaagctggacgaggccgtggactgctccttcgtcttcaccgagaagatgagcaagaccaagaaggccgagaccctgctcaagtacttcccccacgagaagtccaacgggtacctgagccagttcatcaagctgatggtgggcaaccaggggaacttcaagaacgtgttcggcctcgaggaggcgaagctgcagttctccaaggagacgtacgaggaggacctggaggagctcctggagaagatcggggacgactacatcgacctgttcgtccaggccaagaacgtgtacgacgccgtgctcctgagcgagatcctgagcgactccaccaagaacacccgcgccaagctcagcgccggcatgatccggcgctacgacgcgcacaaggaggacctggtcctgctcaagcggttcgtgaaggagaacctgcccaagaagtaccgcgccttcttcggcgacaactccgtgaacgggtacgccggctacatcgaggggcacgccacccaggaggacttctacaagttcgtcaagaaggagctgacgggcatccgcggcagcgaggtgttcctcaccaagatcgagcaggagaacttcctgcggaagcagcgcaccttcgacaacggggtgatcccgcaccagatccacctgaccgagctccgggccatcatcgcgaaccagaagaagcactaccccttcctgaaggaggagcaggagaagctggagtccctcctgacgttcaagatcccctactacgtcggccccctggccaagaagcaggagaacagcccgttcgcctggctcatccgcaagtccgaggagaagatcaagccctggaacctgcccgagatcgtggacatggaggggagcgccgtgcggttcatcgagcgcatgatcaacaccgacatgtacatgccccacaacaaggtcctgccgaagaactccctgctctaccagaagttcagcatctacaacgagctgaccaaggtgcggtaccaggacgagcgcggccagatgaactacttctccagcatcgagaagaaggagatcttccacgagctgttcgagaagaaccggaaggtcaccaagaaggacctccaggagttcctgtacctgaagtacgacatcaagcacgccgagctctccgggatcgagaaggcgttcaacgccagctacacgacctaccacgacttcctgaccatgtccgagaacaagcgcgagatgaagcagtggctggaggaccccgagctcgccagcatgttcgaggagatcatcaagaccctgacggtgttcgaggaccgggagatgatcaagacccgcctgtcccaccacgaggccaccctcggcaagcacatcatcaagaagctgaccaagaagcactacacgggctgggggcggctgagcaaggagctcatccagggcatccgcgacaagcagtccaacaagaccatcctggactacctgatcaacgacgacgacttcccccaccaccggaaccgcaacttcatgcagctcatcaacgacgacagcctgagcttcaagaaggagatcaagaaggcgcagatgatcaccgacaccgagaacctggaggagatcgtgaaggagctcaccgggtcccccgccatcaagaagggcatcctgcagagcctgaagatcgtcgacgagatcgtggggatcatgggctacgagccggccaacatcgtggtcgagatggcccgggagaaccagacgaccggccgcgggctcaagtccagccggccccgcctgaaggccctggaggagtccctcaaggacttcggcagccagctgctgaaggagtaccccaccgacaactccagcctccagaaggaccgcctgtacctgtactacctccagaacgggcgggacatgtacaccggcgcgcccctggacatccaccgcctgtccgactacgacatcgaccacatcatcccgcggagcttcacgaccgacaactccatcgacaacaaggtgctcgtgagctccaaggagaaccgcctgaagaaggacgacgtccccagcgagaaggtggtgaagaagatgcggtccttctggtacgacctgtacagctccaagctcatcagcaagcgcaagctggacaacctgaccaagatcaagctcaccgaggaggacaaggccgggttcatcaagcggcagctggtcgagacgcgccagatcaccaagcacgtggccggcatcctgcaccaccggttcaacaaggccgaggacaccaacgagcccatccgcaaggtgcggatcatcaccctcaagagcgccctggtctcccagttccgcaaccggttcggcatctacaaggtgcgcgagatcaacgagtaccaccacgcgcacgacgcctacctgaacggggtggtcgccctcgccctgctgaagaagtacccccagctcgccccggagttcgtgtacggcgagtacctgaagttcaacgcgcacaaggccaacaaggccacggtgaagaaggagttctacagcaacatcatgaagttcttcgagtccgacacccccgtctgcgacgagaacggggagatcttctgggacaagagcaagtccatcgcccaggtgaagaaggtgatcaaccaccaccacatgaacatcgtcaagaagaccgagatccagaagggcggcttcagcaaggagaccgtggagcccaagaaggactccagcaagctgctcccccggaagaacaactgggacccggcgaagtacgggggcctggggtcccccaacgtggcctacacggtcgccttcacctacgagaagggcaaggcccgcaagcggaccaacgccctggaggggatcaccatcatggagcgcgaggcgttcgagcagagccccgtgctgttcctgaagaacaagggctacgagcaggccgagatcgagatgaagctgccgaagtacgccctcttcgagctggagaacggccggaagcgcatggtggcctccaacaaggaggcccagaaggcgaacagcttcctgctccccgagcacctggtcacgctgctctaccacgccaagcagtacgacgagatctcccacaaggagagcttcgactacgtgaacgagcaccacaaggagttctccgaggtgttcgcccgggtcctggagttcgccgggaagtacaccctggccgagaagaacatcgagaagctcgagaagatctacaaggagaaccagaccgacgacctggcgaagctggccagctccttcgtgaacctcatgcagttcaacgccatgggcgcccccgcggacttcaagttcttcgacgtgaccatcccccgcaagcgctacacgagcctgaccgagatctggcagtccaccatcatccaccagagcatcaccgggctgtacgagacgcggatccgcatgggcaagtga

SEQ ID NO: 1822 - RNA, 4023 nt, synthetic construct
  misc_feature 1..4023: note = Cas9 variant
  source 1..4023: mol_type = other RNA
atgaagaaggagtacaccatcggcctggacatcgggaccaacagcgtgggctggtccgtcctcacggacgactaccgcctggtgagcaagaagatgaaggtggccgggaacaccgagaagtccagcaccaagaagaacttctggggcgtccggctgttcgacgaggggcagaccgccgaggcgcgccggtccaagcgcacggcccggcgccggctcgcccgccggcgccagcggatcctggagctgcagaagatcttcgcccccgagatcctcaagatcgacgagcacttcttcgcccgcctgaacgagagcttcctggtgctcgacgagaagaagcagtcccggcacccggtgttcgcgaccatcaagcaggagaagtcctaccaccagacctaccccaccatctaccacctccgccaggccctggccgacagcagcgagaaggccgacatccggctcgtctacctggcgatggcccacctcctgaagtaccgcggccacttcctgatcgagggcgagctgaacacggagaactccagcgtgaccgagaccttccggcagttcctctccacctacaaccagcagttcagcgaggccgacgacaagcagacggagaagctggacgaggccgtggactgctccttcgtcttcaccgagaagatgagcaagaccaagaaggccgagaccctgctcaagtacttcccccacgagaagtccaacgggtacctgagccagttcatcaagctgatggtgggcaaccaggggaacttcaagaacgtgttcggcctcgaggaggaggcgaagctgcagttctccaaggagacgtacgaggaggacctggaggagctcctggagaagatcggggacgactacatcgacctgttcgtccaggccaagaacgtgtacgacgccgtgctcctgagcgagatcctgagcgactccaccaagaacacccgcgccaagctcagcgccggcatgatccggcgctacgacgcgcacaaggaggacctggtcctgctcaagcggttcgtgaaggagaacctgcccaagaagtaccgcgccttcttcggcgacaactccgtgaacgggtacgccggctacatcgaggggcacgccacccaggaggacttctacaagttcgtcaagaaggagctgacgggcatccgcggcagcgaggtgttcctcaccaagatcgagcaggagaacttcctgcggaagcagcgcaccttcgacaacggggtgatcccgcaccagatccacctgaccgagctccgggccatcatcgcgaaccagaagaagcactaccccttcctgaaggaggagcaggagaagctggagtccctcctgacgttcaagatcccctactacgtcggccccctggccaagaagcaggagaacagcccgttcgcctggctcatccgcaagtccgaggagaagatcaagccctggaacctgcccgagatcgtggacatggaggggagcgccgtgcggttcatcgagcgcatgatcaacaccgacatgtacatgccccacaacaaggtcctgccgaagaactccctgctctaccagaagttcagcatctacaacgagctgaccaaggtgcggtaccaggacgagcgcggccagatgaactacttctccagcatcgagaagaaggagatcttccacgagctgttcgagaagaaccggaaggtcaccaagaaggacctccaggagttcctgtacctgaagtacgacatcaagcacgccgagctctccgggatcgagaaggcgttcaacgccagctacacgacctaccacgacttcctgaccatgtccgagaacaagcgcgagatgaagcagtggctggaggaccccgagctcgccagcatgttcgaggagatcatcaagaccctgacggtgttcgaggaccgggagatgatcaagacccgcctgtcccaccacgaggccaccctcggcaagcacatcatcaagaagctgaccaagaagcactacacgggctgggggcggctgagcaaggagctcatccagggcatccgcgacaagcagtccaacaagaccatcctggactacctgatcaacgacgacgacttcccccaccaccggaaccgcaacttcatgcagctcatcaacgacgacagcctgagcttcaagaaggagatcaagaaggcgcagatgatcaccgacaccgagaacctggaggagatcgtgaaggagctcaccgggtcccccgccatcaagaagggcatcctgcagagcctgaagatcgtcgacgagatcgtggggatcatgggctacgagccggccaacatcgtggtcgagatggcccgggagaaccagacgaccggccgcgggctcaagtccagccggccccgcctgaaggccctggaggagtccctcaaggacttcggcagccagctgctgaaggagtaccccaccgacaactccagcctccagaaggaccgcctgtacctgtactacctccagaacgggcgggacatgtacaccggcgcgcccctggacatccaccgcctgtccgactacgacatcgaccacatcatcccgcggagcttcacgaccgacaactccatcgacaacaaggtgctcgtgagctccaaggagaaccgcctgaagaaggacgacgtccccagcgagaaggtggtgaagaagatgcggtccttctggtacgacctgtacagctccaagctcatcagcaagcgcaagctggacaacctgaccaagatcaagctcaccgaggaggacaaggccgggttcatcaagcggcagctggtcgagacgcgccagatcaccaagcacgtggccggcatcctgcaccaccggttcaacaaggccgaggacaccaacgagcccatccgcaaggtgcggatcatcaccctcaagagcgccctggtctcccagttccgcaaccggttcggcatctacaaggtgcgcgagatcaacgagtaccaccacgcgcacgacgcctacctgaacggggtggtcgccctcgccctgctgaagaagtacccccagctcgccccggagttcgtgtacggcgagtacctgaagttcaacgcgcacaaggccaacaaggccacggtgaagaaggagttctacagcaacatcatgaagttcttcgagtccgacacccccgtctgcgacgagaacggggagatcttctgggacaagagcaagtccatcgcccaggtgaagaaggtgatcaaccaccaccacatgaacatcgtcaagaagaccgagatccagaagggcggcttcagcaaggagaccgtggagcccaagaaggactccagcaagctgctcccccggaagaacaactgggacccggcgaagtacgggggcctggggtcccccaacgtggcctacacggtcgccttcacctacgagaagggcaaggcccgcaagcggaccaacgccctggaggggatcaccatcatggagcgcgaggcgttcgagcagagccccgtgctgttcctgaagaacaagggctacgagcaggccgagatcgagatgaagctgccgaagtacgccctcttcgagctggagaacggccggaagcgcatggtggcctccaacaaggaggcccagaaggcgaacagcttcctgctccccgagcacctggtcacgctgctctaccacgccaagcagtacgacgagatctcccacaaggagagcttcgactacgtgaacgagcaccacaaggagttctccgaggtgttcgcccgggtcctggagttcgccgggaagtacaccctggccgagaagaacatcgagaagctcgagaagatctacaaggagaaccagaccgacgacctggcgaagctggccagctccttcgtgaacctcatgcagttcaacgccatgggcgcccccgcggacttcaagttcttcgacgtgaccatcccccgcaagcgctacacgagcctgaccgagatctggcagtccaccatcatccaccagagcatcaccgggctgtacgagacgcggatccgcatgggcaagtga

SEQ ID NO: 1823 - RNA, 4023 nt, synthetic construct
  misc_feature 1..4023: note = Cas9 variant
  source 1..4023: mol_type = other RNA
atgaagaccgactacttcatgggcctggacatggggaccggcagcctcgggtgggccgtgacggactccagctaccacctgtgccgcgcccacggcaaggacctgtggggcgtccggctgttcgagaccgcgcagaccgccgaggagcgccgggtgttccgctgcaaccggcgccggctggaccgccggaagcgccggatccagctgctccaggacatcttcgcccccgagatctacaagatcgacccggggttcttcctgcgcctgaaggagtcccggtacctccccgaggacaagaagaacctggagggcaagacccccgagctgccctacgccctcttcgtggacaagaagtacacggacaaggacttccacaaggagtacccgaccatctaccacctccgcctgcggctcatgcaggaccgcacccccgccgacgtccggctggtgtacctggcgctccaccacctgatcaagcaccgcgggcacttcctgttcgccggcatcgaggccgacaaggtgaccgacttcagcgccgcgttctccgagttcctccggatcgtccaggagcaggagctggacatcagcttcacgcccgacgaggagtccagccagatcatcaaggagaccctgcagaacaccaacttcacccgctccaagaagtccacggagctcatcaaggggctgaaggccagcaccggctgcgagaaggccctgctcaagctgatcagcgggtgcaaggtgaagctgtccgccgtgttcgacgaccccggctgcgacgcctacgagaagccgcaggtctgcttcgcggagagctcctacgaggactacgccgccatcctcgaggacgagctggaggaccggttcatcgtgatcgccgccgcgaaggccctgtacgactggagcgtgctcgtcaacatcctgggcgaggcctccaccgtgagcgaggccaaggtggggatctacgagaagcaccgccgcgacctgaagtacctcaagcacctggtcaagaccaacctgacgcgggaggactaccaggacctcttcgtgaaggccggcgcgaagaagaacaactactgcgcctacatcgggatgaccaagaagaacaacaagaaggtggtcctggaggagaagcgctgcaccaaggaggacttctacgcctacctgaagaaggagatctactccaaggtgcaggagaaccccgaggccgagtacctcctggaggagctggagaagggcaccttcctcccccgccaggtgagcaaggacaacggcgtcatcccctaccagctgcagttcctggagctccagaagatcctgaagaacgccgtggagtacctgccgttcctgaaggaggagagcgagaagatccagcagatcatgacgttccggatcccctactacgtggggcccctcaacggcaagaaggaggggcagaacaccttcgcgtgggccgtccggaagaacaacgagcccgtgtacccgtggaacttcgaggaggtcatcgacaccgaggcctccgccgagcagttcatccgccggatgaccaacaagtgcacgtacctgcccggcgaggacgtgctgcccaaggagagcctcctgtactccaagttcatggtgctgaacgagctcaacaacctgcgcatcaacgggaccaagatcagcgtcgagctgaagcaggagctctacgagaagctgttccagcggtaccgcaaggtgtccgcgaagaagctgcgggactacctcgtgcgcaacggcatcaccgagaaggacgccgagatcagcggcatcgacggggacttcaagggcaccctgcgggcctaccacgacttcaaggagaagctgacgggggtcgagctcaccgaggccgagaaggagaccatcatcctgaacatcaccctgttcggcgaggacaaggtgctcctgaagaagcgcatgcagcggctgctccccaacctgacggaggggcagaagaaggccatcgtgaccctgaactactccggctggggccgcctcagccgggagttcctggaggaggtccaggcgccgaaccccgagtccggggagatcctgagcatcatccgcgccctctgggagaccaacgccaacctgatgcagctgctctccaaccagtacggctaccaggagatcctggagcagatgcgggccgactggaccgggcacaagctggactaccagacggtggaggagctctacgtgagccccgccgtcaagcgccagatctggcagaccctccaggtggtgaaggagctgaagaaggtcatgggcggggagcccaagcgcgtgttcctcgaggtggcgcgggagaagatggagtccggccgcaccgtcagccggaagaagcacctgaaggacctgtacctctcctgcaagagcgaggagcgcaactggctggccgagctggaccggcacgaggagcactcctaccgcagcgaccggctgttcctgtactacacccagaagggccgctgcatgtactgcgggaagccgatcgacctgggccacctctgggacgtgaacatgtacgacatcgaccacatctacccccagtccaaggtgatggacgacagcatccggaaccgcgtcctgacctgccggacgtgcaacgccgagaagaccgaccactaccccctgaaggccgagatccgccagaagatgcggcccttctgggacagcctcaaggccgggaacttcatcgaggaggagaagtggaagcgcctgatccggtccgaggagttcaccagcaccgagctggcgggcttcatcgagcgccagctcgtggagacgcggcagtccaccaaggccgtggccgacatcctgaagcaggccatgccggagaccgagatcgtctacgtgaaggcgaagaacgtgagcgccttccgccaggacttcaacttcgtcaagaaccgggacgtgaacgacttccaccacgccaaggacgcctacctgaacatcgtggtcggcaacacctacttcgtgaagttcacgaagaacgcctcctggttcatcgagcgcaaccccgggcggagctacaacctcaagcgcatgttcacctccgactacgacgtgatgagcaacggcgagatcgcgtggaaggccgggaactccggcaccatcaccacggtccgcaagatgatgaagaagaacagcgtgctgttcacccggcgctccttcgaggtgagcgggggcctgttcgaccagcagctcatgaagaagggcaaggggcaggtctacgtgaagtccggcgacgagcggctgcgcagcatcgagaagtacgggggctacaacaaggccaccggggcctacttcatgctggtggagtccgagggcaagaagggcgtcaagaagcggaccatcgagttcgtgcccctctaccgcaaggccgagctggaggcgagcgaggagaagatgctggagtacctccggacggagatcgggctgaaggagccgcacgtgctgctccacaagatcaagaccgacaccctgttccaggccgacggcttcaagatgcacctgtccgggcgcaccggcaagcagctcgtcttcaagggggccaaccagttcctggtggccgaggactacgagcggctgctcaagaaggtgggcaaggtcacggagcagctgaagaccaacaagaactacaagatcaacgactacgacggcatcaccgaggaggggctgaaggccctctacagcgagttcctgagcaagctgcagaaggcgccctacggcaaccgcctcgggacccaggccgagacgctggagaacggcaaggagaagttcgacaagctgtccctcgagaacaagtgccaggtgctgagcgagatcctgcacctcttccagtgcaactccagcgccgccgacctgtccaagctcgggggccccggccacgggggcatcctggtgctgagcaacgagatcaccaagtgcaacaagatctccatcatccaccagagccccgcggggatctacgagcaggagatcgacctgaagaccctctga

SEQ ID NO: 1824 - RNA, 4023 nt, synthetic construct
  misc_feature 1..4023: note = Cas9 variant
  source 1..4023: mol_type = other RNA
atggagcaggagtactacctgggcctcgacatggggaccggcagcgtggggtgggccgtcaccgactccgagtaccacgtgctgcgcaagcacggcaaggccctgtggggcgtgcgcctcttcgagagcgcgtccacggccgaggagcggcggatgttccgcaccagccggcgccggctggaccgccggaactggcgcatcgagatcctgcaggagatcttcgccgaggagatctccaagaaggaccccgggttcttcctccggatgaaggagagcaagtactacccggaggacaagcgcgacatcaacggcaactgccccgagctgccctacgccctgttcgtcgacgacgacttcaccgacaaggactaccacaagaagttccccaccatctaccacctccggaagatgctgatgaacacggaggagaccccggacatccgcctggtgtacctcgccatccaccacatgatgaagcaccgggggcacttcctgctgtccggcgacatcaacgagatcaaggagttcgggaccaccttcagcaagctcctggagaacatcaagaacgaggagctggactggaacctcgagctgggcaaggaggagtacgcggtggtcgagtccatcctgaaggacaacatgctcaaccgcagcacgaagaagacccggctgatcaaggccctgaaggccaagtccatctgcgagaaggccgtgctcaacctgctggccgggggcaccgtgaagctcagcgacatcttcggcctggaggagctgaacgagaccgagcgccccaagatctccttcgcggacaacgggtacgacgactacatcggcgaggtcgagaacgagctcggggagcagttctacatcatcgagacggccaaggccgtgtacgactgggccgtgctggtcgagatcctgggcaagtacaccagcatctccgaggcgaaggtggccacctacgagaagcacaagagcgacctccagttcctgaagaagatcgtgcggaagtacctgaccaaggaggagtacaaggacatcttcgtctccacgagcgacaagctcaagaactactccgcctacatcggcatgaccaagatcaacgggaagaaggtggacctgcagagcaagcgctgcagcaaggaggagttctacgacttcatcaagaagaacgtgctgaagaagctcgagggccagcccgagtacgagtacctgaaggaggagctggagcgggagaccttcctccccaagcaggtcaaccgcgacaacggggtgatcccgtaccagatccacctgtacgagctgaagaagatcctcggcaacctgcgcgacaagatcgacctgatcaaggagaacgaggacaagctcgtgcagctgttcgagttccggatcccctactacgtcgggcccctgaacaagatcgacgacggcaaggagggcaagttcacctgggccgtgcgcaagtccaacgagaagatctacccctggaacttcgagaacgtggtcgacatcgaggccagcgcggagaagttcatccggcgcatgacgaacaagtgcacctacctgatgggggaggacgtgctcccgaaggactccctgctgtacagcaagtacatggtcctcaacgagctgaacaacgtgaagctggacggcgagaagctctccgtggagctgaagcagcggctgtacaccgacgtcttctgcaagtaccgcaaggtgaccgtgaagaagatcaagaactacctcaagtgcgaggggatcatcagcggcaacgtcgagatcacggggatcgacggcgacttcaaggcctccctgaccgcctaccacgacttcaaggagatcctgaccggcaccgagctcgccaagaaggacaaggagaacatcatcacgaacatcgtgctgttcggggacgacaagaagctgctcaagaagcggctgaaccgcctgtacccccagatcacccccaaccagctcaagaagatctgcgccctgagctacaccggctgggggcggttctccaagaagttcctggaggagatcaccgcgcccgacccggagacgggcgaggtgtggaacatcatcaccgccctctgggagagcaacaacaacctgatgcagctgctctccaacgagtaccgcttcatggaggaggtcgagacctacaacatggggaagcagaccaagacgctgagctacgagaccgtggagaacatgtacgtgtcccccagcgtcaagcggcagatctggcagaccctgaagatcgtgaaggagctcgagaaggtgatgaaggagtcccccaagcgcgtcttcatcgagatggcccgggagaagcaggagagcaagcgcaccgagtcccggaagaagcagctgatcgacctgtacaaggcctgcaagaacgaggagaaggactgggtgaaggagctcggcgaccaggaggagcagaagctgcgcagcgacaagctgtacctctactacacccagaagggccggtgcatgtactccggggaggtgatcgagctgaaggacctgtgggacaacacgaagtacgacatcgaccacatctacccccagagcaagaccatggacgacagcctcaacaaccgcgtcctggtgaagaagaagtacaacgccaccaagtccgacaagtacccgctgaacgagaacatccggcacgagcgcaagggcttctggaagtccctcctggacgggggcttcatcagcaaggagaagtacgagcgcctgatccggaacaccgagctcagccccgaggagctggcgggcttcatcgagcgccagatcgtggagacgcggcagtccaccaaggccgtcgccgagatcctgaagcaggtcttccccgagagcgagatcgtgtacgtgaaggccgggaccgtgtcccgcttccggaaggacttcgagctcctgaaggtgcgcgaggtcaacgacctgcaccacgcgaaggacgcctacctcaacatcgtggtgggcaacagctactacgtcaagttcaccaagaacgcctcctggttcatcaaggagaaccccgggcggacgtacaacctgaagaagatgttcaccagcggctggaacatcgagcgcaacggggaggtggcctgggaggtgggcaagaagggcaccatcgtcaccgtgaagcagatcatgaacaagaacaacatcctggtgacgcggcaggtccacgaggccaagggcggcctcttcgaccagcagatcatgaagaaggggaaggggcagatcgcgatcaaggagaccgacgagcgcctggcctccatcgagaagtacgggggctacaacaaggccgccggcgcctacttcatgctggtggagagcaaggacaagaaggggaagaccatccggaccatcgagttcatcccgctctacctgaagaacaagatcgagtccgacgagagcatcgcgctgaacttcctcgagaagggccgcgggctgaaggagcccaagatcctgctcaagaagatcaagatcgacacgctgttcgacgtggacggcttcaagatgtggctgtccgggcggaccggcgaccgcctcctgttcaagtgcgccaaccagctgatcctcgacgagaagatcatcgtcaccatgaagaagatcgtgaagttcatccagcggcgccaggagaaccgggagctgaagctgagcgacaaggacggcatcgacaacgaggtgctcatggagatctacaacaccttcgtcgacaagctggagaacacggtgtaccgcatccggctgtccgagcaggccaagaccctcatcgacaagcagaaggagttcgagcgcctgagcctggaggacaagagctccaccctcttcgagatcctgcacatcttccagtgccagagctccgccgccaacctgaagatgatcgggggccccgggaaggcgggcatcctcgtgatgaacaacaacatcagcaagtgcaacaagatctccatcatcaaccagagccccaccgggatcttcgagaacgagatcgacctgctgaagatctga

SEQ ID NO: 1825 - RNA, 4023 nt, synthetic construct
  misc_feature 1..4023: note = Cas9 variant
  source 1..4023: mol_type = other RNA
atgggcgaggagtacttcctggggctcgacatgggcaccgggagcctgggctgggccgtgaccgacgacaagtaccagatcctgcgccggcacgggaacgccctctggggcgtccgcctgttcgagacggcgaacaccgccgaggagcggcgcatgttccggaccaaccgccggcgcctggaccggcagggctggcgcatcaagatcctccaggagctgttcgccgaggagatctgccgggtggaccccgggttctacctgcgcatgaaggagtccaagtactacccggaggacaagcgggacgccaacggcgagtgccccgccctcccctacgcgctgttcgccgacgcccagtacaccgacaaggactaccaccgcgagttccccacgatctaccacctccggaagatgctgatggagaccgagaccaccccggacatccgcctggtgtacctggccttccaccacatgatgaagcaccgggggcacttcctcctgagcggcgacatctcccaggtcacggagttccgcaacaccttcctgcagatgatcgcgaacatcaagagcgaggagctcgacttctccctggagatcgaggagacccagatggggcagatcgaggccgtgctgaaggaccacaagctcacccggagcgagaagaagcgccggctgacgcagatcctgaagcccgccaccgcctgcgagaaggccatcttcaccctcctgtccggcggcaccgtgaagctgagcgacatcttcgggaaggcggagctcgacgagggcgagcgccccaagatctccttcgccgacaacgggtacgacgactacagcgcctccgtcgaggccgacctgggcgagcagtactacatcatcgagagcgccaaggcggtgtacgactggtccgtgctgagcgacatcctcggcgactccgtcagcatctccgacgccaaggtgaagctgtacgagaagcacaagaaggacctggcctacctcaagaaggtggtccgcgagaacctgccccgggaggtgtacaaccaggtgttcgtcaacacggacgagaagctgtgcaactactgcgcctacatcgggatggccaagaagaacggccgcaaggtggcgctcgaggggaagcggtgcacccgcgaggagttcgagagcttcctgcggaagaagatcgtgaacaagatcgaggacaaggagatccaggagtacctgtccgaggagatcgagaagggcaccttcctcccgcgccaggtcaccaaggacaacggggtgatcccctaccagatccacctgtacgagctgcggaagatcatcgacaacctcagcccccgcatgcccttcatccgggacaacggcgacaagatcatccagctgttcacgttccgcatcccgtactacgtgggccccctggggaagggcgaggggagcgagaagttctcctgggccgtccggcgcaccgacgaggccatctacccctggaacttcaaggacgtgatcgacgtggaggccagcgccgagaagttcatctgccggatgaccaacaagtgcacctacctctacggcgaggacgtcctgcccaaggactccccgctgtacagcaagttcatggtgctcaacgagctgaacaacctgaagctggacgggcagtccgtcagcgtggagctcaagcagcgcatctaccaggagctgttctgccacacgcggaaggtgacccagaagaagctggtctcctacctcgtgcgcgagggcatcaccggcaagaacgtggagatcagcgggatcgacggcgacttcaaggcgtccctgaccgcctaccacgacttcaaggagaagctgacgggggtcgagctcagccagcaggagcaggaggagatcgtgcggaacatcgtgctgttcggcgaggacaagaagctgctcaagcagcgcctggaggggcggttcccccagctgacccagaagcagatctccgtcatcgccaccctcagctacaagggctggggccgcctgtcccgcgagttcctggagaacatcaccgtgcccgcccccgggacgggcgaggtgtggaacatcatcaccgcgctctgggagaccaacgacaacctgatgcagctgctctacggggagtacggcttccagaccgagatcgagtgcttcaacgccaaggagaagaagaagtccctgagctacgagacgatcgaggagagctacgtctccccgagcgtgaagcggcagatctggcagaccctccaggtggtcaaggagctgaagaaggtgatgcgcggcgaccccaagcgggtgttcatcgagatggcccgcgagaaccaggagtccaagcggaccgagagccgcaagaagaccctgctggacctctacaagaactgcaagaaggaggagcccgagtggatcgccgagctgaccgagcacctggagaagctcgacgacagccagctgcggaaggacaagctgttcctctactacacgcagaaggggcgctgcatgtactccggcgagcggatcgagctggaggacctgtgggacaacacccgctacgacatcgaccacatctacccccagagcaagaccatggacgactccgtcgacaaccgggtgctcgtgaagaaggagtacaacgccaagaagaccgacgtctacccgatcgcggccgacatccgcgggaagatgagccccttctggaagaagctgctggacaacaagctcatctccaagaagaagtacgaccggctggtgcgcacggaggagctgacccccgaggagctcgccggcttcatcgaccggcagctggtggagacccgccagagcaccaaggtcgtggccgagatcctgaaggaggccttccccgacacggagatcgtgtacgtcaaggcggggaacgtgtccaacttccggcacatgttcgacatcgtgaaggtccgcgagctcaacgacctgcaccacgccaaggacgcctacctgaacatcgtggtgggcaacgcctactacgtcaagttcaacaagaacgccgcgtggttcatcaaggagaacccgggccggagctacaacctcaagcgcatgttcgactacgacatccggcgcaacaacgaggtggcctggctggccgggtccaccggcaccatcagccaggtgaagaacatggtctccaagaaccacatcctggtgacccgcaagagctacgaggtgaccgggggcctcttcgaccagcagctgatgaagaaggggaagggccaggtccccgtgaagacgtccgacgagcggctgggcaacatcgagaagtacgggggctacaacaaggccagcggggcgtacttcatgctcgtgaagtccaagaacaagaagggcgaggagcagcgcaccatcgagtacgtccccatctacctgaagcactacatcgaggagagcaaggagaacgccctggactacctcaagaacgagcggaagctgaacgagccggagatcctgctcgacaagatcaagaaggacaccctgttccgcgtgaacgggttctacatgtgcctgtccaagcggacgggcaagcagctcgccttcaagggcgccaacgagctgctgctccccgagcccgagaccctgctgctcaagaagatcaccaagtacatccagcgccggaaggagaacaaggacctgaagctgaccaagcaggacaacatcacggagaaggagctcctggagctgtacgacgtgttcaccgagaagctcaaccacagcgtctacgccgtgtgcctggggacccagggcaagaccctggtgcagaagaagcccgcgttcgtcgccctcccggtggaggagaagtgcatcgtgctgagcgagatcctgcacctcttccagtgccagtccgggagcgccaacctgaagctgatcggcgggcccgcctccgccggcatcctctacctgaacagcaacatctccgacgcgggcgagatcctgatcatcaaccagagcccctccgggatcttcgagaagcgcatcgacctcctgcggctgtga

SEQ ID NO: 1826 - RNA, 4023 nt, synthetic construct
  misc_feature 1..4023: note = Cas9 variant
  source 1..4023: mol_type = other RNA
atgaagaaggagtacaccatcggcctggacatcgggaccaacagcgtgggctggtccgtcctcacggacgactaccgcctggtgagcaagaagatgaaggtggccgggaacaccgagaagtccagcaccaagaagaacttctggggcgtccggctgttcgacgaggggcagaccgccgaggcgcgccggtccaagcgcacggcccggcgccggctcgcccgccggcgccagcggatcctggagctgcagaagatcttcgcccccgagatcctcaagatcgacgagcacttcttcgcccgcctgaacgagagcttcctggtgccggacgagaagaagcagtcccggcaccccgtgttcgcgaccatcaagcaggagaagtcctaccaccagacctaccccaccatctaccacctccgccaggccctggccgacagcagcgagaaggccgacatccggctggtctacctcgcgatggcccacctcctgaagtaccgcggccacttcctgatcgagggcgagctgaacacggagaactccagcgtgaccgagaccttccggcagttcctgtccacctacaaccagcagttcagcgaggccggggacaagcagacggagaagctcgacgaggccgtggactgctccttcgtcttcaccgagaagatgagcaagaccaagaaggccgagaccctgctgaagtacttcccccacgagaagtccaacggctacctcagccagttcatcaagctgatggtggggaaccagggcaacttcaagaacgtgttcgggctggaggaggaggcgaagctccagttctccaaggagacgtacgaggaggacctggaggagctgctcgagaagatcggcgacgactacatcgacctgttcgtccaggccaagaacgtgtacgacgccgtgctgctcagcgagatcctgagcgactccaccaagaacacccgcgccaagctgagcgccggcatgatccggcgctacgacgcgcacaaggaggacctcgtcctgctgaagcggttcgtgaaggagaacctcccgaagaagtaccgcgccttcttcggggacaactccgtgaacggctacgccgggtacatcgagggccacgccacccaggaggccttctacaagttcgtcaagaaggagctgacgggcatccgcgggagcgaggtgttcctgaccaagatcgagcaggagaacttcctccggaagcagcgcaccttcgacaacggcgtgatcccccaccagatccacctgtccgagctgcgggcgatcatcgccaaccagaagaagcactaccccttcctcaaggaggagcaggagaagctggagagcctgctcaccttcaagatcccctactacgtcgggccgctggccaagaagcaggagaactcccccttcgcctggctgatccgcaagagcgaggagaagatcaagccctggaacctccccgagatcgtggacatggagggctccgccgtgcggttcatcgagcgcatgatcaacacggacatgtacatgccgcacaacaaggtcctgcccaagaacagcctgctgtaccagaagttctccatctacaacgagctcaccaaggtgcggtaccaggacgagcgcgggcagatgaactacttcagctccatcgagaagaaggagatcttccacgagctgttcgagaagaaccggaaggtcaccaagaaggacctgcaggagttcctctacctgaagtacgacatcaagcacgcggagctgagcggcatcgagaaggccttcaacgcctcctacaccacgtaccacgacttcctcaccatgagcgagaacaagcgcgagatgaagcagtggctggaggaccccgagctggcctccatgttcgaggagatcatcaagaccctcaccgtgttcgaggaccgggagatgatcaagacgcgcctgagccaccacgaggcgaccctgggcaagcacatcatcaagaagctcaccaagaagcactacaccgggtggggccggctgtccaaggagctgatccaggggatccgcgacaagcagagcaacaagacgatcctcgactacctgatcaacgacgacgacttcccccaccaccggaaccgcaacttcatgcagctgatcaacgacgacagcctctccttcaagaaggagatcaagaaggcccagatgatcaccgacaccgagaacctggaggagatcgtgaaggagctgaccggcagcccggccatcaagaaggggatcctccagtccctgaagatcgtcgacgagatcgtgggcatcatgggctacgagcccgccaacatcgtggtcgagatggcccgggagaaccagaccacggggcgcggcctcaagagctcccggccccgcctgaaggcgctggaggagagcctgaaggacttcgggtcccagctcctgaaggagtaccccaccgacaacagctccctgcagaaggaccgcctctacctgtactacctgcagaacggccgggacatgtacaccggggccccgctcgacatccaccgcctgagcgactacgacatcgaccacatcatcccccggtccttcaccacggacaacagcatcgacaacaaggtgctggtgtccagcaaggagaaccgcctcaagaaggacgacgtcccctccgagaaggtggtgaagaagatgcggagcttctggtacgacctgtactccagcaagctgatcagcaagcgcaagctcgacaacctgaccaagatcaagctgaccgaggaggacaaggccggcttcatcaagcggcagctcgtcgagacccgccagatcacgaagcacgtggccggcatcctgcaccaccggttcaacaaggccgaggacaccaacgaccccatccgcaaggtgcggatcatcaccctgaagtccgcgctcgtcagccagttccgcaaccggttcgggatctacaaggtgcgcgagatcaacgagtaccaccacgcccacgacgcctacctgaacggcgtggtcgccctggccctcctgaagaagtacccgcagctggcgcccgagttcgtgtacggggagtacctcaagttcaacgcccacaaggccaacaaggccaccgtgaagaaggagttctactccaacatcatgaagttcttcgagagcgacacgcccgtctgcgacgagaacggcgagatcttctgggacaagtccaagagcatcgcccaggtgaagaaggtgatcaaccaccaccacatgaacatcgtcaagaagaccgagatccagaagggcgggttctccaaggagaccgtggagcccaagaaggacagctccaagctgctgccgcggaagaacaactgggaccccgcgaagtacggcgggctcggcagccccaacgtggcctacaccgtcgccttcacgtacgagaaggggaaggcccgcaagcggaccaacgcgctggagggcatcaccatcatggagcgcgaggccttcgagcagtccccggtgctgttcctcaagaacaagggctacgagcaggccgagatcgagatgaagctgcccaagtacgccctgttcgagctcgagaacgggcggaagcgcatggtggccagcaacaaggaggcgcagaaggccaactccttcctgctgcccgagcacctcgtcaccctgctgtaccacgccaagcagtacgacgagatcagccacaaggagtccttcgactacgtgaacgagcaccacaaggagttcagcgaggtgttcgcccgggtcctcgagttcgccggcaagtacacgctggcggagaagaacatcgagaagctggagaagatctacaaggagaaccagaccgacgacctcgccaagctggcctccagcttcgtgaacctgatgcagttcaacgccatgggggcgcccgccgacttcaagttcttcgacgtgaccatcccgcgcaagcgctacacctccctcacggagatctggcagagcaccatcatccaccagagcatcaccggcctgtacgagacccggatccgcatggggaagtga

SEQ ID NO: 1827 - RNA, 4023 nt, synthetic construct
  misc_feature 1..4023: note = Cas9 variant
  source 1..4023: mol_type = other RNA
atggagcaggagtactacctgggcctcgacatggggaccggcagcgtggggtgggccgtcaccgactccgagtaccacgtgctgcgcaagcacggcaaggccctgtggggcgtgcgcctcttcgagagcgcgtccacggccgaggagcggcggatgttccgcaccagccggcgccggctggaccgccggaactggcgcatcgagatcctgcaggagatcttcgccgaggagatctccaagaaggaccccgggttcttcctccggatgaaggagagcaagtactacccggaggacaagcgcgacatcaacggcaactgccccgagctgccctacgccctgttcgtcgacgacgacttcaccgacaaggactaccacaagaagttccccaccatctaccacctccggaagatgctgatgaacacggaggagaccccggacatccgcctggtgtacctcgccatccaccacatgatgaagcaccgggggcacttcctgctgtccggcgacatcaacgagatcaaggagttcgggaccaccttcagcaagctcctggagaacatcaagaacgaggagctggactggaacctcgagctgggcaaggaggagtacgcggtggtcgagtccatcctgaaggacaacatgctcaaccgcagcacgaagaagacccggctgatcaaggccctgaaggccaagtccatctgcgagaaggccgtgctcaacctgctggccgggggcaccgtgaagctcagcgacatcttcggcctggaggagctgaacgagaccgagcgccccaagatctccttcgcggacaacgggtacgacgactacatcggcgaggtcgagaacgagctcggggagcagttctacatcatcgagacggccaaggccgtgtacgactgggccgtgctggtcgagatcctgggcaagtacaccagcatctccgaggcgaaggtggccacctacgagaagcacaagagcgacctccagttcctgaagaagatcgtgcggaagtacctgaccaaggaggagtacaaggacatcttcgtctccacgagcgacaagctcaagaactactccgcctacatcggcatgaccaagatcaacgggaagaaggtggacctgcagagcaagcgctgcagcaaggaggagttctacgacttcatcaagaagaacgtgctgaagaagctcgagggccagcccgagtacgagtacctgaaggaggagctggagcgggagaccttcctccccaagcaggtcaaccgcgacaacggggtgatcccgtaccagatccacctgtacgagctgaagaagatcctcggcaacctgcgcgacaagatcgacctgatcaaggagaacgaggacaagctcgtgcagctgttcgagttccggatcccctactacgtcgggcccctgaacaagatcgacgacggcaaggagggcaagttcacctgggccgtgcgcaagtccaacgagaagatctacccctggaacttcgagaacgtggtcgacatcgaggccagcgcggagaagttcatccggcgcatgacgaacaagtgcacctacctgatgggggaggacgtgctcccgaaggactccctgctgtacagcaagtacatggtcctcaacgagctgaacaacgtgaagctggacggcgagaagctctccgtggagctgaagcagcggctgtacaccgacgtcttctgcaagtaccgcaaggtgaccgtgaagaagatcaagaactacctcaagtgcgaggggatcatcagcggcaacgtcgagatcacggggatcgacggcgacttcaaggcctccctgaccgcctaccacgacttcaaggagatcctgaccggcaccgagctcgccaagaaggacaaggagaacatcatcacgaacatcgtgctgttcggggacgacaagaagctgctcaagaagcggctgaaccgcctgtacccccagatcacccccaaccagctcaagaagatctgcgccctgagctacaccggctgggggcggttctccaagaagttcctggaggagatcaccgcgcccgacccggagacgggcgaggtgtggaacatcatcaccgccctctgggagagcaacaacaacctgatgcagctgctctccaacgagtaccgcttcatggaggaggtcgagacctacaacatggggaagcagaccaagacgctgagctacgagaccgtggagaacatgtacgtgtcccccagcgtcaagcggcagatctggcagaccctgaagatcgtgaaggagctcgagaaggtgatgaaggagtcccccaagcgcgtcttcatcgagatggcccgggagaagcaggagagcaagcgcaccgagtcccggaagaagcagctgatcgacctgtacaaggcctgcaagaacgaggagaaggactgggtgaaggagctcggcgaccaggaggagcagaagctgcgcagcgacaagctgtacctctactacacccagaagggccggtgcatgtactccggggaggtgatcgagctgaaggacctgtgggacaacacgaagtacgacatcgaccacatctacccccagagcaagaccatggacgacagcctcaacaaccgcgtcctggtgaagaagaagtacaacgccatcaagtccgacaagtacccgctgaacgagaacatccggcacgagcgcaagggcttctggaagtccctcctggacgggggcttcatcagcaaggagaagtacgagcgcctgatccggaacaccgagctcagccccgaggagctggcgggcttcatcgagcgccagatcgtggagacccggcagtccacgaaggccgtcgccgagatcctgaagcaggtcttccccgagagcgagatcgtgtacgtgaaggccgggaccgtgtcccgcttccggaaggacttcgagctcctgaaggtgcgcgaggtcaacgacctgcaccacgcgaaggacgcctacctcaacatcgtggtgggcaacagctactacgtcaagttcaccaagaacgcctcctggttcatcaaggagaaccccgggcggacctacaacctgaagaagatgttcacgagcggctggaacatcgagcgcaacggggaggtggcctgggaggtgggcaagaagggcaccatcgtcaccgtgaagcagatcatgaacaagaacaacatcctggtgacccggcaggtccacgaggccaagggcggcctcttcgaccagcagatcatgaagaaggggaaggggcagatcgcgatcaaggagacggacgagcgcctggcctccatcgagaagtacgggggctacaacaaggccgccggcgcctacttcatgctggtggagagcaaggacaagaaggggaagaccatccggaccatcgagttcatcccgctctacctgaagaacaagatcgagtccgacgagagcatcgcgctgaacttcctcgagaagggccgcgggctgaaggagcccaagatcctgctcaagaagatcaagatcgacaccctgttcgacgtggacggcttcaagatgtggctgtccgggcggacgggcgaccgcctcctgttcaagtgcgccaaccagctgatcctcgacgagaagatcatcgtcaccatgaagaagatcgtgaagttcatccagcggcgccaggagaaccgggagctgaagctgagcgacaaggacggcatcgacaacgaggtgctcatggagatctacaacaccttcgtcgacaagctggagaacaccgtgtaccgcatccggctgtccgagcaggccaagacgctcatcgaccgccagaaggagttcgagcggctgagcctggaggacaagagctccaccctcttcgagatcctgcacatcttccagtgccagagctccgccgccaacctgaagatgatcgggggccccgggaaggcgggcatcctcgtgatgaacaacaacatcagcaagtgcaacaagatctccatcatcaaccagagccccaccgggatcttcgagaacgagatcgacctgctgaagatctga

SEQ ID NO: 1828 - RNA, 4026 nt, synthetic construct
  misc_feature 1..4026: note = Cas9 variant
  source 1..4026: mol_type = other RNA
atgcgcttccagaacaagaagaccggcgactacttcgtggggctggacatcggcaccaacagcgtcgggtgggccgtgacgaacgagaagtacgagatcctccgggccaagaaccaccgcatgtggggctcccggctgttcgaggaggggaagaccgcggaggagcgccgggtgcaccgcgccggccggcgccggctgaaccgccggaacgaccgcctcatgatcctggaggacctgttcgccgaggagatcagcaaggtcgacaaggccttctaccagcggctccacgagtcccagtaccgccaggagcacaagaccgtgagcggcccctacttcctgttcaacgacaaggagttcaccgacgaggactaccacatcgactacccgacgatctaccacctccgggtggccctgatgaaggcgcccgccaaggacgtccgcctgctgttcctcgccatccaccacatcatcaagtaccgggggaacttcctgcacgagggcgagaccttcaagaccaccgggggcctgacggacatcctccagcgcgtgctggcctgcaacgagttctccgggctgaagcagcacatcgacgacaccgcgctcgtgaagctgctgaccaacaagggcatcacccggagcgacatcgccaagcagatctccgagctcgccacggacaagctgtaccgcaagcaggccaaggccttcgcgagcctggtcctcggcctgaaggccaacctggacgacctcttcaacgagcccgagtacaaggagctggactccgagatccggaccgtggagttcagcgggaaggagtactgggaggagcgcgacaagtacgagccctacctgggcgagtccctcttcgccctggacgggtgcaagaccctgtacgacaccctcctgctgagcaacatcaagccggacggcaagtacctctccgaggccaaggtggagacgttcgagaagcaccacgagcacctggagagcctgaaggacctcctgaagtccaacaaggccctgtacaaccgcgtcctccgggacgacgagaagaacctgaacaactacatcacctacatcggcaagagcgagttcaacaagcgctgctcccgggacgagttctacaagttcctgaagcagaccatcaaggacatcagcgacaacgagaacaaggcggagatcgtgcagctcatggagctggactccttcctgcccctcctgcgcgtgcgggagaacggggtcatcccctaccagatccacgaggaggagctggagcagatcctgaacgtgagcagcgagaagtaccccttcctcaacaaggccgacggctccgggttcaccatcgcccagaagatcctgaagctgctcacgttccgcatcccgtacttcgtgggccccctgaaccccgcccacaaggaccgggacaacgggttcgcctgggtcgtgcgcaaggcgcccggcaaggtgtacccgtggaacttcgaggacaaggtcgacatcagcgcctccgccaccgccttcatcgagaacctgaccaacaagtgcacctacctcatcggcgaggacgtgctgcccaagtacagcctggcctactccaagttcagcctcctgaacgagctgaacaacctccggtacgacgggaagcccctgtcctacgagacgaagcagagcttcatcaaggactgcttcgagaaggagcaccgcaagatgaccgagaagcggatccgcgagttcctgaagcacctcggcgggaccgacggcaagggggcgctgaccggcctggacgtggacatcaagtccgacctcaagagctaccgggacatggtccgcatcctgggcgacgggttcgacgagacgatggccgagcggatcatccgctacgtgaccctgttcggcgaggccaagaaggtcctcctgtccaccctggagatcgagttcggggacgacctcagcgacacccagaagaagcagatcctgaagctgcagtaccgggactggggccgcctctccgccacgctgctgaaggggatcaagggcgtggcgggcgacaaccccgagtgcagcatcctcgagtgcatggagcagcagccgctgaacctgatggaggtgctctccagccacaacacctacctggccgccatcgaggagttcaacaaggagcggaccgagcccaccgacatcgtcgactacaagctggtggacgacctctacatctcccccgccgtgaagcgcagcgtctggcagacgctgcgcatcctggacgagatcaccaagctccgggggtccgtgcccaagaaggtgttcgtcgaggtggcccgcaccaaccgggcggagaagaagaagaccgacagccgcaaggagcggctgctgcagctctacaagaccatcaaggacgagggccgcaactggacggaggagatcaagcagcgggacgccggggacttcaacagcaagaagctgttcctgtactacacccagcagggccgctgcatgtactccggcgagaagatcaccagcatcggggacctcttcacctccaagtacgacatcgaccacatctacccgcggagcgtgacgaaggacaactcctgggacaacctggtcctggtgaaggccgagctcaaccgcgagaagaaggacatctaccccatcgagaaggacacccaggaccggtgcatcagcctgtggaagcagctgctcgagcagggcctgatctccgagcgcaagtacgagcggctggtgcgcaccacgcccctcaccgccgacgagctggccgacttcgtcaaccggcagctggtggagaccaaccagagcgtgaaggcggtcaccaacctcctgaagcgcctgtaccccgacaccacgatctgctacgtgaaggccgagaacgtgtccgacttccggcaggagcgcgagttcgtcaagctccggagcctgaacgcccaccaccacgccaaggacgcctacctgaacatcgtggtggggaacgtctaccacgagaagttcaccaacaacccgcgcaacttcatcaagaacgcgcggtccgacaagaagcgcccctacagcctcaaccacatgttcgactacctgctccaggtgggcaacaaggagatctggaaccccaagaccgacaacaacctggtgaagaagatgatgcgcaacaacgacgtccaggtgacccggatgctggtggagcagacgggggccctgtacgacgccaccatctacaaggcctccgtcaccaagagcgagtcctacgtgcccctcaagagctccgacgcgatcctgagcgacgtgaagaagtacggcggcttcaccagcatcaagatcgcctactactccatcttccgcttctacaagaagaacagcgaggagttcgagacgcacatcatctccatcccggtcctgaaggccgggaccctcaacagcaaggaggactacgtggcctacggcgaggagatcatgaacaagcagaagttcgaccgggtggagctggtctacaagaagctgtgcatgaactccctcgtgcgcatcaacggggtgatgtactacctgggcgggaagaccaacaacagcctgtacatcgactccgccatcagcctcgtcctgcccgacaacatcgcgaagaagatcaaggccgtggagaagtacatcgcccgggtggccgagaacggcaactacaagccccagccggaccaggtctcccccgagttcaacatgatcatctacaaggccctgaccgagaagatgaagcagcccgcgttcgtgggcctcaagacgaaccgcgagaacgagctggagaaggagaccaccatcaccgccttcatcgccatgacgctgatcgagcagtgcaagatgctcatggagatcctgaacctgctcacccagcagaagaccacctacgccctgaagcccatcggggtgagcgcctcccggagcacgctgggcatgaacatcaccgggctctccgagttcaccatcatcacccagagcgtcacgggcctgcaggagaaggagatccgcatcatctga

SEQ ID NO: 1829 - RNA, 4026 nt, synthetic construct
  misc_feature 1..4026: note = Cas9 variant
  source 1..4026: mol_type = other RNA
atgtggggcagccgcctgttcgaggaggcctccaccgcccaggaccggcgcgagcaccggagcaaccgccggcgcctcgagcggcgcaagtaccggctggacctgctcgaggagctgttcgtggaggagatcaacaagatcgaccccgagttcttcatccgcctgcgggagtccaagttccacttcgaggaccgcagcctcaagaacaccttcatcctgttcaacgacaagatggagggcgggtacaacgacaaggtcttcttctccaagtacccgacgatctaccacctccggagcgcgctcatcaacgggaacaaggaggacgtgcgcgccgtgttcctggccatccacaacatcctgaagaaccggggccacttcctcctggccgggaacgacatcaacatctccctgagcctcaacgacaccctgaccgacctgttcgagtacctcaagatccacctgggcatcgaggtcgagttcgagaacaagctgaaggacatcgagaagatcgccctcgacaagaacctgtccaagagcgacaagcagaagaagatcgtgcagctgctcgagaccgactacaagaagcagctggcggacgtgttcaagctgtccctcggcctgacggccaacatggagaacatcttcgggaaggagaacgagcagggcctggagttcatcaacgccgagaacaagatcaagaagatccagttcgacagctcctacgaggagaacatcgccgagttcgaccagttctacggggagtacttcgagatcatcgacatctgcaagaagatctacgacgcgatcagcctctcccagatcctggtcgacggcaaggggctgagcgagtccaaggtgctcagctacgagaagcacaaggaggacctgaagctgctcaagaaggtgctgaagaacatcgacaaggcctacgacaacaagggcgaggaccgcctggtctacaaggtgctcaaggaggacaaggacaagggcaccaactacgtgaactactccaagctgagcaacaacgggaccgccaccacgaaggaggagttctacaagttcctgagcaagaacctcgacctgaagaagttcggcaagctgaacaaggaggacatcgagaccctcgactacatcaactccgagatcctgctggggcggttcctccccctgcagaaggagaagatcaacggcgtcatcccctaccagctgcagatgaaggagctgacccagatcctcaacaacgccagcaagtacctgcccttcctgaacaagatcgaggacggcatgaccgtgaaggacaagatcatctccctcatcaagttccgcatcccgtactacgtggggcccctgaacgagtacaaccggatcgagaacggcaacgggttcgcctggatcgagaagaagaagaacgagaagatcttcccctggaacttcaacgacgtcgtggacatcgagaagtccgcggagaagttcatcaacaacctgacgaacaagtgcacctacatcaaggaggagaccgtgctccccaagaacagcatcatctacagcaagttcatggtcctgaacgagctgaacaacctccagtacggcaacaagaagctggacatcgagctgaagatgaagatgtacaccgacctcttcctggagaagaaggacaaccgcaaggtgacggagaagcggatcctggagtacttccgcatcaacgggatcaacgacggcaaggagaagctcaccggcctgaacaacgagatccacgccgacatgaagtcctaccgcgacatgtgcgagatcatgggggagaacttcaacatcaacgtggccgagaacatcatcaactggatcaccgtcttccacggcgagaagaagatcctgatcaacaagatcaagaacgtgtacgggaagatgttcaacgacgagcagatcagcaagctctccaagctgaactacagcgactggggccggctgtccaagaagctcctgaccgacatcaagtgctacatcgacgccgacgggatcaacttcccggtgagcatcctggaggccatggaggtctccaacaagaacctcatggagctgctgagcaacaagtacgagttcatctcctgcatcgacgacatcaacaacaagtacttcggcgaccgcgacatcagcgcgtccgagctcatcgacgagctgtacgtgagccccgccgtcaagcggggcatctggcagtccgtgcgcatcctggaggagatcgtgagcatcatcgggcacaaccccaagaagatcttcatcgagatgacgcggcacaacgaggagaaggtccagaagtccagccgccggcacaacctcgaggagctgtacaaggccatccgcaaggaccccgagtacgtggagctgatcaaggagttcgacagcaccaccgacaccgactccttcaagatcaagaagctctacctgtacttcatgcagctgggcaagtgcgcctacagcaaggagaagatcgacttcgacaagctgttcacggactcctacgacatcgaccacatctacccgcggagcaagaccaaggacgactccatccacaacaacctggtgctggtcaaggccaagtacaaccgcgagaagaccgacgtgtaccccatcgacatcaacatccagaagaacatgaacagcttctggaacttcctctacaccaagaagttcatcacggaggagaagtacaagcggctgatccgcacctccgacctgaccgacgaggagctcgcgaagttcatcagccggcagctggtggagacctcccagagcacgaaggccaccgccgaggtcctgaagcagatctacggggactccgacatctgctacgtgaaggccgagaacgtgagcgacttccgctacggctccagccggcagaaggacaagaacgacatccagaagctgttcgtcaagtgccgcgaggtgaaccacttccaccacgccaaggacgcgtacctgaacatcgtggtcgggaacgtgtacgacgtgaagttcaccaagaaccccgtcaacttcatcaagaagaacaagatgggcaacaagtccaactacagcctgaaccacatgttctgcttcgacgtggagcggaacggctacaaggcctgggacagctccgagaccatcaagacggtggggcgcatgatgaagtccaacgacgtccggatcaccaagcacgtgcaccccacccgcggcgagctctacgacgccaccatctacaaggccaagatcgcgaagaccgggagctacatgccgctcaagagctccaagaacacgcccctgagcgacgtgaccaagtacggcggctacaccaagatcaagatcgcctactactccgtctacaagtacaagttcagcgacaagaacctcatcaagaccgagatccgcctgatccccatccccatctacctgtccaagaacgacgacgacatcaaggagtacgtgaagaactacctcaacgaccgggtgaacagcaagctgatcgacttcacgaagatctacgacaagctgtacgtcaactccctcatcaagatcaacgggtacctgtactacctgggcgggaagaccaacgaccgcgtgtggatcgacaacgccgtgagcatcgtcctcgacgacaagatcgagtacctgatcaagcggatctccaacgacatcaagtacggctacgagatcaacgtgagcgacgacgagctgatggacatctacgagtccctcgccgagaaggccaacaagaagatcttctacaaccgcctgagcgacttcgagaagatcttctccaacatggacgtgaagaagaagttcgtcaagctggagaagaacgacaagtgccgggtgctcctgcagctgctcaacgtgctgaccgacagccagaccacgtacaagctggagatggtcgggctcaagcactcccgcagcaacatcggcatgaagatcagcaacctggaggagttcaaggtgatcaactccagcatcaccggcctgtactccaacgagatcgacatcctcaacatctga

SEQ ID NO: 1830 - RNA, 4026 nt, synthetic construct
  misc_feature 1..4026: note = Cas9 variant
  source 1..4026: mol_type = other RNA
atggagaaggactactacctgggcctcgacatggggagcggctccgccgggtgggccgtgaccgacgaccagtaccacgtgctgcgcgcgcacggcaaggccatgtgggggacccggctgttcgagagcgccaacacggccgaggagcgccggatcaaccgcaccgcccggcgccggctcaagcgccggaaccagcgcatcgagtggctgcaggagatcttcgcggaggagatcaacaccaaggactccggcttcttccggcgcatgaaggagagccggtactgggccgaggacaagcgcgacgagaacggctcctgccccgagatgccgtacagcctgttcatcgacgaggacttcaccgacaaggagtaccacgagaagttccccacgatctaccacctccggaagtacctgatgaccaccgaggagacccccgggatccgcctggtgtacctcgccttccaccacatgatgaagcaccggggccacttcctgctgaacgggaacatcgaggagatccgcaagttccggaagacgttcgaccagttcctcgaggtggtccgcaacgaggagatgggcttcgccggggagatcgaggaggagacctacaagaagatcgagatgaccctgaaggacgtgaacctgacccggtccgcgaagaagacgaccctcatcaagagcctgaaggtgacccgcgtcgaggagaaggagctgctcgccctgatctccggctgcaccgtgaagctgagcaacatcttcaacgacaagtccctcgacgagacggagcgccccaagatcagcttcgccgacgccggcttcgacgactacgaggccgagatccagtccaacctgaacgagaagtactacatcatcgagagcgcgaaggccgtgtacgactgggccgccctggccgacatcctcggggagtactcctgcatcagcgaggcgaaggtcgccctgtacgagaagcaccacaaggacctgaagcggctcaaggacctggtgcgcaacaacatctccagcgaggtgtacaaggagatcttcgtcgacgtgtccggcaagtacaagaactactgcgcctacatcgggaccaccaacatcaacggcaagaagaaggacttcgagggcaagaagtgcaccaaggaggacttctacgcctacctgaagaagtccgtgatcgagtgcatcaacgacagcgagaagacggactggctcaagctggagctggagaaggggaacttcctcccgaagcagctgaccggcgagaacagcgtcatcccctaccaggtgcacctgtacgagctcaacgccatcatcaccaacctgcaggagcggatccccctgctcaagcgcgacggggagaagatccggcagatcttcaccttccgcgtgccctactacgtcggcccgctgaacgggatcagcatcgacggcaagaagacgaactgggtgaagcggaaggagggcgtgatctacccctggaacttctccgacatcgtcgacgaggagagctccgcggagagcttcatccgccggatgaccaacaagtgcacctacctgatccacgaggacgtgctccccaagtactccctgctgtacagccgcttcgaggtgctcaacgagctgaacaacgtccggctgaacggggagctcctgtccgtggagctgaagcagaagatctacgaggacgtcttccagcgctaccggaaggtgacccagaagcgcctgaagcggtacctcctgacggagggcatcatcgacgagaacaccgtgatcaccgggctggacggcgacttcaaggggagcctcaccgcctaccacgacttcaaggagaagctgacgggcctgaacctcaccgagcgcgagaaggaggagatcatcctgaacatcaccctgttcggcgacgcccggtccctcctgcgcaagcggatcgggaagatctgcagccagctgtccgacaagcagaaggagaacctcagcaagctgtcctaccagggctgggggcgcctgagcaagaagttcctcaacggcatcgccatctccgtccagggggaggaggagtggaccatcatcaaggccctgtgggagacgcaggacaacctgagccagctcatgggcgcgaagtacaccttccgcaacgccgtggagaaggagaacggcgagctggagaaccgggagatctcctacgagaccgtgaaggacctgagcatcagcccctccgtcaagcgccaggtgtggcagagcctcctgatcgtgaaggagatctgcaagatccagaagaagccgccccggaaggtcttcgtggaggtggccaaggagaagaccaactccgggcgcaccgagagccggaagaagcgcctgcaggacttctacaagtactgctccaagtacgagaaggagctctacgacgagagcatccagaacaagctggagaagtgctccgagagcgacctgcggtccgacaagctgttcctgtactacatgcagatgggccgctgcatgtacacggggcagcccatcgacttcgacgagctgtggaacaaccagaagtacgacatcgaccacatctacccccagagcaagaccatggacgactccatcgacaaccgggtcctcgtgaagcgcatcagcaaccaggagaagaccgacgtgtacccgatccgggccgacatccgcgagaagcggcgcggcttctggaaggagctgaagaacgtcggcctgatctccgaggagaagtacaagcggctcacccgcgcgacggagttcgagcccgccgagctggccgggttcatcagccggcagctggtggagaaccgccagaccaccaaggtggtcgcctccatcctcaagcaggccatgcccgacaccgagatcgtgtacgtgaaggcgcggacggtcagcgagttccgccacaagttcaacttcatcaaggtgcgggagatgaacgacttccaccacgccaaggacgcctacctgaacgtggtcgtgggcaacacctacctggtgaagttcaccaagtcccccgtcaacttcatcgagaaccacagcaaccgcagctacaacctcaagaagatgttcaccgacgggcgcgtggagcggaacggcgagatcgcctggatctccggggagaacggcacgatcggcaccgtgcgcaacatcatgaagaagaacaacatcctggtcacccggcgcgcccacgaggcgaccgggggcttcttcgaccagcagctgatgaagaaggggaagggccaggtgccggtgaaggggagcgacgagcggctcctggacatcgagaagtacggcggctacaacaaggagacgggggcctacttcgtcctggtggagtccgacgagaagaagggcaagaagaagcgcaccatcgagtacgtgcccatccggctcaagaagcagctggagaacaaccgcaaggccctggagaactacctctgcgagcagcgggggctgaccaaccccgtcgtgctgatcgacaagatcaagatggacagcctcttccgcgtggacggcttcttcatgtggctgtccgggcggaccggcaaccagctcctcttcaagtgcgccaaccagctggtcctgagcacggaggacgaggccaccctcaagaagatcgtgaagttcgtgaaccgccggaaggagaacaaggagatcaagatctacgagtccgacaagctgaacgaggagatgctgaaccgcctctacaacaccttcctgtacaagctgcagaacagcatctacggcaaccggctcggggagcaggcgaagaccctgtccagcaagaaggagaacttcgacaagctgcagatcgaggagaagtgcctcgtcctgtacgagatcctgcacatgttccagtgccagtccgccacgagcgacctccagctgatcgagggccccgggaaggccggcaccctgcgcctcaactccaacatcaccaagtacaagaacatcaacatcatcaaccagagcccgaccgggatctacgagcaggtcatcgacctgcagaagatctga

SEQ ID NO: 1831 - RNA, 4026 nt, synthetic construct
  misc_feature 1..4026: note = Cas9 variant
  source 1..4026: mol_type = other RNA
atgggcaaggggtactacgtgggcctggacatggggaccggcagcgtcgggtgggccgtgaccgacgagtcctaccagatcctccgccggcacggcaaggccatgtggggcgtgcgcctgttcgagagcgcgaagacggccgaggagcggcgcatgttccggaccgggcgccggcgcctggaccggcgcggctggcggatcgagatcctccaggagatcttcgccgaggagatctcccgcgtcgaccccgggttcttcctgcggatgaaggagagcaagtactacccggaggacaagcgcgacatccagggcaactgccccgagctgccctacaccctcttcgtggacaagaccttcacggacaaggacttccacaagaagtaccccaccatctaccacctccggaagatgctgatggagaccgaggacaccccggacatgcgcctcgtgtacctggccctgcaccacatgatgaagcaccgggggcacttcctcctgtccggcgacatcagccaggtcacggagttcaagaacaccttcaaccagttcatcgagaacatccgcaacgaggagatggacttcgagatcgagctggacgagtccgccgtgcagatgatcgaggagaccctcaaggacaagaacctgacccggagcgcgaagaagtccaagctggtgaagggcctcaacgccaagaacgtccgcgacaaggccttcctgacgctgctcagcgggggcaccgtgaagctgtccgacctgttcgggatggaggagctcaacgagggcgagcggcccaagatcagcttcgccgacaacggctacgaggagtacgcggccgtggtcgagatggagctgggggagctgtactacatcgtggagtccgccaaggccgtgtacgactgggccatcctcagcgacatcctgggcgggtccaccagcgtctccgacgcgaaggtgcgcgcctacgagaagcacaaggccgacctgaagtacctcaaggccgtggtcaaggagtacttccccaaggaggtgtacaacgccgtgttcgtcgagagctccgacaagctgaacaactaccccgcgtacatcggcatgaccaagaagaacgggaagaaggtgagcctggagggcaagcgctgcagccgggaggagttcatggacttcctcaagaagaacatcgtggtcaagctgccggacgaggaggccaagatgtacctgcagtccgagctcgagaaggacagcttcctgcccaagcaggtcaacaaggacaacggcgtgatcccctaccaggtgcacaagtacgagctgaagaagatcctcgacaacctgggggacaagatccccttcctgaaggagaacgccgagaagatcgagaagctgttctccttccgcatcccgtactacgtgggccccctgcggacggggaacggcgagaacagcaagttcgcctgggccgagcgcaagtccaccgagaagatctacccctggaacttcgagaacgtcatcgacgtggagcagagcgcggagaacttcatccggcgcatgaccaacaagtgcacctacctgatcggggaggacgtgctccccaaggactccctgctgtacagcaagttcatggtcctcaacgagctgaacaacctgcggctggacggccagaagatctccgtggagctcaagcagaagatctaccgcgacgtgttctgccggagccgcaaggtcacgcagaagaagctgaagtcctacctgatccgggagggcatcgccgggaagaacgtggagctcaccggcatcgacggggacttcaagggcagcctgaccgcctaccacgacttcaaggagaagctgatcgacgtggagctcacccagaaggagaaggaggagatcatcctgaacatcgtcctgttcggggacgacaagaagctcctgaagcagcgcctgaagaagaagttcccgcagctcacggagaagcagatcaacaccgtgaccgccctgtcctacaagggctggggccggctgagcaagaagctcctggaggaggtgaccgtccccgcccccgagacgggggaggtgtggaacatcatcaccgcgctgtgggagaccaacgacaacttcatgcagctcctgtccaaggagtaccagttcagcgaccgcatcgaggagttcaacgaggagaaggccgaccccgaggtgtcctaccagaccatcgaggacctgtacgtcagcccggccgtgaagcggcagatctggcagacgctccagatcatccaggagatcgagaaggtgatgggcgagaagcccaagcgcgtcttcgtggagatggcccgggagaagcaggagaacaagcgcaccgagtcccggaagaagaccctgagcgacctgtacaccaagtgcaagaaggaggagcccgagtggatcgaggcgctctgcacgagcctggagaagcacgaggagcaccagctgcgctccgacaagctctacctgtactacacccagaaggggcgctgcatgtacagcggcgagcccatcgacctggaggacctctgggacaacaccaagtacgacatcgaccacatctacccgcagtccaagaccatggacgacagcctgaagaaccgggtgctggtcaagaaggagtacaacgccaagaagtccgacacctaccccatcgccgccgacatccagaagaagatgatgcccttctggaagtccctcctgacgggcgggttcatccccaaggagaagtacgaccgcctggtgcggaacaacccgctcgacgccaacgagctggcgggcttcatcgagcgccagatcgtggagacccggcagagcaccaaggccgtcgccgagatcctgaagaagatcctccccgacaccgagatcgtgtacgtgaaggccaagacggtcagcaagttccgccaggacttcgacttcatcaaggtgcgggacatgaacgacctgcaccacgccaaggacgcgtacctgaacatcgtggtcgggaacgtgtacttcgtgaagttcaccaagaacgccgcctggttcgtcaaggagaaccccggccgcacctacaacctcgagaagatgttcatctgggacgtggcccgggacggggagatcgcctggaaggcgggcaagtccggcagcatcgtgcaggtccgcgccatgatggagaagaaccacatcctggtgacccggcgctcctacgaggtgaagggcgggctgttcgaccagcagatcctcaagaaggggaagggccaggtcccggtgaaggagagcgacgagcggctgcgcgacatcgggaagtacggcggctacaacaaggccgccggggtgtacttcatgctggtctccagcaaggacaagaagggcaaggagcagcggacgatcgagttcgtgcccatctacctcaaggaccgcgtggagaaggacatggagtccgcgcggaactacctgatggaggagcgcgggctgcgggagcccaagatcctcatcaagaagatcaagatcgacaccctgttcaaggtcgacggcttctacatgtggctgagcgggcgcacctccaaccagctcatcttcaagggcgccaaccagctgatcctgagcaaggaggacatgaagaccctcaagaaggtggtgaagtacatccagcggcagaaggaggacaagaacgtcaagatcagcatgcgcgacggcatcacggaggaggagctgctgaagctctacgagaccttcctggacaagatccgccactccatctacggggcccggctgagctcccaggagaagaccctcgtgaacggcaaggagaagttcatcgacctgagcgtcgaggccaagtgccaggtgctgtacgagatcctccacctgttccagtgccagtccggggccgcgaacctgaagatgatcggcgggcccgccagcgccggcatcctcgtgatgaacaacaacatctccaagtgcaagaacatcagcatcgtcaaccagtccccgaccggcatctacgagaaggagatcgacctgctgcgcgtgtga

SEQ ID NO: 1832 - RNA, 4026 nt, synthetic construct
  misc_feature 1..4026: note = Cas9 variant
  source 1..4026: mol_type = other RNA
atgacccagaaggtgatcccctacaacatcggcctggacatcgggaccaacagcgtcggctgggccgtgacggacaacgagaacaagctcctgcacatcaaggggcacaacggcatcggggtgcgcctgttcaaggagggccagtccgccgcggagcggtgcggcttccgcaccacccggcgccggctcagccgccggaagtggcgcctgcggctgctcaacgagatcttcgccgacaagatcgccaaggtcgacccgtccttcttcgcccgcctgaagcagagcaacgtgtcccccaaggaccccaacaagaccatgttcgggaacatcctgttcgacaacggcaacctcaacgacaagagcttccacgacgagtacaagacgatctaccacctccggcagtccatcatcgaccaccccgagaagaagttcgacatccgcctgatctacctggccatgcaccacatcatcaagtaccgggggcacttcctgaaccaggcgaacgtgcaggacttcaagggcgggaagatcgacctggaggagagcttcaaggacctcaactccatcttcgagaaccagggccgcgacctgcggctggtcaccgaggacgccaacaagtacgtgaaggagctcagcgacaactccaagacccgcaacgaccggcagaaggagctgagcaaggtgctgtacatcccgatcgacaagaactccgacaagaacaacaagaaggtcaccacggagatcatcaaggccatcctcggcatgaaggccaagttcgacgtgatcttcgggatcgacgcggagaacgccaaggagtggagcctgaccttcaactccgacgacttcgacgacaagatcgagggcctgagcgcccagatgaccgacgaggccggggagatcctcctgatcctgaaggagctctacttcgccctgaacctgtccgacatcctcaacaacagcgtgaccgacaagaacgcgaagacgctgtccgaggccatgatcaaccgctacgacgaccacaaggagcagctgaccatgctcaagcaggtcatcgacaacagcgacaagaagcacgccaaggccctgaaggccgcgtacagcgcctacatcgacggcgagaacaacaagaagatctccttcgaggacctgcggaagcgcatccagaagaacctcgacaacagcgagacctccaagaagatcaacgacctgctggagcacgactacttcctccccaagcagcggagcaaggagaacggcgccatcccccaccagctgcagcagcaggagctggacaagatcatcgagtcccagaagcactactaccccttcctcgccgagctgaacccgaacgagaagcgcagccgccaggccaagtacaagctggacgagctcgtggcgttccgggtgccctactacgtcgggcccatggtgaaggccaccgagaacaaccagtccaacaacggcaagttcgcctggatgatcaagaacgacaacatcagcgacaagctgaagaaggaggagatcacgccctggaacttcgacaagaaggtggaccgcaccgagaccgccaccaagttcatcacgcggatgaccaccaccgacacgtacctgatcggggagccggtcctccccaagaactccctgctgtaccagaagttcgtggtgctgaacgagctcaacaacctgaagatcaacaagcagcccatcacccccgagcagaagcagtacgtctacgagcacgtgatgaagcagaccaagcgcgtgagcctgaagaagatcgccgacgcgctcgtcatcaagggcgactacccgtacgcccccgagatcaccgggacgaccgaccagaagaacatgaacaacggcctgtccacctacatcgacctggccaagatcttcggcgacgagctcgacgacatcgaccggaaggaggacttcgagaagatcatcgagtggagcaccatcttcgaggaccagcacatcttcgccctgaagctgaaggagatcaagtggctcacggaggaccagcgcaagcaggtcgtgaagctgcggtaccaggggtggggcaagctgtccaagaagctcctggcggacctggtggacgacaacgggcagcgcatcatcgacctcctgtgggacagcaagcaggacttcatgcagatcgtgaaccagaactccttcaagcaggccatcgccgagcacaacggcgcccacctggaggagaaggacctcaaggacatcatcaacaacctgtacaccagcccccagaacaagaaggccatccggcaggtcatcctggtggtggacgacatcatccgcgcggtcgggtacgagcccgtgaacatcatgatggagttcgcccgggaggactccaaggaccaccgcctcaccaacagccggtcccgccagctggagaaggtgtacaaggacatcaccaacagctggttcgacgacgacaacgtcaaggacgagctgaaggacaagatcaaggacaaggccaagttcacggaccggctctacctgtacttcacccagggcggcaaggacctgtacaccggggagccgctcgacatcgacaacctgagcaactaccagatcgaccacatcctgccccagtccttcatcctcgacaacagcctggacaaccgcgtgctgacctccaagatcaacaaccagatcaagaaggacaacctccccggcgagttcttcgggagcaagatgcacaacttctggaagcacctgaaggagctgcacctcatctccaacaagaagtactacaacctgaccctgacgcccaacagcatctccaagttcaacaaccagggccggttcatcaaccgccagctcgtggagacccggcaggtcatcaagctggccgccgagatcctgcacaaccgctacagcgaggagaacgggaccaacatcgtgaccgtgaaggcgaacctcacgcaccacatgcgcgagaagttcaacttctacaagaaccggaacgtcaacgactaccaccacgccttcgacgcctacctggccgccttcgtgggcaactggctgctccagcagtacccgaagctgaagccctacttcgtgtacggcgacttcgcgaagaccgagatcgacaacctgaagtccttcaacctcatctacaagttcgagcaggcccaccagctgaacgaggaggacgggaagatcgccaaggacaccgacgccctgctcggctacatgaagaacgtctaccacttcaagaagatgctggtgaccaaggagctggagacgaaccacgggaacctcttcaagcagaccctgtaccccagccacggcaagatgaagaacctgatcaaccccaaggagaaccgctccagcgacatctacggcgggtactccagcgagaccggcgcgtacgtgtccctcatcaaggtcttcaagaagaacaagatcgagaacaagatcatcaagatcccgctgctgtacatcgacaagctcaaccggcaggccaacgccaagcagttcatccgcaacttcatcatcaaggacgacagcaacaagttcgacatcctgtccgagaagatcttcctgaaccagctcgtgatcgacggggacgagctgttcaccatcagcggcagcggggaccggcagaacgcccagcagctgatcctctccgacaagagcctgaagatcctgtccaagaacatcaacgtgatcagcaagaacgacctcatcatcatcttcaacgagatcatcgacgacatctgcaagtacatgaagatgtacgaggtcgagaactccgacgagacgaaggccaagttcgaggagatcaacgacaaggaccgcatgctgaagatcatcaacgacctgctcctgggcctgcacgcgaacgccagccggtccaacctcagctccatcggcctgagcccctccttcgggcgcttcttcagcggcaacgccgggatcaagctgtccgagaacgccaagttcatctaccagagccccaccggcctcttctcccggaaggtgaagatcagcgacctgtga

SEQ ID NO: 1833 - RNA, 4032 nt, synthetic construct
  misc_feature 1..4032: note = Cas9 variant
  source 1..4032: mol_type = other RNA
atgacctactacctgggcctcgacatggggaccagctccgtgggctgggccgtgacggacgagaactacaacctgatccaccgccaccggaaggacctgtgggggatccgcgagttcgaggaggccaagaccgcggtggagcggcgcacccagcggatcagccgccggcgccggcagcgcgaggtggcccggatcggcctcctgaaggactacttccacgacgagatccagaaggtcgaccccaacttctaccagcgcctggacaactccaagtacttcccggaggacaaggaggaggtggtgaaggggaagaacggcatcttcgccgacgagaactacaccgaccgggactacttcgccgagtaccccacgatcttccacctccgccgggagctgctgaacagcaaggagccccacgacgtccgcctcctgtacctggccctcctgaacatgtacaagcaccggggccacttcctgaacaccaccctcgggaccgacggcgagaaccgcaagctgtccgacgtgtaccgggacttcgtggtcaagacggaggaggtgctggggctcaccttcccccaggagaccgacaacggcaagatgcaggagatcatgtgcagccgcgagttctcccggaagcgcaaggcggagctgctgtgcgccctcctggagatcgacaagaagcagaagcagcaggtcgccctgatcgagtgcgtgctcgggctggacaagagcgtgaagcagatgtacggcaccgccgtgccggacgacttcgacaagtccgtcaaggtgaacttcagcgactccagcttcgaggagaaggtgtccgaggtcgaggagctgctcgacgaggagaagtacgagctgatcctgtgcatgaaggagctctacgacacggcggtgctgaaccagatcatgggcgactgcaactacctgagcgaggcccgcgtgcaggagtacgagaagcacaaggaggacctcaagctgctgaagcggaccgtcaagaagtacgggaccgccgaggagtaccagttcctcttccgctccagcgagaaggcctcctacaacgcctacgtgcacagcgtgaactccggcgagaagatccggcgcaacatggacgggcggagccgcgacgacctgtacaccgtcctgaagaagatgctcaagaactacccccaggaggacgcggactgcaagtacatcctggaggagatcgagaaggagcagttcctgcccaagcagctcgtgagcgacaacggcgtcatccccaaccagatccactacaaggagatgaagaagatcctggagaacgccgagcagtacctgcacttcctccgggagaaggacgagtccggctacacggtggccgagcgcatcctgaagctgttcgccttccagatcccgtactacatcgggcccaccagcgagaagtccggcaagaacgggggcaacgggtgggtggtccggaaggagcagggccaggtgctcccctggaacatcgaggagaagatcgacatgaaggccaccagcgagaccttcatctcccgcatggtgcggcgctgcacgtacctgagcgacgagatggtcctgcccaaggcgtccctggagtacgagagcttctgcgtgctcaacgagctgaacaacctgcggatccgcggcgtgaagctcccgatcaccgtcaagcaggacatctacaaggacctgttcgagcgggggaagcgcgtgacccggaagcagatcgtgaactacctgaagggcgtcgggatcctccaggagggcgaggaggacgagctgaccgggatgatggacacgttcaactccagcctggcctcctacggcaagttcaagagcatcctcggcgagaagatccaggaggactcctgcaagcgcatggtggagcagatcatcttctggtgcaccatctacggggacgccaagaagttcctgaaggagcagctggaggagaagtacggcgacgtgctcacccgggagcagatcaagcgcatcctggggttcaagctgaaggactggggcaacctcagcaagaagttcctggagctgaacgggtgcgaccgcaacaccggcgaggtcatgtccctcatccggatgctgtgggagagcgacgacaacctgatggagctcctgaaggactccagctacacgtaccgcgccgagctggaggagcagcaggagaagctcaccaagaccctgaccgagatctgccccgaggacctggagggctactacttctccgcccccgtgaagcggatgatctggcagacgctcctgatcctgaaggaggtggagaaggtcatgggggagcccccgaagcgcgtgttcgtggagatgacccgggagcacgacgagcgccgggagatgaaggacagccgcggcaagaagttccaggagctctacaagaacatcaaggacgaggagcacaactggaaggcggagatcgaggacgccgagaaggacgggcggatccgcagcaagaagatgtacctgtacctgacccagcggggccgctgcatgtacaccggcaaccccatcgacctcgaggagctgttcacgaccaagtacgacatcgaccacatctacccccggcacttcgtcaaggacgacaacctggacaacaacctcgtgctggtggagaaggagaagaacgcccacaagtccgaccagtaccccctgggggacgacatctacaccggccgcctcagctggtggaaggagctgcaccgggagaagctgatcaacgacgagaagtacaagcgcctcaccgggcgggccccgttctccgacgagcagaaggccggcttcatcgcgcgccagctggtcgagaccagccaggggacgaagggcgtggcctccatcctgaaggaggtgctccccgagaccaccaccatcgtctacgccaaggcccggaacgtgagcgacttccgcaacacgaacgagctgctgaaggcgcggtccgtgaacgacttccaccacgcccaggacgcctacctcaacatcgtcgtgggcaacgtgtactacgtcaagttcaccaacaaccccctgaacttcgtgcgcagcggggagggctacaacctggacggggtgttccgcaagaacgtcatccggggccaggagaacgcctggatcgtgaagcccgagaagggggagaagatgaccctcgagaccgtgaagcgcgtcatggccaagaacacgccgctgctgacccggctctccttcgagggccgcggcgggctggcgaaccagaccctgtacagcgccaaggaggccgccggcgaggggtacgtgcccctcaagtccagcgactcccggctgcaggacgtgaccaagtacggcgggttcacgagcgtcaccaccgcctacttcatcctggtggagcacgacatgaagaagaagcgcgtgcggaccatcgagtccgtccccatcctctggaaggagcgcatcgagaaggagagcggccagctggagatctactgccgggaggcgctgggcctcgtgaaccccgacatccgcgtgcggaagatcctgatccagtccctggtcaagaaggacgggttctacatgcacctcagcggcaagacggggaaccgcttcatcatgcggaacgccgtggagctgtgcctgaagcaggagtggatcaactacagcaagaagctcgagaaggagggctgcgacgagtccatcaccaaggagaagaacgaggagctgtacgagatcctgaaggagaagcacatcaacgggatctaccgcaagcggccgaaccccatgggcgagaagctccacatccgccaggagaccttccggatgctgaccctggaggagcagaagaaggtgctcctgagcctgctcaacctgacgaagatcggccccgtcgaggccaacctggagctcatcggggagtccgcccacaccggcaagatgctgatcagcaagaacatcaccgaggtgaaggagttctacctgatccaccagtccgtcaccgggatctacgagaagcaggtcaacctcctgacggtgtga

SEQ ID NO: 1834 - RNA, 4032 nt, synthetic construct
  misc_feature 1..4032: note = Cas9 variant
  source 1..4032: mol_type = other RNA
atggccaccaagaaggagtacaacatcggcctggacatcgggaccacgagcgtgggctggtccgtcgtggagaccgacaaccagaaggtgatgcgcaaggggaacaaggccctctggggcgtccggctgttcgaggaggcgaccaccgccgagagccgccggatgcagcgctccacgcggcgccggtacgaccgccggcgcgagcggatcaagctgctccaggaggagttcagcgaggagatcaacaaggtggacaagaacttcttccagaagctgaaggagtccaagtacgtggagaacgacaagatcaacaagaagatcgtcctgaccaaggaggagaagcaggagctcaaggactaccagaacaagtacaagaccatctaccacctccgcgacgagctgatcaacaaccccgagaagaaggacatccggctggtgtacctggccatccaccacatcatcaagtaccgcgggaacttcctgtaccagaacgccaacttcaacatcgacaacctcgacatcaaggacaagctgaacgagctgttcagcatcctctccaacaacatccaggagctggagatcccggaggactacatcaacatcatcgacttcgacgagctggaggccgacctcctgaaggacaccaagaacgacgtgaaggcgctgctcatcgacaacctgacggagctgaccaacaagagctccgccaccgagttcggcaagctcatggtcggcaacaaggggaacatcaacaagctgctgatgctcgagaccgacaacaagatcgagatcagcttctccggcacggactacgacgacaagtacgaggagtaccaggaggccctgggggagaacatcgagatcctggacatcctcaagcagatctacgactgcatcttcctgaagaagatcttcaagggcaacaagaacaccagcatctccagcctgatggtgaagtccttcgagcagcacaagaaggacctcaacttcctgaaggagctgttcaaggacaaccgggagctctacaacgagatcttccgcaccaagaaggacctgtgcctgtacgagaagtacatcaccaacaagatcgactgcgacgagttccggaaggagatcaacaagctcctggagagcctgttctccgacgagaacatcaagcagaacctcctggacgagtacaacctggaggtgaaggagcgcatcgagaacgggacgttcctcccccggatcaccaccaccgacaacggcaagtacccctaccagctgaacaagagcgagctgatcaagatcatcgagaaccagggcaagtactaccccttcctcctgaacaagctgaacgacaacaagacgtacaagatcgtcaagctgctcgagttccgcatcccgtactacgtggggcccctggtgtccgagaagcggagcgagaacagctggctggagcgcaagatcaacaacgtcaagatcaccccctacaacttcgacgacgtggtggacaaggagaagaccgccgagaagttcatcaagcgcatgatctcccactgcacctacctcctggacgagtacgcgctggccaacaacagcatcctctactccgagttcaaggtcatgaacgagctgaagcagatccgggtgaacgaccgcaagctggagctcaagttccagcagcagatcctggaggacttcttcaagaagacgagcggcaccatcaccgagcggaagttcaagaactacctgatctccaccggggagtacagcatggagggcggcaacttccgcatcacggggtactccgccgacggcaagttcgccaacaacatgcagagctacgtggacttcttcggggagaacggcatcttcgccgacaccgactacaacctcgagaacgcggaggagatcatcgagtggatcaccatcttcgaggacaaggacatcctggagaagaaggtccgggacaactactccaagctgaacgagaaccagatcaagaaggtgctcgccaagaagtacagcgggtggggctccctgagcaagaagctgctcaagaccaagtactacaaggacaaggccacggagctgtacaagtccatcctggacctcatgtacgagaccgacaagaacttcatgcagatcatcaacgacgacaagtacaacttccaggagatgatcaagaagttcaacaacaaggaggagaacaagaagctgaactacagcatcgtggaggagctggccacctcccccgccaccaagcgcggcatctaccaggcgctcaaggtcgtggaggagctggtcgactacatcgggtacgagccgaagaacatcagcatcgagatggcccggtccgaggaggagaaggtgcgcaaggacagccggaaggactacatcaacaacctgtacaagggctgcaaggactccatcgagaactacaagaagctcaagcacgagctggacagccacgagatcacgagccagcgcctgttcctctacttcatccaggaggggaagtgcctgtacaccggcacgcccctgaacatcgaggacatcgagaaccagtccctctacgagatcgaccacatcatcccccggagcctgatcaaggacgactccatcgacaacaaggccctggtgctcaaggagtgcaaccaggacaagaaggccagctacgtcctgccctccaagttccgcaacagcaagcagaagacctggtggaagcacctgaaggacaacgggctcatgtccgccaagaagttccacaacctgatccgggagaagtacaacgaggaggacatcaacggcttcatcaaccgccagctggtggagacccggcagatcaccaagcacgtggcgaacatcctcaacaacctgtacaaggacaccaacgtcatctacctgaaggccgacctcagccacaactaccgcgagaagtacgacctgttcaagttccgggacatcaacgactaccaccacgcccacgacgcctacctggccgcggtgctcggcgagtacaaggagcgcttcatgaagcggaagatcaacttcgacatggtgaaggagctgaactccaagatcgtcgagatggacgaggggaagcgccgcaacctgcggttcggctacgtgatcaacagcctcgacgagaacctgaacgacatcgtgctgaagatctccgagaacctcgtcgacaacgagaccggggaggtgctgttcgacgcccacgagttcaacaagcgcgtggaggacaccctgtaccggaacgacatcctcatcagccgcaagacggagatccggaccggccagttctacaaggagaccatctacaagaaggggaagggcaccatcccgatcaagttcggcatgcccacggacatctacgggggctactccaacaccaacgcccgcaagctgatgctgatcgagtacaacgagagcaagatgaagatcatcgggctccccatggccctggcggtccggaacaacgacgccgagatcaacgactacatcaagacccagatcaacctgaagaagaactccaccttcaagatcaagaagtgcagcatccccttcgagacggagatcatctacaacaaccagaacgtgttcatcaagggctactccatcggccacaagaactgcgagatcagcaacgccatccagctcaagatcgccaaggacaagatgaagcactggaagtacgccctgcagtacctgctcaacgacaagaagcagtacatcgacttcgcggagaagtacgtgaacgagatctacgacttcctgatcaacctggacctcttcccgctgttcaacaaggagctggacaagatcaagaacaaggtcaacttcgaggacctcgccctggaccagcagaagaagatcaccaaggagctgttcaagatgctccactgcaacagcgtgaacgccaacctgtccgagttcgggctgggcgaccgcatggggcggctcagcggctacaacatcaccgacgggatcatcatctccaagagcgtgaccggcatccgcgagtcccggtacgagttctga

SEQ ID NO: 1835 - RNA, 4035 nt, synthetic construct
  misc_feature 1..4035: note = Cas9 variant
  source 1..4035: mol_type = other RNA
atgagccagaacaacaacaagatctacaacatcggcctggacatcggggacgcctccgtgggctgggccgtcgtggacgagcactacaacctcctgaagcgccacgggaagcacatgtggggcagccggctgttcacccaggcgaacaccgccgtggagcgccggtccagccgctccacgcggcgccggtacaacaagcgccgggagcgcatccggctcctgcgcgagatcatggaggacatggtcctggacgtggaccccaccttcttcatccggctcgccaacgtgagcttcctggaccaggaggacaagaaggactacctgaaggagaactaccactccaactacaacctcttcatcgacaaggacttcaacgacaagacctactacgacaagtacccgaccatctaccacctccgcaagcacctgtgcgagagcaaggagaaggaggacccccggctcatctacctggccctgcaccacatcgtcaagtaccgcgggaacttcctctacgagggccagaagttctccatggacgtgagcaacatcgaggacaagatgatcgacgtgctgcggcagttcaacgagatcaacctgttcgagtacgtcgaggaccgcaagaagatcgacgaggtgctcaacgtgctgaaggagcccctgtccaagaagcacaaggccgagaaggcgttcgccctcttcgacacgaccaaggacaacaaggccgcctacaaggagctgtgcgcggccctggccggcaacaagttcaacgtcaccaagatgctcaaggaggccgagctgcacgacgaggacgagaaggacatcagcttcaagttctccgacgccaccttcgacgacgcgttcgtggagaagcagcccctgctcggggactgcgtggagttcatcgacctgctgcacgacatctacagctgggtcgagctccagaacatcctgggctccgcccacacgagcgagccgtccatcagcgccgccatgatccagcggtacgaggaccacaagaacgacctgaagctcctgaaggacgtgatccgcaagtacctgcccaagaagtacttcgaggtgttccgggacgagaagtccaagaagaacaactactgcaactacatcaaccaccccagcaagacccccgtcgacgagttctacaagtacatcaagaagctcatcgagaagatcgacgacccggacgtgaagaccatcctgaacaagatcgagctggagagcttcatgctcaagcagaactcccgcaccaacggggccgtgccctaccagatgcagctggacgagctgaacaagatcctcgagaaccagagcgtctactactccgacctgaaggacaacgaggacaagatccgcagcatcctgacgttccggatcccctactacttcggccccctcaacatcaccaaggaccgccagttcgactggatcatcaagaaggaggggaaggagaacgagcggatcctgccgtggaacgcgaacgagatcgtggacgtggacaagaccgccgacgagttcatcaagcgcatgcggaacttctgcacctacttccccgacgagcccgtcatggccaagaactccctgacggtgagcaagtacgaggtcctcaacgagatcaacaagctgcgcatcaacgaccacctgatcaagcgggacatgaaggacaagatgctgcacaccctcttcatggaccacaagtccatcagcgccaacgccatgaagaagtggctggtgaagaaccagtacttctccaacaccgacgacatcaagatcgagggcttccagaaggagaacgcgtgcagcacctccctgacgccctggatcgacttcaccaagatcttcggcaagatcaacgagagcaactacgacttcatcgagaagatcatctacgacgtgaccgtcttcgaggacaagaagatcctccgccggcgcctgaagaaggagtacgacctggacgaggagaagatcaagaagatcctcaagctgaagtactccgggtggagccggctgtccaagaagctcctgagcggcatcaagaccaagtacaaggactccacgcgcaccccggagaccgtgctggaggtgatggagcggaccaacatgaacctcatgcaggtcatcaacgacgagaagctggggttcaagaagacgatcgacgacgccaacagcacctccgtgagcggcaagttcagctacgccgaggtgcaggagctggccggctcccccgccatcaagcgcgggatctggcaggcgctcctgatcgtcgacgagatcaagaagatcatgaagcacgagcccgcccacgtgtacatcgagttcgcccggaacgaggacgagaaggagcgcaaggacagcttcgtgaaccagatgctgaagctctacaaggactacgacttcgaggacgagaccgagaaggaggccaacaagcacctgaagggcgaggacgcgaagtccaagatccggagcgagcgcctgaagctctactacacccagatggggaagtgcatgtacacgggcaagtccctggacatcgaccggctggacacctaccaggtcgaccacatcgtgccccagagcctcctgaaggacgactccatcgacaacaaggtgctggtcctcagctccgagaaccagcgcaagctggacgacctggtgatcccgagctccatccgcaacaagatgtacgggttctgggagaagctgttcaacaacaagatcatcagccccaagaagttctactccctgatcaagaccgagttcaacgagaaggaccaggagcggttcatcaaccgccagatcgtggagacccggcagatcacgaagcacgtcgcccagatcatcgacaaccactacgagaacaccaaggtggtgaccgtccgcgccgacctgagccaccagttccgggagcgctaccacatctacaagaaccgggacatcaacgacttccaccacgcccacgacgcctacatcgcgaccatcctcggcacctacatcggccaccgcttcgagtccctggacgccaagtacatctacggggagtacaagcggatcttccgcaaccagaagaacaagggcaaggagatgaagaagaacaacgacgggttcatcctgaacagcatgcggaacatctacgccgacaaggacacgggcgagatcgtgtgggaccccaactacatcgaccgcatcaagaagtgcttctactacaaggactgcttcgtgaccaagaagctcgaggagaacaacgggaccttcttcaacgtcaccgtgctgcccaacgacacgaactccgacaaggacaacaccctggccaccgtgccggtcaacaagtaccggagcaacgtgaacaagtacggcggcttcagcggggtgaactccttcatcgtcgccatcaagggcaagaagaagaaggggaagaaggtgatcgaggtgaacaagctcaccggcatccccctgatgtacaagaacgcggacgaggagatcaagatcaactacctgaagcaggccgaggacctcgaggaggtccagatcgggaaggagatcctgaagaaccagctgatcgagaaggacggcggcctctactacatcgtggcccccacggagatcatcaacgccaagcagctgatcctgaacgagagccagaccaagctcgtgtgcgagatctacaaggccatgaagtacaagaactacgacaacctggactccgagaagatcatcgacctgtaccgcctcctgatcaacaagatggagctgtactaccccgagtaccggaagcagctcgtcaagaagttcgaggaccgctacgagcagctgaaggtgatcagcatcgaggagaagtgcaacatcatcaagcagatcctggcgaccctccactgcaactccagcatcgggaagatcatgtactccgacttcaagatcagcaccacgatcggccggctgaacgggcgcaccatctccctggacgacatcagcttcatcgccgagtccccgaccggcatgtacagcaagaagtacaagctctga

SEQ ID NO: 1836 - RNA, 4035 nt, synthetic construct
  misc_feature 1..4035: note = Cas9 variant
  source 1..4035: mol_type = other RNA
atgaagaagaccaacccctacatcctgagcctcgacatcggcaccgcctccatcgggtacgcctgcatggacctggacttcaacatcctgaagtaccacgacaaggacgcgatcggcgtgctcacgttcgagggggccgacaccgccgccgagcgccggggcttccgcaccagccggcgccggaagaaccgccggatcaagcgcctggggctgctccaggaggtcctggccccgctggtgaagaaccccaactactaccagctcctgaacctgcacaagtggaagaactccaacgaggacttcaagcaccggagcctctccgaggtgctgaagatcctgggcaagaaccccaagacctaccccacgatctaccacctccagcaggacatccagaaccacccggagaagaagttcgagcccgagctgatcttcctggcgctctaccacctggtcaagtaccgcggccacttcctgttcaacaacctcagcttcgacaaggggaagaccgtggacaacgaggcccagctgtccgagctgctcgagcagtaccagagcatcaacccctacgaggactccatcagcaacaaggacatcaacgtgatcgtcgacaccctgaaggacgaccagctgacccggaacgacaagtccaaggagctcaagcgcaacgtgagcaagacgcacgccgagctgttcaagatgctggtgggcctcaagttcaagcagtccatcctgttcgagaacatggagaacgccgaggacatcaaggagagcgcgaccgggtccgacgccatcagcctgtccgacgactactacgagaacctcagcgagttcctgaccgacgagcagctgaacttcatcgagtccgccaacaccttcttcatgggcatcatgctcgaccggatcctgaagggggccacgagcatcagcgccgcgaaggtccgcgactacaagatcttcaagaaccagctgaagatcatcaaggacatcgtgtaccagaacaagtacgacaagtaccacgagttcttcgtgacctccaaggaggacatgcgggcctaccaggagaaccccgacgccaagaccttcggcaagctcagcaagttcgaccagtacctgatccacccgaaggaccagtacgccaagctgatgaaggacctcaagggcatcgtccccaagaagtacaccgaggtgctgaacctgatcgacgagcagaagttcctcgtggtccagaacacgaccgacaacgcctccatcccctaccagaacaacgtgttcgaggcggagaacatcctgcgcaaccagcagaagtactaccccgagatcaccgaggagatgatcgggaaggtgatcaacctgatcagcttccggatcccgtactacgtcggccccctcaccaacaagaacgggcagtccgacttcgcctggatgatccgcaagagcgacgagcagacgctgccctggaacttcgacaaggtgatcgacaagtccaagagcgccgagaagttcatccggcgcatgacctccaagtgcacctacctgctggaggaggacgtgctccccaagcacagcctgctgtaccaggagatggaggtcctcaacgagctgaacaacgtgcagctgcggggcgagaacgagccgaagcaccgcatccaccgcctcgaccccaaggtgaagcagttcatctaccacaacctgttccagaagaagaagaacgtcacccacaaggacctgatcacgctcctgcagaactccgagcaccggaacaccctgaacaagaccagcggccagaagctcaaggtgttcgggacccagaacgactccaagttcgccagcaagctgtccacgtacaacgacatgaaggccatcttcggcagcgtcgagaacaagcgccagatgatcgaggagctggtgctctggatcaccatcttcgaggacaaggcgatcctgaagcagaagatcggggagaagtaccccaacatcaccgagaagcagctgaaccagatcgtgaagctcaactactccggctgggggcggctgagcgagaagctgctcaccaaggaggtcaacggccgctccctgatcgacctgatgtacagcacggagaacaacttcatggagatcatcaccgacaagaccctcggcttcgactgcttcatcaagaacagcaacaaggtgaagaacgccaagatctcctacaaggacgtggccgagctgcggaccagccccgccctgaagaaggggatctggaacgccatcaagatggtccgcgagatctccgacctcttcggcgcgccggagaagatcatcatcgagttcgccacggaggaccaggtgaaggggaagcggcagaagtcccgcagcgagctgtgggacgacctggtgaagaagaacaacctcaagcggaacaagaagttcaagggcctgttcgaggagctgaaggcctaccccgacctcgacttcagcaaccccaagctgtggctgtacatccaccagaacgggaagtgcatgtacaccaagaagcccatcgacctcgagcgcctgatgtccgacaccaacaaccagctgtacgagatcgaccacatcctcccgcggaccttcgtcaaggacgacagcatcaacaacaaggtgctggtgatccagtccgccaaccagaagaagtccggcgacaagatgcccctggagatcttcgacaaccacgtcctcgtgcccttctggaagatgctgtacgagaacgacctgatcagcagctccaagctcagcaagctgatgaagaaggagttcaacgacctggacaaggagggcttcatccagcgccagctcgtggagacccggcagatcatctcccacgtcagcgacttcctgacggaggagtacccctccaccaccgtggtgccgatgaaggcgaacgtcgtgagcgagctgcgccggaagttcgacatccccaagatccgccagctcaacgactggcaccacgccgtggacgcctacctgaacgggttcgtctaccaggccgcccgggtgttctaccccaaggtgaacctgttcgagttcaacttcaagtgggagaaggtccgcgagaagtggcggcagctcggcgagttcaccgagaacaacaagaagcgcgagttcttcctgttcaagcgcatggagaactacgtgaacgagcacggggagggcatgatcagcaagctgatcttcgacctcgacaacttcaagttcaactactcccggaaggtggagagcacggagtccgcgttctacaagcagagcgccttctccccgaagaacaccaccgcccagtacgacagcgacaagaacaagaccgccatctacaaggagatgaagaacaagcgcgggatcgtcgtgtcctacacgtacgtgaagaaggaccaggagctgatcggctacggcgtcttcaacgagaccgtgttcgagtacgtgaacaacgccgacgtcgacatgaacacccgggcgctgaagatcgtgcgcaaggccttccccaagctcgacatcaagaaggcccagtacctgttcagcatcaacaagggggacgccctgctcgtgaacggccaccccttcctgttcgtctccgccaaggagcggatcaacgggaagcagctggagttcgacatcaacatgcagcgccggctcaagaaggcgctgcgcccctacaacaagatgaccgagcaggagaaggtgggcgtgtacaaccagttcgccgagaaggtcgtgcaggagtacgagaacagcctgggcgccaagacgcggaacgagaagctcgagctgatccgcaaccagttcaacgagtccgacaagagcaacgaggccctgatccagtgcatcctcgaggtgctgaagatgaccaaggtctccgcggagcggagcgtgaagctgaagatccgctgggggtcccagaccccgaacaccctcatcgacatcaacaacaaggccaagatcatgtacaacagcatcacgggcctgaagcagacccggctgaagtccatctacaagctcgccgagagcaagaacgagctgtga

SEQ ID NO: 1837 - RNA, 4035 nt, synthetic construct
  misc_feature 1..4035: note = Cas9 variant
  source 1..4035: mol_type = other RNA
atgaacaagaactactacatcggcctggacatggggaccaacagcgtgggctgggccgtcaccgaccaggagtacaacctcatcaagctgaaggggacgcacgcctggggcgcgcgcatcttccaggaggccaaggacaagaaggggacccgggccatccgctccagccggcgccggatggaccgccggaagtaccgcatccacctcctcaaccagctgttcgcccaggagatccaggccatcgactccaccttcttcatccggctggcgtacagcgcctactgggaggtggacaagaaggacaagggcatcggccgcaacatcctcttcaagaccaagcaggaggagtcccagttctacaagaagtaccccacgatctggcacctccgcaagagcctgctggagaaccagccggacgccttctccgacctgcggtacgtgtacctggccttccaccacatcatgaagtaccgggggaacttcctccacgagggcgagatcaagaccaacgagctgcaggtccagcagatcgagcagctgaaccagttcctcatcaacaagtacaaggagatctacgacaacgacgtggaggagcgcaccttcatcgcgaaccaccagatcgacgccctgaaggagatcctgctcaacaagaacaccaacaagacgaccaaggagaaggagatcaagaagctgttcgactacgccgactgcgagagcctggagccctacatctcctgcttcagcaagctcgccgtcgggggcaagttcgacctgtccaagctggggtacgagggcaacatccagttcagcgacccctccttcgaggagaaggccagcatcctccaggacgacttccggctgatcgcgatcgccaaggagatgtacgacttcgtgatcctgaacgacctcctgaaggaccagcccaacctgtccaccgccatggtgcacgtgtacgagacccaccgccaggacctcaagaagctgaaggacatcatcatcgacatcgacgccaacaagggcctgcagaacaacgaccggtggtacttcaagctgttcaaggacaagaacgccccgaagaactacagcgcgttcatccacaagaactccaaccagaagcgccccagcatcgacgagttcaacgacgagatcaagaagatcctgatcgagcaccggaacgacgtctccctggagaagcaggacgacctcaagatgctgttcgagaaggtggagaacaagacgctgctcaagaccatcgccatccagagcaccagcgtgatcccccaccagctgcacctggacgagctcgagaagatcatcgacaacgcctccaccaagtaccccttcctgagcaacatccgcgacaagctggtcctcctgttcacgttccgggtgccgtactactacgggcccctgaacgacaagtccccctacagcaacgtggagcgcaagcagttcgccaccgtcaccccctggaacttcgacgagatcttcgacgagaacaagacccgcgagaagttcatgaagaagctcacgaacaactgcacctacctgtccggcgagaccgtgatgccgaagaaggccctggcgtacgaggactacctgatctacgaccggctcaacgtgctgctggtcaacggggagtacctcagcctgcaggagaaggagaagatctaccactacctgatctcccgccccaagaccacgctcgaccagctgaagaaggagctggccaagtggcacaaccagagccccatcgacatcatcttctccaacatccacgaggagatccccttcgaggccagctcccacgcccacctcatgaagtccttcgacctggagaagcagaaggaggagctggagcggtacatcaccctcgccaccatctacgcggacgacaagaagtccctgaaggagctgctcaagaacgagagcctgctggacgagaaccagaagaacgtgatcctcaccctgccgacgaagaagtgggcgcccctgagctacaagctcctgcagaacatcgtgtacaccgacgactacggcgtcgtgcacagcatcctggacatcatgaaggagaccaaccagaacttccagatggtgctccacaacgagcagtaccacttcaaggagctgatcgagcaggagaaccagaagttcacccaggagaagacgatcgaggacctgatcgaggagaagctcgagtccatccccagcctgacccagcgctccatccggcagaccctgctcatcatcgacgacatcatcaaggccagccaccagaaggtccccgagaagatcttcatcgaggtgacccgcaacaacgacgacaagcggaagggccaggacgggaaccagctggcccgcgacaaggagctgaaccggttcctcacgaacctgctgaaggacgagaaggccaaccagttctgcgacgtcagccagctcctgaaggacctggaggaggtggacaaggtgaagctcaagggcaagcacatctacctgtacttcaagcagctggggatcgacctctacaccggcaagaagatcgtcctgaaccagctgctcacctccaccaagtacgacaccgaccacatcatcccgcagagcctgatcaaggacgactccctggacaacctcgtgctggtggagcgcgaggtcaacctgaaggtgaaggggaaccactaccccgtgcccagccggatccaggacgagcagaagaagctctggcacttcctgctgcagaagaaggccatctccgagaagaagtacggcaacctcacgcgcaccagcaagatcaagctggaggaggtcgaggacttcgtggcccggcagatcaacgtgatcaactactccaacgtcatcatccgcgacatcctgaagctcaagtacccccacaccgacatcatcttcagcaagtcccagtacccgagcttcatccggaagcacctgaagatcgtgaagaaccgcgacgtgaacgacgcccaccacgccgtcgacgcgtacctgaacgtggtgtccggcaacctcctgagcaccacgttctccaaggcctacatccggaagaagtacatccagatccaggacggggagaaggagaccttcaacatggagaccatcctggagaactacttcaagaacaacgagaaccagctcaagatcaagaccaactgcctgcgccgggacgccctgatcacgttcaaggtcgactacttcagcggcgagttctacgggcagacccgcctccccaagggcaacgagaacctgatccccatcaccctgaacgaggacaaccccatgtccgacaccagcaagtacgggggctacacgaacctcgcccaggcctacctgttcgcggtgtcctaccaggaggacggcgagatgaagaaggccatcctgcgcgtgccgtacctctacgacaccctgtacaagaacgacagcgacaagctgctcagcaaggtcctggacaaccccaaggccaccaacatccagatcctgcggaagatccacctcaaccagaagatccgcttcaacgacgggatctacctgctgtacaccaacgagaaggaccggaacaagtacaagatggcctaccagaactacatcgacaacgactacctctactacctgcactgggccaacaagcacctggaggagctcctggacaaccaggagaagcagacgttcatctacaactccaagaacgaccagttcgaggtgagcaaggcgaagaacaaggagatcttccagtacctgctccagaagaccaaggccaaggtgtacgacacgtgcaactacatcgtcaaggcccgcgagaccaacatcgagatcttcgagcagctgaccctgaaggagcagatcaccatgatcaaccagtggatcaagatgatgtcccgggactgcgagaaggtgaagttcgacgcccgcttcaccaacttcagcaactgcctcctgcggctgtccaacaacatcaaccccaaggacagcatcaccatcatctacgagtccccgacgggcctcttcaagcacgaggtgaagatctga

SEQ ID NO: 1838 - RNA, 4035 nt, synthetic construct
  misc_feature 1..4035: note = Cas9 variant
  source 1..4035: mol_type = other RNA
atgaagaagaccaacccctacatcctgagcctcgacatcggcaccgcctccatcgggtacgcctgcatggacctggacttcaacatcctgaagtaccacgacaaggacgcgatcggcgtgctcacgttcgagggggccgacaccgccgccgagcgccggggcttccgcaccagccggcgccggaagaaccgccggatcaagcgcctggggctgctccaggaggtcctggccccgctggtgaagaaccccaactactaccagctcctgaacctgcacaagtggaagaactccaacgaggacttcaagcaccggagcctctccgaggtgctgaagaccctgggcaagaaccccaagacgtaccccaccatctaccacctccagcaggacatccagaaccacccggagaagaagttcgagcccgagctgatcttcctggcgctctaccacctggtcaagtaccgcggccacttcctgttcaacaacctcagcttcgacaaggggaagaccgtggacaacgaggcccagctgtccgagctgctcgagcagtaccagagcatcaacccctacgagggctccatcttcaacaaggacatcaaggtgatcgtcgacaccctgaaggacgaccagctgacgcggaacgacaagagcaaggagctcaagcgcaacgtgtccaagacccacgccgagctgttcaagatgctggtggggctcaagttcaagcagagcatcctgttcgagaacatggagaacgtcgaggacatcaaggagtccgccaccggcagcgacgcgatctccctgagcgacgactactacgagaacctctccgagttcctgaccgacgagcagctgaacttcatcgagagcgccaacacgttcttcatggggatcatgctcgaccggatcctgaagggcgccacctccatcagcgccgccaaggtgcgcgactacaagatcttcaagaaccagctgaagctcatcaaggacatcgtgtaccagaacaagtacgacaagtaccacgagttcttcgtcaccagcaaggaggacatgcgggcgtaccaggagaaccccgacgccaagaccttcggcaagctgtccaagttcgaccagtacctgatccacccgaaggaccagtacgccaagctcatgaaggacctgaaggggatcgtgcccaagaagtacacggaggtgctgaacctcatcgacgagcagaagttcctggtcgtgcagaacaccaccgacaacgccagcatcccctaccagaacaacgtgttcgaggccgagaacatcctgcgcaaccagcagaagtactaccccgagatcaccgaggagatgatcggcaaggtcatcaacctcatctccttccggatcccgtactacgtggggcccctgacgaacaagaacggccagagcgacttcgcgtggatgatccgcaagtccgacgagcaggccctgccctggaacttcgacaaggtgatcgacaagagcaagtccgccgagaagttcatccggcgcatgaccagcaagtgcacctacctgctcgaggaggacgtcctgcccaagcactccctgctctaccaggagatggaggtgctgaacgagctgaacaacgtgcagctccggggcgagaacgagccgaagcaccgcatccaccgcctggaccccaaggtcaagcagttcatctaccacaacctgttccagaagaagaagaacgtgacccacaaggacctcatcacgctgctgcagaacagcgagcaccggaacaccctcaacaagacctccgggcagaagctgaaggtcttcggcacccagaacgacagcaagttcgcctccaagctgagcacgtacaacgacatgaaggccatcttcgggtccgtggagaacaagcgccagatgatcgaggagctcgtgctgtgggtcaccatcttcgaggacaaggcgatcctgaagcagaagatcggcgagaagtaccccaacatcaccgagaagcagctcaaccagatcgtgaagctgaactacagcgggtggggccggctgtccgagaagctcctgaccaaggaggtgaacggccgcagcctgatcgacctcatgtactccacggagaacaacttcatggagatcatcaccgacaagaccctggggttcgactgcttcatcaagaacagcaacaaggtcaagaacgccaagatcagctacaaggacgtggccgagctgcggacctcccccgccctcaagaagggcatctggaacgccatcaagatggtgcgcgagatcagcaacctgttcggggcgccggagaagatcatcatcgagttcgccacggaggaccaggtcaagggcaagcggcagaagtcccgcagcgagctgtgggacgacctcgtgaagaagaacaacctgaagcggaacaaggagttcaaggggctgttcgaggagatcaaggcctaccccgacctcgacttctccaaccccaagctgtggctgtacatccaccagaacggcaagtgcatgtacaccaagaagcccatcgacctcgagcgcctgctgagcgacaccaacaaccagctctacgagatcgaccacatcctgccgcggaccttcgtgaaggacgactccatcaacaacaaggtcctggtgatccagagcgccaaccagaagaagtccggcgacaagatgcccctcgagatcttcgacaaccacgtgctggtccccttctggaagatgctgtacgagaacgacctcatcagctccagcaagctgtccaagctgatgaagaaggagttcaacgacctcgacaaggaggggttcatccagcgccagctggtggagacccggcagatcatcagccacgtgtccgacttcctgacggaggagtaccccagcaccaccgtcgtgccgatgaaggcgaacgtggtctccgagctccgccggaagttcgacatccccaagatccgccagctgaacgactggcaccacgccgtggacgcctacctgaacggcttcgtgtaccaggccgcccgggtcttctaccccaaggtgaacctcttcgagttcaacttcaagtgggagaaggtgcgcgagaagtggcggcagctgggggagttcaccgagaacaacaagaagcgcgagttcttcctgttcaagcgcatggagaactacgtcaacgagcacggcgaggggatgatcagcaagctcatcttcgacctggacaacttcaagttcaactacagccggaaggtggagtccacggagagcgcgttctacaagcagtccgccttcagcccgaagaacaccaccgcccagtacgactccgacaagaacaagaccgccatctacaaggagatgaagaacaagcgcggcatcgtggtcagctacacgtacgtgaagaaggaccaggagctgatcggctacggggtgttcaacgagaccgtcttcgagtacgtgaacaacgccgacgtggacatgaacacccgggcgctcaagatcgtccgcaaggccttccccaagctggacatcaagaaggtgcagtacctgttctccatcaacaagggcgacaccctcctggtgaacgggcaccccttcctgttcgtcagcgcctacgagcggatcaacggcaagcagctcgagttcgacatcgccatgcagcgcaagatcaagcaggccctgtccccctacaacaacatgacggagcaggagaaggtggagttctacaaccagttcgcggagaaggtgatcgaggagttccggaacagcatcggcctgcagtcccgcgaccggaaggtcaacctcatcaagaacctgttcaacaacaccgagaagtccaacgacagcatgacccagagcatcctggaggtgctcaagatgaccaaggtgtccgccgagcgcagcaaggagctgaagatccggtggaacgggcagacgccgaacaccttcatcgacaccaagaacaacgccgagatccagtacaagtccatcaccggcctgaagacgaccaagcccaagagcatcttcaagctcgccgagtccaagaacgagctgtga

SEQ ID NO: 1839 - RNA, 4038 nt, synthetic construct
  misc_feature 1..4038: note = Cas9 variant
  source 1..4038: mol_type = other RNA
atgaagaagccctacagcatcggcctggacatcgggaccaactccgtgggctgggccgtcgtgaccgacgactacaaggtgccggccaagaagatgaaggtcctcgggaacacggacaagagccacatcaagaagaacctgctgggcgcgctcctgttcgactccgggaacaccgccgaggaccgccggctgaagcgcaccgcccggcgccggtacacccgccggcgcaaccggatcctctacctgcaggagatcttcagcgaggagatgggcaaggtggacgactccttcttccaccgcctggaggacagcttcctcgtgacggaggacaagcggggcgagcgccaccccatcttcgggaacctggaggaggaggtcaagtaccacgagaacttccccaccatctaccacctccggcagtacctggccgacaaccccgagaagaccgacctgcgcctggtgtacctcgccctggcgcacatcatcaagttcggcgggcacttcctgatcgagggcaagttcgacacccggaacaacgacgtgcagcgcctcttccaggagttcctggccgtctacgacaacacgttcgagaactccagcctgcaggagcagaacgtccaggtggaggagatcctcaccgacaagatctccaagagcgccaagaaggaccgggtgctgaagctgttcccgaacgagaagtccaacgggcgcttcgccgagttcctcaagctgatcgtgggcaaccaggcggacttcaagaagcacttcgagctggaggagaaggcgcccctccagttcagcaaggacatctacgaggaggagctggaggtgctgctcgcccagatcggcgacaactacgccgagctgttcctgtccgccaagaagctctacgacagcatcctgctgtccgggatcctcaccgtcaccgacgtgagcacgaaggcgcccctgtccgccagcatgatccagcggtacaacgagcaccagatggacctggcccagctcaagcagttcatccgccagaagctgtccgacaagtacaacgaggtgttcagcgacgtcagcaaggacggctacgccgggtacatcgacggcaagaccaaccaggaggccttctacaagtacctgaagggcctcctgaacaagatcgaggggtccggctacttcctggacaagatcgagcgggaggacttcctccgcaagcagcgcaccttcgacaacgggagcatcccccaccagatccacctccaggagatgcgggcgatcatccgccggcaggccgagttctacccgttcctggccgacaaccaggaccgcatcgagaagatcctgaccttccggatcccctactacgtgggccccctggcccgcgggaagtccgacttcgcctggctgagccggaagtccgcggacaagatcacgccctggaacttcgacgagatcgtggacaaggagagctccgtcgaggccttcatcaaccgcatgaccaactacgacctgtacctcccgaaccagaaggtgctgcccaagcacagcctgctctacgagaagttcaccgtgtacaacgagctgaccaaggtcaagtacaagacggagcagggcaagaccgccttcttcgacgccaacatgaagcaggagatcttcgacggcgtgttcaaggtctaccggaaggtgaccaaggacaagctgatggacttcctcgagaaggagttcgacgagttccgcatcgtggacctgaccgggctggacaaggagaacaaggccttcaacgcgtcctacggcacgtaccacgacctccggaagatcctggacaaggacttcctggacaacagcaagaacgagaagatcctcgaggacatcgtcctgaccctgaccctcttcgaggaccgcgagatgatccggaagcgcctgaagaactactccgacctgctcaccaaggagcagctgaagaagctggagcggcgccactacacggggtggggccggctcagcgccgagctgatccacgggatccgcaacaaggagtcccggaagaccatcctggactacctcatcgacgacggcaacagcaaccgcaacttcatgcagctgatcaacgacgacgccctgtccttcaaggaggagatcgccaaggcccaggtgatcggcgagaccgacaacctcaaccaggtggtcagcgacatcgccgggtcccccgccatcaagaagggcatcctgcagagcctgaagatcgtggacgagctcgtgaagatcatggggcaccagcccgagaacatcgtcgtggagatggcccgcgagaaccagttcaccaaccagggccggcgcaactcccagcagcggctgaaggggctgacggacagcatcaaggagttcggcagccagatcctcaaggagcacccggtggagaactcccagctgcagaacgaccgcctgttcctctactacctgcagaacggccgggacatgtacaccggggaggagctggacatcgactacctcagccagtacgacatcgaccacatcatcccccaggccttcatcaaggacaactccatcgacaaccgcgtcctgaccagctccaaggagaaccggggcaagagcgacgacgtgccctccaagaacgtggtccgcaagatgaagtcctactggagcaagctgctcagcgcgaagctgatcacccagcggaagttcgacaacctgacgaaggccgagcgcgggggcctcaccgacgacgacaaggccggcttcatcaagcggcagctggtggagacccgccagatcaccaagcacgtggcccggatcctggacgagcgcttccacaccgagacggacgagaacaacaagaagatccggcaggtcaagatcgtgaccctcaagtccaacctggtgagcaacttccgcaaggagttcgagctgtacaaggtccgggagatcaacgactaccaccacgcccacgacgcgtacctcaacgccgtgatcgggaaggccctgctgggcgtgtacccccagctcgagccggagttcgtctacggggactacccccacttccacggccacaaggagaacaaggccaccgccaagaagttcttctactccaacatcatgaacttcttcaagaaggacgacgtgcgcaccgacaagaacggggagatcatctggaagaaggacgagcacatcagcaacatcaagaaggtgctgtcctacccccaggtcaacatcgtgaagaaggtggaggagcagacgggcggcttcagcaaggagtccatcctgcccaaggggaacagcgacaagctcatcccgcggaagaccaagaagttctactgggacaccaagaagtacggcgggttcgacagccccatcgtcgcgtactccatcctggtgatcgccgacatcgagaagggcaagagcaagaagctgaagaccgtgaaggccctcgtcggggtgacgatcatggagaagatgaccttcgagcgcgaccccgtggccttcctggagcggaagggctaccgcaacgtccaggaggagaacatcatcaagctgcccaagtactccctcttcaagctggagaacggccgcaagcggctgctcgcgagcgcccgcgagctgcagaaggggaacgagatcgtgctgccgaaccacctcggcaccctgctgtaccacgccaagaacatccacaaggtggacgagcccaagcacctcgactacgtcgacaagcacaaggacgagttcaaggagctgctggacgtggtgtccaacttcagcaagaagtacaccctcgccgaggggaacctggagaagatcaaggagctgtacgcccagaacaacggcgaggacctcaaggagctggcgtccagcttcatcaacctgctcacgttcaccgccatcggggcccccgccaccttcaagttcttcgacaagaacatcgaccggaagcgctacacctccacgaccgagatcctgaacgccaccctgatccaccagagcatcaccggcctctacgagacgcggatcgacctgtccaagctgggcggggactga

SEQ ID NO: 1840 - RNA, 4038 nt, synthetic construct
  misc_feature 1..4038: note = Cas9 variant
  source 1..4038: mol_type = other RNA
atggagaactacaacatcggcctggacatcgggaccaccagcgtgggctgggccgtcgtgaacgacgccacgaacaaggtgatgcgcaagggcgggaaggcgctctggggcgtccggctgttcgaccccgccgtgaccgccgaggaccgccgggccaagcgcgggacccggcgccggtacgaccgccggcgcgagcggatcaagctgctccaggacgagttcaaggacgagatcaacaaggtggactccaacttcttcctgaagctggaggagagcaagtacacctccaaggacatcaagaacaagacggtcctcatcagcatggaggaggagaaggccatcaagaagtacaaccaggagtacccgaccatctaccacctccgccagaagctgatgaactccaacgagcagatggacatccggctcgtgtacctggcgatccaccacatcatcaagtaccgcggcaacttcatctacgaggggaacagcttctccgtgaacaacctgaacatcgacaacaagctcaaggagatcttcctgagcctgtccgaggacgtcgacgagctcgacatcagcgaggagtgcatcaacaacatcaactacaagcagctggccaacatcttcaacgagcagtccaagaacgacctgaaggtgaagctcaccagcgagctgacctcctacagcctgaacaagaacttcatctccgagttctgcaagctcatcatcggcaacaagttcagcgccaagaagctgttcaacctggagacggacaacgacgtgtccctcagcttcgacgggaccgacttcgaggacaaggccggcgacctggagtccctgctcaacgactacctggaggtcctggagcagctcaaggagctgtacgacatggtgttcctgaagaagatcttcgggggcagcaaggagaccaccatcagcggcctcatggtggagcggtacaaccagcacaagaaggacctgaagctgctcaaggacacgttctccagcgaccgcaagatctacaacaagatcttccggtccaagaaggacatcaaggacgacaaggacatgtgcctgtacgacctgtacatccacaacaagctcgagaccaccgacttcctgaaggagatcaagaagtacgtcaacaccgacaacttcatcatcacggacgaggacttcctgaagcgcctcgagaacaacgaggtgctgccccggatcaccagcaaggagaacgggaagtacccctaccagctgaacaaggacgagctcgtgtccatcatcgagcaccagggcaagcactaccccttcctgctgaacaagaccgacgacgggatctacaagctcgtccgcctgctggagttccggatcccgtacttcgtgggccccctggtgagcaaggacatgtccgagaacgcgtggatgctccgcaacgagggcatgcagggggtccacatcaccccctacaacttcaagaaggtgatcaacctggacaagacggccgagatcttcatcaagcgcatgatcagccactgcacctacctgctcgacgaggaggccctgcccaacaactccatcctgtacagcgagttcaaggtgctcaacgagctgaagcagatcaaggtcaacggcgagcacctgaccaaggacgagcagcacaagatcatcgaggagctgttcatgaagacctccgggacgatcaccgagaacaagttccgggagttcctgctgaacaccctcgactacaacttctacgagaacgagctgaagatcaccggctacagcgccgactgcaagttcgccaacaacatgcagtcctacatcgacttcttcggggagaacggcatcttcgagggcacgagctacaacaccaacgacgcggagaagatcatcgagtggatcaccatcttcgacgacaaggacatcctgaagcgcaaggtggagaacgagtacccggagctcaagtccaaccaggtcaagaacatcctgaacaagaagtacagcgggtggggccggctgtcccgcaagctcctgctggacctccgggtgctggacaaggagaccgacatccccaagagcatcatggacctgatgtacgagacggacgagaacttcatgcagatcatcaacaacgacaagtacaacttccagaagctcatcgccaaggagaacaagatcgagaacacctccaacgacctgagctacgacgtggtcgagaacctggccaccagccccgccaccaagcgcgggatctaccaggccctcaaggtggtgaaggagatcacgacctacatgggctacgagcccaagaacatcatggtcgagatggcgcgcggggacgagaagaagatccggaaggacgaccggaagaagtacctgcagaagctgtacgacaacatcaaggacgaggtggactccaactacaagaacctcaagaaggagctggccaaggaggagaagatcgacaccgacaagctgtacctctactacctgcaggagggcaagtgcctgtactgcggcaagccgatcaacgtggacgacctcaacaccaagaacagcctgtacgagatcgaccacatcctgccccgcaccctcatcaaggacaactcctgggacaaccgggtcctggtgtgccgcgggtgcaaccagaagaaggccgccagcctggtgctccccaaggagttccggaacgactacacgaagtccatctggatccgcctgaagaacaacaagctgatgagcaacaagaagttctacaacctcacccggaagtcctacagcgaggaggacatcaagggcttcatcaaccgccagctggtcgagacccggcagatcaccaagcacgtggccaacatcctgaactgcttctaccccaagacgaagatcgtgtacctcaaggcgaacatctcccacagctaccgcgacaagtacgacctgttcaagttccgggacatcaacgactaccaccacgcccacgacgcctacctggccgccaccctcgggtcctaccaggagaagtacctgcactacgacctggactacaacaagatcaacgagttcaacgagaagctcatcaagaacgaggactacaagcgcctgcactacggcatcgtcgtgaacagcctggacgaggagttccagtccgcgttcgccgagatcgccccgcgcctcatcaacgaggagaccggggagctgctgttcaacgccaagaagttcaacgacctcgtggaggacaccctgtaccggaacgacatcctgatcagccgcaagacggagatccggaccggcaagctctacaaggagaccatctacaagcgcggcaaggggaacatcaagatcaaggagaacatgcccaccgagacgtacggcgggtactccaacatggagaccagctacctgaccctggtcaagtacggcaacaagaccaagctcatcggcatccccatgtccatcgcgaacaacaaggacgtgaaggtgaagctggacttcatcaaggagcacctggacctcaagagcctggacaacatcgtcatcctgaaggacaacatcccctacgacgtgagcatcaactacaagaaccaggacgtgtacgtcaaggggtactccacggccaacaagaactgcgagctcagcaacgcccaccagctgaagatcaagaaggacatgatgaagaagtgcaagtacgtgctgaacaaggtgtacaagaacaagtacgacgacatcaccaacatggacatcgagaacgccatcaccttcatcaactacctcttcgagatcaagatcgagttcccgctgttctccaaggagatcaccaagatccaggacaacatcaacctgacggagtgcagcttcgagcagctcgccaacatcatcaagcagctgctgatcatctaccactgcaactccaagaacggcaacctcaaggagttcgggctgagcgaccggatcggccgcctgtccggggcgaacgtcaccggcggcgacttcatcttcaccagcgtgaccgggctcaaggagaagacggcctcctacgacggcgagtga

SEQ ID NO: 1841 - RNA, 4038 nt, synthetic construct
  misc_feature 1..4038: note = Cas9 variant
  source 1..4038: mol_type = other RNA
atggtggagaagtacggcatcgggctggacatcggcaccagcaccctcgggtggacgtccgtcgacgagaacggcaagatccagcgcctgaaggggcagaccgccctgggcacccggctgttcaacgagggccagaccgccgaggagcgccgggggttccgcacgacccggcgccggatccagcgccggcgctggcggctgcgcctgctccgggagatcttcgacgagcccatcggcagcgtggacgcggggttcttcgcccgccagaagatgtccagcctgtccccgcaggacgaccggttcgaggacacctaccgcctgttcaacaaccagaccgacaaggccttccacgacgagtaccccacgacctaccacctccggcaggccctgatgaacagcgaccgccagttcgacatccgggagatctacctggccatccaccacatcgtgaagtaccgcggcaacttcctccggtccgggaagcccgcggacttcaagaccggcaagctggacctgaaggagaagttcgaggagatcaacgccgactggcagaccctcatcagcgaggacgcgccccagctgccggtcgacgacctgacgaccatcaaggccgtgctcgtggacggctcccgcagccgctccgaccggcagcgcgggctggtcaagctgtggatggccaacgagaccgtggagaagaactggaagcccgtgatgaccgagctcgccaaggccatcctgggcctgaagacgaagctctacctgctgaccgggctcgacctgcccaaggaggaccagaaggcctggaccttcagcctggacaccctcgaggaccaccagggcgacatcgactccttcttcgacgaccacgcccagcagctgatcgaccggctggcggagctccgcgccatgatccagctgacggagatcatccccagcggcctgaacttctcccagagcatggtccagcggtacgaggcccaccgctcccacctcgagatgtacaagcagtacgccctggaccagaccgacccgaagcggaccaaggccctgcgcgcggcctacaacgcctacatcgaccagcacgagatcgccgacgacttctacaccgccgtgaagcgggtgacgaaggacgaccagagcgagaccgcggaggagatcaaccgcctcatcgggctggagcagttcatgcccaagcagcggaccaaggagaacggcgtcatcccctaccaggtgcaccagcaggagctggaccagatcatcgcccaccagaagaagtactaccccttcctcgggaccgagaacccggtgatcgaccaccgcgagtcccagccctacatgctggacgagctggtcagcttccgggtgccctactacgtgggccccatggtcgccgccaacccggagctcaagacgaccgagaaccccttcgcctggatgatccgcaaggcgcagggggagatcaccccctggaacttcgacgagaaggtggaccggaagggcagcgccaccgccttcatcgagcgcatgaagacgaccgacacctacctgctgggcgaggacgtgctcccccagcagtccctgctgtaccagcggttcatggtcctgaacgagctcaacaacatccgcatcgacgacgagctgctgaccacgaaccagaagcagtgggtgttcgaccgggtgttcaaggggaagggcaccatcagcgccaagcacctccaggacgcgctgaagcaccacggggagaccgacggcctgccgaagatctccgggctcgccgaccccaccaagttcaacagcgccctgacctcctaccgcgacttccagaagtggctgcccaacgacatcgaccgcaaggaccggacggccgacatcgagaccatcatcaactggagcaccgtcttcgaggacacccacatcttcgtggagaagctcaaggagatcgagtggctgacggccgaccagcgccggcgcatcgcgtccaaccggtaccgcggctggggccggctgagcaagcacctcctgaccgagatcaaggacgagcaggggctgtccatcatggaccagctctggcgcacccagcacaacttcatgcagatcgtccacgagcccgactacgccaagcagatcgaggccgccaacaccgtgggcatggccaagcaggacatcgggacggtgatcaacgacctgtacaccagcccgcagaacaagaaggcgatccggcaggtcctggccgtggtgaaggacatccagaacgcccaccacggcgtcgccccctcctggatcttcatggaggccgcgcgcggggccgaccagaacccccagcggagccgccagcggcagcgccagctccaggacctgtacgccaagaccgccgcggacctggtggacaccgaggtgcagcaggagctcacggacaagatcaaggacaaggccaacttcaccgaccggctgatgctgtacttcctccagaacggccaggacatgtactccaaggagaagctgaacatcgaccgcctgagcgagtacgacatcgaccacatcctcccccaggccctgatcaaggacgactccctggacaaccgggtcctcgtgcaccagagcatcaaccgcaacaagtccgacaccttcgccagcgagaagtacggcgccaagatgcagggggcgtggcaccagtggcgggccgccggcctgatctccgcccgcaagctgcggaacctcgagatgcgcccggacgagatcagcaagtacgccaccgggttcatccgccggcagctggtggagacgcgccaggtcatcaagctggtgaccgagatcctcagccaccagtacaaccccgaggagaccaagctggtgtccgtcaaggcgggcctgagccacgagctccggcgcgaggccggcctgcccaagctgcgggacctcaacgactaccaccacgccatcgacgcctacctggccgcgcgcatcgggacctacctgctcaagcggtacccgcgcctggagcggttcttcgtgtacggccagttccagacgtcccgcctggacctccggcgcttcaacttcatccacgacctggtcaagagcaagcagggggtgatcgtggactccgacaccggcgagatcctgtgggaccggcagaaggacatcgactacatcaagcacctcatggggctgaagcacctcctcgtgacccacgaggtctacgacagcgccgccgagatgtacgcccagaccatcttcaaggcgtccgacaacgacagcaaggtgctgatccccacgaagaacgaccgccccaccgccatctacggcggctacaccaagcggcgcaacgggtacctggccatcctcaagatcaccgagaagaaggccgagacgtaccgggtggtcggcgtgcccaccctgtacatgtcccagctggccaccgcgcgcagccactccgtggaggccgagaaggccctcctcaagagcctgatggccccggagatcctgtccgagagcaaggtcgtgtccttcgaggtggtcgtgagccacgtgcacctgaaccagctggtccgggacaccgtgttcgggcccgcccactacttcggcctcgggcccttccgctacgtgcgcaacttccaccagctggtcctgcccttcaaggaccaggagatcctcgtgaagcggacgccgaccgacgaggagctgaacaccgtgttcgaggacatctgctggcaggtcgagaactacttcgcggtgttcgacatcaacggcttccgcaacgccctgaagaagtccatcgacaagttcgagcagctccccatcgagaacgtgttcaaggacaagaagctggtcacccagggcaagaaggaggtgctggccttcgtgatgcaggggctccacgccaacgccagctaccggaacctgaaggtcagcctgggcatcaagacgcccctcgggcagctgcagctgaccaagttcatgctctcccgcgacgcggagctgatcgacgagagccccaccggcctgttccggcgcatccggcgcctcaaggacctgtga

SEQ ID NO: 1842 - RNA, 4038 nt, synthetic construct
  misc_feature 1..4038: note = Cas9 variant
  source 1..4038: mol_type = other RNA
atgggcaacaagctgcgcaacgtggacgactactacctcgggctggacatcggcaccgagagcgtcgggtgggccgtgaccgacaagtactacgtgatccccaagttcaagggcaacgccatgtggggcgtccacctgttcgacgagggggagacgtccgtgaagcggcgcggcttccggagcgcgcgccggcgcacccagcggaagcgcgagcggctcgccctgctggaggccctcttcgacgaggagatctgcaagaaggactgcaccttcttccgccggctgcacgagtccgacctgtggccggaggacaagagcggggacgacaagtacgccgtgttcgccgacgagaactacaccgacaaggacttccacaaggagtaccccacgatctaccacctccgctacgagctgatcaagaacaaggagccccacgacgtcaagctggtgttcctcgcgctgcaccacatcatcaagaaccggggccacttcctgttcgactccctcagctccgccgaggacttcaacagcgcctacgagaccatgtgctcctacctgagcgacaacgagatccagctgaactgctccgacatcgagcagttcaaggccatcctcaaggaccgccggcaggggaagatcgagaagaccaagaacctggcgagcctgttcggcatcaccaagaagtccgaccccgtgagctacgccgtcatggccgtgctctccgggagcacggtgaagatgtgcgacctgttcggcgacgacgagctgaagaccgtcgagaagaacaacatctccttcgccagcggctacgaggagaacgaggagatctacgcctccgtgctcggggaccgcttcgagctggtgaagatcctgaaggcggtctacgactgggccgtgctcgccgacatcctggacggcaagaagtacatcagcgaggccaaggtggccgtctacgagaagcacaagaacgacctgaagaccctcaagaagtacgtgaagacctacctgccggagaagtacaacgagatcttcaagatcagcgacgggaagaaggacaactacgtggcgtactccggccacatcaaggagagcggcaagacgggggagctgaagaagacctgcaactccgagaacttctgcgcctacctcaagaagaccctgggcaagaacgccgacctgagctacaaggagatgttcgacgagatcgagaacaagaccttcatgcccaagcaggtcacgaagtccaacggggtggtgcccatgcaggtcaacgaggaggagctcaaggccatcctggacaacgccaaggactacctgagcttcctcaactcctgcgacgagaacggcgtgagcgtctacgacaagatcatcaagatcttcgagtaccggatcccctactacgtggggccgctgaacacccacaccgagaactcctggctgaagcgcaaggacggcgtgaagatctacccctggaacttcgacgacgtcgtggacatcgacagctccgcggagaagttcatcaacaacctcaccagcaagtgcacgtacctgcccgagtgcgacgtgatccccaagtgctccctgctctacagcaagttcaccgtcctgaacgagatcaacaacctgaagctcaacggcgaggacatcccggtggagctgaagcaggggatctacaaggacctgttcatgacccggcgcaaggtgaccgtcaagcagatcaaggactacctgaaggcccggggctgctacgacaacaacgacgtgctctccgggatcgacacgaccgtcaagagctccctcaagagctacttcgacttcaagggcttcgagtccctgaccttcgacgacaaggagagcatcatcgccagctccgtgatcttcggggacgacaagaagctcctgaagaagcgcctgaagaagctgttccccgagaagctgaccgacgaggacatcaagaagatctgcaagctgaagtacacgggctggagccgcctctccaaggagttcctgtgcgacgtggagttcacctacaagaagaccggcgaggtgatgaacgtcatcaccgccctgtgggagacgaactacaacctcatgcagatcctgtacagcgaggacttctgctgcgacggggacgagaagaagaacctgaacgacaagctcgacgagctgtcctacaccggcgaccagcacagcctgcggaaggccgtggacgcgctctacgtgtcccccaaggtcaagcgccccatcctgcgggccctgctcatcgccaaggagatcgagaagatccaggagcgcccgcccaagaagatcttcgtggaggtggcccgggggatcgacaaccgcgaggagcggcaccgcgacagccggaagaaccgcctgatggagctgtacaagaactgcaagaaggaggcggagaagttctgcccctacttcgacgccctctccaagaagctgagcgacgaggacgagtccaagctgcggcgcgacaagctctacttctactacatccagctgggcaagtgcatgtacaccggggaggagatcagcctgggcgagctcatgaacggcaacgggcggttcgacatcgaccacatctacccccgctccaagatcaaggacgacagcctgaccaacaaggtcctggtgaacaagacggtgaacaacaacaagaccaacgtctacccgatcgacgccgccatccagtccaagatgagcccctactggcagatgctccggtccagcggcctgatcagcgaggagacctacaagcgcctgacccggaagacgcccctcaccgacgacgagctgtccgccttcgtgagccgccagctgaccgagacccagcagtccaccaaggcggtggcccacatcctcgagcagctgtaccccaagccgaagacggagatcgtctacgtgaaggccgccctggtgcacgccttccggcagagcaacgacatgctcaagtgccgcgaggtcaacgacctgcaccacgcgaaggacgcctacctgaacatcgtggtggggaacgcctacaacgtcaaggtgacccacaacaaggtgaacttcatcaagggcctccagaacaacgacaagggctacaccgtcaaccccgagaagttcttctcccacgacatccccggggcctggagcgtgaaggactccatgaacaccgtgcgccggttcatgaacaagaacaacatccgctacacgcggttcccccgcaagaagcagggcgggctgttcaagatcaacccgctgaagaagggcaacgggcaggtccccctcaaggccagcggcgcgcggtcctgcatcgagaagtacggcgggtacgacaaggccaccagcgcctacttctcctacgtggagtacaccgacaagaagggcaaggccgtgcgccagatgttccccgtcaacctgtacgaggtgaaggagtacgaggcggacatgcaggggttcgtgaccagccggatcgccgaggcctccaacgtcaagatcctgatcccgtgcgtgaagtacgacgcctgcatcagcttcgacggctgccgcatgttcatcacgaagaagaccgggaaccggatcggctacaagcccggcatgcagctcgtgctggggtacaagtacgagaagtacatccgcaacatcgagaactacctgaccaagcacaaggaccgggagatcatcccccgcgacaacatctccgccgaggagaacatcgagctctacgacatcctgaccggcaagatgctgaacacggtcctcagcgtgaagttctccgggatcggcaagaagctggagaagcggcgcgagaagttcgtgctgtgcagccccgaggagcagtgctgcgtcctcaacgagatcctgaagatcctgcacgcgaacgtgctctccggggacctgagcctgatcggcgagagcccgaacaccggcaccatgaagaccaacgccaagttctccgagatcaaggacgtccacagcatcaagctcatcaaccagtccgtgacggggctgttcgagcaggagatcgacctgctcaagtga

SEQ ID NO: 1843 - RNA, 4038 nt, synthetic construct
  misc_feature 1..4038: note = Cas9 variant
  source 1..4038: mol_type = other RNA
atgggcaagccctacagcatcgggctggacatcggcaccaactccgtggggtgggccgtcgtgaccgacgactacaaggtgccggccaagaagatgaaggtcctcggcaacacggacaagcagagcatcaagaagaacctgctgggggcgctcctgttcgactccggcgagaccgccgaggccacccgcctgaagcggaccgcccgccggcgctacacgcggcgcaagaaccggctccgctacctgcaggagatcttcaccggcgagatgaacaaggtggacgagaacttcttccagcggctggacgacagcttcctcgtggacgaggacaagcgcggggagcaccaccccatcttcggcaacatcgccgcggaggtcaagtaccacgacgacttccccaccatctaccacctccggcgccacctggccgacacctccaagaaggccgacctgcggctggtgtacctggccctcgcgcacatgatcaagttccgcgggcacttcctgtacgagggcgacctgaaggccgagaacacggacgtgcaggccctcttcaaggacttcgtcgaggagtacgacaagaccatcgaggagagccacctgtccgagatcaccgtggacgccctgagcatcctcaccgagaaggtgtccaagagctcccggctggagaacctgatcgcccactaccccacggagaagaagaacaccctcttcgggaacctgatcgcgctgagcctcgacctgcacccgaacttcaagaccaacttccagctgtccgaggacgccaagctccagttcagcaaggacacctacgaggaggacctggagggcttcctgggcgaggtcggggacgagtacgccgacctcttcgcctccgccaagaacctgtacgacgcgatcctgctcagcggcatcctgacggtggacgacaactccaccaaggccccgctgagcgcctccatggtgaagcgctacgaggagcaccagaaggacctcaagaagctgaaggacttcatcaaggtcaacgcccccgaccagtacaacgccatcttcaaggacaagaacaagaaggggtacgcgagctacatcgagagcggcgtgaagcaggacgagttctacaagtacctgaagggcatcctcctgaagatcaacgggtccggcgacttcctggacaagatcgaccgggaggacttcctccgcaagcagcggaccttcgacaacgggagcatcccccaccagatccacctccaggagatgcacgccatcctgcgccggcagggcgagcactacccgttcctgaaggagaaccaggacaagatcgagaagatcctgaccttccgcatcccctactacgtggggcccctggcccgcaagggctcccggttcgcctgggccgagtacaaggcggacgagaagatcacgccctggaacttcgacgacatcctggacaaggagaagtccgccgagaagttcatcacccgcatgaccctcaacgacctgtacctgccggaggagaaggtcctccccaagcacagccccctgtacgaggccttcaccgtgtacaacgagctgacgaaggtgaagtacgtcaacgagcagggcgaggccaagttcttcgacaccaacatgaagcaggagatcttcgaccacgtgttcaaggagaaccggaaggtgaccaaggacaagctcctgaactacctgaacaaggagttcgaggagttccgcatcgtcaacctcaccgggctggacaaggagaacaaggcgttcaacagctccctgggcacgtaccacgacctccggaagatcctggacaagagcttcctggacgacaaggccaacgagaagaccatcgaggacatcatccagaccctcaccctgttcgaggaccgcgagatgatccggcagcgcctgcagaagtactccgacatcttcacgaaggcccagctcaagaagctggagcggcgccactacaccgggtggggccggctgagctacaagctcatcaacgggatccgcaacaaggagaacaagaagaccatcctggactacctgatcgacgacggctacgccaaccggaacttcatgcagctcatcaacgacgacgccctgtccttcaaggaggagatcgcgcgcgcccagatcatcgacgacgtggacgacatcgccaacgtcgtgcacgacctgcccggcagcccggccatcaagaaggggatcctccagtccgtgaagatcgtcgacgagctggtgaaggtgatgggccacaaccccgccaacatcatcatcgagatggcgcgggagaaccagaccacggacaaggggcgccggaacagccagcagcgcctgaagctcctgcaggactccctgaagaacctcgacaaccccgtcaacatcaagaacgtggagaaccagcagctgcagaacgaccggctgttcctctactacatccagaacggcaaggacatgtacaccggggagaccctggacatcaacaacctgagccagtacgacatcgaccacatcatcccccaggccttcatcaaggacaactccctcgacaaccgcgtgctgacccgcagcgacaagaaccggggcaagtccgacgacgtcccgagcatcgaggtggtgcacgagatgaagtccttctggagcaagctgctcagcgtcaagctgatcacccagcgcaagttcgacaacctgacgaaggccgagcggggcgggctcaccgaggaggacaaggccggcttcatcaagcgccagctggtggagacccggcagatcaccaagcacgtggcccagatcctggacgagcgcttcaacacggagttcgacgggaacaagcggcgcatccggaacgtcaagatcatcaccctcaagtccaacctggtgagcaacttccgcaaggagttcgagctgtacaaggtgcgggagatcaacgactaccaccacgcgcacgacgcctacctcaacgccgtcgtgggcaacgccctgctgctcaagtacccccagctggagcccgagttcgtgtacggcgagtaccccaagtacaactcctaccgcagccggaagtccgcgaccgagaagttcctgttctacagcaacatcctccgcttcttcaagaaggaggacatccagaccaacgaggacggggagatcgcctggaacaaggagaagcacatcaagatcctgcggaaggtcctgtcctacccccaggtgaacatcgtgaagaagacggaggagcagaccggcgggttcagcaaggagtccatcctccccaagggcgagagcgacaagctgatcccccgcaagaccaagaactcctactgggaccccaagaagtacgggggcttcgacagcccggtcgtggcctactccatcctggtgttcgccgacgtcgagaagggcaagagcaagaagctccggaaggtgcaggacatggtggggatcaccatcatggagaagaagcgcttcgagaagaaccccgtcgacttcctggagcagcggggctaccgcaacgtgcggctggagaagatcatcaagctccccaagtactccctgttcgagctggagaacaagcgccgccggctcctggccagcgcgaaggagctgcagaaggggaacgagctcgtgatcccgcagcgcttcacgaccctgctgtaccacagctaccggatcgagaaggactacgagcccgagcaccgcgagtacgtcgagaagcacaaggacgagttcaaggagctcctggagtacatctccgtgttcagccggaagtacgtgctggccgacaacaacctcaccaagatcgagatgctgttctccaagaacaaggacgccgaggtcagctccctggccaagagcttcatctccctcctgaccttcacggccttcggcgcgcccgccgccttcaacttcttcggggagaacatcgaccgcaagcggtacaccagcgtgaccgagtgcctgaacgccaccctcatccaccagtccatcacgggcctgtacgagacccgcatcgacctgagcaagctcggcgaggactga

SEQ ID NO: 1844 - RNA, 4038 nt, synthetic construct
  misc_feature 1..4038: note = Cas9 variant
  source 1..4038: mol_type = other RNA
atggaccagaagtacagcatcggcctggacatcgggaccaactccgtgggctgggccgtcgtgaccgacgactacaaggtgcccgccaagaagatgaaggtcctcgggaacacggacaagcagagcatcaagaagaacctgctgggcgcgctcctgttcgactccggggagaccgccgaggccacccgcctgaagcggaccgcccgccggcgctacacgcggcgccggaaccgcctccggtacctgcaggagatcttcgccgaggagatgaacaaggtggacgagaacttcttccagcgcctggacgacagcttcctcgtggacgaggacaagcggggcgagcgccacccgatcttcggcaacatcgcggccgaggtcaagtaccacgacgacttccccaccatctaccacctccggaagcacctggccgacatctcccagaaggccgacctccgcctggtgtacctggcgctcgcccacatgatcaagttccgggggcacttcctgatcgagggccagctgaaggccgagaacaccaacgtgcaggccctcttcaaggacttcgtcgaggtgtacgacaagaccgtggaggagagccacctgtccgagatgacggtcgacgccctgagcatcctcaccgagaaggtgtccaagagccgccggctggagaacctgatcgcgcactaccccgccgagaagaagaacaccctcttcgggaacctgatcgccctgtccctcggcctgcagcccaacttcaagaccaacttccagctgagcgaggacgccaagctccagttctccaaggacacgtacgaggaggacctggaggggctgctcggcgagatcggcgacgagtacgccgacctgttcgcgagcgccaagaacctgtacgacgccatcctcctgtccgggatcctgaccgtggacgacaacagcaccaaggccccgctctccgccagcatggtcaagcgctacgaggagcaccagaaggacctgaagaagctgaaggacttcatcaaggtgaacgcgcccgaccagtacaacgccatcttcaaggacaagaacaagaagggctacgccgggtacatcgagaacggcgtgaagcaggacgagttctacaagtacctcaagggcatcctgctgcagatcaacgggtccggcgacttcctcgacaagatcgaccgggaggacttcctgcgcaagcagcggaccttcgacaacgggagcatcccccaccagatccacctccaggagatgcacgccatcctccgccgccaggaggagcactaccccttcctgaaggagaaccaggacaagatcgagaagatcctgacgttccggatcccgtactacgtcggccccctggcccgcaaggggagccggttcgcgtgggccgagtacaaggccgacgagaagatcaccccctggaacttcgacgacatcctcgacaaggagaagtccgccgagaagttcatcacccgcatgaccctgaacgacctgtacctccccgaggagaaggtgctgccgaagcacagcctgctctacgagacgttcaccgtgtacaacgagctgaccaaggtcaagtacgtgaacgagcagggcgaggcgaagttcttcgacgccaacatgaagcaggagatcttcgaccacgtgttcaaggagaaccggaaggtcaccaaggacaagctgctcaactacctgaacaaggagttcgaggagttccgcatcgtgaacctgacgggcctcgacaaggagaacaaggccttcaactccagcctggggacctaccacgacctgcggaagatcctcgacaagtccttcctggacgacaaggccaacgagaagaccatcgaggacatcatccagaccctgacgctgttcgaggaccgcgagatgatccggcagcgcctgcagaagtacagcgacatcttcaccaaggcccagctgaagaagctcgagcggcgccactacaccggctgggggcggctgtcctacaagctgatcaacggcatccgcaacaaggagaacaagaagaccatcctcgactacctgatcgacgacgggtacgcgaaccggaacttcatgcagctgatcaacgacgacgccctcagcttcaaggaggagatcgcccgcgcccagatcatcggcgacgtcgacgacatcgccaacgtggtgcacgacctgcccggctcccccgcgatcaagaaggggatcctgcagagcgtcaagatcgtggacgagctcgtgaaggtcatgggccacaaccccgccaacatcatcatcgagatggcccgggagaaccagatgacggacaaggggcgccggaactcccagcagcgcctgaagctgctccaggacagcctgaagaacctggacaacccggtgaacatcaagaacgtggagaaccagcagctccagaacgaccgcctgttcctgtactacatccagaacggcaaggacatgtacaccggggagaccctcgacatcaacaacctgtcccagtacgacatcgaccacatcatcccccaggccttcatcaaggacaacagcctggacaaccgggtcctcacccgctccgacaagaaccggggcaagagcgacgacgtgccctccatcgaggtggtccacgagatgaagtccttctggagcaagctgctgagcgtgaagctcatcacgcagcgcaagttcgacaacctgaccaaggccgagcggggcgggctgaccgaggaggacaaggcgggcttcatcaagcgccagctcgtggagacccggcagatcaccaagcacgtcgcccagatcctggacgagcgcttcaacacggagttcgacgggaacaagcggcgcatccggaacgtgaagatcatcaccctcaagagcaacctggtgtccaacttccgcaaggagttcgagctgtacaaggtccgggagatcaacgactaccaccacgcccacgacgcctacctgaacgcggtggtgggcaacgccctcctgctgaagtacccccagctcgagccggagttcgtctacggcgagtaccccaagtacaacagctaccgctcccgcaagagcgccaccgagaagttcctgttctactccaacatcctgcggttcttcaagaaggaggacatccagaccaacgaggacggggagatcgcctggaacaaggagaagcacatcaagatcctccggaaggtgctgagctacccccaggtgaacatcgtcaagaagacggaggagcagaccggcgggttctccaaggagagcatcctgcccaagggcgagtccgacaagctcatcccgcgcaagaccaagaacagctactggaaccccaagaagtacgggggcttcgactcccccgtggtggcctacagcatcctggtcttcgcggacgtggagaagggcaagtccaagaagctgcggaaggtgcaggacatggtcgggatcaccatcatggagaagaagcgcttcgagaagcaccccgtggacttcctcgagcagcggggctaccgcaacgtgcgcctggagaagatcatcaagctgccgaagtacagcctcttcgagctggagaacaagcggcgccggctgctcgcctccgcccgcgagctgcagaaggggaacgagctggtcatcccccagcggttcacgaccctcctgtaccacagctaccagatcgagaagaactacgagcccgagcaccgcgagtacgtggagaagcacaaggacgagttcaaggagctgctcgagtacatctccgtgttcagccggaagtacgtcctggccgacaacaacctgaccaagatcgagatgctgttcagcaagaacaaggacgccgaggtgtccagcctggcgaagtccttcatcagcctgctcaccttcacggccttcggcgccccggccgccttcaacttcttcggggagaacatcgaccgcaagcggtacacctccgtgaccgagtgcctgaacgcgaccctgatccaccagagcatcacgggcctctacgagacccgcatcgacctgtccaagctgggcgaggactga

SEQ ID NO: 1845 - RNA, 4038 nt, synthetic construct
  misc_feature 1..4038: note = Cas9 variant
  source 1..4038: mol_type = other RNA
atgaagaaggagtacagcatcggcctggacatcgggaccaactccgtgggctgggccgtcatcaccgacgactacaaggtgcccgccaagaagatgaaggtgctcgggaacacggacaagcagagcatcaagaagaacctgctgggcgcgctcctgttcgactccggggagaccgccgaggccacccgcctgaagcggaccgcccgccggcgctacacgcggcgcaagaaccggctccgctacctgcaggagatcttcaccgaggagatgaacaaggtcgacgagaacttcttccagcggctggacgacagcttcctcgtggaggaggacaagcagggctccaagtacccgatcttcggcaccctgaaggaggagaaggagtaccacaagaagttcaagaccatctaccacctccgcgaggagctcgccaacagcaaggagaaggcggacctgcggctggtgtacctcgccctggcccacatgatcaagttccgcgggcacttcctgtacgagggcgacctcaaggccgagaacacggacgtccaggcgctgttcaaggacttcgtggaggagtacgacaagaccatcgaggagtcccacctgagcgagatcaccgtggacgccctctccatcctgaccgagaaggtcagcaagtccagccggctggagaacctcatcgcccactaccccacggagaagaagaacaccctgttcgggaacctgatcgccctctccctgggcctgcagcccaacttcaagaccaacttccagctcagcgaggacgccaagctgcagttctccaaggacacctacgaggaggacctggaggagctcctgggggagatcggcgacgagtacgcggacctgttcgccagcgccaagaacctctacgacgccatcctgctgtccggcatcctcgccgtggacgacaacacgaccaaggcgcccctgagcgcctccatggtgaagcgctacgaggagcaccagaaggacctgaagaagctcaaggacttcatcaaggtcaacgccccggaccagtacaacgccatcttcaaggacaagaacaagaaggggtacgccggctacatcgagagcggggtggagcaggacgagttctacaagtacctgaagggcatcctgctcaagatcaacggcagcggggacttcctggacaagatcgactgcgaggacttcctgcggaagcagcgcaccttcgacaacggctccatcccccaccagatccacctccaggagatgcacgcgatcctgcggcgccagggggagcactaccccttcctgaaggagaaccaggacaagatcgagaagatcctgaccttccggatcccctactacgtgggcccgctcgcccgcaaggggagccggttcgcctgggccgagtacaaggccgacgagaagatcacgccctggaacttcgacgacatcctggacaaggagaagtccgcggagaagttcatcacccgcatgaccctgaacgacctctacctgcccgaggagaaggtcctgcccaagcacagcccgctctacgagaccttcacggtgtacaacgagctgaccaaggtgaagtacgtcaacgagcagggcgaggccaagttcttcgacaccaacatgaagcaggagatcttcgaccacgtgttcaaggagaaccgcaaggtgaccaaggacaagctgctcaactacctgaacaaggagttcgaggagttccggatcgtcaacctgacgggcctcgacaaggagaacaaggccttcaactccagcctggggacctaccacgacctgcgcaagatcctcgacaagtccttcctggacgacaaggccaacgagaagaccatcgaggacatcatccagaccctgacgctgttcgaggaccgggagatgatccgccagcggctgcagaagtacagcgacatcttcaccaaggcgcagctgaagaagctcgagcgccggcactacaccggctgggggcgcctgtcctacaagctgatcaacggcatccggaacaaggagaacaagaagaccatcctcgactacctgatcgacgacgggtacgccaaccgcaacttcatgcagctgatcaacgacgacgccctcagcttcaaggaggagatcgcccgggcccagatcatcggcgacgtggacgacatcgcgaacgtggtccacgacctgcccggctcccccgccatcaagaaggggatcctgcagagcgtgaagatcgtcgacgagctcgtgaaggtgatgggccacaaccccgccaacatcatcatcgagatggcccgcgagaaccagacgaccgacaaggggcggcgcaactcccagcagcggctgaagctgctccaggacagcctgaagaacctggacaacccggtcaacatcaagaacgtggagaaccagcagctccagaacgaccgcctgttcctgtactacatccagaacggcaaggacatgtacaccggggagaccctcgacatcaacaacctgtcccagtacgacatcgaccacatcatcccccaggccttcatcaaggacaacagcctggacaaccgggtgctcacccgctccgacaagaaccggggcaagagcgacgacgtcccctccatcgaggtggtgcacgagatgaagtccttctggagcaagctgctgagcgtcaagctcatcacgcagcgcaagttcgacaacctgaccaaggcggagcgcggcgggctgaccgaggaggacaaggccggcttcatcaagcggcagctcgtggagacccgccagatcacgaagcacgtggcccagatcctggacgagcggttcaacaccgagttcgacggggcccagcgccggatccgcaacgtcaagatcatcaccctcaagagcaacctcgtgtccaacttccggaaggagttcgagctgtacaaggtgcgcgagatcaacgactaccaccacgcccacgacgcgtacctgaacgccgtcgtgggcaacgccctcctgctgaagtacccccagctcgagccggagttcgtgtacggcgagtaccccaagtacaacagctaccggtcccgcaagagcgccaccgagaagttcctgttctactccaacatcctgcggttcttcaagaaggaggacatccagacgaacgaggacggggagatcgcgtggaacaaggagaagcacatcaagatcctccgcaaggtcctgagctacccccaggtgaacatcgtgaagaagaccgaggagcagaccggcgggttctccaaggagagcatcctgcccaagggcgagtccgacaagctcatcccgcggaagaccaagaacagctactggaaccccaagaagtacgggggcttcgactcccccgtcgtggcctacagcatcctggtgttcgccgacgtcgagaagggcaagtccaagaagctgcgcaaggtgcaggacatggtggggatcacgatcatggagaagaagcggttcgagaagaaccccgtcgacttcctcgagcagcgcggctaccggaacgtgcgcctggagaagatcatcaagctgccgaagtacagcctcttcgagctggagaacaagcggcgccggctgctcgcctccgcccgcgagctgcagaaggggaacgagctggtgatcccccagcgcttcaccaccctcctgtaccacagctaccagatcgagaagaactacgagcccgagcaccgggagtacgtcgagaagcacaaggacgagttcaaggagctgctcgagtacatcagcgtgttctcccgcaagtacgtgctggcggacaacaacctgaccaagatcgagatgctgttcagcaagaacaaggacgccgaggtctccagcctggccaagtccttcatcagcctgctcacgttcaccgccttcggcgccccggcggccttcaacttcttcggggagaacatcgaccggaagcgctacacctccgtgaccgagtgcctgaacgccacgctgatccaccagagcatcaccggcctctacgagacccggatcgacctgtccaagctgggcgaggactga

SEQ ID NO: 1846 - RNA, 4041 nt, synthetic construct
  misc_feature 1..4041: note = Cas9 variant
  source 1..4041: mol_type = other RNA
atgaaccagaccaagaactacgacatcggcctggacatcggggtgggcagcgtcgggtggaccatcacggactcccagagccagaaggtgctcaaggtgaagggcaagcaggggatcggcgtccacctgttcaacgagggccagaccgccgaggagcgccggcagttccgcaccaaccggcgccggctgaagcgccggaagtggcgcctccggctgctgcgcgagctgttcgacgagcccatctccagcatcgacccggagttcttcgcccggctgaagtacttcaacgagtccagcaaggaccccaagaacaaggggtaccagccccagctgcacgacgacctcaaggacgtggacttctaccgccagtaccccaccatctaccacctccggcacgcgctgatgacgcagaaggagaagttcgacatccgcgacatctacctcgccatccaccacatcgtgaagtaccggggccacttcctgatgaacgggcactccagctccttcagcgtcgcccagaccgactggaaggccgacctgaccaagctgttcgagctgatccaggagacccgcacgaacctggacttctccttcgacctcaccgagatcgacaccatcaagagcctgctgttcgacaagaacctctcccggaacgaccgccagaaggagatcgtgggcctgatcaacaacaacagccagctggacaagaaggacaaggccctcaccaagcagctggtggagtccgtcgtgaaggggatcgtgggcatgaagacgcggaccgacatcctgctcggctacgaggtcgacaacaaggagcagagcaaggcgtggaacttctccatcgacgagctggacgaccagatggccaccatcgacccggccctgagccagaactcccaggcccacgacatcatcaccctcatccagaagctgtacatgacggtgcagctggcgcagatcgtgcccgaggggcagagcgtcagcgagatgatgatcaaccgctacaacctctacgccgagcagctgcagcagctgaaggactacaagaagatcaacctcgagaccggcctgctgctccgggaggcctacgacgagctgatgaccaaggccctgaccgccgcgcccgggaagacgatccacgacaccttctacaacaaggtgaagaagatcctcaaggaccaggacaacaagcaggccctgtccatcaagcaggccatcgaggacagcaactacctgatccccctccgcatcaagtccaacggcgtgatcccgtaccagctgcaccagcgcgagctggacgccatcatcgagaaccagaaggagttctaccccttcctcgccacccccaaccccgtcgacggccaccaggaggcgctgccgtacaagctggacgagctgatcgggttcaaggtgccctactacgtgggccccatggtcgaccccgaggtggacagcgaccagaacttcgcctggatggtgcggaaggagaagggggagatcaccccgtggaacttccacaacaaggtcgacatcacgcagtccgccgacaacttcatcaagcgcatgaagaccaccgacacctacctcatcggcaaggacgtgctgccccagaacagcctgctctaccagcggtacacggtcctgaacgagctgaacgggatcaaggtggccaacaagaagctcaccatcgagcagaagcagcgcctgtacgaccagctgttcaagaagaagaagaccgtgaagaagcaggacatcctcaacaacctggtcgccgcgggcgagatccacgaggacgacaacctgaccggcctctccaacgggacgaccttcaacaacaacctgggcagctacatcgactactgcaagatcatcgggcaggacaagctggaggacgcctccaagcaggccgacatcgagcggatcatcgagtggagcaccaccttcgaggacgccaacatcttcctcacgaagctggccgagatcaactggctgaccgaggaccagcgccagaagctctcccagatccggtaccgcggctgggggcagttcagcaagaccctgctgaccgacatcaaggacaacaaggacaactccatcatcgacaacctcatgagcaccaagaaggtgttcatgcagatcatcaacgacacgaccatcaagcagaagatcgacgactacaaccagtaccacctgaaccacgcggacctgaaggacaccatcgccaacctcttcaccagcccccagaacaagcgggccatcaaccagacgctgctggtgatcgaggacatcatcaacgccgtcggccacaagcccaaccgcatcttcatcgagagcgcgaaggacaaccggaacgccaagaaccagctcacccagtcccgcctgaagcggatcgtgaagcagttcgaggacaacaagcagcacgtggaccagagcgtctacgaggagctgaagcagctcgacgacggctcccacgccagcatcgacgaccgcctgctgctctacttcctgcagaacgggaaggacatgtacaccggccagccgatcgacatcagccagctgtccaccagccagtaccacatcgaccacatcctcccccaggccaaggtgatggacaacgccctggacaaccgggtgctggtctccagcaaggcgaacacggagaagtccgaccgcttcctcagcgagatcccccagttccagcagcggtccctgtgggccgagctggagcgcatggggttcctcaccaaggccaagaaggagcggctgctgatgaccagcgacgagttcaagcagaactccgtgcgcttcatcgcccgccagctcgtggagacccggcagatcatcaagctggtcaaccagctgatcatccaggagcaccccgaggtgaagctcgtgaacatcaaggccgacctgacgaacgcgttccgcaagaagttcaacttcgtcaagaaccggaacgccaacgactaccaccacgccttcgacgcctacctgaccagcctcatcggctcccacctcctgaagtcccacccgaagtgggagcccctcttcgtgtactccgactacgacaagatcaagttcgacaacgcgccccagggggtgaacatcatgaaggagttcgagcagagcaagctggccgacgagaacggcgagatcatctggaacaaggacgagatgatggcctacctggagcgcctctacaactcccggcagatcctgatcaccaagaaggtctacgcccgccacggcaacctgttcaagcagaccatcttcaaggccggggagagcgacaacctcatccccgtgaagaacaaccggtccgacatcgcgatctacggcgggtacaagagcaagcaggtcagctactacgccctgatctccctgcacaacaagaagcgccagaagcggctcgtggccgtgtacctgatcgacatccagaagctgcagaacctcaacgagagcgactacttcaagacgctgcacaccatcatcaaggagcgccacaacatcaagccggagttcgacatcctggccgacaagatctaccagaaccagctcatcatcgacaacaagaacggctccaaccggcccttccgcatcgagggcgacttcaagaacgaccggcagctgtacctgcccctccagtaccagcgctggctggccagcaaggagccgaccgacgagaagctgaaccggatcttcgaccacatctgcgagcagctcgcggactacttccccctgttcgccgggaacgcctgcgacaagctgctcgacaaccgcgacaagttctaccagctgtccatcaagagcgagttcaacgacaagggcaagctgatcgccgaggggaagctctccgtgatcgacaagctgctggtcgccatgcacgcggacagccggaactccaacctcgccgtgatcggcctgagctccagctgggggcgcttcaagctgcacggcggcaacgaggccatcgggacctccgtgcagctcatccaccagagccccacgggcctgttcaagcggatccagcgcttcaactga

SEQ ID NO: 1847 - RNA, 4041 nt, synthetic construct
  misc_feature 1..4041: note = Cas9 variant
  source 1..4041: mol_type = other RNA
atgctgagcgccggcgtgatgctcggggacgtctccgccctcaagagctcccgcaacagcctgttccagaagtccaagaagctgatcgagaacagctccagcgacctgaccaaggtggactactccaagatgcgggagatcctgctcagcatccgcaacatcgcgatccggttcttcaacaacgaggacttcaaggagtccgactactacaaggagttccccaccatctggcacctccgcaagaacctgatggagagcgacaagaaggccgacatccggctggtgtacctggccctgcacaacatcgtcaagtaccgcggcaacttcctccaggagaacaacaaggacctgcgggccgccaacgcgaacgccggggccgccgcgatcgacctgtccaacgccctcgaggagtacttcagcctgcacgaggacgagtccgccctgacgtgcgtgccgaacgtggccgacctccagatgaccctggagcagcccggcctgcgcaacggggagcggctcgaccgcatcgtcgccgcgctgaacatgcccgaccgggcccgcgccaagctgttcgccaaggcctgcatcggccagaaggtggagttcagcaagctcgcgctgggcatggagaagcaggaggggaccaacgcctacatctgggacgacgacaagtacgacgagctggtggccctctgccccgaggacttcttcccggtcctggagaccctgaagaacgcctactccgcctacgtgctcagcgacctgctggcgggcaagctctccatcagcgccagcctgatcgactcctacgagcagcaccagaacgacctgaagatcgtgaaggagctcgtccgggagtacctggggcagaaggagtacggccgcctgttccgggggcccaagttcgccaacggcgactacaacttcaacaaggtggccaagcccagctacacgtcctacatcctcggcgagagcctgtgcaacaagcaggggaccacccgcgaggagctggtgaaggagctcaagcgggtcttcgacgactgctccgccatccaggcggacaagcgctaccagaagatcaagcagcggctggaggacgaccccaagttcctgatcaagcagaagacccgcgccaacggcgccatcccgtaccagctccacctggaggagatgcaccagatcatcgagaagcaggggaagtactaccccttcctggtggagcagcaggacctcatcgagaagctggtgagctcccggatcccctactacgtcggccccctgaacggcgggcacgacccgaaccacccctaccccacgaaccccatcgacccgaagcgcaagttcgcctggagcgtgcgcaagcccggcatggagcacgagaaggcgtacccctggaacgtggacgaggtcatcgactccgaggagaccgccgagcggttcatccgccggatgaccgggacctgcacgtacctgtacggcgagcccgtggtgccgcgctgcagcctcctgtacgaggagttctgcgtcctgaacgagctcaacggggcccggtggggcgagggcaacggggacacccaccgcttcgactccagcgaccggaccgagatcctggagcagctgttcaagaagcgcaagcgggtgacccacaaggccatcgccacgtggctcgagatcaaccacggcgtcaccaacgtgaagatctccgggacccaggcggagaacgccttcgagagcaagctgtccagctacaacgacttctgcaacctgctcggcgtggacgggctggaggacgtctgccccctgaccaaggacgacatcgagcagatcatcctctgggtgacggtgttcgaggacaagaagctgctgctccagaagctgcagcgcgccttcggcgacaagctgtccgagaagcagatcgccagcatcatgcggaagccctacgccggctgggggcgcctctccagcaagctgctgaccggcatcaagcgggagacccccttcgggcgcatcagcatcctcgacgtcatgcgggacggcgacccgcgccccgggcaccacctggacgcgatgaacttcatggagatcctgcgggagaaggacttcggcttccaggaccgcatcgacgagatcaacaaggagcggaccaaggagtccggcctcctgctgagcgtggaggacctccccgggtcccccgccctgcgccgcagcgtgaaccaggccatgcacatcctgaaggagatcgtctccatcgccggcaaggagccgagccggatcgtgatcgaggtgacgcgcgaccccgacgaggagaagcgggggcaccgcaccgacacccggtacaagcagctctccgaggccctggcggccatcaagaccgacatcgtccagttcgacagctccctgctcgccgagctgaaggagcgcaaggacagcctggactccgagcggctcatgctgtacttccagcagtgcggcaagagcctgtactccggcaagcccctcgacatcaaccgcctgagcgagtaccaggtggaccacatcatcccgcagtgctacatcaaggacgactccctggacaacaaggccctcgtgttcgcgagcgagaaccagatcaagctggactccctgctcctggacaagagcatcatccggagccagaaggggcgctggcaggagctgcaccgggccggcctcatctccaacaagaagttccgcaacctgacgtgcaccgagatcagcgaccggatgatgaaggggttcatcaaccgccagctggtcgagacctcccagatcgtgaagttcgtgcggcagatgtgcgagcagcgctacgagagctccgaggtcatcagcctccgggcctccctgagccacaacctgcgcgaccggtgcggcttcatcaagtgccgcgagctcaacgactaccaccacgcccacgacgcctacctggcgtgccagatcgcccggttcatcgggatccgctacccccgctggcaggacggcatctcccgggagttcatcaacaagtacatcaagcagctggtgaagaagggcaagagctccgggaagttcttcgccggcaagagcgggttcatcatcgactccttcatgcacgacggcttcgaccgcgagaccggggagatcttccgggacggctgggacgccacgttcgagatcacccgcatgcggcgcgtgctcggctacaaggactgcttcatcacccggatgcccgaggagcagaccggggcctactgggaggagacgatctacagccccctggacgcgaagaacggcaagaacctgcagatcccgctcaagcagtccgggaaggagggctacctggaccccaagaagtacgggggcaccaacaccgccttcaacgcctacttcttcgccttcgtcgccaaggacgcgcgcggccgggacaagtacttcttcgagggggtgcccgtgtacctggccaagcagctcaacgagcagccccagatcctggtcgacttcgccaacagcatcgccgcgaccaagaagtgctccaccgccaagatcctgcgcagcaaggtgccgctccggcagaagttcctgctggacggcacgtccttctacctcgggggccgcaccgggaacaagaacgtgatcctgagcggcgtcgagttcgcctgcggcatcgacatggccaagatgatcgacaccgccatcaagcaccccgaggagctgagccagaaggagctcatctccatcatccagatgctggcggacaccatcgagcggaacagcgaccgccaggcctccctgatcaacttccggcgcttcgacgacaagctccggaacatcgacgccatcgccgccagccgcatcatcaagaacctgctgaactccatgaacggggtgaagcagagctgcgacctctccgacctgggcgggagcaagcagtccggcttcatgcagagcaacatcgcgacgctgttcgagcggatcacctggtgctactccagcatcaccggcatgttcgagcagcgcgtgtccttcgaggacctcaagaacgggatctga

SEQ ID NO: 1848 - RNA, 4041 nt, synthetic construct
  misc_feature 1..4041: note = Cas9 variant
  source 1..4041: mol_type = other RNA
atgaagaagcgcaaccgggaggagtactacgtgggcctggacatcgggaccagctccgtcggctgggccgtggccacccccgactaccgcatcccgaagttccgggggcacaagatgtggggcagccgcctcttcgcggaggggaagcgggccgccgagcgccggcagttccgcacgaaccggcgccggctggcccgccggcgcgaccggctgcagatcctcgaggagctgttcgccgaggagatggcgaaggtggacaacaccttcttcatgcgcctgaaggagtccaagttcttcctcgaggacaagaccgtcaaggagaagcacatcctgttcagcaccgacaagttcgacgccgaccggttctacaaggacaaccccacgatctaccacgtgcgcaagcggctgatggaggaggagccccaggacatccgcgagctgttcctcgccgtgcaccacatcctgaagtaccggggccacttcctcttcgccggctccctggagcagaacggggacagcatcgaggagctggtccgcaccctcttcggcaagcaggggctggcgatcctggacgacaccatcgactccaacgagatggtgaacatcctcaagaacaacgagaagaccaagagcgaccgcaagaaggccgtgcaggagctgtggaaccccctgaaggacaaggtcaagaaggcccaggccgccgagatggcgggcgtggtgctcgggctgaactccgacatcagcaagctgttcgacaactccgactacaaggacctcaagatcaacttcagctccggcgactacgacgagaagcgggacgactacgccaacagcatcggcgacgacatcgtcctgctggacacgatgaaggccctctacgacaccctgatcctgtcccagatcctccaggggaagcagagcatctccgaggccaaggtggaggactacaacacccacaaggagcagctgcgcgccctgaaggcgatcctcaagccgcacaagcggctgtacaacgagatgttccgcgagaacaacaagaaggacctgagcaactacgtggcctacatctccagctacagcgagggcaagcgggtcaaccgcgaggggttctacaagtacgtgcaggccgtgctcaagcaggtcgacgactccgacagcaagcaggccatcctggaggccatccggctggagaccttcctccccctgctgcgcgtgaaggacaacgcggtgatcccccaccagatccaccaggccgagctcgaggccatcctggagacggcccggaagaagtacaagttcctgaacgacgtctccgagggcgtgagcgtgaaggacaagatcatccagctgttcaccttccgcatcccctactacgtcggcccgctcaacccccactccggggagaccgtggccgaccggaagcagggcaccgggtgggtcgtgcgcaagcagcggggcaaggtgtacccctggaacttcgcggacatggtcgacgtgaaggccagcgccgaggccttcatcacgaacctgaccaacaagtgcacctacctcatcggggaggacgtgctgcccaagcgctccctgctgtacagcgagttcatgctcctgaacgagctgaacatgatcaagtacgacggccacgagctcccggtcgagatcaagcggctgtacatcgagcaggtcttcaagcaggagcacaagaagcagaccaagggccgcgtgctggacttcctcaagcggaacgggctgatcacgggctccgcgaccgccgtgatcaccgggatggacgacagcatcaagggcgacctgcagtcctaccgcgacatggtgcggatcttcgggaccggcttcgaccacagcatggccgagcgcatcatccgctgggtgaccctcttcggcgaggccaaggacatcctggagaacaagatccgggaggtctacgggaactccatcagcgactcccagatgcgcgccatcaagaagctgaagtacgcggactggggccggctcagccaggccttcttcatcaagatcatcgggtgcgacaagtccggcgtggagcgcaacatcatcacgtgcctgcgggagagctcccagaacctgatggagatcctcagcgaccaggggacctacatcaagcagatcaaggcctggaaccaccagcacaccacgaacatgatggacaccctggactaccagctggtggacgacctctacgtcgcccccagcgtgaagcgctccatctggcagagcctgtgcatcgtggaggagctggtcaagatcatgggccaggcccccaagaagatcttcgtggaggtgacccggaccaaccaggcggagaagacgaagaaggactcccgcaagaagcggctcgtcgagctgtacaccgccatcggcaaggagggggccgcctggaagaaggagatcgagaagcaccaggccggcgacttccgccggaagaagctgtacctctactacacccagatggggcgctgcatgtacagccacgagcccatcgcgatggacgccctgttcacctccgagtacgacatcgaccacatctacccgcagagcctgacgaaggacgactcctgggacaacctcgtgctggtcaagagccagctgaacaaggagaagtccgaccagtaccccctccggcccgccatccgcgagaagaacaaggcctactggcagtacctgtgccgggcgggcttcatcagcgagaagaagtacgagcgcctgatgcggaccaccgagctcaccgccgaggagctgtccggcttcatcgcccgccagctggtggagaccagccaggccacgaaggccgtgatcgggctcctggagcggatctacaagcacaccgacatctgcttcgtgaaggcggagaccgtctcccagttccgccaccagcacaacttcatcaagatccgggagctgaacaactaccaccacgccaaggacgcctacctcaacatcgtggtgggcaacgtctaccacgagaagttcaccaagaacccccgcgagttcatcgcccgcagcacggagcggcgcccgtacaacctgaaccggatgtacgacttcgacctgctcaagcaggggcgcgtgatctggcaggtccccaagtccctggagaccgtgcaggccatgatgaagtccaacgacgtgcggatcaccaagaagctgctcgtgcagaagggcgagctgtacgacgcgaccatcacgaaggcccacaagaccaaggaggggatgtacttccccctgaagggcgccgacgcccgcctccgggacgtccaccgctacggcgggtacgagaagatcaagatcgcctactacagcgtgttcagctgctgcgagaaggcgagcgacaccatccacaccctgatcatccccatcccggtgtacgccgccggcctgctccagacggaggccgacctgaccgcgtacgcctggcagaccaagcagaagaccaagcccatcaaggacatctactccatgatcacgcccatctacaagaagctgtgcatcaacaccgtcgtgaagatcgacgggttcaagtacttcctcggcgggcggaccgaggactacatctgcctgtaccccgccatcccggtggtcctggacgagcaggccgccgcgtacctcaaggccgtgagcaaggtgggccgcgccgacgacgtcgagaacaccgcccaggccatcgacctgatcacggcggaggccaacgaggccttctacgacgtgctgctcaagaagatggaggccaagatcttcgtgaaggcctaccaggagcgggtcgagaagctggcgtccgagaccgcccgcgagcggttccgcaagctgagcatcggcgcccagtgctcctgcctcctggagatcctgaacctcctggccaacaacaagaccaccagcaacctgaagaagtggctcggggtgacgatgtcccggcgcaagcagcccatggacctgaccaagctggaggagtgcatcgtgtacgagaccagcatcaccggcctctacgagaaggccgtctccctgctgtga

SEQ ID NO: 1849 - RNA, 4041 nt, synthetic construct
  misc_feature 1..4041: note = Cas9 variant
  source 1..4041: mol_type = other RNA
atggtggagcactacgccatcggcttcgacatcgggaccggcagcaccgggttcgccggcgtcgaccccaacgggaagctggtgcgcatgcggggcaagaacgtgtacggcgtctaccgcttcaagggcggggaggcggccgccgaccggcgcgggttccggacgacccgccggcgcatcaagcggcgcaagtggcggctccgcttcctgaagtccttcttcgagccgtacatcgcccccatcgaccccgagttcttcctgcggcagaagtacagcgccgacagccccctcgacccgaagggcatccgcgcggacaaggggctgctgtccgacatgtccgaccaggagttccacgccaagtaccccaccatctaccacctccggtaccagctgatgcacgagaagcgccagttcgacgtgcgggagatctacctggccatgcaccacatcatcaagtaccgcggccacttcctcatcgaggacggcgccgacaacttcgacgcgaagcagatcgacttcttcgaccagttccagcggatggccgccgtgaccgccgggctgcccgagctggagacgctcgtcgtgcccgacgagacccagagcgacgccttcaagcgcgtgctgttcgacgagtcccagaccaagagcgaccggcagaaggtcctggcgtcccagctcctggacatccaggacaaccagagcaaggccatcaaggacttcatcgccgccctgaccaaggccgtggtgggcatgaaggcgaacctcgccacgctgacctccaccgccatcgagagcaccgacaagaacgactggacgaagccgctggggcagctcgacgacttcctgctgaagcacgaggaggacctcgacgaggacggctacgccctgatcgacgccgcgaaccagatgtactccgccgccgtcctggccgccctcgtgcccgagggcatggggttcagcgaggcgatgatggcccgctacgcccagcacaagaagcagctggccctgtacaagcaggtcatcgcgtccctccccgacaagacccagcgccacgagctgaaggacgcctacgccgactacatcgagcacgccgcccagaacccccgggacgcgttctacaagcgcgtgaccaaggtgctggagggcgtggacagcgccgacgcccggaccgtcatgacggccatctcccacgacgagttcctcctgaagcagcgcaccctgagcaacgggaagatcccgtaccagatgcagcagcacgagttcgacgccatcatcgagaaccagaaggcgtactacccctggctcgccacccccaaccccgtggaggccgacgccaagcggctgccgtactacctggacgagctcatcggcttccgcgtgccctactacgtcgggcccatggtgaccgagaagcagtcccagttcgcctggatgatccggaaggcggacggcgagctgacgccctggaacttcttcgacgtggtcgaccgcgagaagaccgccaaccggttcatccagcgcatgcagaccaccgacaagtacatcctgggcgaggacgtgctcccgaagcacagcatcctgtaccagcagttcgaggtcctgaacgagctcaacaacatccgggtggagaagcaccccctgacgaccgagcagaagcagttcatctaccagcgcctgttcgtggaccagcagcggaagaccatcaccaagaagaacctccaggacacgctggtcgccatgggggagttcgacaaggcccccgacatcggcgggctggcgaaggaggacgtgatgatgagctccctggccaccttcgccgactacagcaagatcctccccgaggccatctccgacccgacccgccagaacgacatcgaggacatcatcgcctggagcaccatcttcgaggacacgcagatcttcttcgacaagctgaagaccgtggactggctgaccacccagcagcggaagcgcctcgcgtccatccggtacacgggctgggggaagctgagcaagcgcctgctccagcagatccccacctccaagcacaccaacgtcatggccgccctgtgggccaccagcgacaacttcatgcagatcctgcaggacgagcagttccaggagggcctctacgacgccaaccggctgcccgaggagaccctgacgcccgacgagcaggtcgagaagatcctcgacgaggcgtacctgtccccggccgacaagaagggcgcccgcaaggtgatcaaggtgatgaacgacatcgtgcgcgccaaccacggggtgctgcccgagcaggtcttcctcgagagcgccgacgacccccagaagaacaagcggcgctccgtgagccggtccaagcagctggaggagaagtaccgccaggcggcccagagcttcatcgacgaggccgtgaaggaggagctgaacgcccagatcgtcaactccgcggagttcaacgaccggctcgtgctgtacttcacccagaacggccgcgacatgtacaccgggaagcggctggacatcgagaacctcggcagctaccagatcgaccacatcctgccgcagtccctggtgaaggacgacagcctcgacaaccgcgccctgaccgcccgggacatcaacgccgagatgtccaaccagttcgtcagcgagcgcttcgggctgggcccccgggccttctggcagcagctcaagaacaacggcctgatcagcgggcgcaagttccggaacctggtgatgcagcgcgacgagatcgacaagtacgcgcccggcttcatcaaccggcagctcgtggagacgcgccagatcatcaagaccgtcgagcagatcatccaccggctgtggcccgacatccagatcgtgaccatcaaggccaacctgacccaccaggtgcgctccgagctcgggttcccgaaggtccgggagctgaacgactaccaccacgccttcgacgccctgctcgccgcgcgcatcggccagtacctgctggagcactacgccggcctcaagcccttcttcacgtacggggagttcaagcggggcgacaccaagaagtacgggaccaccaacttcctgcgccgcctgacgaaggacaacaaggacaagaagggcgagctcctgcccgaggtgagcgactggatcgactccatcgacagcatctacaactacaagaagatccccgtggtctgggagaacaccaccaacatgtccgccctgttcgaccagaccatctacccgcggcccgaccgcgacacgaccaagcggaagctcatccccaccaagctggacaagcccaccgacatctacgggggctacagctccgccaagacggcctacatggcggtgatgcgcgtgcagaccaagaagggcaccgagtacccggtcttcaacatccccgtgagcatcgcctcccagctgaaccggatcaccgaccagacgatgctcaagcagcaggtcaagcagttcatcatcaacgccgagcagagcgcctccaagaagaagctgtacgagagcggggacgtgatcctgtcccgcgtggccctcggccagcggttcaccgacaagaactacggggaggtgttcctgatcagcaacatggaggtccagaacccccagtccctgtggctcggccgcgcgagccagcagcggctgacccgcgagcccgaggggaacgagaagccggagacctccctggccgacatctaccagcagatcctcaagcaggtcgaccggtacttcctggccttcaacatccgccagcagcggcagaagctgctcggcacgctggaccagttcaccagcctgcccgtgggccgcgtgaacgagcagacccggaccgaccagaaccagcgcagcatcatcgcccgggtgatgatcgtgctcgggaagggctcccgcgaggagaagttccccgagttcgggctgagcgcgctgggccggctcgtccgcaccgggggcatcacgctgtccgaggacgcccagatcatctaccagagccccaccggcctgttcgagcgccgggtggccctcaaggacctgtga

SEQ ID NO: 1850 - RNA, 4041 nt, synthetic construct
  misc_feature 1..4041: note = Cas9 variant
  source 1..4041: mol_type = other RNA
atggccaagatcctgggcctcgacctggggaccaacagcatcggctgggccgtggtcgacatcgagaacaacaacgagttcaccctgatcgagaagggggtgcgcatcttccaggagggcgtgaagatcgagaaggggatcgagggctccaaggcggccgagcggacgacctaccgcagcgcccggcgcatcaagtaccggcgcaagctccggaagatccagctgctgggcgtcctctccgagaacgggtactgccccttcctgagcaaggacgagctggactcctggcgctacaagaaggtgtacccgaccaacaagagcttcctcaactggcagaagaccaacgagatccagctggagaacccctacttctaccgggccctgctcgtggagaagaagctgaacctgaacatcgaggaggaccgcttcaagatcggccgggccttctaccacctcgcgcagcgccgggggttcctgtccaaccgcatggagggcacgaaggagaacgacgggaccgtcatcaagagcatcaccgagatctccaccgccaagggcgacaagacgctgggccagtacttctacgagcggtacaagaagggggagaagatccgcgacacctacacccaccgggaggagcactacctcgaggagttcgtgcgcatctgcgagttccagcagctggacaacaagttcgccgagaaggtgcggaaggccatcttctaccagcgccccctcaagagccagaagggcctcatcgggaagtgcgtcttcgagcccaagaagtcccggtgcagcgtgtcccgcccggagttcgaggagtaccgcatgctgtgcttcctgaacaacatcaagatcaagacccccagcgacgagaacctccggttcctgacggacaacgagaaggagaagctgaagccccagttcttccgcaagtccaaggaccacttcgacttcgaggacctcgtgaagcagctggcgcccaagaaccagttcaagttctacaagagccgggacatcctgccgggcaactggctgttcaactactccatgaacaccaccgtcagcggctgccccatctccgcccgcctgaaggacctgttcggggagaacttcatggacatcaagttcgactacatccgggagaaggacggcaagaagtccgtgatcgacatccacgacatctggcacgtcctcttcacctacgacagcgaggagaagctgaaggagttcgcccgcaaccggctgaacctcgacgacatcaagatcaaggagttccagcgcatccagctgaagaaggagtacgccgccctgagcctcaaggcgatccggaagatcctgcccttcctgcgcgaggggctcatctacagccacgccgtgttcatcgccaacatggagacggccatcccctccgagatctggaacaactacaccaaccggaacatcatcaagaacgagatctacaacatcatcagcaaccagaccgaggacaagcaggtcgtggacatcgtgaacggcatcatcaagtccagccgcatcgagaactccgtgtggagcaacgaggccgtggagttcttcaagaaggacctgaactccaagatcaagaactactacgggatcaagacctacaacgacttcccggaggagaagaagatccggatcgagacgtacgcgttcaacctgttcaagcagcagatgatgaagaacttcggccgcggcgagttcgccgccgtccagcggatcgacgagcgcctcaagctgttcctgaccgacaacttcaacatcgaccccatcctcctgaagaagatctaccaccccagcgccatcgaggtgtaccagcccccggtgcggaagaacgacgggaagctgtacctgggctcccccatggtcagctccatccgcaaccccatggccatgcgggcgctccaccagctgcgcaagctgatcaacgagctcatccgcaaggagctgatcgacagcaacaccaaggtgaacatcgagatggcccgggagctgatgaacgccaacgagcgcaaggcctaccagaactggcagaacgaccgggagaagatccgcaaggagtacgccctcaagatcaagcagcacctggacgtcgacaaggagccctccgacgtggacatcctgaagtaccagctctgggaggagcagaaccacaagtgcatctacaccgggaaggagatcaacatcagcgacttcctgggctccaacccgaagttcgacatcgagcacacgatcccccggagcatctccttcgacaacagccagagcaacaagaccctgtgcgagaactacttcaaccgctccgtgaagaagaaccggatccccgcggccctccccaaccacggggagatcatcgagcgcctggagaactggaagctgaagtacgaggagctcgagaagcagatccagtacgccgtccggcaggccaagggcgcgggcgacaaggacagcaaggaccgcgccatccagaagcggcacaagctgaagttcgagtacgactactggaagaacaagtacgaccgcttcgtgatggaggacgtgccggaggggttcaagaactcccagctggtcgacaccggcatcatcaccaagtacagccggatgtacctcaacacgctgttcgacaaggtgtacaccgtgaaggggaacaccgtcgccgacttccgcaagctgtggggcatccaggacgagtacgagaagaaggcccgggtgaaccactcccaccactgcgtggacgccatcaccatcgcgtgcatcaccaagagcaactacgagaacctcgccaagttctaccacgactgggaggagctgcacgtcaaggggatcgaccagctgccgcccatgaacaagccctggaagacgttcaccgaggacatcaaggccatccagtacgagatcctcgtgtcccactacacccccgacaacctgcccaagcagagcaagaagatcctgcgcaagaagggccggatccagaagaacgagaacggcaaccccatctacctcaagggggacacggtgcgcggctccctgcaccagcagaccttctacggggccatcgagaagaccgaggtcaacaagaagggcgagccggagaaggtgatcaagtacgtggtccgcaagagcctggacgtgctcgacgactccagcgtgaagaacatcgtcgacgacatcgtgaaggagatcgtgcagaacgcccggatcaaggagaaggacttcatcaaggagctggagatccagaagcggaagctggcgaaggccgaggagaacaaggtcgtgcagatccaggccgagatcgacaagctcaacaagcaggtcgccgacctgtacaccatgcccaacaagaacggcaaccccatccccatcaagaaggtgcgcatcttccagacctccgtgacgaacccgatccacctgaagcagcagcgcgacaagagccagaagacctccaagccccacaaggagttctactacgccgcgaacgacagcaactacatgatggccatctacgaggggaaggacgagaagggcaaggtgaagcgggacttcaagctcctgaacaacctggaggccggggagttcttcaagtactccgtccacaaggacctcaaggagaagaacctggagaacatccgcaacgtgatccccgacaaggtgagcgccggcaagatcgagatccccctgaaggcgatcatcaagaccgggaccatggtcatcctctgggagaacagcccggacgaggtgtgggacctgacgatctccgaggtggacaagcggctgtacaaggtcgtgggcatgagcgtgaaccgcatcaagtccgacgtcaagaccttcgagttcggcaacatcgtgctccggcacaacaaggaggccagccccgccaccctgctgaagatccaggacggggagttcaagtccgacgagaactacatcgcccagcgcaagctcagccacaaccagttcaacgccctggtggagggcgtcgacttctccctgagcgtgctcggggagatcaagcggctgaagtga

SEQ ID NO: 1851 - RNA, 4044 nt, synthetic construct
  misc_feature 1..4044: note = Cas9 variant
  source 1..4044: mol_type = other RNA
atgggcgaggacgggaagcccgtgcgcgtcaagggcaagaccgccatcggggcccggctgttccaggagggccacgtggcggccgaccgccggatgttccgcaccacgcggcgccggctcaaccgccggaagtggcgcctgaagctgctcgacgagatcttcgacccgtacatcacccccgtggacagcaccttcttcgcccggctgaagcagtccaacctgagccccaaggactcccgcaaggagttcaaggggagcatgctgttccccgacctgaccgacaagcagtaccacgaggactacccgacgatctaccacctccggcgcgccctcatgaccgaggacaagaagttcgacatccggatggtctacctggccatccaccacatcgtgaagtaccgcggcaacttcctgaactccgcgaccgtggacaccttcaaggccagcaaggtcgacttcaagaagtccttcaaccagctcaacgagctgtacagcgccatcaaccccgaggacgccttccaggtggacatgaacaagtccgacgagacgggccggctgttcctcgacagctccatccgcaagttcgacaagcagaagcagatcagcaagctgatccccgtggtcgtggaggacaaggaggcgaagaagctgaacgggaagatcgccctcgagatcaccaaggccatcctgggctacaagtccaagctgaacgtggtcacccagaccgagcccgaggacccgaagaagtgggccgtgaagttcgacgacgaggacatcgacagcaagctcaacgacatcctgcccgagatggacgagaaccagcagtccatcgtggagatcatccaggacctgtacagccaggtcacgctcaaccagatcgtgcccaacgggatgtccctgagcgactccatgatcaagaagtacaacgaccaccacgagcacctgaagctctacaagaagctgatcgacaacatcagcgacaccaagaagcggagcgccctgaagaccgcgtacgacaagtacgtgggcgacgacgggaagaccatcgagcaggacgagttctactccaacgtcaagaagaacctcgacgacagcgacctgtccaagcagatcgccgacctgatcgaggccgagaagttcatgcccaagcagcgcacgagccagaacggcgtgatcccgcaccagctccaccagcgggagctggacgagatcatcgagcaccagtccaagtactacccctggttcgccgaggccaaccccaacaagcacgacctgcacctcgcgaagtacaagatcgaggagctggtggccttccgcatcccctactacgtcggcccgatgatcacccccgaggaccaggagaagtcctcccagaccatcttcgcctggatgaagcgcaaggagcccgggcagatcaccccctggaacttcgacgagaaggtggaccggatggagagcgccaaccgcttcatcaagcggatgacgaccaaggacacctacctgatcggcgaggacgtgctcccggaccagtccctgctgtacgagaagttcaaggtcctcaacgagctgaacatggtgcgcgtcaacgaccaccccctgaaggtgagcgagaagcaggccatctaccgggacctcttcgagaaccagaagcgcatctccgtgaagaacctgcagaactacgtcaagagcaagtccgggctgcccaccggccccaagatcagcggcctctccgacccggaccacttcaacagctccctggggacgtacaacgacttcaagaagatgttcggcgacaaggtggacgaccccgacctgcaggacgacttcgagaagatgatcgagtggagcaccatcttcgaggacaagaagatcctgcgggcgaagctcgacgaggtggcctggctgtccgacacccagaagaacgagttcaaggagatccgctaccaggggtggggccggctgagcaagaagctcctgaccgggatcgtcgacggcaacggccagcgcatcatcgacgagctgtggaacacgaacaagaacttcatgcagatccagagcgacgactccttcgccaagcggatccacgaggccaacgccaaccagatgaaggcgaccgacgtggaggacgtgctcgccgacgcctacaccagcccccagaacaagaaggccatccgccaggtcgtgaaggtggtcgacgacatccagaaggcgatgggcggggtggcccccaagttcatctccatcgagttcacccggagcgaggaccgcaacccgcggcgcacgatctcccggcagcgccagctggagaacaccctgaaggacaccgcccaggccctcgtcaagagcatcaaccccgacatcctgtccgagctggacaacgccagcaagtccaagaaggggctcaccgaccggctgtacctgtacttcacgcagctcggcaaggacatgtacaccgggaagcccatcaacatcgacgagatcagcaactacgacatcgaccacatcttcccgcaggcgttcatcaaggacgactccctgaacaaccgcgtgctggtgagcaaggccggcaacaacggcaagtccgccaacgtgcccctcaagctgttcggggccaagatgggcgggtactggaagcagctggccgacgcgggcctcatcgggcagcgcaagctgaagaacctgcagaccaaccccgacaccatcagcaagttcgccatgcacggcttcatccggcgccagctcgtcgagacctcccaggtgatcaagctggtggccaacatcctgggcgacaagtaccggaacgacgacacgaagatcatcgagatcaccgcccgcatgaaccaccagatgcgggacgagttcgggttcatcaagaaccgcgagatcaacgactaccaccacgccttcgacgcgtacctcaccgccttcctgggccactacctgtaccaccggtacatcaagctccgcccctacttcgtctacggggacttcaagaagttccgggaggacaaggtgaccatgcgcaacttcaacttcctgcacgacctgacggacgacaagcaggagcggatcgccgacaccgagaccggcgaggtgatctgggaccgcaagcggagcatccagcagctccgcgacgtctaccactacaagttcatgctgatctcccaggaggtgttcagcctgaacaaggagatgttcaagcagaagctgttcccggccaccctcgcgaagaagtccaagctgatccagatcaagaaggacaagcccgtggacatctacggcgggtacagcaacaacacggacgcctacctcaccgtcgtgaagctgaagggcagcaaggaggacaagtacaagatcgtgggggtccccatgcgggccctggacaacctcaagcacgccgagaaggagagcccccagagctacaccgccgagctgcgcaaggcgctggagccgcagttcaccaagatcaagaagaaccggaagacgggcgaggtgtccaaggtggtcaccaacttcgacatcgtgctcgggcgcctgttctaccggcagatggtgatcgacggcagcgagaagtccctgatcgccagctccgtctaccagtacaacgccaagcagctcgtgctgagcgaccaggccatccgcaccatctccgaccaggagggcatcgacgagttcgagctgagctcccagtacgacaaggtgtacgacgagatcgtccagaaggtggagaagctcctgcccatcttccagcaccggcacttccaggagcgcctgaacaacggcaagagcctcttcgtgaacctgcccgtccacgacgtgtacgaggggaacaagctggagcaggtcgggaagaagcacatcatcaactccatcctcggcgggatccacgccaacgcggaccgccccgacatcgacctgttcggcatcaagaacctgggccagttcagctccaccagcgggatcaacctctccagcgacgccatcatctgctaccagagcccgacgggcctgttcgagcggcgcgtggtgctgaaggacctctga

SEQ ID NO: 1852 - RNA, 4044 nt, synthetic construct
  misc_feature 1..4044: note = Cas9 variant
  source 1..4044: mol_type = other RNA
atgaccaagcgcgaggagccctacaacgtgggcctggacatcgggagctccagcgtcggctgggccgtggtggacaacaactaccacctcctgaacatcaagaagaacaacctgtggggcgcccgcctcttcaaggaggcggagaccgcccaggtcacgcgggggcaccggtccatgcgccggcgctaccggcgccggcgcaaccggctgaactggctggacgagctgttcgccgacgagctggccaagatcgacccgagcttcctgctccgcatgaagaactcctgggtgagcaagaaggagtccacccggaagcgcgacccctacaacctgttcatcgacgagaagtacaacgacgtggactacttcaaccagtaccccaccatcttccacctccggaaggagctcatcaccgaggacaagaaggtcgacatccgcctgatctacctggccatccacaacatcatcaagtaccgggggaacttcacgctcgagaaccagaacttcgacatcagccagctgtccagcaacttctcccagcagatcagcgacttcttcgcgctgttctccgacttcggcgtgatcatgcccgaggacttcgacccggacaagatcagcgacatcctcctgaaccccaacctgtcccccagcggcaaggtgtccgaggccatcgccaccatcagccccaagaccaacgtcaaggccaagatcaagatcatcctcctgctgctcgtggggaacaacggcgacctgaagaagctgttcgacctcgagaccacggagaagatcgcggtgaagctgtccagccgccacatcgacagcgagctgccgatcatcctctccgagctgaacgagcagcaggagaacatcatcaccatcgccaacagcatcttcgggtccatcatcctgaaggacttcctcggcgacgagaccagcatctccgccgccaaggtcatcagcttcgaggaccacaagcaggacctgcagaagctgaagaccatgtggcgggagacgtccaacaaggaggccgtgaaggcggggaagaaggcctacgaggactacatcggccacgaggacagcgagaccttctacaagaagatcaagaagttcctcgagaaggcccagcccgtggacctggccaacaaggccctggcggagatcgagctcgagaactacctgcccaagcagcgcaaccggaacaacaccgtcatcccctaccagctgaacgagaacgagctcatcgccatcctggaccaccaggagaagtactacccgttcctgaaggagaaccgcgacaagatcctctccctgctgaccttccgcatcccctactacgtgggccccctccaggacagcaacaacaaccggttctcctggatgacgcgcaaggccagcggggccatccggccctggaacttctccgagaaggtgaacgtcgagcagagctccaacgacttcatcaagcgcatgcggagcaccgacacctacctgatcggcgagccggtgctgcccaagaagtccctgatctaccagtgctacgaggtgctcagcgagctgaacaacacccgcgtcaaggacgggtccagcaaccccaagcggctggacgtgacgatcaagcagcgcatctacaacgagatcttcaagaaccagaagtccgtgagcgtcaaggtgctccagaactggctgatcaaggagagctacttcaagtcccccgagatcagcggcctggccgacaagaagaagtacctctccagcctgtccacctacatcgacttcaagaagatcttcggccagcggttcgtcgacgacccggtgaacagcccccagctggaggagctcgcggagtggctgaccctgttcgaggacaagaagatcctcctgatcaagctgcagaactccaagtacagctacgaccaggccaccatcaacaagctctccacgatgcgctaccaggggaccggcaagctgagcaagaagctgctcgtggacctgaagaccaccaagaagtccatcggcaagagcggggccgagtccctgagcatcctcgacctgatgtggtccacgaaggacaacttcatgcagatcatccacgacgccgactacaccttcgagcagcagatcaaggagttcaactacgacaccgaggacgagctgacgcccctcgagaaggtcgccaacctgcacgggagccccgcgctgaagcggggcctcaaccagagcatcaaggtggtggccgacatcgtcaagttcatgggccacgacccggagaagatcttcatcgagttcacccgctccgacgacttcagcaagctgaccatctcccggtaccgccggatcaagaagcagtacctggagatcgccaaggccatcaagaagatccccgcggagttcaaggacatcaaggagtaccagacccagctcgaggagaacaaggggaagctggccagcgagcgcctgatgctctacttcctgcagtgcggccactccctgtacagcaacaagcccatcgacctcaacatgatcaactccagcaagtaccacgtggaccacatcctgccccagtcctacatcaaggacgacagcctggagaacaaggccctcgtgctggcctccgagaacgagaacaagatcgacaacatgctgatcagccacgacatcatcgccaccaacctcccgcggtggcaggcgctgaaggaccagaacctgatggggtccaagaagttcgccgacctcacgcgcaccaccgtcaccgagaaccagaagaagggcttcatccagcggcagctggtgcagaccagccagatcgtgaagaacatcacgctgatcctcaacgacctgtacaagaacacctcctgcatcgagacccgcgccaccctgagctccgagttccgcaaggccttcagcaacttcgacgagacgacctaccactaccagttccccgagttcgtcaagaaccgggacgtgaacgacttccaccacgcccaggacgcgttcctcgcctgcgtgatcggggagtaccagctgaagaagtaccccaaggacaacctgcgcctcgtctacgaccagtactccaagttcctggacagcctgaagaaggacacccggaagaagaacggccgcatgccgcggtacacccagaacggcttcatcatcgggagcatgttcaacggcaagacgtacgtggacgacaacggggagatcatctgggaccagaagatcaaggagtccatccgcaagaccttcaactaccaccagttcaacgtggtccggcagaccatcgagcagcacggcaagctgttcaacgacaccatccagccccacagcgaccgctacaagctgatccccctgaagacgaaccgggaccccgccatctacgggggctacaacaacgacaacaacgcctactccgtggtgctcgacgtcgacggcaagaagaagatcaacgggatcccgatccgcatcgccaaccagctcaagagcgacgagctggacctctccagctggctggagaacaacatcaagcacaagaagcccatgaccatcctgatcgacaaggtgcccaagtaccagcggatcatcaacgaggagaccggcgacctcctgatcacctccgcgaacgaggtgatcaacaacgtccagctgttcctccccagcatgtacacggccctgatctccctgctcgacagcaccaagaccgagatgtactccaagctgctgagcaactacgaggccaacatcctcatcgacatctacgactacctgctgaccaagctcaagaacaactacccgctgtaccgcaaggagtgggccaagctggcggagcaccgggacgacttcatcgagtccgacctcgtgacgcaggccagcaccctgcagcagctgatcaagttcatgcacgccgacccctccaacgtgaacctcaagttcgggaacttcaagggcaaccgcttcggccggaagaacgggaacatcaagctgagcaagaccgacttcatctacgagtcccccaccggcctgttcaagagcatcaagcacatcgactga

SEQ ID NO: 1853 - RNA, 4044 nt, synthetic construct
  misc_feature 1..4044: note = Cas9 variant
  source 1..4044: mol_type = other RNA
atgaagtccgagaagaagtactacatcggcctggacgtggggaccaacagcgtcggctgggccgtgaccgacgagttctacaacatcctccgcgccaaggggaaggacctgtggggcgtgcggctgttcgagaaggcgaagacggccgccgacacccgcaccttccggagcgggcgccggcgcaacgaccggaagggcatgcgcctccagatcctgcgggagatcttcgaggacgagatcaagaaggtcgacaaggacttctacgaccgcctggacgagtccaagttctgggccgaggacaagaaggtgagcggcaagtactccctcttcaacgacaagaacttcagcgacaagcagtacttcgagaagttccccaccatcttccacctccggaagtacctgatggaggagcacgggaaggtggacatccgctactacttcctggccatcaaccagatgatgaagcggcgcggccacttcctgatcgacgggcagatctcccacgtcacggacgacaagccgctgaaggagcagctcatcctgctgatcaacgacctcctgaagatcgagctggaggaggagctcatggacagcatcttcgagatcctggcggacgtgaacgagaagcggaccgacaagaagaacaacctgaaggagctcatcaagggccaggacttcaacaagcaggaggggaacatcctgaactccatcttcgagagcatcgtgaccggcaaggccaagatcaagaacatcatctccgacgaggacatcctggagaagatcaaggaggacaacaaggaggacttcgtcctcaccggcgacagctacgaggagaacctgcagtacttcgaggaggtgctgcaggagaacatcaccctcttcaacaccctgaagtccacctacgacttcgtgatcctgcagagcatcctcaaggggaagtccaccctgagcgacgcccaggtcgagcgctacgacgagcacaagaaggacctggagatcctcaagaaggtgatcaagaagtacgacgaggacggcaagctgttcaagcaggtcttcaaggaggacaacgggaacggctacgtgtcctacatcggctactacctgaacaagaacaagaagatcacggccaagaagaagatcagcaacatcgagttcaccaagtacgtgaaggggatcctcgagaagcagtgcgactgcgaggacgaggcggtgaagtacctgctgggcaagatcgagcaggagaacttcctcctgaagcagatctccagcatcaacagcgtcatcccccaccagatccacctgttcgagctcgacaagatcctggagaacctggccaagaactacccctccttcaacaacaagaaggaggagttcaccaagatcgagaagatccggaagaccttcacgttccgcatcccctactacgtggggccgctcaacgactaccacaagaacaacggcgggaacgcctggatcttccggaacaagggcgagaagatccgcccctggaacttcgagaagatcgtggacctgcacaagagcgaggaggagttcatcaagcggatgctgaaccagtgcacctacctccccgaggagaccgtcctgcccaagtccagcatcctgtactccgagtacatggtgctgaacgagctcaacaacctgcgcatcaagggcaagccgctggacaccgacgtgaagctcaagctgatcgaggagctgttcaagaagaagacgaaggtcaccctcaagagcatccgcgactacatgatccggaacaacttcgccgacaaggaggacttcgacaactccgagaagaacctggagatcgtgagcaacatgaagtcctacatcgacttcaacaacatcctgggggacaagttcgagctcgagatggtcgaggacctgatcgagaagatcaccatccacaccggcaacaagacgctgctcaagaagtacatcgaggagacctaccccgacctgagctccagccagatccagaagatcatcaacctgaagtacaaggactgggggcgcctctcccggaagctgctggacggcatcaaggggcgcaacaagaccgacgacgtgaacaccgtgatcaacttcatgcggaacagctccgacaacctcatgcagatcatcgagggcaagaactacagcttcaacgagtacatcgacaacctgcgcaagaagtacatcccccaggagatctcctacgaggtcgtggagaacctgtacgtgagcccctccgtcaagaagatgatctggcaggtcatccgggtgacggaggagatcaccaaggtgatgggctacgacccggacaagatcttcatcgagatggccaagagcgaggaggagaagaagaccaccatcagccgcaagaacaagctcctggacctgtacaaggcgatcaagaaggacgagcgggactcccagtacgagaagctcctgacggggctgaacaagctcgacgagagcgagctgcgctccaagaagctgtacctctactacacccagatgggccgggacatgtacaccggggagaagatcgacctggacaagctgttcgacagcacccactacgacaaggaccacatcatcccccagtccatgaagaaggacgacagcatcatcaacaacctcgtgctggtgaacaagaacgccaaccagacgaccaagggcaacatctaccccgtcccctccagcatccgcaacaacccggacatctacaactactggaagtacctgatggagaaggagttcatctccaaggagaagtacaaccggctcatccgcaacacgcccctgaccaacgaggagctgggggtgttcatcaaccggcagctcgtggagacccgccagagcacgaaggccatcaaggagctgttcgagaagttctaccagaagtccaagatcatccccgtcaaggccagcctggcctccgacctccggaaggacatgaacaccctcaagagccgcgaggtgaacgacctgcaccacgcgcacgacgccttcctgaacatcgtggccggcgacgtctggaaccgggagttcacctccaaccccatcaactacgtgaacgagaaccgcgagggcgacaaggtgaagtacagcctgtccaagtacttcacccgcccgcgcaagagcaaggggaaggtcatctggacgcccgagaagggccggaagctgatcgtggacaccctcaacaagcccagcgtgctgatctccaacgagagccacgtcaagaagggggagctgttcaacgccaccatctccggcaagaaggactacaagaagggcaagatctacctccccctgaagaaggacgaccggctgaaggacgtgagcaagtacgggggctacaaggccatcaacggggcgttcttcttcctcgtggagcacaccaagtccaagaagcgcatccggagcatcgagctgttcccgctgcacctcctgtccaagttctacgaggacaagaacacggtcctggactacgccatcaacgtgctccagctgcaggaccccaagatcatcatcgacaagatcaactaccgcaccgagatcatcatcgacaacttcagctacctgatctccaccaagagcaacgacggctccatcaccgtgaagcccaacgagcagatgtactggcgggtcgacgagatcagcaacctcaagaagatcgagaacaagtacaagaaggacgccatcctgacggaggaggaccgcaagatcatggagtcctacatcgacaagatctaccagcagttcaaggccgggaagtacaagaaccggcgcaccaccgacaccatcatcgagaagtacgagatcatcgacctggacacgctcgacaacaagcagctgtaccagctgctcgtggccttcatcagcctgtcctacaagaccagcaacaacgcggtggacttcaccgtcatcggcctgggcaccgagtgcgggaagccccggatcacgaacctcccggacaacacctacctggtgtacaagtccatcaccggcatctacgagaagcgcatccggatcaagtga

SEQ ID NO: 1854 - RNA, 4047 nt, synthetic construct
  misc_feature 1..4047: note = Cas9 variant
  source 1..4047: mol_type = other RNA
atgaagaagccctacaccatcgccctggacatcggcaccaacagcgtggggtgggtcgtggtgacggacgactaccgcgtcccgaccaagaagatgaaggtgctcggcaacaccgagcggaagaccatcaagaagaacctgatcggggccctgctgttcgactccggcgacacggcggaggggacccgcctgaagcggaccgcccgccggcgctacacccggcgcaagaaccggctgcgctacctcaaggagatcttcacggaggagatggccaaggtggacgacggcttcttccagcggctggaggacagcttctacgtcctggaggacaaggagggcaacaagcaccccatcttcgccaacctcgccgacgaggtggcgtaccacaagaagtaccccaccatctaccacctccgcaaggagctggtggacaacccccagaaggccgacctccggctgatctacctggccgtcgcccacatcatcaagttccgcgggcacttcctcatcgagggcaccctgtccagcaagaacaacaacctgcagaagtccttcgaccacctcgtggacacctacaacctgctgttcgaggagcagcggctcctgacggaggggatcaacgcgaaggagctgctcagcgccgccctgtccaagagcaagcgcctggagaacctcatctccctgatcccgggccagaagaagaccgggatcttcggcaacatcatcgccctgagcctcggcctgacccccaacttcaaggccaacttcgggctgtccaaggacgtgaagctccagctggcgaaggacacctacgccgacgacctggacagcctcctggcccagatcggcgaccagtacgccgacctgttcctcgccgcgaagaacctgtccgacgccatcctgctcagcgacatcctgacggagtccgacgagatcacccgggccccgctgagcgcctccatggtcaagcgctaccgggagcaccacaaggacctcgtgaccctgaagaccctgatcaaggaccagctccccgagaagtaccaggagatcttcctggacaagacgaagaacgggtacgccggctacatcgagggccaggtgagccaggaggagttctacaagtacctgaagccgatcctggcgcgcctcgacgggtccgagcccctgctgctcaagatcgaccgggaggacttcctgcgcaagcagcgcaccttcgacaacggcagcatcccccaccagatccacctggaggagctccacgccatcctgcggcgccaggaggtcttctaccccttcctgaaggacaaccggaagaagatcgagagcctcctgaccttccgcatcccgtactacgtggggcccctggcccggggccactcccgcttcgcctgggtgaagcggaagttcgacggggccatccgcccctggaacttcgaggagatcgtcgacgaggaggcgagcgcccagatcttcatcgagaagatgaccaagaacgacctctacctgcccaacgagaaggtgctgccgaagcactccctcctgtacgagacgttcaccgtgtacaacgagctgaccaaggtcaagtacgccaccgagggcatgacgcggccccagttcctcagcgccgaccagaagcaggcgatcgtggacctgctgttcaagaccaaccgcaaggtgaccgtcaagcagctcaaggagaactacttcaagaagatcgagtgctgggactccgtggagatcaccggcgtcgaggacagcttcaacgcctccctggggacgtaccacgacctgctcaagatcatccaggacaaggacttcctggacaaccccgacaaccagaagatcatcgaggacatcatcctgaccctcaccctgttcgaggacaagaagatgatcagcaagcggctggaccagtacgcccacctcttcgacaaggtggtgctgaacaagctggagcgccaccactacaccggctgggggcggctctccggcaagctgatcaacgggatccgcgacaagcagagcggcaagacgatcctggacttcctcaaggccgacggcttcgccaaccggaacttcatgcagctgatccacgactccgagctgagcttcatcgacgagatcgcgaaggcccaggtcatcgggaagaccgagtactccaaggacctcgtgggcaacctggccgggagccccgccatcaagaagggcatctcccagaccatcaagatcgtggacgagctggtcaagatcatggggtacctcccgcagcagatcgtgatcgagatggcccgcgagaaccagaccaccgcgcagggcatcaagaacgcccggcagcgcatgcggaagctggaggagacggccaagaagctgggcagcaacatcctcaaggagcaccccgtggacaactcccagctgcagaacgacaagcgctacctgtactacctccagaacgggaaggacatgtacaccggcgacgacctggacatcgactacctgagctcctacgacatcgaccacatcatcccccagagcttcatcaagaacaacagcatcgacaacaaggtcctcacctcccagggggccaaccgcggcaagctggacaacgtgcccagcgaggccatcgtgcggaagatgaagggctactggcagtccctgctccgcgcgggggccatcagcaagcagaagttcgacaacctgaccaaggccgagcggggcgggctgacgcaggtcgacaaggccggcttcatccagcgccagctcgtggagacccggcagatcaccaagcacgtggcgcagatcctggactcccgcttcaacaccgagttcgacgaccacaacaagcggatccgcaaggtccacatcatcacgctcaagagcaagctggtgtccgacttccggaaggagttcgggctgtacaagatccgcgacatcaaccactaccaccacgcccacgacgcctacctgaacgccgtggtcgccaaggcgatcctcggcaagtacccgcagctggcccccgagttcgtgtacggcgactaccccaagtacaacagcttcaaggagcggcagaaggccacccagaagatgctgttctactccaacatcctcaagttcttcaaggaccaggagagcctgcacgtgaactccgacggggaggagatctggaacgccaacaagcacctccccatcatcaagaacgtcctgagcatcccccaggtgaacatcgtgaagaagaccgaggtccagaccggcgggttctacaaggagtccatcctgagcaagggcaactccgacaagctgatcccccgcaagaacaactgggacacgcggaagtacgggggcttcgacagccccaccgtggcctactccgtgctcgtcatcgcgaagatggagaagggcaaggccaaggtgctgaagccggtgaaggagatggtcgggatcaccatcatggagcgcaccgccttcgaggagaaccccgtggtgttcctggaggcccggggctaccgcgagatccaggagcacctcatcatcaagctgcccaagtacagcctgttcgagctcgagaacgggcggcgccggctgctggccagcgcgtccgagctccagaagggcaacgagctgttcctgcccgtcgactacatgacgttcctctacctggccgcccactaccacgagctgaccgggagctccgaggacgtgctccgcaagaagtacttcgtggaccggcacctccactacttcgacgacatcatccagatgatcaacgacttcgccgagcgccacatcctggcgagctccaacctggagaagatcaaccacacctaccacaacaacagcgacctgccggtcaacgagcgcgccgagaacatcatcaacgtgttcaccttcgtggccctgggcgcccccgccgcgttcaagttcttcgacgccacgatcgaccggaagcgctacacctccaccaaggaggtcctcaacgccaccctgatccaccagagcgtgacgggcctgtacgagacccggatcgacctgtcccagctcggggagaactga

SEQ ID NO: 1855 - RNA, 4047 nt, synthetic construct
  misc_feature 1..4047: note = Cas9 variant
  source 1..4047: mol_type = other RNA
atgaagtccgagaagaagtactacatcggcctggacgtggggaccaacagcgtcggctgggccgtgaccgacgagttctacaacatcctccgcgccaaggggaaggacctgtggggcgtgcggctgttcgagaaggcgaagacggccgccgacacccgcaccttccggagcgggcgccggcgcaacgaccggaagggcgtccgcctccagatcctgcgggagatcttcgaggacgagatcaagaaggtggacaaggacttctacgaccgcctggacgagtccaagttctgggccgaggacaagaaggtgagcggcaagtactccctcttcaacgacaagaacttcagcgacaagcagtacttcgagaagttccccaccatcttccacctccggaagtacctgatggaggagcacgggaaggtcgacatccgctactacttcctcgccatcaaccagatgatgaagcggcgcggccacttcctgatcgacgggcagatctcccacgtgacggacgacaagccgctgaagcagcagctcatcctgctgatcaacgacctcctgaagatcgagctggaggaggagttcatggacagcatcttcgagatcctcgcggacgtgaacgagaagaagaccgagaagaagaacatcctgaaggagctgatcaacgcccaggacttcaacaagcaggagggcaagatcctctactccatcttcgagagcatcgtcaccgggaaggccaagatcaagaacatcatctccgacgaggacatcctggagaagatcaaggaggacaacaaggaggacttcgtgctgaccggcgacagctacgaggagaacctccagtacttcgaggaggtgctgcaggagaacatcacgctgttcaacaccctcaagtccgcctacgacttcgtcatcctgcagagcatcctgaagggcaagtccaccctcagcgacgcccaggtggagcggtacgacgagcacaagaaggacctggagatcctgaagaaggtgatcaagaagtacgacgaggacgggaagctgttcaagcaggtcttcaaggaggacaacggcaacgggtacgtgtcctacatcggctactacctgaacaagaacaagaagatcaccgcgaagaagaagatcagcaacatcgagttcacgaagtacgtgaagggcatcctggagaagcagtgcgactgcgaggacgaggacgtcaagtacctcctggggaagatcgagcaggagaacttcctgctcaagcagatctccagcatcaacagcgtgatcccccaccagatccacctgttcgagctggacaagatcctcgagaacctggccaagtactacccctccttcaacaacaagaaggaggagttcaccaagatcgagaagatccgcaagaccttcaccttccggatcccctactacgtgggcccgctgaacgactaccacaagaacaacgggggcaacgcctggatcttccgcaacaagggggagaagatccggccctggaacttcgagaagatcgtcgacctccacaagagcgaggaggagttcatcaagcgcatgctgaaccagtgcacgtacctgcccgaggagaccgtgctccccaagtccagcatcctgtactccgagtacatggtgctgaacgagctgaacaacctccggatcaacggcaagccgatcgacaccgacgtcaagctgaagctgatcgaggagctgttcaagaagaagaccaaggtgacgctcaagagcatccgcgactacatgatccgcaacaacttcgccgacaaggaggacttcgacaactccgagaagaacctggagatcgtcagcaacatgaagtcctacatcgacttcaacaacatcctcggcgacaagttcgagctggagatggtggaggacctgatcgagaagatcaccatccacaccgggaacaagaagctcctgaagaagtacatcgaggagacctaccccgacctgagctccagccagatccagaagatcatcaacctcaagtacaaggactggggccggctgtcccgcaagctgctcgacgggatcacgggcaccaacatcgagaccggggagatcgacaccgtgatcaacttcctgcggaacagctccgacaacctgatgcagatcatcggcagccagaactactccttcaacaacgacatcgacaagctccgcaagaagtacatcccccaggagatcagctacgaggtcgtggagaacctgtacgtgtcccccagcgtcaagaagatgatctggcaggtcatccggatcacggaggagatcaccaaggtgatgggctacgacccggacaagatcttcatcgagatggccaagagcgaggaggggaagaagaccaccatctcccgcaagaacaagctgctcgcgctgtacaaggccatcaagaaggacgagcgggacagccagtacgagaagctgctcacgggcctgaacaagctggacgactccgacctccgcagccggaagctgtacctgtactacacccagatggggcgcgacatgtacaccggcgagaagatcgacctcgacaagctgttcgactccacccactacgacaaggaccacatcatcccccagagcatgaagaaggacgactccatcatcaacaacctggtgctcgtgaacaagaacgccaaccagacgaccaaggggaacatctaccccgtgcccagctccatccggaacaacccgaagatctacaactactggaagtacctgatggagaaggagttcatcagcaaggagaagtacaaccgcctgatccggaacacgcccctcaccaacgaggagctgggcggcttcatcaaccgccagctggtcgagacccggcagtccaccaaggccatcaaggagctgttcgagaagttctacaagaagtccaagatcatccccgtgaaggcgatcctggccagcgacctgcgcaaggacatgaacaccctcaagagccgggaggtgaacgacctgcaccacgcccacgacgccttcctgaacatcgtcgccggggacgtgtggaaccgcgagttcacctccaaccccatcaactacgtgaaggagaaccgggagggcgacaaggtcaagtacagcctctccaagtacttcacccgcccgcgcaagagcaaggggaaggtgatctggacgcccgagaagggccggaagctgatcgtggacaccctgaacaagcccagcgtcctcatctccaacgagagccacgtgaagaagggcgagctgttcaacgcgaccatcgccgggaagaaggactacaagaagggcaagatctacctgcccctcaagaaggacgaccgcctgcaggacgtgtccaagtacgggggctacaaggccatcaacggggccttcttcttcctggtcgagcacaccaagagcaagaagcggatccgctccatcgagctgttcccgctccacctcctcagcaagttctacgaggacaagaacacggtgctggactacgccatcaacgtgctgcagctccaggaccccaagatcatcatcgacaagatcaactaccggaccgagatcatcatcgacaacttctcctacctgatcagcaccaagtccaacgacggcagcatcaccgtcaagcccaacgagcagatgtactggcgcgtggacgagatctccaacctgaagaagatcgagaacaagtacaagaaggacgcgatcctcacggaggaggaccggaagatcatggagagctacatcgacaagatctaccagcagttcaaggccggcaagtacaagaaccgccggaccaccgacaccatcatcgagaagtacgagatcatcgacctggacacgctggacaacaagcagctctaccagctgctggtggccttcatctccctcagctacaagacctccaacaacgccgtcgacttcaccgtgatcgggctgggcaccgagtgcgggaagccccgcatcacgaacctgccggacaacacctacctcgtgtacaagagcatcaccggcatctacgagaagcggatccgcatcaagtga

SEQ ID NO: 1856 - RNA, 4047 nt, synthetic construct
  misc_feature 1..4047: note = Cas9 variant
  source 1..4047: mol_type = other RNA
atgaagtccgagaagaagtactacatcggcctggacgtggggaccaacagcgtcggctgggccgtgaccgacgagttctacaacatcctccgcgccaaggggaaggacctgtggggcgtgcggctgttcgagaaggcggacacggccgccaacacccgcatcttccggagcgggcgccggcgcaacgaccggaagggcatgcgcctccagatcctgcgggagatcttcgaggacgagatcaagaaggtcgacaaggacttctacgaccgcctggacgagtccaagttctgggccgaggacaagaaggtgagcggcaagtactccctcttcaacgacaagaacttcagcgacaagcagtacttcgagaagttccccaccatcttccacctccggaagtacctgatggaggagcacgggaaggtggacatccgctactacttcctcgccatcaaccagatgatgaagcggcgcggccacttcctgatcgacgggcagatctcccacgtcaccgacgacaagccgctgaaggagcagctcatcctgctgatcaacgacctcctgaagatcgagctggaggaggagctcatggacagcatcttcgagatcctggcggacgtgaacgagaagcggacggacaagaagaacaacctgaaggagctcatcaagggccaggacttcaacaagcaggaggggaacatcctgaactccatcttcgagagcatcgtgaccggcaaggccaagatcaagaacatcatctccgacgaggacatcctggagaagatcaaggaggacaacaaggaggacttcgtcctcaccggcgacagctacgaggagaacctgcagtacttcgaggaggtgctgcaggagaacatcaccctcttcaacacgctgaagtccacctacgacttcctgatcctccagagcatcctgaaggggaagtccaccctgagcgacgcccaggtggagcgctacgacgagcacaagaaggacctcgagatcctgaagaaggtcatcaagaagtacgacgaggacggcaagctgttcaagcaggtcttcaaggaggacaacgggaacggctacgtgtcctacatcggctactacctcaacaagaacaagaagatcaccgccaagaagaagatcagcaacatcgagttcacgaagtacgtgaaggggatcctggagaagcagtgcgactgcgaggacgaggacgtgaagtacctgctcggcaagatcgagcaggagaacttcctgctgaagcagatctccagcatcaacagcgtgatcccccaccagatccacctcttcgagctggacaagatcctggagaacctcgcgaagaactacccctccttcaacaacaagaaggaggagttcaccaagatcgagaagatccggaagaccttcaccttccgcatcccctactacgtcgggccgctgaacgactaccacaagaacaacggcgggaacgcctggatcttccggaacaagggcgagaagatccgcccctggaacttcgagaagatcgtggacctgcacaagagcgaggaggagttcatcaagcggatgctcaaccagtgcacgtacctgcccgaggagaccgtgctgcccaagtccagcatcctgtactccgagtacatggtcctcaacgagctgaacaacctgcgcatcaacggcaagccgctcgacaccgacgtgaagctgaagctgatcgaggagctgttcaagaagaagaccaaggtgacgctcaagagcatccgcgactacatggtccggaacaacttcgccgacaaggaggacttcgacaactccgagaagaacctggagatcgccagcaacatgaagtcctacatcgacttcaacaacatcctcgaggacaagttcgacgtggagatggtcgaggacctgatcgagaagatcaccatccacaccgggaacaagaagctgctcaagaagtacatcgaggagacctaccccgacctgagctccagccagatccagaagatcatcaacctgaagtacaaggactggggccgcctctcccggaagctgctggacgggatcaagggcacgaagaaggagaccgagaagaccgacaccgtgatcaacttcctccgcaacagctccgacaacctgatgcagatcatcgggagccagaactactccttcaacgagtacatcgacaagctgcggaagaagtacatcccccaggagatcagctacgaggtggtcgagaacctctacgtgtcccccagcgtgaagaagatgatctggcaggtcatccgcgtgacggaggagatcaccaaggtgatgggctacgacccggacaagatcttcatcgagatggccaagagcgaggaggagaagaagaccaccatctcccggaagaacaagctgctggacctctacaaggcgatcaagaaggacgagcgcgacagccagtacgagaagctgctgacgggcctcaacaagctggacgactccgacctgcggagccgcaagctctacctgtactacacccagatggggcgggacatgtacaccggcgagaagatcgacctggacaagctgttcgactccacccactacgacaaggaccacatcatcccccagagcatgaagaaggacgactccatcatcaacaacctggtcctggtgaacaagaacgccaaccagacgaccaaggggaacatctaccccgtgcccagctccatccgcaacaacccgaagatctacaactactggaagtacctcatggagaaggagttcatcagcaaggagaagtacaaccggctgatccgcaacacgcccctgaccaacgaggagctcggcgggttcatcaaccggcagctggtcgagacccgccagtccaccaaggccatcaaggagctgttcgagaagttctaccagaagtccaagatcatccccgtgaaggccagcctcgccagcgacctgcggaaggacatgaacaccctgaagtcccgcgaggtgaacgacctccaccacgcgcacgacgccttcctgaacatcgtcgccggcgacgtgtggaaccgggagttcaccagcaaccccatcaactacgtgaaggagaaccgcgagggcgacaaggtcaagtactccctgagcaaggacttcacccgcccgcgcaagagcaaggggaaggtgatctggacgcccgagaagggccggaagctcatcgtggacaccctgaacaagccctccgtcctgatcagcaacgagtcccacgtgaagaagggggagctgttcaacgccaccatcgccggcaagaaggactacaagaagggcaagatctacctgcccctgaagaaggacgaccggctccaggacgtgagcaagtacgggggctacaaggcgatcaacggggccttcttcttcctggtcgagcacaccaagtccaagaagcgcatccggagcatcgagctgttcccgctccacctcctgtccaagttctacgaggacaagaacacggtgctcgactacgccatcaacgtgctgcagctgcaggaccccaagatcatcatcgacaagatcaactaccgcaccgagatcatcatcgacaacttcagctacctcatctccaccaagagcaacgacggctccatcaccgtcaagcccaacgagcagatgtactggcgggtggacgagatcagcaacctgaagaagatcgagaacaagtacaagaaggacgccatcctgacggaggaggaccgcaagatcatggagtcctacatcgacaagatctaccagcagttcaaggccgggaagtacaagaaccggcgcaccaccgacaccatcatcgagaagtacgagatcatcgacctcgacacgctggacaacaagcagctgtaccagctcctggtggcgttcatcagcctgtcctacaagaccagcaacaacgccgtcgacttcaccgtgatcggcctcggcaccgagtgcgggaagccccggatcacgaacctgccggacaacacctacctggtgtacaagtccatcaccggcatctacgagaagcgcatccggatcaagtga

SEQ ID NO: 1857 - RNA, 4047 nt, synthetic construct
  misc_feature 1..4047: note = Cas9 variant
  source 1..4047: mol_type = other RNA
atggagaagaactactacctgggcctcgacctggggagcaactccgtgggctgggccgccaccgacgaggactacaacttcctgcgcctcaaggggaagaccgcgtggggcgcccggatcttcagcgaggccaaggactgcaaggagcgccggacgtaccgctccaacaagcggcgcctggcccggcgcaagtaccggctggtcctcctgaagcagctgttcgccgaggagatgaccaaggtggacaagaccttcttcctccgcctggcgaacagcacctactgggaggaggacaagacgaaggactccgacgggaacgagatcggcaagaacctgatcttcaagacccacgaggaggagaagcagtactacaccaagtaccccaccatctggcacctccggaaggccctgatcgagaacgacgaggaggccctgagcaacctccgctacgtgtacctggccatccaccacatcgtcaagtaccggggcaacttcctgacggagggggagatgggcaacgacatcccgcccatcaccaccatcgaggagatcaaccagaccctctccctgctggaggtggacagctccgaggacgcgacggacaagaccacctacatcaagcccgagagctacaacgagctgttcaccatcctcgagaacaacaacctgaacaaggtgaagaagcagcaggagatcgacaagctgttcatctccagcaaggagcgctccgagaacatcaagaactacatcaacctcttcaagacgatcatcgtcgggggcagcttctccctgaagaagatcaacgaggacaccgaggacatcagcgtggacttcaccaaggacttcgagaactccgaggccgacatcagcaaggccctcggggactccttcaacctggtgctgatcgccaagaagtactacgactacatcatcctcaaggagctgctgggcaagaacaaggagatcagcgaggccatggtccagatctacgaggagcacaaggacgacctcaagagcctgaagaccatcctgaaggacctcgacaacaagctgggcaacgacgggaaggaccggatctactactccgtgttcaagcaggagcccacggagaagttcaaggagaccaactacctgagcttcgtgcagggcgggaagctcgaggagctgaacaagtacatcaagaagatcctggagaacaacgagaaggacatcgacgacaaggagacctacaacgcgctctacgagaaggcctgcaagggcgacctgttcaagaagcaggccaacgcctgcacctccctgatcccgcaccagttccacctccgcgagctgaagaagatcctggagaacgccggccggaagtacagcttcctcaacgacatctccgacaagatcatcaagatcttcaagttccgcgtcccctactactacgggcccctgaacaacgagagcaacgcgcactcctgggtggtgaagaaggagggccaggagaaggccaagatcacgccctggaacatcaacgagatcatcgacaccccgaagacccgggacaacttcttcaagaagctgaccaacagctgcacgtacctggtcggggagaccgtgctccccaagacctccctgtactacgagaagtacctggtgctcgaccgcctgaacaagatgcaggtcaacggcgactacctgagcgcctccgagaagaacgacgtgctcaagttcatcctgagccggaagaccacgaccatcgagcagatccgcacctacctgtccaagaacaagagcaccaaggccaacgacatctccatcagcaacatcaaggccacggaccccttcaacgcggtgtcccacgccttctacgggaagcaccccgacctcaacatcaacctgtgcgaggagctgatcaagttcgccaccatctacgccgacgacaagaaggagctcaagaagttcgtcagctccaacttcaacctgaccgacgagttcatcaaggagtacctgaacaccccgaccaacaagtggggccgcctcagccggaagttcctgtgcggcggggaccagctggagatgtactacgtggacgacaacggcatcctccacagcatcctgaacatcctggaggagacgaacgagaacctccaggagatcctgaacaacgagaagtacgggttcaaccagaagatcgccgacttcaacaacaccctgaccgcggacaagaccacggaggagcagatcgaggacatcctcgactccacccccgccctgatgcgccggagcatcatccagaccctggccgtggtcgacgacgtgatcaaggccgcgggcaaggcgccccagaagatcatgatggaggtcacccgcacggacgggaagaaggaggagaccaagtcccggtacgtgcagctcaagaagcagatcaccaacgacaaggtgctgaccagcgacgagaagaaggagctgctcacgaacctggagaacaagaagatccagctgaagggcaagcacatctacctctacttcatgcagatgggcatcgacttctacaccgggaagatcatggacatcaacgacgtcatcaacggcaagtacgacatcgaccacatcatcccccagtccatgatcaaggacgacagcctggacaacatggtgctggtgtccaaggactacaaccagaaggtcaagaaggacatctacccgatctgcgacgagatccgcaacaacatgctcgacaagtggaaggggtactacgcccggaagatcatcagcgaggagaagtacaaccgcctgaagcggaccaaggagctgaacgccgacgagatcaacgccttcatcaaccgccagatcaacgtggtgaactactccaacatccagatcaagcggatcttcgagatcaagtaccccgagaccaagatcatcttcagcaaggcctccttccccagcctcctgcgcaaggagtacgagatcgccaagatgcgggacctgaacgacgcccaccacgccgtcgacgcctacctcaacatcgtgtgcggcaacatcctgacgaccctgtacaccgacatcttctacatgttcaaggagaagaaggaggaccacaagaacatctccttcaacatggagaagcgcctcatcaactacatcgacaagaacaacctgaaggacaagatcaagaccagctgcctgcggcacgacgcgctcatcacgtacaagcccgactacgactccgggaagttctacaaggagaccatcttcaagaagtccggcgacaaggagaccggcctgatcccgctgcacaccaaggggcccatgagcgacacgaagaagtacggcgggtacagccagctcagccagtcctacatcatcgccgtggagtacaagctgaagaacaagaccgtcaagaagctgtgccgcgtgcccaccctctacctgaagcagtacaagaacgacctgaacaccatcgccaagatcatgatcgacgacgagaaggccacggacatcaaggtgctccggaagatctacctgaaccagaagatccgctacaacggctgctactacctgatctacaccagcaaggagaagcagaacaagtacaagatggcctaccagaactacctcgacaacgactacctgatctacctgaacaagtgcctcaagaagatcgacgagctggacgacggcgagctgacctcccaggagttcatcgtcaacaaggacggggacaagttcctcatcgacaagaaccacaacctggagatcttcaagagcatcaaggagcagtacaacaagaccatctacgactacacgccctacatcgtgcagtcccgggagatgaaggaggaggacttcaacaacctgagcctcaagaagcagatcgacaccctgctgaacatgatcaagatcctctcccgcagcaacgagcaggcgaagttcgagaccgccttcttcgagaacttcaccaaggtgttcctgaagacgatgaccatcaccaacgagaaggtctacatcgtgaacgagtccccgagcggcctgttcaaggggaaggaggagctcatctga

SEQ ID NO: 1858 - RNA, 4047 nt, synthetic construct
  misc_feature 1..4047: note = Cas9 variant
  source 1..4047: mol_type = other RNA
atgaagaagttcgaggactactacctgggcctcgacctggggaccagctccatcggctgggccgtgaccaacgagaagtacgacatcctgcgcttcaacaagaagttcatgtgggggacgcacctcttcgacatgggcaacaccgccagcgagcggcgcatcttccggacctcccgccggcgcctgaagcggaagaagaaccgcatcgagctgctccagaccctgttcagcgcggagatgtccaagaaggacttcgggttcttccagcggctgaaggagagccagtacttcatcgaggacaagacgttcaagaacaagaacaccctcttcatggacgagaactacaccgaccaggactaccacatggagtaccccaccatctaccacctccgcaaggccctgatcgacaacgaggagtccgccttcgagatccggaagctgtacctggccatcagccacatcctgtcccaccgcggccacttcctcttcgagggcgagctgagcgacaacctggacttcgacgacatcttcaacgagttcgtcaagtacctcaacgaggagctgaacatcgacttcaagatcaagtccgacgtgagcctgcaggccatcaaggagatcctcacggacaagatgctgaaccggaccaagaagaaggagaagctgtccgagctcctggaggaggagaagaacaagatctaccaggagatctggaagctgctcgtggggaacgaggcgaagatgagcaccatcttcgacgacaaggagtacgaggaggccaagatcgccttctccaagggcaactacgacgagaaggaggaggagtacgagagcatcctgggggagaagatcctgttcgtccagaaggccaaggcgatctacgactggatgctcctgcagaacatcctgaaggaggacaagtacctctcctacagcaaggtgaagctgtacaacgagcacaagaaggacctgaagatcctcaaggacgtgctgaagaacctggacaagaagatctacaaggagatcttctccgagaacggcctctacgaggagtacctgcgcatcgagaagaagaagatcgggagcaaggaggagaagaccaaggacatcctgtacaaccggctcaagaagatcttcgagaaccgcgacaacatggccatcgaggacatcctgaacaagatcgagctggacagcttcctcccgaagcagaagatcaaggacaacggcgtcatcccccgccaggtgcaccagaaggagctggagatcatcctgaagaacgccgagaagtacttcaagtggctcatcgagaaggacgagacgggcctgtccgtgagcgagaagatcatgaagatcttcaagttcaagatcccctactacgtcgggcccctgaactccaagagcccgttcgcctggatcgagcggaaggagtacggcaagatcctgccctggaacttcgagaacatggtggacatgtccaagaccgccgagaagttcatcaagcggatgaccaacaagtgcacctacctccccgagaaggacgtgatccccaagaacagcctgctgtacacgaagtacatggtcctcaacgagctgaacaacctgaagatccgcggggagaagatcaaggtggagctcaagcagaagatctacaccgagctgttccagaagaacaagaagatcggcatgaagaccctgatcgagttcctcaagtcccagaacatcgtggtcaccaaggtggagatcacgggcatcgacgggaccttcaacaccagcctgggctcctacatcgacatgaagaagatcttcggggaggagaagatcgtgaaggacagctacaagaagatgatcgaggacatcatcctgtggatcaccctctacggcgaggagaagaagctgatcaagtccaagatcgaggagaagtacccggagaaggtcacgcccgaggagatgaagctgatcctcaagctgaagtaccgggactggagccgcctgtccaaggagttcctcaccgagatcgagaccatggacgaggagaccggggagctgatcagcatcatcgagatgctgtggcgcaagaacgagaacatcatggagctcctgtcctacaagtacgacttcagcaaccggatcaaggagtacaacggcatcaacgagaaggagaagaacatcacgtacgaggacctggtgaaggacctccagatctcccccagcgtgaagaagatgatctggcgcgcgctggtcatcgtgaaggagatcaagaaggtgaccaacaagtcccccaagaaggtcttcatcgagatggcccgggacacccagaccgagaagaagcgcacggagaagcggaaggacaagctgctcgagctgtacaagaacatcaagaacgacgacagcatcaaggagctggagaagaacctcaaggacaagaccaacgacgacctcaagagcaagaagctgtacctgtactacctgcagctgggccgctgcatgtactccggggaggtgatccggctcgaggacctgatgaacgacaacctgtacgacatcgaccacatctacccgcagagcaagatcaaggacgactccttcgacaacaccgtcctcgtgaagaagcagatcaacgccgacaagaccaacgagtaccccatcgacaagagcatccagaacaagtgcaaggccttctggacgtccctgaaggagcgcggcctgatgagcaacaccaagtacgagcggctcacccgcaccgaggggttctccgacgacgagctggccggcttcatcagccggcagatcgtggagacccgccaggcgacgaaggtcctggccgacctcctgaaggtgatcttcgggtccgacacccggatcgtgtacgtcaaggccggcctgaccagcgacttccgccagaagttcggcatctacaagttccgggagctcaacgactaccaccacgcccacgacgggtacctgaacatcgtgaccggcaacatctacaacacgctgttcaccgacaacccctacaacttcatcaaggaccgcaagaaggacaaccggacctacaacctcaacaaggtgttcgagcgcgagaacgacgtctggaaccccgacgtgatgctgtccaagatcgagcggtacatctacaagatccgcccgctgttcacccgcgccagctacgagcagaagggcgggttctccgaccagaacatcagctccgagaaggacaagctccggcccctcaagagctccggggtgctgagcaacatcaagtacggcggctacgacaagatcaagaacagctacttcttcatcgtcgagtacacggagaagaagaagcgcgtgcggtccatcgagaccctgcccatctacatcaagaagtccatcagcaccaaggaggacctggagaagtactgcaaggaggagctgaagctccaggagcccaaggtgctggtcagcaagctgaactacaagtccctcatctacagcaacgggcacgagtactacatcaactccaagaccgcggacagcatcacgatccagaacggcatccagatcatcctgaccaaggagaactacgagacctaccgcaagatctacaagaacctggagtacctcaagctgatctacaaggacgagaagatccgggaggagaagatcctggagaagatcccgaagatcctcaagaacaacaagaacgaccgcgacctgtccgaggacgagatcagcgagaagttctggaagctgtacaaggagatcttcgagaagatcaagatcgggatcttctccaagttcaagagcaccctccccatctacatcgaggactgcaagaagctgaaggacttcacgaccctgaacaactacgccaagtcccggttcatccaggagatcctcaagtgcctgaacagccagcagggcgagttcgacaccaagtacacccacaactactccaagaagtacaacacgaagctgagcaagtccaagatcctcgagaacgacttctacatcatcaaccagagccccaccggcctgttcgagaagaaggtgttcctggacaagtga

SEQ ID NO: 1859 - RNA, 4047 nt, synthetic construct
  misc_feature 1..4047: note = Cas9 variant
  source 1..4047: mol_type = other RNA
atgggggaggacgggaagcccctgcgcgtgaagggcaagaccgccatcggggcccggctgttccaggagggcaacccggcggccgaccgccggatgttccgcaccacgcggcgccggctgaaccgccggaagtggcgcctgaagctcctggacgagatcttcgacccctacatcacccccgtcgacagcaccttcttcgcccggctgaagcagtccaacctcagccccaaggactcccgcaaggagttcaaggggagcatgctgttcccggacctgaccgacaagcagtaccacctcgactaccccacgatctaccacctccggcacgccctgatgacccaggacaagcagttcgacatccgcatggtgtacctcgccatccaccacatcgtgaagtaccggggcaacttcctgaactccacccccgtcgacagcttcaaggcgtccaaggtgaacttcgacgaccagttcaagaagctgaacgagctctacaccgccatcaaccccgaggagagcttccagatcaacctggccaactccgagaagatcggccagcagttcctggacccgagcatccgcaagttcgacaagaagaagcagatccccaagatcgtgcccgtcacgatggacgacaaggccgtggacaagctcaacgggaagatcgcgtccgagatcatcaacgccatcctgggctacaagagcaagctggacgtggccgtccagtgcgaccccgaggactccaacccgtgggccgtgaagttcgacgacgaggacatcgacgccaagctccagaagatcctgcccgagatggacgagaaccagcagagcatcatcgggatcatccaggacctgtactcccaggtgaccctcaaccagatcgtccccaacggcatgagcctgtccgagagcatgatcaagaagtacaacgaccaccacgaccacctgaagctctacaagaagctgatcgggcagatctccgacagcaagaagaagaccgcgctgaagaaggcctacgaccagtacgtgggcaacgacggcaaggtgatcgagcaggacgacttctacagctccgtcaagaagaacctcgacgacagcgagctgtccaagcagatcatggacctgatcgacgccgacaagttcatgcccaagcagcggaccagccagaacggggtgatcccgcaccagctccaccagcgcgagctggacgagatcatcgagcaccagtccaagtactacccctggctggccgagagcaaccccaacaagcacgacctccacctggccaagtacaagatcgaggagctggtggcgttccggatcccctactacgtcggcccgatgatcacgcccgaggaccagaagaagtccggggccgccgtgttcagctggatgaagcgcaaggagcccggccagatcaccccctggaacttcgacgagaaggtggaccggatggagtccgccaacaagttcatcaagcgcatgaccaccaaggacacgtacctcatcggcgaggacgtcctgccggacgagagcctgctctacgagaagttcaaggtgctgaacgagctgaacatggtgcgcgtcaacggggactccctcaaggtggccgacaagcaggcgatctaccaggacctgttcgagaactacaagcacatcagcgtcaagaagctgcagaactacatcaagggcaagaccgggctccccaacaaccccgagatctccggcctgagcgaccccgaccagttcaacaactccctggggacctacaacgacttcaagaagctgttcggcgacaaggtggacgacccggacctccagaacgacttcgagaagatcgtggagtggagcaccgtcttcgaggacaagaagatcctgcgggccaagctgaacgagatcacgtggctcaccgacaagcagaaggacgacctggagtccagccgctaccagggctgggggcggctgtccaagaagctcctgaccggcatcgtgaacgaccagggggagcgcatcatcgacgagctgtggaacaccaacaagaacttcatgcagatccagagcgacgacgacttcgccaagcggatccacgaggccaacgccgaccagatgaagtccacgaacatggaggacgtgctcgcggacgcctacaccagcccccagaacaagaaggccatccgccaggtcgtgaaggtggtcgacgacatccagaaggccatgggcggggtggcgcccaagttcatcagcatcgagttcacccggtccgaggaccgcaacccgcggcgcaccatcagccggcagcgccagctggagaacacgctgaaggacaccgccaagtccctcgtcaagagcatgaaccccaacatcctgtccgagctggacaacgccagccggtccaagaagggcctcaccgaccgcctgtacctgtacttcacccagctcggcaaggacatgtacacgggggagcccatcaacatcgacgagatcagcaactacgacatcgaccacatcctgccccaggccttcatcaaggacgactccctgagcaaccgggtgctcgtgtccaaggccgtgaacaacggcaagagcgcgaacgtcccgctgaagctgttcggggccaagatgggccacttctggaagcagctcgccgaggccgggctgatcaacaagcacaagctgaagaacctccagaccaaccccgacaccatctccaagttcgccatgcacggcttcatccgccggcagctggtggagaccagccaggtgatcaagctggtcgcgaacatcctcggcgacaagtaccgcaacgacgacacgaagatcatcgagatcaccgcccggatgaaccaccagatgcgcgacgagttcgggttcatcaagaaccgcgagatcaacgactaccaccacgccttcgacgcctacctgaccgccttcctgggccggtacctctaccaccgctacatcaagctgcggccctacttcgtgtacggggacttcaagaagttccgcgaggacaaggtgaccatgcggaacttcaacttcctgcacgacctcaccgacgacacgcaggcgcgcatcgccgacaccgagaccggcgaggtcatctgggaccgggagacctccatcaagcagctgcgcgacgtgtaccactacaagttcatgctgatcagccaggaggtgtacacgctccggggcgccatgttcaaccagaccatctaccccgccagccaggcggggcgcaagaagctgatcccgatgaaggccgacaagcccgtcgacgtgtacggcgggtactccggcagcaccgacgcctacatggccatcgtgcggatccacgacaagaagggggacaagtacaaggtcgtgggcgtgcccatgcgcgccctgaaccggctcaacaccgcgaagaacgtctccgacgccaagtacgaccaggagctgaaggaggtgctgacgccccagttcaccaagagcaagaagaaccgcaagaccggcgagatcacccagacggtggaggacttcgaggtcgtgctcgggaaggtgatgtaccggcagctggtcatcgacggcgacaagaagttcatgctggggtccagcacctaccagtacaacgccaagcagctcgtgctgtccgacgagagcatcaagaccctggcctccgagggcaagctcaacgaggcccaggagagcgcggcctacgacaaggtgtacgacgagatcctggacaaggtcaacaagtacttcgccctgtacgacaccaacaagttccgccagaagctctccctggggaaggacaagttcgtgggcctgccgaaccacaacgtgttcgacggcagcaagaagatctccagcgggaagcgggagatcctcaacgagatcctgaacggcctgcacgccaacgccacgctcgggaccctgtccgacatcggcttcagcacccccttcgggaagatgcagcagccccgcggcatcggcctgtccagcaacacctccatcgagtacgagagcttcacgggcctcttcaagcggaccatcttcctgaaggacctgtga

SEQ ID NO: 1860 - RNA, 4047 nt, synthetic construct
  misc_feature 1..4047: note = Cas9 variant
  source 1..4047: mol_type = other RNA
atgaagaagccctacaccatcgccctggacatcggcaccaacagcgtggggtgggtcgtggtgacggacgactaccgcgtcccgaccaagaagatgaaggtgctcggcaacaccgagcggaagaccatcaagaagaacctgatcggggccctgctgttcgactccggcgacacggcggaggggacccgcctgaagcggaccgcccgcccccggtacacccgccggaagaaccgcctgcggttcctcaaggagatcttcacggaggagatggccaaggtggacgacggcttcttccagcgcctggaggacagcttctacgtcctggaggacaaggagggcaacaagcaccccatcttcgccaacctcgccgacgaggtggcgtaccacaagaagtaccccaccatctaccacctccggaaggagctggtggacaacccgcagaaggccgacctccgcctgatctacctggccgtcgcccacatcatcaagttccgggggcacttcctcatcgagggcaccctgtccagcaagaacaacaacctgcagaagtccttcgaccacctcgtggacacctacaacctgctgttcgaggagcagcgcctcctgacggaggggatcaacgcgaaggagctgctcagcgccgccctgtccaagagcaagcggctggagaacctcatctccctgatccccggccagaagaagaccgggatcttcggcaacatcatcgccctgagcctcggcctgacccccaacttcaaggccaacttcgggctgtccaaggacgtgaagctccagctggcgaaggacacctacgccgacgacctggacagcctcctggcccagatcggcgaccagtacgccgacctgttcctcgccgcgaagaacctgtccgacgccatcctgctcagcgacatcctgacggagtccgacgagatcacccgcgcgcccctgagcgcctccatggtcaagcggtaccgcgagcaccacaaggacctcgtgaccctgaagaccctgatcaaggaccagctcccggagaagtaccaggagatcttcctggacaagacgaagaacgggtacgccggctacatcgagggccaggtgagccaggaggagttctacaagtacctgaagcccatcctggcccggctcgacgggtccgagcccctgctgctcaagatcgaccgcgaggacttcctgcggaagcagcgcaccttcgacaacggcagcatcccccaccagatccacctggaggagctccacgccatcctgcgccggcaggaggtcttctacccgttcctgaaggacaaccgcaagaagatcgagagcctcctgaccttccggatcccctactacgtggggcccctggcccgcggccactcccggttcgcctgggtgaagcgcaagttcgacggggccatccggccctggaacttcgaggagatcgtcgacgaggaggcgagcgcccagatcttcatcgagaagatgaccaagaacgacctctacctgccgaacgagaaggtgctgcccaagcactccctcctgtacgagacgttcaccgtgtacaacgagctgaccaaggtcaagtacgccaccgagggcatgacgcgcccccagttcctcagcgccgaccagaagcaggcgatcgtggacctgctgttcaagaccaaccggaaggtgaccgtcaagcagctcaaggagaactacttcaagaagatcgagtgctgggactccgtggagatcaccggcgtcgaggacagcttcaacgcctccctggggacgtaccacgacctgctcaagatcatccaggacaaggacttcctggacaaccccgacaaccagaagatcatcgaggacatcatcctgaccctcaccctgttcgaggacaagaagatgatcagcaagcgcctggaccagtacgcccacctcttcgacaaggtggtgctgaacaagctggagcggcaccactacaccggctgggggcgcctctccggcaagctgatcaacgggatccgggacaagcagagcggcaagacgatcctggacttcctcaaggccgacggcttcgccaaccgcaacttcatgcagctgatccacgactccgagctgagcttcatcgacgagatcgcgaaggcccaggtcatcgggaagaccgagtactccaaggacctcgtgggcaacctggccgggagcccggccatcaagaagggcatctcccagaccatcaagatcgtggacgagctggtcaagatcatggggtacctcccccagcagatcgtgatcgagatggcccgggagaaccagaccaccgcgcagggcatcaagaacgcccgccagcggatgcgcaagctggaggagacggccaagaagctgggcagcaacatcctcaaggagcaccccgtggacaactcccagctgcagaacgacaagcggtacctgtactacctccagaacgggaaggacatgtacaccggcgacgacctggacatcgactacctgagctcctacgacatcgaccacatcatcccccagagcttcatcaagaacaacagcatcgacaacaaggtcctcacctcccagggggccaaccgcggcaagctggacaacgtgccgagcgaggccatcgtgcgcaagatgaagggctactggcagtccctgctccgggcgggggccatcagcaagcagaagttcgacaacctgaccaaggccgagcgcggcgggctgacgcaggtcgacaaggccggcttcatccagctccagctggtggagacccggcagatcaccaagcacgtggcgcagatcctggactcccgcttcaacaccgagttcgacgaccacaacaagcggatccgcaaggtccacatcatcacgctcaagagcaagctggtgtccgacttccggaaggagttcgggctgtacaagatccgcgacatcaaccactaccaccacgcccacgacgcctacctcaacgccgtggtcgccaaggcgatcctgggcaagtacccccagctggcccccgagttcgtgtacggcgactaccccaagtacaacagcttcaaggagcggcagaaggccacccagaagaccctcttctactccaacatcctgaagttcttcaaggaccaggagagcctgcacgtgaactccgacggggaggagatctggaacgccaacaagcacctcccgatcatcaagaacgtcctgagcatcccccaggtgaacatcgtgaagaagaccgaggtccagacgggcgggttctacaaggagtccatcctgagcaagggcaactccgacaagctcatcccccgcaagaacaactgggacacccggaagtacgggggcttcgacagcccgaccgtggcctactccgtgctggtcatcgcgaagatggagaagggcaaggccaaggtgctgaagcccgtgaaggagatggtcgggatcaccatcatggagcgcatcgccttcgaggagaaccccgtggtgttcctcgaggccaagggctaccgggagatccaggagcacctgatcatcaagctgcccaagtacagcctcttcgagctggagaacgggcgccggcgcctgctcgccagcgcgtccgagctgcagaagggcaacgagctgttcctcccggtcgactacatgacgttcctgtacctggccgcccactaccacgagctcaccgggagctccgaggacgtgctgcggaagaagtacttcgtggagcgccacctccactacttcgacgacatcatccagatgatcaacgacttcgccgagcggcacatcctggcgagctccaacctggagaagatcaaccacacctaccacaacaacagcgacctgcccgtcaacgagcgcgccgagaacatcatcaacgtgttcaccttcgtggccctcggcgcccccgccgcgttcaagttcttcgacgccacgatcgaccggaagcgctacacctccaccaaggaggtcctgaacgccaccctgatccaccagagcgtgacgggcctgtacgagacccgcatcgacctctcccagctgggggagaactga

SEQ ID NO: 1861 - RNA, 4050 nt, synthetic construct
  misc_feature 1..4050: note = Cas9 variant
  source 1..4050: mol_type = other RNA
atgaagcagaagttctacgtgggcctggacatggggaccgccagcgtgggctgggccgtgaccgacgacaagtacaacatcatcaagcgccacgggaaggcgctctggggcgtgcggctgttcaagacggccaacaccgccgaggagcgccggatcttccgcgccgcccggcgccggacccagcgccggaagcagcgcatggagctgctccaggagatcttcggggacgagatctccaagaccgacatcggcttctaccagcggatgaaggagagcaagtactggttcgaggacaagcgcgacatcaacggcaagcagcccgagctgccgtacgcgctgttcgtcgacgacgggttcacggacaaggactaccacgagcagttccccaccatcttccacctccggaacgtgctggtgaacgagtggacccagaagtacgacatccgcctggtctacctcgccatccaccacatcatcaagcaccggggccacttcctgttcgaggggaagaagatgtccgaggtgaccgacttcggcagcgccttcgaggccttctgcaaggtggcgtccgacaacgacatcgagatcacggtcgacgaggagaagctgaaggacatcgaggacctcctcaagagccgccagaagtccaagaccgccaagaagcaggagctggggaagatcatcgccggcgccgacaagcagaagaaggccctcgcggccctggtgaccggctgcatggtgaagctgagcgagatcttcgccgacaagtccctcgacgacggggagcggaacaagatcagcttcgccgactccaactacgacgagtacatcgccaacgtcgaggagaccctggcggagcgcttcctgctcatcgccgccggcaaggccctgtacgactgggccgtgctgagcgacatcctcgaggggtccacgtacatcagcgaggcgaaggtgaagatctacaagaagcacggcgacgacctgcggaagctgaagggcctcctgaagacccgccccgacgagtacaagctgatcttcgggctccccgagaagcaggccaactactccgcctacatcggcatggtcaagaagaacgggaagaaggtgccgatcgacaagaagtgcaccaaggccgacttctacagcttcctgaagaagaccctgaacaagatcaacttcgaggacgagaaggagcgggagatcgccgagtccatcatcaacgagatcgagaacgagacgttcctccccaagcaggtcatcagcgacaacggcgtgatcccctaccagctgcacgaggcggagctggaccgcatcctcaagaacgccgccctgtactaccccttcctgtccgagaaggacgacgaggggtacaccaacatggacaagatcaaggccatcttcaagttccgcatcccgtactacgtgggccccctcaacacctaccacagcgacaagggcgggaacagctgggcggtgcggaagcaggacggcaagatctacccctggaacttcgagtccaagatcgacgccggggagagcgcccgcaagttcatcggccggatgaccaacaagtgcacgtacctgatcgggaaggacgtcctgcccaaggagtccctcctgtacagcaagttcatggtgctgaacgagctcaacaacctgcgcatcgacggcgagaaggtgtccgtcgagatcaagcaggccgtgtacgagaacgtcttcaagaagtaccagcgggtgaccggcaagaaggtgaaggacttcctgatccgcagcgggatcatcggccgggagcaggagctctccgggttcgaccagaacttcaagagctccctgaaggcctaccacgacatcaagcagatcgcgggcgacatcaacctgagccagaaccagaaggaggacatcatcaaggagatcaccgtcttcgccgactcccagaagatgctgaagaagcgcctcaagatcaagtacccggagctgagcgacaagcaggtcaccaagctggccgccaagaagtacacggggtggggccggctctcccgcgagttcctggaggaggtggagagcgtgaacaaggagaccggcgaggtgctgaacatcatctccgccctctgggagaccaacgagaacctgatgcagctgctcagcaacaagtacgactacctgtccgagatcaagcggctgaacgacgaggcggaggacaagagcgaggtggtcacctacgacgacgtgcagaagctctacgtgtcccccgccgtcaagcgccccgtgtggcagacgctgaagatcgtggaggagatcagcaagatcatggggagcaagcccgagcggatcttcgtcgagatggcccgcgagccgggccagaagggggacgtgaaggtgtcccgcaagagccggctgctcgagaagtacaagtactgcaagaaggaggcccccgagatctacgagaacctggtcaaggaggacgacaacaagctgcggtccgacaagctgttcctgtactacacccagatgggccgctgcatgtacagcaacgaggtgatcgacatcgaggacctgttcaccaaccggtacgacatcgaccacatctacccccagtccaaggtgatggacgacagcctcgacaaccgcgtcctggtgaagcgcgagctgaactccaacaagaccgacgtgttccccgtcccgaaggagtacatggacaaggccaagacgctctgggacatgctgaagaagaaggacctgatcagcaaggagaagtaccaccggctcacccgccgggacggcttctccgagaacgagctgagcgggttcatcgcgcgccagctggtggagacccggcagtccaccaaggccgtgacgcagctcctgaccaaggcctaccccgagagcgagatcgtctacgccaaggcgaacgccgtgtccgagttccgccacaagttcggcttcaccaaggtgcggagcatcaacgactaccaccacgccaaggacgcctacctgaacatcgtcgtggggaacacctactacgtgaagttcaccaaggacgccgcgtggttcatccgcaacaaccccggccggacgtacaacctcaagaagatgttcgagcaggggaccgtctcccgcggcggcgagaccgcctgggtgagcggggaggacggcaccatcttcacggtgaagcgggtcatggggaagaacaacatcctgttcacccgcaaggcctacgaggtgcggggcgggctgttcgaccagcagatcatgaagaagggcaagggccagatccccgtgaagaacaactccgaggacgaccgcctctgcgccaccgagaagtacggggcctacaacaaggcgagcggcgcctacttcatgctggtcgagagcgaggacaagaaggggaacaagatccggaccctggagttcgtgccggtgtacctcgccaaggagctggagaagtccgaggacgccgccatccgctactgcgtcgagaagctggagctcaagaaccccgacgtgcgggtgcgcaagatcaagatggacagcctgttcaacgtcgacggcttccggatgcacctgtccgggcgcacgggcaagcagctcatcttcaagtgcgcggagcagctggtgctggacgaggagagccagaagatcctcaagaagaccgccaaggtgttcgccgactacaaggagaacaagaacatcaagatctccgacaagatcgagctgaccgacgagatgctgatcaagctctacgagctgttctacaagaagctgaaggacaccgtctacaacatccggctcagcacccaggtgaagacgctggagtccggcaaggagaagttcgagaagctgagcctcctggacaagtgcctggtgatcgaggagatcctccacctgttccagtgccagtccgtcgccgcgaacctgagctccatcgggggcgccgccaccgccgggatcctcgtgctgaacaacgagatcagccgctgcggcaaggtcgagatcatcaaccagtccatcaccgggttctacgagcaggtcatcgacctgaagaacatctga

SEQ ID NO: 1862 - RNA, 4050 nt, synthetic construct
  misc_feature 1..4050: note = Cas9 variant
  source 1..4050: mol_type = other RNA
atgcagaagtactacctgggcctcgacatcgggaccaacagcgtgggctgggcggtcaccgacgagaactacaacctgtgcaagttcgggggcaagcgcatgtgggggatccggctgttcgacggcgcccagacggcggaggagcgccggatgaaccgctccaaccggcgccggctcagccgccagaagcagcggatcgacctgctgcaggagctgttcgccaaggagatcgccaaggtggaccccaccttcttcatccgcctgaacgagtcccggctgtacatggaggacaagagcaccggcaccaagttccccctcttcgccgacccggggtacacggacaaggagtactacaaggagtaccccaccatctaccacctccgccaggagctgatcaagaaccccgagtcccacgacatccggctcgtgtacctggcctgccaccacatcctgaagaaccgcggccacttcctcatcaacgggagcttctccgacctgaagaacctgagcttcgtctgccgggagatgctcgacgcgttcaacgagctgtccaagtaccagctgatgatcagcgacatcgacgccctcgagaagatcctgtccgaccgcaagcagcagaagtccgccaaggtgaaggagctggtgcagatcttcgagtgcgtcccgcgggaggacaagagcgacgccaagatctgcaaggagatcctcagcaacctgtgcaagttcctggtgggcgcgaaggggaacatcacccgcctcttcgacaccgacttcgacgagatggagacgtccagcttctccttcggcgacagcaagtacgaggactccctgctgcccagcctcgaggagaactaccccgactacgccaacgtgatccagaagatcaaggccatgtacgactggagcgtcctggtggagatcatggccggcgagaactacctgtccttcgccaaggtgaacgcgtacaagaagcacaaggagaacctcagcatcctgaagtccctgatgaagaagtactgcacccccgacgtctaccagcggttcttctacgagaccgacgagaagtccagctacgggaactacatcggcgccatccacaacaacgggcacagccacaccatgaagaagtgcgacgaggagacgttctacaagtccctcagcaagatcctggacaagctggtggtgcagaagaccgaccaggacaccctcgagatcctgaagaaggaggccaagaaccagaccctgctcccgctggcccgcacgaaggccaacggcgtcatccccaaccagatccacatccaggagctgcgggcgatcctcgacaacgccaagacctacctgtccttcctgaacgaggccgacgagtacggcaccatcgccgagaagatcatccgcatcgccaagttcaagatcccctactacgcggggcccctcagcacccgccacaaggagcagggcgccaacacgtggatcgtgcggaagcaggaggggcgcatctacccgtggaacttcgaggagatggtggacctggagcggtccaacaacgagttcatccgccggatgaccaacaagtgcacctacctgatcggcgaggacgtcctgcccaagaacagcctcctgtactccaagttcatggtgctgaacgagctcaacaacctgaagatccgcgggcacaagatcagcgtggagctgaagcaggagctctacaaggagctgttctgcaagaaggccaaggtcaccggcaaggccctgctcgtgtacctgaagaagaaggacgccgagctgacgctcgaggacatctccggcttcgacgcggacttcaagagctccctgagcatctacatcgacttcaagaaccacatcctgcgggagcagatcgacgacgggaagtaccagtccatcgtggagaacatcatcaagtggaagaccatcttcgacgtcgacagcaagatgatcgagaagctcatcgcccgcgagtaccccaacatgttcagctccgagcagatcaagaagatctgccggctgaagtgccgcggctgggggaacttcagctcccggttcctgaacggcatccagggggagaacaccgagaccaaggagtgcttcacgatcatcgaggccctctggaagaccaactacaacctgatgcagctgctcagcaagcagttcaccttcaaggacgccatcgactgcatcaacgcggacaaggtgggcaagatcgacaaggtcacctacgagaacacggtgaaggacctggtggtctcccccgccaacaagcgcgccatctggcagaccgtgcagatcaccgaggagatcaagaaggtgatgaagtgcgagccggagaagatcttcgtcgagatggcccggggcggggagaaggagaagaagcgcaccatcagccggaaggagcgcctgctcaagctgtacatggactacaaggacgagaaccgggactggatcaaggagatcgagtcccgcgacgagcaggacttcacgaaccggaagctgtacctctactacacccagatcggccgctgcatgtacagcggggaggagatctccctggaggagctgatgcagaagaacagcaagtgggacaaggaccacatctacccccagtccaagatcaaggacgacagcctcgacaacctggtgctggcccgcaaggacatcaacaacaacaagtccaacaagctcctgcccaccggcatccaggacaagatgaagaagtactggaagatgctgctcaagtacgggttcatcagcaagaagaagtacgaccggctgatgcgcaccgaggacttctccgacgaggagctgagcggcttcatcgcgcggcagatcgtggagacccgccagtccagcaaggccgtcgccgagctcctggagcacctgaacgagcacacggagatcgtgtacgtgaaggccgagctcgtcagcgacttccggcacgacaacaacatgctgaagtcccgccggatcaacgactaccaccacgccaaggacgcgttcctgaacatcgtggtgggcaacgtctacaacgccaagttcaccgccaacccccgcaactggatcaagaagaaccggaacaccaactacagcatccgccgggtgttcgactacaccgtgaagcgcgggtccacgatcgtctggcagggcgtgaaggacgggggccacagcatcgacggcatcaagaagaccatggcccggaacgacatcctctacaccgagcgcacctactgcgagcagggggagctgttcaacgccacgctgatcaagaagggcaacccgaacgcgatcgggctcaagaagggcctggaccccatgaagtacgggggctactccagccccaagacctccgccttcgccttcatcgagttcgacggcaagaaggggcggcagaaccacctggtggagatccccgtctacatcgccaacatcgcggcccgccagccggagtacatcaagaaccacctcgaggagaagaagggctaccagaacgtgatcgtgaagaagtaccccatccagaagaacgccctgatcaagctggacgggtaccccgcccggctccgcggcgccaacgagaagtccatcaccctgaagaacgcggtccagctggtgctcaagcccgagtaccacgagaccatccggaacgtggagaagtacctggagtacatcgacaaggacgagagcgtcagcaaggccgcccgcttctcccacacggagctggacaagctctacgacgagctgtgcttcaaggccgagaacagcatctacaagaagcggccggccaaccagtccgcgaccctgaagaacgggcagaagaccttcctcgccatcaccaacctgaaggagaaggcccaggtgatcaacaacatcatcacgatgttccgctgcgacgccaccaccaccacgaacctgaagaccatcggcggcagcgccaacgccgggggcatgcaggtcaacaagaacaccctcacctcccagaaggtggtgctggtgcaccagagcatcacggggctgttcggcaccgaggaggagctcctgtga

SEQ ID NO: 1863 - RNA, 4053 nt, synthetic construct
  misc_feature 1..4053: note = Cas9 variant
  source 1..4053: mol_type = other RNA
atgaagaagccctacagcatcggcctggacatcgggaccaactccgtgggctgggccgtcgtgaccgacgactacaaggtgccggccaagaagatgacggtcctcgggaacaccgacaagagccacatcaagaagaacctgctgggcgcgctcctgttcgactccgggaacaccgccgccgaccgccggctgaagcgcaccgcccggcgccggtacacgcgccggcgcaaccggatcctctacctgcaggagatcttcgccgaggagatgagcaaggtggacgactccttcttccaccgcctggaggacagcttcctcgtgaccgaggacaagcggggcgagcgccaccccatcttcggcaacctggaggaggaggtcaagtaccacgagaacttccccaccatctaccacctccggcagtacctcgcggacaaccccgagaaggtggacctgcgcctggtgtacctcgccctggcccacatcatcaagttccgggggcacttcctgatcgagggcaagttcgacacccgcaacaacgacgtccagcggctgttccaggagttcctggccgtgtacgacaacacgttcgagaactccagcctgcaggagcagaacgtgcaggtcgaggagatcctcaccgacaagatctccaagagcgcgaagaaggaccgcgtgctgaagctgttcccgaacgagaagtccaacgggcggttcgccgagttcctcaagctgatcgtgggcaaccaggccgacttcaagaagcacttcgagctggaggagaagacgcccctccagttcagcaaggacacctacgaggaggagctggaggtcctgctcgcccagatcggggacaactacgccgagctgttcctgtccgcgaagaagctctacgacagcatcctgctgtccggcatcctcacggtgaccgacgtgagcaccaaggcgcccctgtccgccagcatgatccagcgctacaacgagcaccagatggacctggcccagctcaagcagttcatccggcagaagctgtccgacaagtacaacgaggtcttcagcgacgtgagcaaggacggctacgccgggtacatcgacggcaagaccaaccaggaggccttctacaagtacctgaaggggctcctgaacaagatcgagggctccggctacttcctggacaagatcgagcgcgaggacttcctccgcaagcagcggacgttcgacaacgggagcatcccccaccagatccacctccaggagatgcgcgccatcatccggcgccaggccgagttctacccgttcctggccgacaaccaggaccggatcgagaagatcctgaccttccgcatcccctactacgtgggccccctggcccgggggaagtccgacttcgcgtggctgagccgcaagtccgccgacaagatcaccccctggaacttcgacgagatcgtcgacaaggagagctccgccgaggccttcatcaaccggatgaccaactacgacctgtacctcccgaaccagaaggtgctgcccaagcacagcctgctctacgagaagttcacggtgtacaacgagctgaccaaggtcaagtacaagaccgagcagggcaagaccgccttcttcgacgcgaacatgaagcaggagatcttcgacggggtgttcaaggtctaccgcaaggtgacgaaggacaagctgatggacttcctcgagaaggagttcgacgagttccggatcgtggacctgaccggcctggacaaggagaacaaggccttcaacgcctcctacggcacctaccacgacctccgcaagatcctggacaaggacttcctggacaacagcaagaacgagaagatcctcgaggacatcgtcctgaccctgaccctcttcgaggaccgggagatgatccgcaagcggctggagaactactccgacctgctcaccaaggagcaggtcaagaagctggagcgccggcactacaccgggtggggccgcctgagcgccgagctcatccacgggatccggaacaaggagtcccgcaagaccatcctggactacctgatcgacgacggcaacagcaaccgcaacttcatgcagctcatcaacgacgacgcgctgtccttcaaggaggagatcgccaaggcccaggtgatcggggagacggacaacctgaaccaggtggtgagcgacatcgccggctcccccgccatcaagaagggcatcctccagagcctgaagatcgtggacgagctggtcaagatcatggggcaccagcccgagaacatcgtggtggagatggcgcgggagaaccagttcaccaaccagggccgccggaactcccagcagcgcctcaaggggctgaccgacagcatcaaggagttcggcagccagatcctgaaggagcacccggtcgagaactcccagctccagaacgaccggctgttcctgtactacctccagaacgggcgcgacatgtacaccggcgaggagctggacatcgactacctgagccagtacgacatcgaccacatcatcccccaggccttcatcaaggacaactccatcgacaaccgggtgctcacgagctccaaggagaaccgcggcaagagcgacgacgtgccctccgaggacgtcgtgaaccggatgcgccccttctggaacaagctgctgagctccgggctcatcagccagcggaagtacaacaacctgaccaagaaggagctgaccccggacgacaaggccggcttcatcaagcgccagctcgtggagacccggcagatcaccaagcacgtcgcccgcatgctggacgagcggttcaacaaggagttcgacgacaacaacaagcgcatccggcgcgtgaagatcgtgacgctgaagtccaacctcgtcagctccttccggaaggagttcgagctgtacaaggtgcgcgagatcaacgactaccaccacgcccacgacgcgtacctgaacgccgtggtcgtgaaggccctcctggtgaagtaccccaagctggagcccgagttcgtctacggggagtaccccaagtacaacagctaccgggagcgcaagaccgccacccagaagatgttcttctactccaacatcatgaacatgttcaagagcaaggtgaagctcgccgacgaccagatcgtggagcgcccgatgatcgaggtcaacgacgagaccggcgagatcgcgtgggacaagacgaagcacatcaccaccgtgaagaaggtgctgtcctacccccaggtcaacatcgtgaagaaggtggaggagcagaccatcggccagaacgggggcctgttcgacgacaaccccaagagccccctcgaggtcatcccgagcaagctggtgcccctgaagaaggccctcaaccccgagaagtacgggggctaccagaagccgacgaccgcctaccccatcctgctgatcgtggacaccaagcagctcatccccatctccgtcatggacaagaagcggttcgagcagaaccccgtgaagttcctgaaggacaaggggtaccagcagatcgagaagaacaacttcgtgaagctgccgaagtacaccctcgtcgacatcggcaacggcatcaagcgcctgtgggccagctccaaggaggtgcacaaggggaaccagctggtggtcagcaagaagtcccaggacctcctgtaccacgcgcaccacctggacaacgactacagcaacgagtacgtgaagaaccactaccagcagttcgacatcctcttcaacgagatcacgtccttcagcaagaagtgcaagctgggcaaggagcacatccagaagatcgaggaggcctactccaaggagcgggacagcgcctccatcgaggagctggccgacgggttcatcaagctcctgggcttcacccagctgggggccaccagccccttctccttcctcggcatcaagctgaaccagaagcagtacaccggcaagaaggactacctgctcccctgcatggaggcgacgctgatccaccagagcatcaccgggctgtacgagacccgcatcgacctctccaagctgggcggggactga

SEQ ID NO: 1864 - RNA, 4053 nt, synthetic construct
  misc_feature 1..4053: note = Cas9 variant
  source 1..4053: mol_type = other RNA
atgggcaagaactactacctggggctcgacatgggcaccagctccgtggggtgggccgtcaccgacgagaagtaccgcatcctgcgggccaagggcaaggacctgtggggcgtgcgcctcttcagcgaggcgaagacggccgccgagcggcgcacccaccggacctcccgccggcgcctggaccgggagaaggcccgcatcgcctgcctgaaggagatgttcgcggaggagatcaacaagatcgaccccgggttctaccagcggctcaacgacagcaagtacttcctggaggacaagaaggagcaccagccgtacgccatcttcgccgacaccggctacacggacaaggagtactacgacgagtaccccaccatcttccacctccgcaaggccctcctgaacatcgagaacgacaagaagaagtacgacgtgcggctggtctacctcgcgatcctgaacatgttcaagcaccgcgggcacttcctgaacgccaacctcgacgacaagtccggcgggaacctgaaggagtacatcgagatgctgcaccagagcatggtgaacatcctcaacatcaacctgaagaacgtggagatcgagaagatcgagaagatcctgaagtccacccagtacagcaactccgagcggctcgagaacctgctggagctctacgagctgagcaagaacaagaacaagatcgagaccgagatcttcaagttcatctgcggcctgaaggggacgatctccaagatctacgtcgaggacaagttcgaggacgagttcgccaagatgaccctcagcttccgcgactccaacttcgacgagaagatcatcgagatcgaggacaacctggacgacgacaagtacgacatgttcctgctcatcaagcagatccacgactggagcgtgctggccaacatcatgaacggcgaggagtacctgtccgtggcccgggtcaagctctacgacaagcacaagaaggacctggaggtgctgaagaagtactacaagcagaacagcatggaggagtacaacaagatgttccgccagatgaacgacggcaactactccgcgtacgtggggagcgtcatctacaaggacaactccgtgcggcgcggctgcaagagcaagaaggaggacttctacaagaacatcctcaacaccatcaagagctgggaggactgcgaggccaaggagtacatcacctccgagatcgacaaggggaacttcctgcccaagcagatcacggccagcaacggcgtgatccccaaccaggtccacaagaaggagctgaagaagatcctcaagaacgcctccgagtacctgaacttcctgaacgagaaggacgagagcggctacaccatctccgagaagatcgtgaagctgttcgagttccagatcccgtactacgtggggcccatcgcctacaacatcggcaacgacgagagcaagcaccggcacaacatgtggtccgtccgcaaggagaaggggcccatctacccctggaacttcgagcagaagatcgacatcaagaagtccagcgagaagttcatccgcaacctgatcaaccactgcacctacctgaacgacgaggaggtgctcccgaagaacagcctgctgtacgagaagttcatggtgctcaacgagctgaacaagctgaagatcaacggcgagaagatctccgtcgagctgaagcagaacatcttcaacgacctcttcaagaaggggaagaaggtgaccaagaagggcctgatcaagtacctgaaggagcagggcgagatcgacaactgcgaggaggtggagatcagcgggatcgacggcgacttcacgaacaagctctccaactacaagaagttcgcggacatcttcggggtccagagcctgacctacgagcagaccgacatcgccgagaacatcatccggtactccaccatctacggcgacagccgcaagttcctggaggagcggatccgcgaggagtactccaacgtgctcgacgagaagcagatcaagcggatcctggggatgaagttcaaggactggggccgcctgagcaaggagctcctggagctgtccggcgtcgacaaggagacgggggagatcgccagcgtgatcagccggatgtggaacgacaactacaacctcatggagctgatcgccaccgagcgcttctcctacgcctacgagatcgagcagcggagcaagaagctggagaagaccatctccaccatcgagtacgaggacctcgacgagctgtacatgagcacgcccgtgaagcgcatggtctggcagaccatcctggtgctcaaggagctggaggaggtgctgggctgcccgcccaagcggatcttcgtcgagatggcgcgcgacgtgaacgcccccaaggaccggaaggactcccgcaagaagaagctcctggagctgtacaagaactgcaagaaggaggagggggactggagcaaggagctcaacgcccgggaggagtccgagttcaagagcaagaagctgtacctgtactacatgcagaagggccgctgcatgtactccgggaagcccatcgacctcaagaacctgctgaacgacaacctctacgacatcgaccacatctacccccggcacttcgtgaaggacgacagcatcgagaacaacctggtcctggtggagaagaacttcaacgcccacaagtccgacaactaccccatcgagaacgagatccgccagaagatgcacagcatgtggaagatgctccgggacggcaacttcatcaccgaggagaagtactcccgcctgatccgcaaggaggagttcaccgacgacgagaaggccaagttcatcagccggcagatcgtggagacgcgccagggcaccaaggtcatcaccgacctgttcgagcagaccttcccggagtccgacatcgtgtacgtgaaggcggggaacgtcagcgagttccggcacaagttcaagctcatcaagtgccgcaacgtgaacgacttccaccacgccaacgacgcctacctgaacatcgtggtcggcaacgtgtactacacgaagttcaccaagtccgccctgaacttcatcaaggactacaagaagaaccccgagaagaacaagtaccacatggaccacatgttccagtaccccgtgagccgcgggggcgtcgacgcgtggatcaccaagggcgccgagagcatctccatggtgcggaagatgatggccaagaacacccccatggtgacgcggatgaactacgagaagcacagcgggcagaagggcgggatctccgaccagaacatctgcagcgccaagatcgccaagaagaacgtctacctcccgatcaagatgggcgacgagaagctgaagaacgtggagaagtacgggggctacggctccctgaccgcgaagtacttcttcctcgtggagcacaccatcaagaagaagcgcatccggaccatcgaggcctaccccatgtacctggacgccctgaacaaggagaacaagctcctgaactactgcgtccaggtgctggagtacgacgagcccaagatcatcatggagaagatcaaggtcaagagcctcttcaagatcaacgggtactactactacctgaacgccaagtccgtgaaccgcatcatctggggcaacgccacccagctgttcctcgagaacgacatcaacgagtacgtgcggaagatcagcaagaacatcgagtgcatcgacatcaactccgagaacaacatcaaggtgtacgacatcttcatcgagaagtacagcaacaagctgttctccaaccgcctggggaacctcaaggaggcgatcatccagaaccggaacaagttcatcgagctgaagatcaacgagcagatcaacgtcatcctggagctcgtgcgctacagccaggacggcgtgtactccatcaacctgagccagctggggctctccagcacgtacgccatcaaccggacctccaaggagatcagcaagatgaaggagtgcaagctgatcaaccagtccgtcaccggcctgtacgagaacgagatcgacctcctgaccgtgtga

SEQ ID NO: 1865 - RNA, 4053 nt, synthetic construct
  misc_feature 1..4053: note = Cas9 variant
  source 1..4053: mol_type = other RNA
atgcagcagtactacctgggcgtggacatggggagcgcctccgtcggctgggccgtgaccgacgagaagtaccagctcgtgcgcaagaaggggaaggacctgtggggcgtccggaccttcgacatcgcgcagacggccgaggtgcgccgggtgagccgcaccaaccggcgccggcagaaccgccggaagcagcgcatccagatcctgcaggagctcctgggggaggaggtcctgaagatcgacgccggcttcttccaccggatgaaggagtcccgctacgtggccgaggacaagcggaccctcgacggcaagcaggtcgagctgccctacgccctgttcgtggaccaggggttcaccgacaaggacttctacaagcagttcccgacgatcaaccacctcatcgtgtacctgatgaccaccagcgacacccccgacatccgcctggtgtacctcgcgctgcactactacatgaagaaccggggcaacttcctgcactccggggacatcaacgacgtcaaggacatccagagcatcctcgagcagctggagaacgtgctgaaggagtacgtggacgactgggagctctccctgaaggacaaggtcgacgccatcaaggagatctacaacaaggacctgggccgcggggagcggaagaaggccttcatcaacacgctcggcgtgaagaccaagagcgccaaggcgttctgctccctgatcagcggcgggtccaccaacctggccgagctgttcgacgacagcggcctgaaggagtccgagtacgccaagatcgagttcgccaacgccaacttcgaggacagcgtggaggggatccaggcgctgctcgaggaccgcttcgccgtcatcgaggccgccaagcggctgtacgactggaagatcctgaccgacatcctcggcgacaacgcctccctggcggaggcccgcgtcaagagctacgagacgcaccacgagcagctggtggagctcaagtccttcatcaagaagtacctggaccggaagatctaccaggacatcttcatcaaccccaacatcgccaacaactaccccgcctacgtgggccacaccaagatcaacgggaagaagcaggagctggaggtgaagcgcgccaagcgcaacgacttctacgcgtacatcaagaagcaggtcatcgacccgatcaagaagaaggtgagcgacaaggccgtgctcgcccggctggccgagatcgagtccctgatcgaggtcaacaagtacctccccctccaggtgaacagcgacaacggcgtgatcccctaccagatcaagctgaacgagctccgccggatcttcaacaacctggagaaccgcctgcccgtcctcaaggagaaccgggacaagatcatcaagaccttcagctaccgcatcccgtactacgtggggcccctgaacggcgtgaaccggaacgggaagtccaccaactggatggtccgcaaggagggcgaggagggcaagatctacccctggaacttcgaggagaaggtggacctggaggccagcgcggagaagttcatccggcgcatgacgaacaagtgcacctacctcgtgaacgaggacgtcctgcccaagtactccctgctgtacagcaagtacctcgtgctgtccgagctgaacaacctccggctggacgggcgcccgctggaggtgagcgtcaagcaggagatctacgagaacgtgttcaagcggaaccgcaaggtgaccctcaagaagatcaagaactacctgctgaaggagggcgtcatctccgagaaggacgagctcagcgggctggccgacgacgtgaagtccagcctgaccgcctaccacgacttcaaggagaagctcggccacctgacgctgaccgaggaccagatggagaagatcatcctcaacgtgaccctgttcggggacgacaagaagctgctcaagaagcggctggccgcgctgtaccccaacatcgacgagaagtccctcagccgcatggccaccttcaactaccgggactggggccgcctgtccaagaagttcctgagcgagatcacgtccgtcgaccaggagaccggcgagctccggaccatcatccagtgcatgtacgagacccagaacaacctgatgcagctgctcagcgagccctaccacttcgtggaggccatcgagaaggagaaccccaaggtggacctggagtccatcagctaccgcatcgtcaacgacctgtacgtgtccccggccgtgaagcgccagatctggcagacgctcctggtcatcaaggacatcaagcaggtcatgaagcacgaccccaagcggatcttcatcgagatggcccgcgagaagcaggagagcaagaccaccaagagccggaagcaggtcctgtccgaggtgtacaagaacgcggagaagtacaagaacctcttcgagaagctgaacagcctgaccgaggagcagctccgctccaagaaggtgtacctgtacttcacgcagctggggaagtgcatgtacaccaacgacgccatcgacttcgagaacctcgtgagcgccaactccaactacgacatcgaccacatctacccccagagcaagaccatcgacgactccttcaacaacctggtgctggtgaagaagggcatcaacaacgacaagagcgaccggtaccccatcgacaagaacatccgcgacgacgagaaggtgaagaccctctggaacacgctgctgtccaaggggctcatcaccaaggagaagttcgagcggctgatccgcagcaccccgttctccgacgaggagctggccggcttcatcgcccggcagctcgtcgagacccgccagagcaccaaggcggtggccgagatcctgtccaactggttccccgagagcgagatcgtgtactccaaggccaagcacatcacgaacttccggcaggacttcgagatcctgaaggtccgcgagctcaacgactgccaccacgcccacgacgcctacctgaacatcgtggtggggaacgcgtaccacaccaagttcaccaacagcccctaccggttcatccagaacaaggccaaccaggagtacaacctgcgcaagctcctgcagaaggccaagaagatcgagtccaacggcgtcatcgcctggatcggccagagcgagaacaaccccgggaccatcgcgacggtgaagaaggtgatcagccggaacaccgtcctgatctcccgcatggtgaaggaggtggacggccagctgttcgaccagcagctcatgaagaaggggaagggccaggtcccgatcaagagctccgacgaccggctgatcgacatcagcaagtacggcgggtacaacaaggccaagggcgcctacttcgtgttcatcaagtccgtgcgccgggggaagaccatcaagagcttcgagtacatccccgtccacctcgccaagaagttcgactgcaacctggagctgctcaaggagtacctggagtccgagaaggacctgaacaacgtggagatcctcatgcccaaggtgatgatcaacagcctgttcaactacaacggctccctgatccgcatccccgggcggtacgacaagaagtccctcctgatcaacgtcgacgtgccgctgctcctggagagccagcacatcaagcagctgaaggtcatcgagaagtacatgtacaagaagcgcgtgagcaagaactccaacatcctcctgaccaagttcgccagcgaccagctgaaggacctcgacgcgctgttcgacgtgctgtcctacaagctcaacgagaacatctacaacgtcatcaacgacaagtacgacaagctggtgatctgccgcgacaagttcatcagcctggacacggaggtgaagtgcgagatgatcttcgagctcctgcacctgttccagtgcaactcccagctcgccaacatcaccaagatcggcgccaccagcaagttcggctccatcagcatgagcaagaacctgaaggagaacgacaagatgtccatcatccaccagagcccctccgggatcttcgagcacgagatcgagctgaccgccctctga

SEQ ID NO: 1866 - RNA, 4053 nt, synthetic construct
  misc_feature 1..4053: note = Cas9 variant
  source 1..4053: mol_type = other RNA
atgaagcgcatcctgggcctcgacctggggaccgccagcatcggctgggccctggtgaacgagtccgagaacgagaaggagaagtccgagatcatcaagctcggggtccgggtgaaccccctgaccacggacgagcagaccgacttcgagaagggccgcccgctgtccgtgaacgcggaccggaccctcaagcgcggggcccggcgcaacctgcagcggttcaagcagcgccggaagaacctgatcgagatcctcatcaagaagggcttcatcaccaacatcagcctgctgacggagatcggctccaacaccacctaccagaccctcgagctgcgcgccaagagcgtcaaggagaagatcgagaaggaggagttcgcccgggtgctgctcacgatcaacaagaagcgcgggtacaagtccagccggaaggccaagaacgacgaggagggctccctgatcgacgggatgagcgtggcgaaggagctgtacgacaacaacctcaccgtcggccagtacgtgtaccagctgctggagaagggcgggaagtacatccccgacttctaccgctccgacctccagaacgagttcgacgtgatctggaacttccagaaggagttctaccccaacatcctgaccggcgagctgtacaagaagctccaggggcagggccagcagaacagccggaagctgttcctggccatccaccagatctacaccgccgagaacaaggggaagcgcgacacggtcaagaagcagcactacaagtggcggaacgacgccatcaacacccagctcctgatcgaggaggtggcgtacgtgctggtcgagatcaacaacaacctcaacaagtccagcggctacctgggcgccatctccgaccgcagcaaggagctgtacttcaacaaggagaccgtgggggagaacctctacaagcagatccaggagaacccccagacctccctgaagaaccaggtgttctaccggcaggactacctggacgagttcgagcagatctgggagacgcaggccaagttctacagcgagctcaccaaggagctgaaggaggaggtccgcgacgtggtgatcttctaccagcggaagctgaagtcccagaagcacctcatcagcgagtgcgagttcgagaagcaccacaaggccatccccaagagcagccccctgttccaggagttcaagatctggcagatcctgaacaacatcgagttcaagcacaagaagaccaaggagctcaagatcctgagcgaggagctgaaggagaccctcttcgaggagctgaacatccgcggcaacttcacgtccgacgccgtcctgaagttcgtgaagctcgacaagaaggagtgggagctgaactacaagaaggggatcgagggcaaccgcaccaacgaggtgctgtacaacgtctaccagaagatcgcggagtacgaggggtacggcttcgactggagcaagaagtccgccgtggagatcaaggaggagctgaacaccatcttcagcgagatcggcatcaactccaagatcctcgacttcaaccccgagatcagcgggaacgacttcgacaagcaggagtcctaccagctgtggcacctcctctacagcgccgaggaggacggcttcctgaagcagaagctgcaggacaagtacgggttcaagtccgagtacgccaacatgctcgccaacgtgagcttccagtccgactacggcagcctgtccgcgcgggccatcaagaagatcctgcccaacctcatcgccgggcacgagttcagcgaggcctgctccctgagcggctacaaccactccaacagcctgaccaaggaggagctcgccaaccgcccgctgaagggcaagctggagctcctgaagaagaacagcctgcggaaccccgtcgtggagaagatcctcaaccagatggtcaacctggtgaaccaggtgatcgagtcctacggggagatcgacgaggtccgcatcgagctggcgcgggagctcaagaagtccgcccaggagcgcgccctgatgacgaccaacatcaacgccagcaagaccaagtacgagagcttccggaagctgctccagaaggacttcggcatcaagaaccccacccgcaacgacatcatcaagtaccggctgtacgaggagctgaaggccaacaagtaccacacgatctacaccaacaagtacatcccccgcgacaagctgttctccaaggagatcgacatcgagcacatcatcccgaaggcgaagctgttcgacgacagcttctccaacaagaccctggccttccggaagcccaaccaggacaaggggaacatgaccgccatcgactacatcctcagctaccagtccaaggacatcgacaactacaagagccgcatcgagaacctgttcaagaacggcaagggggacatctccaaggccaagcggaacaagctgctcatggaggagaaggacatccccgacggcttcatcgaccgcgacctgcggaacagccagtacatcgcgaagaaggccaagcagctgctcgaggaggtgatccgcacggtgaacaccaccaccggctccgtcacgaacaagctgcgggacgactgggggctgatcaacgtgatgcaggagctcaacatgcccaagttcaaggccatcgacgagagcctgatcgagcagatcgagaagaaggacggcaccttcaagacccgcatcaaggactggtccaagcggaacgaccaccgccaccacgccatggacgccctgaccgtggcgttcacccgctacaaccacatccagtacctcaacaacctgaacgccaagagcgacaagaagggggccatctacggcatccaggagctggagacgtacgtcaactccaagggcaagcggaagttcatcaagccgatgcacaacttccgcgaggaggccaagaagcacatcgaggacatcctcatcagcttcaaggccaagaacaaggtggtgaccaagaacatcaacaagatcaagagcaaggacgggttcatcaagaaggtccagctgaccccgcggggccagctgcacaaggagaccgtgtacgggaagatcaacgaggtggtcgtgaaggaggagaagatcaacgcgaagttcgacctcgagaagatcaacaaggtgacgaagcccatctaccgcaacgccctgctgaagcggctccaggagttcaacggcgagcccaagaaggccttcaccgggaagaactccctgagcaagaacccgatctacctggacgtcgcccagaccaagaccctccccgagtccgtgaaggtgcagttcttcgaggagaactacacgatccgcaaggagatcagccccgacctgaagatcgacaagatcatcgacaagggcatccagcggatcctgctcaagcgcctggacgagttcaacggcaagcccaaggaggccttctccaacctggagaagaacccgatctggctcaacaaggagaaggggatcgcgatcaagcgggtcaagatcaagggcgtgaagaacgtggagagcctgcacaacaagcgcgaccacctggggaacgagatcctccagaagggcaagtccgcccccaacgactacgtcagcaccgggaacaaccaccacgtggccatctaccaggacaagaacggcaagctgcaggagaaggtggtctccttctacgaggccgtggcgcgggtgaacaacaagctgcccatcatcgaccaggacttcaacaaggacctcggctggaagttcctgttcaccatgaagcagaacgagatgttcgtcttccccagcgaggacttcaagccgctggagaccgacctcatggacaagaagaacaactccaagatcagcaagaacctgttccgcgtgcagaagctggggaacaaggactacacgttccggcaccacctcgagaccaagatcgaggacatcaagaagctgcgcgacttcacctacatccggaagcgcaaccccgagtccatcaagaacatcatcaaggtgcggatcaaccacctgggcaacatcgtccacgtgggggagtactga

SEQ ID NO: 1867 - RNA, 4056 nt, synthetic construct
  misc_feature 1..4056: note = Cas9 variant
  source 1..4056: mol_type = other RNA
atgagcaagaagtactacctgggcctcgacatcgggaccaactccgtgggctgggccgtcaccgacgagaactacaacctgtgcaagtacgccgggaagcgcatgtggggcatccggctgttcgagggcggggagacggcggagcagcgccggatcagccgctccaaccggcgccggctcagccgcaagaagcagcggatcgacctgctgcaggagctgttcgccgaggagatcgccaagatggaccccaccttcttcatccgcctgaacgagtcccggctgcacctcgaggacaagagcaccggcgagaagttcccgctgttccgcgacaaggactacaccgacatccagtactacaaggagtaccccacgatgtaccacctccggaaggagctcatcgagaactccaaggtgcacgacatccgcctggtgtacctggcctgccaccacatcctcaagaaccgggggcacttcctgatcaacggcagcttctccgacgtcaagaagctgagctccgtgtgcgagagcatgctcaactccttcaacgggatcagcaagtaccagatcgagatcaacgacatcgagcgcctggaggagatcctgtccgaccggaagaagcagaagtccgtgaaggccaaggagctcatccagatcttcgagtgcggcccctgcgaggacaagaccgacgagaagacctgcaaggcgatcgtcagcaacctgtgcaagtggctgaccgggctcaagggcaacatcaacagcatcttcgacatgcagttcgaggagatcgacacgtccagcttcagcttcaccgagcccaagtacgaggacaccatctccgccgccctggaggagaagtacccggactacgccgacgtgatccagaagatcaaggcggtgtacgactggagcgtcctggtggagatcatggccggcgaggactacctctccttcgccaaggtgaacgcctacaacaagcacaaggagaacctgtgcatcctgaaggaggtcatccgcaagtactgcgacagcgagatctaccacaagttcttcaacgggttcgacgagaagaacggctacgggaactacatcggctccatctacaagaacggccacagctacgccatgaagaagtgctccaccgaggacttctacaagacgctcgggaagatcctggacaagatccagcccgagaaggaggacgagaacgtgctggaggagctcaaggtggaggtcaagaaccagaccctgctgcccctcgcgcggaccaccgccaacggcacgatccccaaccaggtgcacatccaggagctgcgcgccatcctggacaacgccaagaagtacctcccgttcctgaacgaggaggacgagtacgggaccgtggccgagaagatcatcagcatcgcgaagttccggatcccctactacgtcggccccctgtccacccgccacaaggagcagggggccaacagctggatcgtgcgcaagcaggagggccggatctacccctggaacttcgaggagatggtggacctcgagcagtccaacaaggagttcatccagcgcatgaccaacaagtgcacgtacctgatcggcgaggacgtcctgccgaagaacagcctcctgtactcccggtacatggtgctgaacgagctcaacaacctgcgcatccgggggaacaagatcagcgtgaagctgaagcaggagctgtacaaggagctgttctgcaccaaggccaaggtcaccggcaagggcctcttcaactacctgaagaaggaggacgaggagctcgccctggaggacatctccgggttcgacatcgacttcaagagctccctgaccagctacctcgacttcaagaagcagatcctgggggaggagatcgagaaggacaagtacaagggcatcgtggagaacatcatcaagtggaagacgatctacgacgacgactccaagatgatgaagaagatgatcgagcgcgagtaccccaacgtcttcagcaaggacaagatcaagaagatctgccggttcaagtacagcggctgggggaacttctccctgagcttcctcaacggcatccgcggggccgaccgggagaccggcgagtccttcaccatcatcgaggcgctgtggaagaccaactacaacctgatgcagctcctgagcaagcagttcacgttccgcgaggagatcgacctgatcaacgccgagaaggtggggaagatcaacaaggtgtcctacgacaacaccgtcaaggacctcatcgtgagccccgccaacaagcgggccatctggcagaccgtgcagatcaccgaggagatcaagaaggtcatgaagtgcgagcccgagcgcatcttcatcgagatggcccggggcggcgagaaggagaagaagcgcacggtgtcccggaaggcgcgcctgctggagctctacgccgcctgcaaggacgacgtgcgggactggaccaaggagatcgaggaccgcgaggagcgggagttcaacagcaagaagctgtacctgtactacacccagatggggcgctgcatgtactccggcgaggagatcaacatcgacgagctcatgcagaagaacagcaagtgggacatcgaccacatctacccgcagtccaagatcaaggacgacagcctggacaacatggtcctggccaagaaggtgatcaacaactccaagcagaacaagctcctgagctccgacatccgcatcaagatgaagaagtactggaacgcgctgtacaaggggaacttcatcagcaagaagaagtacgaccggctcacccgcacggaggacttcaccaacgaggagctgtccggcttcatcgagcggcagatcgtggagacccgccagagcagcaaggccgtcgccgagctgctcaaccggctgtacgagcactccgagatcgtgtacgtgaaggccggcctggtcagcgacttccgccacgacaacaagctcctgaagtcccggcgcatcaacgactaccaccacgccaaggacgcgttcctgaacatcgtggtggggaacgtctacaacgccaagttcaccagcaacccccggaagtggatcaaggagaaccgcggcaccaactactccatccggcgcgtgttcgactacaacgtgaagcgggggaacacggtcgtgtggcagggcgtggaggacgggggccacagcatcgacgagatccgcaagaccatggcccggaacgacatcctctacaccgagtacacctactgcgacaagggcgagctgttcaacgccacgctgatcaagaaggggaacgacaaggccatcaacctcaagaaggcgctggactccgtcaagtacggcgggtacaacagccccaagacctccgccttcgccttcatcgagttcgacggcaagaagaaggagcgcaagaaccacatcgtggagatccccgtgtacatcgtcaacatcgccaagcggcagccggacaccatcaaggagtacctggagcagaagaaggggtacaagaacgtggtggtcaagaagtaccccatcaagaagaacgccctcatcaagatcgacggctacctggcgcgcctgcggggcgccaacgagaccgacatcctcctgaagaacgccgtgcagctgatcctcaacgacaagtactacgagatcatccgccgggtggagaagtacctggagtacaacgtccgctacgaggccgagagcatgttcgaggggttcgaccacgcggacctgaactccctctacgacgagctgacgagcaagctggagacctccatctacaagaagcgccccgccaaccagctcaacgccctggagaagggcaaggagaagttcaagaacatccagaccctgcgggagaaggcccagatcatcaaggagatgctcatcatgtaccgctgcgacgccgcgaccgtggccaacctgaaggccatcgggggcagcgccaacgccgggtccatgaagatcaagaagaacacgctgaccagccggtccctcgtgctggtcaaccagagcatcaccggcctgttcgagaccgaggaggagctcgtgtga

SEQ ID NO: 1868 - RNA, 4056 nt, synthetic construct
  misc_feature 1..4056: note = Cas9 variant
  source 1..4056: mol_type = other RNA
atgtacaagaagtacggcatcgggctggacatcggcaccagctccatcgggtggagcgtggtcgacgagtacggccacatcatccgcgtgaaggggcagaccggcctcggcgtgcggctgttccgcgaggggcagcccgccgccgaccggcgcacgttccggaccacccgccggcgcctgggccggcgccggtggcgcctccggctgctgcgcgagatcttcgacccgtacatcgcggcccaggaccccaacttcttcgcccggcagaaggcctccgccatcgcgcccggggacagccgcttcaaggccgtctaccggctgttcaacgaccagaccgaccgccagttctacgacaagtaccccacggtgtaccacctccggcagaagctgatgaccgagaagcgccagttcgacatccgggagatctacctcgccgtgcaccacatcgtcaagtaccgcggccacttcctgaccgggggcgccgcgaagaacttcaagccgggcaagctggacctcaacacctacttcgccacgatcaacgcccagctggccgccatcttcatggactcccaggtggagctgccccagctcgactgggacgcggtggtcagcctgctgaccaacgaccaggagtcccccagcgaccgccagaaggccctcaccaagatgctggtggcccagggggacgccacccagaagcggttctacacggagttctccaaggccctgctcggcctgaaggcgaagctgtacgtgctcaccgggttcgagggcgacaagaccgaccagaaggccctgaccctgagcctcgagacgctggacgaccaccaggacgacgtcacccagctgctcggcgacgagcagcgccagctggtggagctgctcgcccgggtgcagtccgccatccagctggccatcatcatccccaacgggaagaccttcagcggccagatggtccagcagtaccagacccactacgaccagctgcgcctcctgaaggactaccgggagcagctgacggaccagaagcaccgccgggcgctcaagcaggcctacgccgactacctggccaacgaccaggaccaggacgccctggtgaaggcggtggagaaggtcctcaagcagaaccagccgctgtccaccgtgggggtgcgcctgcagaccgccatcgacgccggcgacttcctccccaagcagcggaccaaggccaacagcgtcatcccccaccagatccaccagcaggagctggaccgcatcatcgaggcgcagtccgtgtactacccctggctggccgaggagaacccggtggccgcccaccggagctacgccccctacaagctcgacgagctggtcgacttccgcgtgccctactacgtcgggcccctggtgcagccgcaggcggacaaggccgccaaggagacgaagttcgcctggatgacccggaaggaggcccagtccaccacccccatcacgccctggaacttcgagcaggaggtggaccgcaacgcgagcgccaacgccttcatccagcggatgaagaccaccgacacctacctgctcggcgaggacgtcctgcccaagaactccctgctctaccagcgcttcgaggtgctgaacgagctgaacaacgtgcgggtcgacggcaagctcctgacgatcgccgagaagcagcgcctgttccaggacctcttcgtggaccggagccaggccagcgtgaccatcgcgcagctgcaggccaacctgatcgcccacggggccgcgaaggaccgcgtcgagatcaagggcctcgccgacccgaagcgcttcctgtccagcctgaccacctaccacgactacgcccagatcatccccgaggccctcgagcagcccgacaagcgggccgacatcgagaagatcatcaactggtccacgatcttcgaggacaccagcatcttcaaggagaagctgcaggagatcgcgtggctgacccccgaccagcgccggcagctctcccagaagcgctaccgggggtggggccagctgagcgacaagctgctcacccagctgcgcgacgccaccgggcagtccgtgatggacctgctctggacggagccgaacaacttcatgcagatcatccggcgcaccgagttccagcaggccatcgcccgggtgaaccagaccgacctgaagcagcaggacctggccaccacgatcaacgacctctacaccagcccccagaacaagaaggcgatccgccaggtcctgctggtggtggccgacatccagaccgccatgcacgaggtcgccccctcctggctgttcatcgaggccgcgcggggccccgagcagaacccgaagcgcaagctggcccggcagcagcagctgctcgaggcctacaagaccagcgccaaggagatcgtgaacgaggcggtgaaggagaagctgctgtccgccatcgacgaccaccagaagttcgaggaccaggtcgtgctctacttccagcagaacggcctggacatgtacacggggaagcccctggacttcgagcgcctcagcaagtaccacatcgaccacatcatcccccagtccgtggtcaaggacgacagcctggacaaccgggtgctgaccaccccggaggagaacgagcgcaagggcgcccgggtgcccgggcccctctacgcctcccagcagggccgctggcggctgctgcagcgcgccgggctcatcagccagcggaagctggaccacctcctcctgcgccccgaggagctggaccagcaggcgaccggcttcgtcgcccgccagctcgtggagacgcgccaggtgatcaagctgatcaccaacatcctgtcccagcagtacgacccggagcagaccaagctcgtcagcgtgaaggccggcctgtcccaccagttccggacccggctgaacctccccaagctgcgcgagctgaacgactaccaccacgcccacgacgcctacctcgcggcccggatcgggacgtacctgctgcagcgctaccccaacctcgagcggttcttcgtgtacggccagtaccagaagacccgcttcgacctgaagcggcacttcaacttcatcggggagatgctgaagggcaagcccgaggacgccgtcatcgtgaaggccccgcacagcgagaccgtgatctgggacaagcaggacgaggtcaagcagctcaagaagatcatggagtaccgccacctcctggtgacccacgaggtgtacgacaaccacggcgccctgttcaaccagacgatccaccccgcgaagaaccccaagaaccggaagctgatcccccgcaagaccacccagagcaccgagctgtacgggggctactccggggagacgaccggctacctcgccatcgcccggaccgtcaccaagaacaagatcagctaccaggtgctgcgcgtgccgacgcggctggtcgggcgcctccagcggtccagcgagtccgcccagcgccagatcctgaccgactggttcgcccccagcttcgtgtcccggggcaagcagcagcccttcgagatcgtgctgcgccacgtcttcaagaaccagaccgtgatcgacgacatccacgagcagagccaccgcttcggcctccggtccgacacctactactgcaaccagcagcagctggtgctgagcctcgagcagcagcgcatgatcatcgaccagaagctgaacaacacgaacaagctgatggtcgtgtacgaggcggtgtgcgaccaggtcgccaagtacttccccctctaccggatgaaccacttcaaggagtccctgctggaggccgggccgaagctcgccgagctgcccatcaacaccgtgcagagcaagaacggcaagctgaagctcgggcagcgctccgtgctgctgcagaccatgcagggcctccacgcgaaccccgagaccaaggacctgagcatcatcgggtgccccaagtacttcggcaagctgcaggtctccagcggcatcaagctgacggagaacgccgtgctcatccacgagtccccgaccgggctgttccagcggcgcgtccggctgagcgacctctga

SEQ ID NO: 1869 - RNA, 4056 nt, synthetic construct
  misc_feature 1..4056: note = Cas9 variant
  source 1..4056: mol_type = other RNA
atgaagatcctgggcctcgacctggggaccaacagcatcggctgggccgtggtcaacgaggccgagaacgagcgcgagtccagctccatcatccggctgggggtgcgcgtgaaccccctcaccgtcgacgagcagaacaacttcgagaagggcaagccgatcacgaccaacgcggaccggaccctgaagcgcagcatgcggcgcaacctgcagcggtacaagctccgccgggccaacctggtgtccctgctcaagacccaggggtggatcacggacgagaccctgctgagcgagcagggcaacaactccaccttcgagacctaccgcctccgggccgaggccgccacgaaggagatcaccctggagcagttcgcgcgcgtgctgctcatgctgaacaagaagcggggctacaagagctcccgcaagatgaagcacgacgaggacgggagcttcgtcaacaacctggacatcgcccgggagctctacgactccggcctgacccccgggcagtacgcctacaacctgctcaaggacggcaagaagtacatccccgacttctaccgcagcgacctgcaggaggagctggacaagatctgggcctaccagtacgagtaccacgagaacatcctcacccactccctgcggagcgcgatcatcgaccagtccaagacggggaccaccaagatcttcctgaagacccacggcatcttcacggccgacatcaagggcaaccgcaacgagcggaacaagcagctgttcgagctccgctgcggggccctggagcgggccctcaccgccgaggagctggcgaccgtgatcgccgaggtgaacggccagatcaacagctccagcgggtacctgggcgccatctccgaccgcagcaaggccctcttcatcaaccaccagaccgtcggccagtacctgatgcagcagctggaccgcgaccccaacaagagcctcaagaaccagccgttctaccggcaggactacctggacgagttcgagcagctgtgggagacgcaggcccactaccaccccgagctcaccgcggccctgaagcacgagatccgcgacatcatcatcttctaccagcggcgcctgaagtcccagaagtggctcgtggccaactgccccttcgagcaccggaaggtgtgccccaagagctccccgctgttccagcacttccgcatctggcaggtcctgaacaacgtgaccgtgaccgtcgacaacaagacgtacgtgctcaacgaggagcagaagtccatcctgagcaaggagctgctctacaaggagaagatcagcaagcgggacgccctgaagatgctgttcgtgaaggccaagggggtcgacatgaacttcgcgtccctggagggcgaccgcaccatgagcaacctcctgaaggccgcccaggagatcgtgtccatcagcgggcacggcgactacgacttcgggaagatgcccgccgacgacatccacaacatcatccggtccgtgttcggcggcctggggttcgccaccgactggctcaacctggacaccgacgcggacgacctggagcaggagagccagatgcgcctctggcacctgatctactccttcgagggcgacaacagcacgaccggggacaccaagctggtcgagcggctcatgtccctgctgaacctcccccaggagtacgcccgcctgttcgccaacgtgcacctggaggacgactactgcggcatcagctccaaggccctcaagcggatcctgcccttcatgaaggcggggcacatctacagcgaggcctgcgccctggccggctacaagcactccgagcagagcctcacccgcgaggagaacaagaaccggccgctgaaggaccacctggagcagctccccaagaacagcctgcgcaaccccgtggtcgagaagatcctgaaccagatggtgaacgtcgtgaactccatcatcgacacgtacggccggcccgacgagatccgcatcgagctcgcccgggagctgaagaacaacgcgctggggcgccaggccatcttcgaggccatcaaccgcaacaccaaggagagcgagcggatccagcagatcctcaagaaggagttcggcctgacccacgtgtcccgcaacgacatcatccggtaccgcctgtaccaggagctcagcgggaacggctacaagaccctgtactccaacatctacatcccgcaggagaagctgttcagcaaggagatcgacatcgagcacatcatcccccaggcccgcctcttcgacgactccttcagcaacaagacgctggagtaccgggacgtcaacatcaagaagtccaacaccaccgccatcgacttcgtgcggaacgagtacggggagaacgaggtggagcagtacaagaagcgcgtcaacgacctgctcaagagcggcgcgatctcccaggccaaggccaagaagctgaagatgaccgaggccgagatccccaacgacttcatcgagcgggacctgcgcaacacccagtacatcagccggaaggcccaggagatgctccgcgacgtggcgcgggtggtcacggccaccaccggctccgtgaccgaccgcctgcggcaggactggcagctggtggacgtcatgcaggagctcaactgggacaagtacgagcgccaggggctgacgaccgtgatcaacggccgggacgggcagcagatccgccggatcaccgactggaccaagcgcaacgaccaccggcaccacgccatggacgccctgacgatcgcgttcaccaagcccgcctacatcagctacctcaaccacctgaacgcccgctccgaggacgacatccgcagcatcgagcggcgcttcctggagcgggacgccaacggccacctccgcttcatctccccgatcgcccacaacttccggagcgaggcgaagcgccacctggagatgatcctggtgagcatcaaggccaagaacaaggtcgtgacccggaacaacaacaccacgaagaccaagggcgggcgccggaaccgcatccagctcacgccccggggccagctgcacgacgccaccgtgtacgggtccatcctgctcccccacaccaagaccatcgccgtcgacggcaagatgaccgccgagatcatcggccaggtgcagaaccccgtgttccgccaggcgctgagccagcggctggaggcctgcgggaacgacccgaagaaggccttcaccggcaagaactccctcgagaaggcccccgtctggatcgaccaggcccacacggagcacgtgcccgcggaggtgaccatccagcgcctggagccccagcacaccatccggcgcgccgtcaacaaggacctgaacatcaacaaggtgctcgacaaggggatccagcacatcctgcaggcccggctggacgcctacggcggggacgcggccaaggccttcgccaacctcgacaacaacccgatctggctgaaccaggagaagggcatcgccatcaagcgcgtgaccacggcggagaacatcagcggggagcccctgcaccacaagcacgacaaggagggccggcccatcctcgacaccaacggcaagccgatgccctccgacttcgtccgcctgatgaacaaccaccacgtggccatcttccaggacgccgacgggaacctgcaggagcacatcgtgagcttctacgaggccgtcgcccgcgtgaccgagctcggcctgcccgtgatcgacaaggagtacaacaaggacaaggggtggcagttcctgttcaccctcaagcagaacgagtacttcgtcttccccaacccggcgcagggcttcaaccccgacgagatcgacctgacggacgagcggaactactcccgcatcagccccaacctgtaccgggtgcagaagatgtccagcaagtactacgtgttccgccaccacctcgagaccaccgtcgaggacaagaaggagctgcaggggatcacctggaagcggatccagtccctgaacaacctcaagggcatcgtgaaggtgcgcatcgaccacatcggccggatcgtccagatcggggagtactga

SEQ ID NO: 1870 - RNA, 4056 nt, synthetic construct
  misc_feature 1..4056: note = Cas9 variant
  source 1..4056: mol_type = other RNA
atgttcagccagcagaacaacctgtactgcgagtccctcagcaagctgtactacaacatcaccaagaacttcctgtccaagaacgaggtgtgccgcatctacgagatcttcttctgcagcatcctcacctacttcctgaagaagtacaaccacgacatcttcaagaagtccagcacgatgaagaccatcctgggcctcgacctgggggtcacctccatcggctgggccgtgatcgtgaccgacgacgacaacacgcccatcaagatcctggggatgggcagccggatcatcccgctctccaccgccgacaaggaggagttccagaaggggcaggcgatcagcaagaaccagtcccgcaccatcgcccggacccagcgcaagggctacaaccggaagcagctgcgcaaggaggagctgaagaagatcctcggcgagctggggatcacgcccagcaaggagctgctcaacctgccctccatcgagctgtggaagctccgggccgacgccgccagcggcaacgcgcccctgtccgccgagcagctggggcgcatcttctacatgctcaaccagaagcggggctacaagagcgcccgctccgaggccaaccaggacaagaaggacaccgactacgtcgcggccgtgaaggggcggcaccagcagctgaaggagaagggccagaccatcggccagcacttctacaccgagatgctgacgctcgaggagaacagcgggcacttccaggtgaagaacaacgtctacccgcgcgaggcctacctggaggagttcaacgccatcatcgccgcgcagaagccccagcacgccttcctgaccgacgacgtggtggaccggctccgcgacgaggtcatcttctaccagcggaagctgaagtcccagaagggcctggtgagcatctgcgagttcgaggggttcgagcgcaccttcttcgacaacgtgaagcagaaggacaagaccatcttcacgggccccaaggtcgcccccaagagctccccgctgttccagctgtgcaagatctgggagaccgtgaacaacatcaacctgaaggtgaagaacaccgacggcagcaagaacaagtgggccgactacgtccccaccctcgagcagaagcaggagatcatcgagcacctgttcaagaacgccgggatctccctggacgcgctccggaagatcctgggcttcaacaaggacgagatcttcgtgaacaagcagatcgagaaggggctgcagggcaacacgacctacgccgagatccacaagatcctcggggacagcaagcccgagctgctgggcttcaacatcaacatcgagccctccaagcacagcgccctcctggtggacaagcgcaccggcgagatcctggccgagaaggaggggcagcaggtctccgccgagatcgagaaggagaacttctaccagctctggcacaccatctacagcatcaaggacctggacgagtgcgcggccgccctgatcaagcggttcaacatcgacccgaacgtggccgcccagctcgcgaagatcgacttctccaagggcgccttcgggaacaagagcaacaaggccatgcgcaagatcctgccctacctgatgcagggctacaactacgccgacgcgtgctccctggccgggtacaaccacagcgactcccagacgaagaaggagaaggaggagaacgtggtcgacgacaagctcaagctgctggagaagaacagcctccggcagcccgtggtggagaagatcatcaaccagatgatccacgtcgtgaacgccatcatcgacaagtacggcaagcccgacgagatccgcgtcgagctggcccgcgacctgaagaagtccaaggacgagcggaacgaggccgagctccagaacgcgagcaacaagaagctgaacgaggaggtggccaaccgcctgaaggagctcggcctgccggtgaccaagcggttcgtccagaagtacaagttcatcttccccgtgcgcgaccggaagatcaaggaggcccagctggtgaaccagtgcatctactgcggggagaccttcaacgtcaccgaggccctctccggcgacaacttcgacgtggaccacatcatccccaagagcatgctgttcgacgactcccagacgaacaaggtgctggtccaccgcaagtgcaacgccaaggacaagagcaacaagaccgcgtacgacttcatcgccgccaagggggagaacgagctcgccatctacctggaccgggtggacgactggttcaagcgcggcgtgctgagctacgggaagatgcagcggctcaaggtctcctacgagcagtacgccgagcgcaagcagctgaagaaggagaccgaggcggacatcaagctgtgggagaacttcatcgagcgggacctccgccagacccagtacatcgccaagaagtccaaggacctgctgaagaagatctgcaacaacgtgacggtgaccgagggcaagatcaccgcccagctccggaacctgtggggctgggacgacgtcctgatgaacctccagctgcccaagtacaaggccctggggcagaccgagatcaaggagtggacgagcgagcacggccgccggctccacaagaaggaggagatcaccaactggaccaagcgcgacgaccaccggcaccacgcgatcgacgccctggtggtggcctgcaccaagcaggggttcatccagcgcatcaacaccctgaacagctccgacacgaaggacgccatggaccgggagatcaaggccgcgaaggagaagtacaacgagctctacgacaagaagctgctgaccgagaccaacgagcaggtcaagaaccacaccgagcgcttcaacaagctcgagacgtacctcaagagccagcagccgcccctgttcaccacccgctacgtggagcaggaggccgacaagatcttcgtgtccttcaaggccggcaagaaggccgccacctacggcatccggaagatcaagaaggacgggaagaaggtcgtggtgcaggagaagatcgtcgtgccccgcggcgcgctccacgagcagagcgtgtacgggaagatcaagacgcaggagaaggacaagcccctgaagtacctgttcgagaacccggagaccatcgtcgacaaccggatcaagatcctcgtgaaggagcgcctggacaagttcgagggcgacgtgaagaaggccctgacctccctcaagaaggagcccctgttcatcgacaacgagaagaacaccctgctcgagaaggccgcctgctacacggacgccaccgtcctgaagtacaagctgcaggcgctcaaggccaaccaggtgaacgacatcgtggacgagggggtcaagcggatcgtgaaggcccgcctggcccagcacaagaacgagaaggaggcgttcaaggacaccgtgtggttcaaccaggagaagcggatccccatcgtcagcgtgcgcgtgttcgcccggcccgacgcctccaagctggccatcatcaagaccgacgagaacaacaagccgatcggcttcgccctcacgggcaacaaccaccacatcgcgatctacaaggacaacaccgggaagctggtccagcacatctgcaccttctggagcgccgtggagcgcaagaagttcggcgtgcccaccgtcgtgaagaacacggggaccctgtggtccgagctcctgcacaaggacctgcccggcaccttcctcgacaagctgccgcaggacgggctggagctcgagtacagcctgcagcagaacgagatgttcgtgctgggcctccccaaggagtccttcgaggacgccatcaagaacaacgacctgcccctgctcagcaagcacctgtacctggtctggtccatcagcgacaacgactactggttccggcaccacctcgagaccaagaacagcgagctgaagtccacgaccggcgccaaggagagcaagcgctactaccggttccagtccgtggggaccttcaccaaggagaaccccatcaaggtgcagctgaaccacctcggcgagatcacgaagatcggggagccgtga

SEQ ID NO: 1871 - RNA, 4059 nt, synthetic construct
  misc_feature 1..4059: note = Cas9 variant
  source 1..4059: mol_type = other RNA
atgaagaagcgcaaccgggaggagtactacgtgggcctggacatcgggaccagctccgtcggctgggccgtggccacccccgactaccgcatcccgaagttccgggggcacaagatgtggggcagccgcctcttcgcggaggggaagcgggccgccgagcgccggcagttccgcacgaaccggcgccggctggcccgccggcgcgaccggctgcagatcctcgaggagctgttcgccgaggagatggcgaaggtggacaacaccttcttcatgcgcctgaaggagtccaagttcttcctcgaggacaagaccgtcaaggagaagcacatcctgttcagcaccgacaagttcgacgccgaccggttctacaaggacaaccccacgatctaccacgtgcgcaagcggctgatggaggaggagccccaggacatccgcgagctgttcctcgccgtgcaccacatcctgaagtaccggggccacttcctcttcgccggctccctggagcagaacggggcgagcatcgaggagctggtccgcaccctcctgggcaagcaggggctggccatcctcgacgacaccatcgactccaacgagatggtgaacatcctgaagaacaccggcgagaccaagagcgaccgcaagaaggacgtgcaggagctgtggaaccccctcaaggacaaggtcaagaaggcccaggccgccgagatggcggggctggtgctgggcctcaagtccgacatcagcaagctgttcgccaactccgactacaaggacctggacagctccatcaagaacatcaacttcagctccggcgactacgaggagaagcgggacgactacgccaacagcatcggggacgacatcgtgctcctggacaccatgaaggccctgtacgacaccctcatcctgtcccagatcctgcagggcaagcgcagcatctccgccgcgaaggtcgaggactacaacacccacaaggagcagctccgggccctgaaggccatcctgaagccgcacaagcgcctctacaacgagatgttccgggagaacaacaagaaggacctgagcaactacgtggcctacatcagctcctacagcgaggggaagcgcgtgaaccgggagggcttctacaagtacgtccaggccgtgctgaagcaggtcgacgactccgacagcaagcaggcgatcctcgaggccatccgcctggagacgttcctgcccctcctgcgggtgaaggacaacgccgtgatcccccaccagatccaccaggccgagctggaggccatcctcgagaccgcgcgcaagaagtacaacttcctgaacgacgtgtccgacggcgtcagcgtgaaggacaagatcatccagctgttcaccttccggatcccctactacgtggggccgctcaacccccactccggcgagaccgtcgccgaccgcaagcaggggacgggctgggtggtccggaagcagcgcgggaaggtgtacccctggaacttcgccgacatggtggacgtcaaggccagcgcggaggccttcatcaccaacctgaccaacaagtgcacctacctgatcggcgaggacgtgctgcccaagcggtccctcctgtacagcgagttcatgctgctcaacgagctgaacatgatcaagtacgacggccacgagctgccggtggccatcaagcagctctacatcgagcaggtcttcaagcaggagcacaagaagcagacgaaggggcgcgtgctggacttcctgaagcggaacggcctcatcaccgggtccgccaccgccgtgatcaccggcatggacgacgcgatcaagggggacctgcagagctaccgcgacatggtccggatcttcggcgccggcttcgaccactccatggccgagcgcatcatccgctgggtgacgctgttcggggaggccaaggacatcctcgagaacaagatccgggaggtgtacggcaacagcatctccgacagccagatgcgcgccatcaagaagctgaagtacgcggactgggggcggctgtcccaggccttcctcatcgccgtcaagggctgcgacaagagcggggtggagcgcaacatcatcacgtgcctgcgggcctccagccagaacctgatggagatcctcagcgaccagggcacctacatcaagcagatcaaggcctggaaccaccagcacaccacgaacatgatggacaccctggactaccagctggtggacgacctctacgtcgcgccctccgtgaagcgcagcatctggcagtccctgtgcatcgtggaggagctggtcaagatcatgggccaggcccccaagaagatcttcgtggaggtgacccggaccaagcaggccgagaagacgaagaaggacagccgcaagaagcggctcgtcgagctgtacaccgccatcgggaaggagggcgcggcctggaagaaggagatcgaggcccaccaggccggggacttccgccggaagaagctgtacctctactacacccagatgggccgctgcatgtactccaacgagcccatcgccatggacgcgctgttcaccagcgcctacgacatcgaccacatctacccgcagtccctgacgaaggacggcagctgggacaacctcgtgctggtgaagtcccagctgaacaaggagaagtccgaccagtaccccctccggcccgccatccgcgagaagaacaaggcccactggcagtacctgtgccgggccgggttcatcagcgagaagaagtacgagcgcctgatgcggaccaccgagctcaccgcggaggagctgagcggcttcatcgcccgccagctggtcgagacctcccaggccacgaaggccgtgaccgggctcctggagcggatctacaccaacaccgagatctgcttcgtgaaggccgagacggtcagccagttccgccaccagcacaacttcatcaagatccgggagctgaacaactaccaccacgcgaaggacgcctacctcaacatcgtggtgggcaacgtctaccacgagaagttcaccaagaacccctgggagttcatcgcccgctccaccgagcgccggccgtacaacctgaaccgcatgtacgacttcgacctgctcaagcaggggcgggtgatctggcaggtccccaagagcctggagaccgtgcaggccatgatgaagtccaacgacgtgcgcatcacgaagaagctgctcgtgcagaagggcgagctgtacgacgcgaccatcaccaaggcccacaaggccaaggagggcacctacttccccctgaagggggccgacgcccggctccgcgacgtccaccggtacggcgggtacgagaagatcaagatcgcgtactacagcgtgttcagctgccgcgagaaggcctccaacacgatccacaccctgatcatccccatcccggtgtacaaggccggcctgctccagaccgaggccgacctgaccgcctacgcgtggcagacgaagcagaagaccaagcccatcaaggacatctacagcgccatcacccccatctacaagaagctgtgcatcaacaccgtcgtgaagatcgacgggttcaagtacttcctcggcggcaagacgggggactacatgtggctggaccccgccatcccggtggtcctggacgagcaggccgccgcgtacctcaaggccatctccaaggtgggccgggccgacgacgtggagaacaccgcccaggccatcgacctgatcaccgcggaggccaacgaggccttctacgacgtcctgctcaagaagatggaggccaagatcttcgcgaaggcctaccagaccatcgtggagaagctggccagcgagacggcccgcgagcggttccgcgagctgtccatcggggcccagtgcagctgcctcctggagatcctgaacctcctggcgaacaacaagaccaccttcaccttcttcaaggacaagatgggcgtgacgatgtcccggcgcaagcagcccatggacctgaccaagctcgaggagtgcatcgtctacgagaccagcatcaccgggctgtacgagaaggccgtgtccctgctctga

SEQ ID NO: 1872 - RNA, 4059 nt, synthetic construct
  misc_feature 1..4059: note = Cas9 variant
  source 1..4059: mol_type = other RNA
atgggcaagcgctaccacatcgggctggacatcggcaccagctccatcgggtgggccgtgatggacgacgacttcaagatcatgcgggtcaagggcaagaaggggatcggcgtgcgcctcttcgaggagggcaagaccgccgcggagcggcgcgggcaccggacgacccgccggcgctacagccggcgcaagtggcggctgaacctgctcgaggagatcttcgaccccgagatcgccaaggtggacccgaccttcttcgcccgcctgaaggagtccaacctgagccccaaggacgaccggaagcagtactccggcaacctcatcttccccgagaaggccaaggaggagatccgcgagtggaccgagaagtaccccacgatctaccacctccggaacgccctgatgaccgagaaccgccagttcgacatccgggaggtcttcctcgcgctgcaccacatcgtgaagtaccgcgggaacttcctgttcaacggcaacttccagaccggggaggtgaacctcagcgaccggttcgacgacatcaactccgccttcatcagcgcctgcggcgaggaggaggccccgcagatcccctccgagctgtacaacgacatccaggagctgctgttcgacaagaacacccgcaagctggacaaccagaagcagctggcgacgaagctcagccaggacaacgacaaggactggtccacccagttcagcaaggccctgttcggctacaagaccaagttcaaggtcgtgctgcagtccaacgaggacctcgacgacttccagctggacagcgacgacgccgacgacaagatcgcctccatcagcgagcagatcgacgacgaccgggggtccatcctggacaacatcaagatcctctacagccgcatcaccctgaacgagatcgtgcccgacggcaagacgctgtcccagagcatgatcgagaagtacaacctccaccgcgaccacctgaaggagatcaaggaccagctgaagcacaccgacaactgggtcaagttcgacgacctctacagccagtacgtgaacgggaagctggagtccgaccggcacaagaagctgagctccgacgacttctacaagaaggtgctcaccctgttcgacggcgagctgaagacccgcgtcaaggagtggcaggagaagggcgagttcctccccaagcagcggacggggagcaacggcgtgatcccgcaccagctgcaccagaacgagctggaccagatcatcgagaaccagtccaagtactacccctggctcgccaccctgaaccccaacgagaagcgccagcgggtggcgaagtacaagctgagcgagctcgtcgccttccgcatcccctactacgtggggccgatggtgaccaaggaccagtccgacttcgcctggatggtccggaagtccgacgagaaggagatcaccccctggaacttcgaccaggtggtggaccgcgacaagtccgccgaggagttcatcaaccggatgacgaccaaggacacctacctgatcggcgaggacgtcctgcccgccaagagcctcctgtacgagaagttcaccgtgctgaacgagctcaacaacatccgcatcaacgggaagcccctgacgaccgacgagaagcaccaggtgtaccgggacctgttccagaacgcgaagtccatcagcaccaagaagttccacaactacctggtctgcaagctcaacaagccgaaccacctgaacatcaccggcttctccgacctgacgaagttcaacagctccctcgacagctacatcgacctgaagaagatcttcgccgaccagatcgacgaccagtccctgcaggacgacttcgagaagatgatccgctggagcaccgtgttcgaggacaagcagatcttcgagcggaagctctccgagatcaactggctgaccgaccaggagcgcagcgaggtcgccaagctgcggtaccgcggctgggggcggctcagcaagcgcctgctggccggcatccacgacgagaacgggcagcggatcatcgacgccctctggaactcccccaagaacttcatgcagatccaggcggaggtggccttcaacaagcagatcaacgacctgaacaccaaggagctgagcgacaacaacgtggaggacgtcctcgccgacgcctacacgagcccccagaacaagaaggccatccgccaggtgctgctggtggtcgaggacatccagaaggcgatgcacggcgacgcccccaccagcatctccctcgagttcgcccgcgaggagcaggagagctcccggacccgcagccggcgcgccgcgctgtccgccacctaccggcagatcagcgacgagatcgtgtccgccacggtgaagggggagctgggcaaggccaccagcatctccgaccgcctctacctgtacttcacccagggcgggcgggacatgtacaccggcgagccgatcaacatcgacgagatcagccgcgggtacgagatcgaccacatcctgccccagtccttcatcaaggacgacagcctcgacaaccgggtcctggtgaagggcgccatcaacaacgggaagtccgcgaactacgtgatggaccagagctgggcccccgaccgcctggcctggtggaagaagctcctggacaaccggctgatcagccgcaagaagtaccagtccctcaccctgacgcccggcaagatcaacaagtacagccagaacggcttcatcaaccggcagctggtcgagacccgccaggtgatcaagctcgtggccaacatcctgaacgaccagtactccaacgacgacaccaagatcatcgtcgtgaaggccgcgctgaacagccagctccgggggttcctggagctgttcaagaaccgcaacatcaacgactaccaccacggcatggacgcctacctctccaccttcatcgggaactacctgtacaagaagtacccgaagctgcggagctacttcgtgtacggcgagttcaagaagttctccggcaagcagaacctcaagagcttcaacttcctgcacgacctggaggacgactccatcaacatcatcagcaacgacgacggggagatcgtcggcaaccaccacgagatgatcgaggagctcgagaaggcctaccagtacaagtacatgctggtgtcccgcgaggtgttcgagaagacgggggacctgttcaacgtcaccgtgtacagccggaaggccaagaagaccctcatccccatcaagcaggacaagcccatcaacatctacggcgggtactccggcaacaacgacgcctacatggcgatcgtgaagctgcccggcaagaaggggaagccggacacctacaagatcgtcggcatccccctgcgcttcgccggggagctcgagcgggccaagcagctgggcgagagcgcctaccgcgagaagctgtccgcggtgatcacgccccagttcaccaaggagaagaaggaccgcaagaccggggagatcaccaaggtggtcgacgacttcgaggtggtgctcgaccgggtcccgtaccgccagctgttcaaggacagcgacaagtggttcatgctgggctccgccgcctaccagtacaacgccaagcagctcgtgctgaacaacgacgacgtgaagctgctcaacgagcagggccggaagaagctggagctgcccaacgagaagctcagctccgccctgaacgacgtcttcgaccacatcatccagatcatgaacagcaagttcgggctgtacgacaagaacggcttccgcacgaagctcaccgaggcggccagcatcttctacgacctgcccctgcgggccgagtacaacgggaacaagaaggtgaccgacggcaagctcgaggtgctggacaacatcctgatcgggctccacgccgacccctccttcggcaacctgaagcagctgaacatgagcaccccgttcggccagatgcagacgaagggcggggtcgtgctcaacgggaactccaccctgatctaccagagccccaccggcctgttcgagcgccgggtgaagctcaaggacctgtccaagtga

SEQ ID NO: 1873 - RNA, 4059 nt, synthetic construct
  misc_feature 1..4059: note = Cas9 variant
  source 1..4059: mol_type = other RNA
atgaagaagatcctgggcctcgacctggggaccaccagcatcggctgggccttcatcaacgagggggagaacgacaacgagacgtccagcatcatcaacgccggcgtgcgcatcgtccccctgaccaccgacgaggaggcggacttcaagaaggggaacaccatctccatcaacgccgaccggacgctcaagcgcggcgcccggcgcggcctgcagcggttcaagcagcgccgggacgccctgctccagagcttccgcgggatcaacttcatctccagcaactacgtgtacgccgagaccggcaagcagaccaccttctccagctacaagctgcgggcgaagtccgccacggagctggtgaccaaggaggagctcgtccaggtgctgctgatgctcaacaagaagcgcgggtacaagagctcccggaaggccaagaccgccgaggagggcgacgcgatcgacgggatgaagatcgccaaggagatcttcgagaacaacctgaccccgggccagtgggtgtacaacagcctgtccatcggcgggaagttcatccccgacttctaccgcagcgacctccagaaggaggtcgagaagatcgtgcggttccagaaccagttccaccccgagcagatgaacgagaagctgctggagaacatccagggcaaggcccgcacggtgacctcccagtacttcagccggatcctcaacatccccctggccgagaacaaggggacccgcgaggagaccaagctgcagcactacaagtggcggaacgaggccctcacggaggagctggacctgaaggtcctcgcgttcatcatcaccgagatcaacaaccagatcaaccagtccaacggctacctgggcgccatcagcgaccgctccaaggagctgtacttcaaccaggagaccgtggggcagttccagtacaaccagctcaaggagaacgcccacaccaagctgaagaaccaggtgttctaccggcaggactacctggacgagttcgagaagatctgggagacgcagagcaagttctacccggagctcaacgacgagctcaagagcgaggtccgcgacatcaccatcttctaccagcggaagctgaagtcccagaagcacctcgtgagcttctgcgagttcgagaagggccacaaggccatccccaagtccagccccctgttccaggagttccgcatctggcagaacatcaacaacatcgtggtcaagaacgagaccaccaaggagcccttcctgctcggggaggacctgaagaaggtgatcgcccaggagctgtccttcaaggagagcatgacggactcccagctcctgaccttctgcgacctgaagaagggcacccacaccgtgaacttcaagaagatcgaggggaaccgcacgaacaccagcctcttcaaggcgttcgagaagatcctggtcctggagggctacgacgagctcgacctgtccaagctggacgccagcgacatcaagtccatcatcaagagcgccttctccgacctcgagatcagcaccgccatcctggacttcgacccgaccatccagggcaacgactacgacaagcagtcctactaccagctgtggcacctcctgtacagctccgaggaggacgacttcctgaagaagtccctgatggacaagttcgggttcaaggagagccacctccccttcctgctgaacatcaacctccaggccgactacggcagcctgagcgcgaaggccatcaagaaggtgctgccccacctcatggacgggcacatctacgacaaggcctgcacgctggtgggctacaaccactccagctccctgaccaccgaccagaacaacgagcgggtcctcaaggacaccctggagctgctcaagaagaacagcctgcgcaaccccgtggtggagaagatcctgaaccagatgatcaacgtcatcaacgccatcatcaaggacccggccatggggaagcccgacgagatccgggtggagctcgcgcgcgagctgaagaacaacaacgagcagcggtccgagatgacgaaggccatcaacaagagcaccaccgagcacgagcagatccgcaagctgctccacaccgagttcggcatccaccgggtcacccgcaacgacatcatccggtacaagctgtggaaggagtgcgacggcatctccctgtacacggggaagcccatcgagcccagcaagctgttcaccaaggactacgacatcgagcacatcatcccgaagtcccgcctgttcgacgacagcttctccaacaagaccatctgcgagcggcagctgaacatcgacaagagcaacaagaccgcctactccttcttccaggagaagctcagcgccgaggagttcgaccagttcgagaagcgcgtgaagtccctgttcggcaagatcagccggacgaagcagaacaagctgctcatggcgaacaacgagatccccgaggggttcatcgaccgccagctgcgggagacccagtacatcgccaagaaggccaaggagatcctgctcgaggtgtcccgcaacgtcaccgccaccatcggcagcgtgacggacaagctgcgggacgactgggagctggtggacgtcatgaaggagctcaactgggagaagtacgacaagctggggctgacctacatcgaggagggcaagaacggcgagcgcctctacaagatcaaggactggaccaagcggaacgaccaccgccaccacgccatggacgcgatcaccgtggccttcacgaagcccgcctacatccagtacctgaacaacctgaacgcccgcaccaacaccgacaagaaggggaacagcatcatcggcatcgagaacaagtacctcaagcgggacaagaacaacaagctgcgcttcatcgagcccatcccgaacttccgggaggtggccaagaagcagctggagtccatcctcatcagctacaaggcgaagaacaaggtcgtgaccaagaacaagaacgtgacgaagaagtccaacgggaccaaccagaagatccagctgacgccccgcggccagctgcacaaggagaccgtctacggcaagctccagcagtacgtgaccaaggaggagaagatcaacgccaacttcacccccgagtacgtgaccaaggtcgccaagaaggagtaccgggaggccctgctgaagcgcctcatcgagaacgagaacgaccccaagaaggccttcaccgggaagaacgcgctgagcaagaacccgatctacatctccctggagaacaacatcctcgtgcccgagaaggtgaagatcgtctggctcaagagcgactacacgatccggaaggacatcacccccgacctgaagatcgacaaggtgatcgacatcggcctgaagaccatcctgcagaaccgcctgaacgagttcaacggggacaccaagaaggccttcgtgaacctcgacgagaaccccatctggcagaacaaggagaagggcatcgccatcaagcgggtcacgatctccggggtgagcaacgcccaggcgctgcacaccaagaaggaccacctgggcaacgagatcctcgacgagaacggccagccgctgcccgtggacttcgtctccaccgggaacaaccaccacgtggccatctaccgcgacgagaagggcaacctgcaggaggaggtggtcagcttcttcgaggccgtgacccggaacaacctcgggctgtccatcatcaacaagaaccacgagaagggctgggagttcctgttcagcatgaagcagaacgagttcttcatcttccccacggacgggttcaacccgcacgagatcgacctcctgaacaccgagaactaccacctgatctcccgcaacatgttccgggtgcagaagatcgccaccaagaactacatgttcaaccaccacctcgagaccaagagcgtcgacggcgagatgctgaagacgaagaagcagctgtccaagatcagctaccacttcatccagaccccctcctacctcaactacatcatcaagatccgcatcaaccacctgggccagatcgtgcagctgggggagtactga

SEQ ID NO: 1874 - RNA, 4059 nt, synthetic construct
  misc_feature 1..4059: note = Cas9 variant
  source 1..4059: mol_type = other RNA
atgaagcaggactactacatcggcctggacatggggaccgagagcgtgggctgggccgtcaccgacgtggactacaacctcatcaagaagcgcgggcaggactactggggcgtgtacctgttcgacgaggcccagacggcgcaggggcggcgcgccttccggaccaaccgccggcgcctggcccgggtccgccaccggctcaacctgctgcaggagctgttcgactccgagatcagcgccaaggacttcggcttcttctaccgcctggagaactccaagtacttcgacgaggacaagcccgagatcgcccggggcaagttcctcctcttcaacgacaaggacttcggggacaaggagtactacaagaactacccgaccatcttccacctccgcaacgcgctgcggacccaggagatcaaggacgtgcgcctcctgtacctggccgtgcaccacatcctcaagaaccggggccacttcctgttcggggagcaggacttcaacgtcaacgacgccagcgacgtgtccggcgagttcgagaagatcaaccgcttcctgagcgagaacgacggggccggcttcgaccgggagaagatccccgagatcttcgagacgctctgcaacgagaacctggcgaagcgcgagcggaaggagaagatcctggagctcgccggcaactccaagaacaagctgctgggggaggccgtgaacgccgtcgtgggcctcaacttcagcctgtccaagatgttcggggaggaccgcgacttccagggcgagaacaagatgagcttcaccgactccagcttcgaggagaagctggccaaggcgcggatggccctcgacgacgacgaggccgacttcctggagaccctgaagaaggtgcagtccgtcgccagcctccacaacatcctgcacggcaaggagttcatctccgaggccaagaccgaggcgtacgagacgcaccgccgcgacctgagcgagctcaagaagtacgtgcgggagaactgccccgagaagtacgccctggtgttccgccggcaggtcaagaaggggaagaagaacacctccggcgccgacgagaacgagaaggacgacaagaaggtgaacaactacgccgcctacatcgggatggacaagggcaaggggttcgagaagtgcaagaaggaggacttctacgcgttcctgaagaaggagatcggcatcaacgacgagagcctcctggccaagatcgacgagggcatcttcctgcccaagcagatctccgccgagaactgcgacatcccgtaccaggtgcacctcgccgagctgaaggccatcctggcgaacgccgagaactacttccccttcctcaagcagaaggacgagaactgcgagatgaccgtcagcgagaagatcatcagcctgatgaagttccgcgtgccctactacgtggggcccttcaccgacaaggagacgcggttctcctggatgatcaagaaggagggcctgagcacccagaagatcaccccgtggaacttcgacgacgtcgtggaccgcgacgcctccgagaagaagttcatcgagcggatgaccaacttctgcacgtacctcaccggggagaaggtgctgcccgccagctccttcctgtacagcgagtacgcgttcctcaacgagctgaacaacctgaaggtcaacggcaccaaggacctgcgcgtgaagaacatcctcttcgacttcgccaagaccaacaagaagctgacgctgaagaagtgctgcgagcagctcgtcaagaacgggctgctgcccgagggctccaaggcccgggacgtgttcagcggcaccgacggggacttcaagaactccctcagctcctacatcgacttcaagcgcatcatcggcgacaaggccgacctgtaccgggacatgtgcgagaagatcatcctgtggatcaccgtgatcagcgacaaggagcgcctcgtcaagatcatcaaggacaagtacgggaccgtgctgtccgacgaggagatcaagggcctgaaggccctcaactacacgaagtgggggcggctgagcgagaagctgctcgacggcatcttcgagaccgactccgagggcgaggtggggaacgtcagcatcatcgagaagatgcgcaccgacaccgagaacttcatggagctgctgtccaacaagcacaactacaagcgggcgatcgagctcgccaacagcgagtccatcgtggacgagcgcgtgacgtaccgggccgtcgaggagctgtactgcagccccgccgtgaagcgcagcatctggtccgccctgaagatcgtgcgggagatcgtcaaggtgcagggccacagcccgaagaagatcttcgtggagaccacccgcgagaagcccgacgtcacccgcaaggggcagcggacggtgtcccgcaagcagcagctcctggacaagtaccgggagaacctgcgcaacgagaccgagctcatcaagaagatcgaggagaccgaggacagcaagttcaactccgacaagctgttcttctacttcacccagatgggcaaggacgcgtacacgggcgagaagatcgagttcgacgacgtgttcaagaccgagaagtacgacatcgaccacatctacccccggagcaagatcaaggacgactccctggacaaccgcgtcctcgtgcggcgcaagatcaaccagagcgtgaagaaggactcctaccccctgagcgccgagatccggaaccgcatggaggggctgtggcggcagctccgcgacaagaagctgatctccgacgagaagttctaccggctgacccgcagcaccccgctcaccgagaaggagtgcggcgacttcatcaacgcccagctgatcgccacgtcccagagcgccaaggcggccatccagctgctcaagcggatgctgcccgagtccgagatcgtctacagcaaggccgggaacgtgaacgagttcaagaagcgcctggagttcgtgaagatccgggagctcaacgacctgcaccacgccaaggacgcgtacttcaacatcgtcgtgggcaacgtgttcaacaccaagttcaaccacaaccccgccgtcttccagcgctccaacgggaccggcaactacgacttcgagcggctgtacgacttcgacatcaccaacgcctggaagaagggcgacgagaaccgcatccggagcgtggccgagaagaacacgtgccgcgtggtccgcttcagcaagaccgagaaggggcagttctacgacgccaccatctaccccgcgggcaagaacgacaagctcgccccggtgaaggggaaggcgcccctgaacgacacctccaagtacggcgggtacgacaaggagacgaccgcctacttcatgctggtcaagagccgggacaagaagaagaaggacaagaccctcctgtccctggagtgcgtgaccgtgctcgccgacaagaacttccgcacggccgaggacaagctgaagtactgcgagaaggagctgggcctcaaggagcccgagatcctgatcgagaagatcaagctgaacaccctcttcaagatcaacggcagctacgcctggatccgggggcgcaccaacgaccggctggtgctgtgcaacgccaaccagctctggctggacaacggctccgccaaggagctgaagaagatcagcaaccacttccgcgacgtcaagaagtacaacaacaaggacctccccgtgcgggaggaggagttctccaaggagcagaacctggccctgtacgacctcttcaccgagaagctcgggggcaagatctacgcggggctgccggtgcagggccagatcaagaacctggagaagggccgcgacaagttcgaggccctggagctgaaggaccagctgttcgtcctgatggagatcctgaagttcatgcagtgcaacagcatgacgtccaacatcaagctcatcgggggcgccgagaacgccgggaagaaccggatcagcaagctgatccaggactccgacgtgaagatgatcttctgcagccccaccggctacttctgcaaggtggtcgacttcaagcgcttcctgtga

SEQ ID NO: 1875 - RNA, 4059 nt, synthetic construct
  misc_feature 1..4059: note = Cas9 variant
  source 1..4059: mol_type = other RNA
atgaagaagatcctgggcctggacctggggaccaccagcatcggctgggccttcatcaaggagcccgagaaggacgtggtcgggtccgagatcgtggacatgggcgtgcgcatcgtcccgctgagctccgacgaggagaacgacttcgccaaggggaacacgatcagcatcaacgcggaccggaccctcaagcgcggcgcccggcgcaacctgcagcggttcaagcagcgccggaacgccctgctcgagatcttcaaggagaagaagctgatctccaccaacttcaagtacgccgaggacggccccagctccaccttcagcacgctgaacctccgcgccaaggcggccaaggagaagatcgagctgcaggacctggtgaaggtgctcctgcagatcaacaagaagcgggggtacaagtccagccgcaaggccaagtccgaggaggacgacggcagcgccatcgactccatggggatcgcgaaggagctgtacgagaacgacctcacccccggccagtgggtctacgaggccctgcagaaggggcggaagaacgtgcccgacttctaccgcagcgacctgcaggaggagttcaagaagatcgtgaactaccagtccgagttcttcccggacatcttcaacgccagcttcgtcgaggactggatgggcaaggcctccacccccaccaagcagtacttcaacaagaagggcgtgcagctcgccgagaacaaggggaagcgggaggagcgccggctgcaggagtacaagtggcgcgcggaggccgtgaacttcaagatcgacctgagcgagatcgccctcatcctgtcccagatcaacagccagatcagcaactccagcggctacctgggggccatctccgaccggagcaaggagctctacttcaagaacctgacggtcggccagtacctgtaccagcagatcaagaagaacccccacacccgcctcaagggccaggtgttctaccggcaggactacctggacgagttcgagcgcatctggtccgtgcagagctccttctacccccagctgaacgacgccctcaagcgggaggtccgcgacatcaccatcttcttccagcgccggctcaagagccagaagcacctgatctccaactgcgagttcgaggaccaccacaaggtggtgcccaagagccaccccgtcttccaggagttccgcatctggcagaacctgaacaacctgctgctcatcaagaaggacaacctgaacgagaagttcgacctggagctcgagtccaagatcgcgctggccaacgagctggccttcaagcgggagctcaacgtgaaggacgccctgaagatcctggggctcaagcccaacgagtgggagttcaacttcaccaagatcgagggcaaccgcacgaaccaggccttcttcgacgcgttcgccaagatcatcgagctggaggacggggagcccatcgacctgggcgacctcaaggccgacgacatcctggaccagttcagcgaggccttcctgcggatcgggatcgacaccgagctgctccaggtgaactccgacatcgagggcgccgagtacgagaagcagagctacatccagttctggcacctcctgtactccagcgaggacgaccagaagctgaagctgaacctgatccgcaagttcggcttcaagccggagcacgcgaagatcctcgcctccatcagcctgcaggacgaccacgcctccctgagcagccgggccatcaagaagatcctcccccacctccagtccgggctgatctacgacaaggcgtgcacctacgccggctacaaccacagctccagcttcaccaaggacgagaacgagaagcgcgagctgcgggccgagctggagctgctcaagaagaactccctgcgcaaccccgtcgtggagaagatcctgaaccagatgatcaacgtggtcaacgccatcctcaaggaccccgagctggggcggccggacgagatccgcgtggagatggcccgggagctgaaggcgaacgccgagcagcgcaagaacatgacgagcaacatcgcctccgccacccgggaccacgacaagtaccgcgagatcctcaagagcgagttcggcctgaagcgggtcaccaagaacgacctgctccgctacaagctgtggctggagaccgacgggatctccctctacacgggcaagcccatcgaggccagcaagctgttctccaaggagtacgacatcgagcacatcatccccaaggcgcggctgttcgacgacagcttctccaacaagaccatctgcgagcgccagctcaacatcgacaaggccaacgtgaccgccttcagcttcctgcagaacaagctgtccgccgacgagttcgagcagtaccagagccgcgtgaagtccctctacggcaagctgagcaaggccaagatccagaagctgctcatggcgaacgacaagatccccgaggacttcatcgcccggcagctgcaggagacccgctacatcagcaagaaggccaaggagatcctgttcgagatctcccggcgcgtcagcgtgacgaccgggaccatcaccgacaagctccgggaggactggggcctggtggagatcatgaaggagctgaactgggagaagtacgacaagctcgggctgacgtacaccatcgagggcaagcacggggagcgcctgaacaagatcaaggactggtccaagcggaacgaccaccgccaccacgccatggacgcgctcaccgtcgccctgaccaagccggcctacatccagtacctgaacaacctcaacgccaagggcctgaacaacaagaagggcacggaggtgttcgccatcgagcagaagtacctgaagcgggagaacgggaagctctgcttcatcccgcccatcgagaacatccgcagcgaggcgaagaagcacctgtcccggatcctggtgagctacaaggccaagaacaaggtcgtgaccatcaacaagaacaagaccaagtccaaggccggcctcaacgagcagatcgccctgacgccccgcgggcagctgcacaaggagaccgtgtacggcaagagcttccactactccaccaagttcgagaagatcggcgccagcttcaacgtccagaagatcaacaccgtggcgaagaaggaggagcgggaggccctcctgaagcgcctggccgagaacgggaacgacccgaagaaggccttcaccggcaagaacaccctcaacaagatgcccatctacctggacctggggaagaacatcaagctctccgagaaggtgaagacggtcgtgctggagcagaactacaccatccggaagaacatcgaccccgacctgaaggtggacaaggtcatcgacgtgggcatcaagcgcatcctcgagagccggctggaggagttcgggggcaacgccaagctggcgttctccaacctcgaggagaaccccatctggctgaacaaggagaagggcatcagcatcaagcgcgtgaagatctccggggtcagcaacgtggagtccctgcacgtgaagaaggaccacttcggcgagccgatcctcgaccaggaggggaacgagatccccgtcgacttcgtgagcaccggcaacaaccaccacgtggccatctacgaggacgagaacgggaacctgcaggaggaggtcgtgtccttcttcgaggccgtggtccggcagaaccagggcctgcccatcatcaagaagaaccacaccctcggctggaagttcctgttcacgctgaagcagaacgagtacttcgtgttcccgagcgacgacttcgtgcccgccgacgtcgacctcatggacgagcagaactaccacctgatcagccccaacctgttccgcgtgcagaagatcgcgcggaagaactacgtgttcaacaaccacctcgagaccaaggccgtcgacaacgacctgctgaagtccaagaaggagctcagcaagatcacctaccacttctaccagacccccgagcacctccgcgggatcatcaagatccgcatcaaccacctgggcaagatcatccagatcggggagtactga

SEQ ID NO: 1876 - RNA, 4059 nt, synthetic construct
  misc_feature 1..4059: note = Cas9 variant
  source 1..4059: mol_type = other RNA
atgaacaagaagtactacctgggcctcgacatcgggaccaacagcgtgggctgggccgtcaccgacgagaactacaacctgtacaagtacgccgggaagcgcatgtggggcatccggctgttcgaggcggccgacacggccgccgagcgccggatgaagcgctccaaccggcgccggctcagccgcaagaagcagcggatcgacctgctgcaggagctgttctccgaggagatcgtgaagaaggacctgaccttcttcatccgcctgaacgagagccggctccacttcgaggacaagtccaccggggagaagtaccccctgttcgtggacaaggagtacaccgacatcgactaccacaagcagtacccgacgatgtaccacctccgcaaggagctcatcgagaaccccgagccccacgacatccggctggtctacctggcctgccaccacatcctcaagaaccgcggccacttcctgatcaacggcagcatctccgacgtgaagaacctgagcttcgtgtgcggggagatgatcaaggagttcaactccgtcagcgagtacgagatctccctcaccgacatccgggagctggagcgcatcctgagcgacaagaagaccgcgaagtccgtgaaggccaagcaggtcgcccagctgttcgagtgcacccccgccgaggacaaggagcagcagaagtgcgcgaaggccatcatcacgaacctcagcaagctgatcgtgggcctcaaggggaacatctccaagatgttccaccagccgctggaggagatcagcaccaagtccttcaagttcaccgaggccaagtacgaggacgagatcatgcccgccatcgaggagaactaccccgactacgccagcgtgatcgaccggatcaagggcgtgtacgactggtccgtcctggtggagatcctcgacggggaggactacctgagcttcgcgaaggtgaaggcctacgagaagcacggcaagaacctgcacatcctcaagaacgtcatgaagaagtactgcaaggacgaggtgtaccaggccttcttcaacggcatcaacgagaagaacgggtacggcaactacatcggggccatccgcaagaacggccacacctacaagatggaccggtgcaagagcgaggaggacttctacaagggcctgcagaagatcctgtccacgatcgtgcccgaccaggaggacgaggagctcctggagaagctgaaggccgaggtcgagaaccagaccctcctgccgctggcgcgcagcaaggagaacgggaccatccccaaccaggtgcacctccaggagctgatgaagatcctggacaacgccaaggagtacctcgacttcctgaagaaggaggacgagtacggcaccatcgccgagaagatcatctccatcgccaagttccggatcccctactacgtggggcccctgagccgccgccacaaggaggagggctccaacagctggatgatccggaaggaggaggggcgcatctacccgtggaacttcggcgacaaggtcgacgtggagcagtccaacaaggagttcatcgagcggatgacgaacaagtgcacctacctcatcggcgaggacgtgctgcccaagaacagcctgctctactccaagtacatggtcctgaacgagctgaacaacctgaagatccgcgggaacaagatcagcgtggagctcaagcagcggatctacaaggacctgttctgcaccatggccaaggtcaccggcaagcgcatcctggagtacctcaagatggaggaccccgagatcgtgcaggaggacatctccgggttcgacatcgacttcaagagcgcgctggcctcctacctggacttcaagaagcaggtcgtgggcaacgagatcgagaaggaccactacaaggagatcatcgaggagatcatcaagtggaagacgatctacgacgacgacagcaagatgatgcggcgcatgatcgagcgggagtaccccgaggtgttcgacaaggagcagatcaagaagatctgccagctcaagtactccgggtggggcaacttcagcgaccgcttcctgaacggcgtgcgcggggccgacaaggagaccgaggagtcctacaccatcatcgaggccctgtggaagaccaactacaacctcatgcagctgctgagcaagcagttctccttcaaggaggagatcgaccagatcaacgccgagaaggcgggcgacgtcgggaagatcaactacgagaacacggtgaaggacctcatcgtgagcccgagcaacaagcgggccatctggcagaccatccagatcgccgaggagatcaagaaggtcatgaagtgcgagcccgagcggatcttcatcgagatggcccgcggcggggagaaggagaagaagcggaccgtgtcccgcaagacccggctgcaggagctgtacgcgggctgcaaggacgacacgcgcaactggatgaaggagatcggcgaccgggaggagcgcgagttcaacagccgcaagctctacctgtactacacccagatggggaagtgcatgtacaccggcgacgagatcgacgtggacgccctgatgaaggggaactccaactgggacatcgaccacatctacccccagagccggatcaaggacgactccctcgacaacatggtcctggtgcgcaaggacgtgaacaacaagaagcggaacaagatcctgagccccaagatccgcgaggacatgaagggctactggaccatgctctgccagaagggcctgatctccaagcggaagtacgaccgcctgacgcggaccaccgacttcaccgacgaggagctcagcgggttcatcgagcgccagctggtcgagacgcggcagtccagcaaggccgtggccgagctgctcaaccgcctgtacaaggactccgaggtggtctacgtgaaggccggcctggtgagcgacttccggcacgacaacgacctcctgaagtcccgccgggtcaacgactaccaccacgcgaaggacgccttcctgaacatcgtggtggggaacgtctaccacgtgcgcttcaccagcaacccgcggaagtggatcaaggacaaccgcgactccaactacagcatccggcgcgtgttcaactacgacgtcaagcagggcgacaagatcgtgtggcacgggtccgagaacggcggccacagcatcgaccagatcaagaagatcatgagccggaacgacatcctctacaccgagtacacctactgcgagaaggggcagctgttcaacgagaccctggccaagaagggcaacgagaaggccatcgccctcaagaagaacctggaccccgtgaagtacgggggctacacgacccccaagacctccgcgttcgccttcgtcgagttcgacgggaagaagaaggagcgcaagaaccacatcgtggagatccccgtgtacgtcgtgaacatcgccaagcgggagccggacgccgtgaagaagtacctggaggagcgcaagggctacagcaacgtcgtgatcaagaagtaccccatcaagaagaactccctcatcaagatggacggctacctggcccgcctgcgcggggcgaacgagaaggacatcatcctcaagaacgccgtgcagctgatcctgaacaaggacctctacgagatcgtccggaagatcgagaagtacctggagtacaacctgcagtaccaggccgacgccaagttcgagggcttcaccatgaaggacctcaacatgatctacgaggagctgtacctgaagctcaaggagagcatcttccagaagcggcccgcgcagcagatgaagacgctggagaaggggaaggaggccttcatctccatcgagaacctgggcgagaaggccaaggtgatcaacgagatcatcgccatgttccgctgcgacgccaccaccgtggcgaacctcaaggtcatcaacgggagccagaacgccggctccatgaaggtgaacaagaacaccctgacgagcaagtccctgaagctcgtgcaccagagcatcaccggcctgttcgagaccgaggaggagctggtctga

SEQ ID NO: 1877 - RNA, 4062 nt, synthetic construct
  misc_feature 1..4062: note = Cas9 variant
  source 1..4062: mol_type = other RNA
atgaagaagaagtactacctgggcctcgacatcgggaccaacagcgtgggctgggccgtcaccgacgagaactacaacctgtgcaagttcaacgggaagaagatgtggggcatccgcctgttcgaggacgccaagacggcggccgagcggcgcaccaagcggtccaaccgccggcgcatcgcccggaccaagcagcgcatcgacctcctgcaggagctgtgcgagaagtccatcttcgagaaggaccccaccttcttcatccggctcaacgagagcagcctgcacctggaggacaagtccacgggggagaagtacccgctgttcgtggacaaggagtacaccgacatcgactaccaccgcgagtaccccaccgtgtaccacctccggaaggagctgatcgagaaccccgagccccacgacccgcgcctcgtctacctggcctgctgccacatcatcaagagccggggccacttcctggtgaacggctccatcagcgacgccaaggacctctccttcatctgcgagaacatgatcaacagcttcaacgcggcctccgactacaagatcaacatccaggacatgaccgccctggagacgatcctgaccgaccgcaagatggccaagagcgtgaaggcgaagcagatcgtccagctgttcaagtgcatcccctgcgaggacaaggagcagcagaagtgctgcaaggccatcatcaccaacctgtccaagctgatcgtggggctcaagggcgacatcagcaagatcttcaacgagtccttcgaggagatcaagagcttcaagttcgccgagaccaagtacgaggacgagatcctgcccacgatggaggagatctaccccgaccacgccgagatcatcgagaagatcaagtccatctacgactggagcatcctggacgagatcctcgacggggaggagtacctgtccttcgccaaggtgaaggcgtacgagaagcacaagaagaacctgcacgacctcaagatcctgatcaagaagtactgcgacgacgagacctaccagagcttcttcaacggcatgaacgagaagaacaagtacagcaactacatcgggtccatccggaagaacggccacacctacaaggtcgagaagtgcaagagctccgaggacttctacaaggagctgctcaagctgctgagctccgtgaacccgggccaggaggacgagagcctcctggagcagatcaagttcgagaccgagaaccagacgctgctccccctgctgcgcaccaaggagaacgggaccatccccaaccaggtgcacatgcaggagctcatcaagatcctggacaacgcctccaagtacctggacttcctcaacgagaaggacgagtacggcaccacggccgacaagatcatcagcatcgccaagttcaagatcccctactacgtcgggccgctgtccgaccggcacaaggagaacggcagcaactcctggatggtgcgcaaggagaacggccggatctacccctggaacttcgacgacaaggtggacgccgagaagtccaacaaggagttcatccagcgcatgaccaacaagtgcacctacctgatcggggaggacgtcctccccaagaacagcctgctgtacagccggtacatggtgctcaacgagctgaacaacctgaagatccgcggcaacaagatctccgtggagctgaagcagcagatctacaacgacctcttctgcaccaaggcgcgcgtcacggggaagaacatcctgaactacctgaagaaggaggaccccgagctcgccgccgaggacctgagcggcttcgacgtggacttcaagtccgccctgaccagctacctcgacttcaagaagcaggtcgtggggaacgagatcgagaaggactactacaaggagatcatcgaggagatcatcaagtggaagaccatctacaacgaggactccaagatgatgaagcggatgatcggccgcgagtacccggagaccctgaaccaggaccagatcaagaagatctgccacctgaagtacaacggctgggggaacttcagcgagacgttcctcaacggcatcaagggggccaacaaggagaccggcgagtgctacaccatcatcgaggcgctgtggaagaccaactacaacctgatgcagctcctgagcaagcagttctccttcaaggaggagatcgaccagatcaacgccgagaagacgggggccatcggcaagatcacctacgagaacctggtgaaggacctcgtggtcagccccgccaacaagcgggccatctggcagaccatccagatcaccgaggagatcaagaaggtgatgaagtgcgagcccgagcgcatcttcatcgagatggcgcggggcggggagaaggagaagaagcgcacggtctcccggaagacccgcctgcaggagctgtacaccggctgcaaggacgacacccgggactggatgaaggagatcggggaccgcgaggagcgggagttcagctcccgcaagctctacctgtactacacccagatgggcaagtgcatgtacacgggggaggagatcgacgtggacctgctcatgaccgccaacagcaagtgggacatcgaccacatctacccccagtcccggatcaaggacgacagcttcgacaacatggtgctggtccgcaaggacatcaacaacaacgtgaagggcaacaacatcgtgccgtccagcatccagaaggagatgacctcctactggaagatgctgctccagaaggagctgatcagcaagaagaagtacgagcggctgacccgctccacggacttcaccgacgaggagctcagcggcttcatcgagcggcagctggtcgagacccgccagtccagcaaggccgtggccgcgctgctcaaccggctgtacaagaactccgagatcgtgtacgtcaaggccgggctggtgagcgacttccgccacgacaacaagctcctcaagagccgccggatcaacgactaccaccacgccaaggacgccttcctgaacatcgtggtcggcaactgctaccgcaccaagttcacggccaacccccggcagtggatcaagaagaaccgcgacaccaactactccatccggcgcgtgttcgacttcgacatcaagcagggggacaagatcgtgtggtacggcaacaagaacgagaacggcaagcacaccatcgaccagatcaagaaggcgatgagccggaacgacatcctctacaccgagtacacgtactgcgagaaggggaagctgttcgacgagaccctgaccaagaagggcaacaagaaggccatccccctcaagaagaacctggaccccctgaagtacgggggctacacctccgtcaagacgagcgccttcgccttcatcgagttcgacgacaagaagaaggagcgcaagaaccacatcgtggagatcccgatctacgtggccaacatcgcgaagcgggagcccgaggccgtcatcaagtacctcgaggagcagaaggggtacgtgaacatcgtggtcaagaagtaccccatcaagaagaactccctgctgaagatcgacggctacctcgcccgcctgcggggcggggacagctccatcatcaccctgaagaacgccgtgcagctcgtgctggacaagaagtcctacgagatcatccgcaaggtcgagaagtacctggaccacaacagcaagtacgaggccaacagcaagctcgagaagttcaacgagaacgacctgaacatcatctacaacgagctgtgcctcaagctgcggaactccatctaccagaagcgccccgtgcaccagctggagaccctcgagcagggcatcgacaacttccggagcctggagtccctgaaggacaaggcgaagatcatcaacgagctcctggccatgttccgctgcgacgccaagaccgggatggacctgcggctcatcggcggggccagcaactccggccgcatgcggatcagcaagtcccgcctgacgagcaagtccctgaagctcatcaaccagagcgtgaccggcctgttcgagaccgaggaggagctggtctga

SEQ ID NO: 1878 - RNA, 4062 nt, synthetic construct
  misc_feature 1..4062: note = Cas9 variant
  source 1..4062: mol_type = other RNA
atggagaagaactactacctgggcctcgacatggggaccagctccgtgggctgggccgtcaccgacgagaactacaacctgatgcgcaagaaggggaaggacctgtggggcgtgcgcctcttcaaggaggccaagacgagcgcggagcggcgggtgaagcgcacctcccggcgccggctgcagcgcgagaaggcccggatcgggtacctgaaggagctgttcgccgacgagatcaacaaggtcgacgccggcttctaccagcgcatggaggacagcaagttcatctccgacgacaagaccgtgcaccagaagttcaccctgttcagcgacacgaactacaccgacgaggactactacaacgactaccccaccatcttccacctccggaagaagctcatcgagtccgacgacgagtacgacgtgcgcatggtcttcctggccctgctcaacatgtacaagcaccggggccacttcctgaacgcgaacctgagcgacaacgggatgggcgacatcaacgagcagtacgaccgcctcaaggagctgtgctccgagtacctgaacgtggagtgggagaacaagccggacaagttcgaggagatcctcaaggagtgcaactgcagcaactccctgcggaacgagcgcctgctcgagaccttcaacctgaagaagacggacaaggagaagtgcgagatgctgaagctcatctgcgggctgagcggcaccctgtccaagatcttcaaggacctcgacgacgacagcgagaccaagaagatgaccatctccttccggagctccaactacgacgaggaggccatcaacgtggaggagatcatcgggagcgagaacttcgagatcatcgccgtcctgaaggagatccacgactggtccatgctggccaacatcatgcgcggcaagaagtacctcagcgtggcgcgggtggaggagtacgagaagcacaaggacgacctgaagatcctgaagaaggtcatcaaggagtacagcatcgaggagtacaacaacttcttccgcgtgatggccgacaacaactactccgcctacgtgaacagcgtcaactccaacaaggagagcacgcggcgcggcgccaagtgcgacaacgacaccttcttcaaggagatcaagaagatcgtgaacaagtgctacgactccgaggagaaggagtacatcctcaaggagatcgagaaggggaccttcctgcccaagcagatcatcagctccaacggcgtgatccccaaccaggtccacaagatcgagatgaagaagatcctgcagaacgccgagaagtacctccccttcctgaccgagaaggacgacagcgggctgtccgtgagcgagcgcatcctccagatgttctccttccagatcccgtactacatcggccccatcagcggcaagatcgggtccgacgagaagtccaagaacagctggagcgtgcggaaggagaagggccgcatctacccctggaacttcaaggacaagatcgacgagaaggagtccgcggagaagttcatcgagcggatggtcaaccactgcacgtacctgaacaacgagatggtgctgcccaagaacagcctcctgtacgagaagttcatggtgctgaacgagctcaacaacctgaagatcaacaacgagaacatctccgtcgagctgaagcagagcctctacaacaacctgttcaagaccgggaagaaggtgaccgccaagggcatcaagagctacctggagcgcaacgggctgtgcgagccgaacgaggacatcaacctcaccggcatcgacggcgacttcacgaaccggctgtccaactacgccaagttcaaggggatcttcaacaccgacgagctgacctacgagcagtggaacatggccgagaagatcatcaagtggagcaccatctacggcgactccaagaagttcctcgaggagaagatccgcaacgagtacagcgagaagctggactcccagcagatcaagcggatcctggggatcaagttccgcgactggggccggctcagcgaggagctgctgaacatggagggggccgacgtcaacacgggcgagatcaagtccgtgatcggccgcatgtgggacgagaactacaacctcatggagctgatcgcgaccgacaacttcacctacaagcaggtcatcaaggagaagcagaacgggctggacaagagcctctccgagatcgactacgacgacctggacgagctgtacgtgagcgcccccgtgaagcggatgatctggcagaccctcctgatcatcaaggagctggtgtccgtcatcggctacgagcccacgcgcgtgttcgtggagatggccaaggacgtcaacaccgagaagaagcggaccgacagccgcaagaagaagttcctcgacctgtacaagcagtgcgagaaggacgagcgggacttctggatcaaggagatcgacgacaagtccgaggccgagttccgcaagaagaagctgtacctctactacacccagaaggggcggtgcatgtacacgggcgagcagatcaaccccctggacctgaccaacgacaacctctacgacatcgaccacatctacccgcgccacttcgtgaaggacgacagcatcgagaacaacctggtgctggtcaagaaggagaagaacgcccacaagtccgacaccttccccatcgaggacgacatccggaagaaccagtacgcgttctggaagatgctctacgagaagaacttcatcaccaaggtgaagtaccagcgcctgacgcgcaaggagcccttcagcgacgaggagaaggccaacttcatcatgcggcagatcgtggagacccgccaggggaccaaggtcatcaccgacatcctggagaagtccttcgacaagacccagatcgtgtacgtgaaggccggcaacgtcagcctcttccggcagaagtacgagtgcatcaagtgccgcgagatcaacgacttccaccacgccaacgacgcctacctgaacatcgtggtgggcaacgtctacgacacgaagttcaccagcgacccccggaacttcatcaaggagtaccgcaagaacccgcagaagaacgagtaccacatgtacaagctgttcgactacaacgtgcagcgcggggaccgggtggcgtggaccgcctccaacggcgagagcatgaaggtcgtgaaggggaccctcaagaagaacacgcccctggtgaccttcatgtcctacgaggagcacggcggcctgtacgaccagaacatcatcagcgccaaggacatcgagaaggtcaaggggaagggctacctccccatcaagtccagcgactcccggctgaacaacaccgagaagtacgggggctacgccaaggtgagcggggcgtacttcttcgtggtcgagcacaccgtgaagaacgtgcgcatccggacgatcgagcccatgccgtgctacctgaccaaggtcctcaccaccaaggagaagatcgaggactactgctgcaacatcctgaagtacgactcccccgtggtgaagtacgagaagatcaagatgtacagcctgatcaaggtcaacggctaccccatgtacctcacgggccgcaccgggaaccagctgatcgtgtccaacggcatccagctggtgctcagctacgacgaggccaagtacatcaaggacctgctgaagatcaaccaggaggagttcgaccagaaccggctcgagaacctggggatcaacaagttccgcaacgagaagctgtacgacaccctcaacaagaagtacaccaacgagatctacaagaagcggcccaactccatgggcaacaagatgatcgagtggaagaacacgttccagaacctgagcatcaaggaccagaccgaggtcctgctccagctgatccagctggggcagaagcagaactccggcgtgaacctcgagaagctgggcgccagcaagaagaccggggtgtccctggtcagcaagaagatcaccgacaaggagtccttcgagctcatcaacaagagcatcacgggcctgtacgagaacaaggtggacctgctccgcgtgtga

SEQ ID NO: 1879 - RNA, 4062 nt, synthetic construct
  misc_feature 1..4062: note = Cas9 variant
  source 1..4062: mol_type = other RNA
atggccgccttcaagtactacctgggcctcgacatggggaccaacagcgtgggctgggcggtcaccgaccccaactacaacctgctgaaggccaaggggaaggacctctggggcatccgcgagttcaacgaggcctccacggccgtggagcggcgcacccaccggatcagccgccggcgccggcagcgcgagcaggtccggatcgggctgctgaaggactacttccacgacgccatcggcgaggtggacccggacttcttccagcgcctcgcgaactccaagtaccacctggaggacaaggacaccgaggtgcggtacaagaacaacgtgttcaacgacgacgactacaccgacaaggactacttcgaccagtaccccacgatctaccacctccgcaaggagctgatcgagagcaccgacaagcacgacgtccggctggtgttcctggccctcctgaacatgttcaagcaccgcggccacttcctgaactccgggctcggcgagaacagcggggagaacaacatcaacaacgcctacctggagctgaccaacctcctgtccgagttcacccagtacaacctgaacgagacgatcgacggcaagaagatcgaggacatcctcagccggcgcgacatgtcccggacccgcaaggccgaggggctggcggagatcctgggcgtggactacaagaacaagccctacaaggagctcatccggggcctgtgcgggctgaagttcaacgcctgcgccatcttccccgagatccagagcgacgaggtcccgaagctcgacatctgcctgtccgaggccagcttcgacgagaagtccgacgagatcgccaacatcctgggcgaggactacttcgagatcatcatggcgatgaaggacatctacgacatcgggagcctcgccggcatcatgaagggccacaactacctgtcccaggcccgcgtgaccagctacgagaagcacaaggaggacctgcggctcctgaagaacgtgatccgcaagtactgctccaaggaggactacgacaacttcttcaacagcgaggccgacgggtcctacgccagctacgtcggcagctacaactccaagaccaagcagcgccgggtggggaacaagcgcagctccgaggagctgtacaaggcgatcaagaagatcctcaagaacgtgcccgccgaggacgccgacgtccagcggatcctgatgagcatcgagaacgagacgttcctgcccaagcagctcaccgcctccaacggcgtgatccccaaccaggtgcacgccaaggagatcaagaagatcctgagcaacgcggagcgctacctgccgttcctccgggagaaggacgagaccgggctgtccgtcagcgagaagatcatgaagctgttctccttccagatcccctactacgtgggccccaccacggagaagtccagcaaggacggcgggaacggctgggtggtccgcaaggaggagggccaggtgctcccctggaacatcgacgagaagatcgacatgaaggccaccagcgaggccttcatctcccggatggtgcgccggtgcacctacatcagcggggagccggtcctgcccaagtccagcctggagtaccagtccttctgcgtgctcaacgagatcaacaacatcaagatcgacggggagcgcatcagcgtcgagctgaagcaggacatctacaaggaggtgttccagaagggcaagcgggtgaccaagaagcagctgtgcaagtacctgcacacgcgcggcatcatcgaggccgaggagcaggtcaccgggatcgacgtgaccatcaacaacgccctcaccacgtacggcaagttcaaggcgatcctgggggacgacatctccaaggacagcgtgcagaagatggtcgagaacatcgtgttctggtgcaccgtgtacggcgacagcaagaagttcctgaaggaccggatcgaggagaagtacggggagaagctcaccaaggagcagatcaagcgcatcgtcggcttcaagttcaaggactggggcaacctgtccaagaacttcctggagctcagcggggccgacgtgtccaccggcgagagcgtgtccatcatccgggccctgtggaacaacaacctgaacctcatggagctgatcaacagccgcctgtacaactacaaggagcggctcgccgagtaccagaacacgatgatgaagaccctgtccgacatcgaggcggaggacctggacgagtactacttcagcgcccccgtcaagcgcatgatctggcagaccatcctcatcatcaaggagctggtgaaggtgctggggtgcgagcccgaccggatcttcgtcgagatgacccgccgcccggacgagcggaagatgcgcacggagtcccggcgcaagaagttcgaggagctctacaagaaggtgaaggacgaggacgtggactggatgaaggtcatcgcccacgccgacgagaccggcagcatccggtccaagaagatgtacctgtacctgacccagaagggccgctgcatgtacaccgggaagcacatcgagctcagcgacctgttcaacaacaacctgtacgacatcgaccacgtgtacccccggcacttcgtgaaggacgacaacatcgacaacaacctcgtcctggtgtgcaaggagaagaacgcccacaagtccgacatctaccccctggaggacgagatcctcgcgagccagaagaacatgtggtccgagctgcgccggagcggcttcatcacggaggagaagtacaaccgcctgatcgggcggaactccttcaccgacgagcagaaggccggcttcatcgcccgccagctcgtggagaccagccaggggaccaagggcgtcgccaacatcctgcagcagctgctccccgagagcaagatcgtgtacgccaaggcgtccaacgtgagcgagttccggaacacccgcgacatcccgaagtcccggctgatcaacgagttccaccacgcccacgacgcctacctgaacatcgtcgtgggcaacgtgtactacgtcaagttcacgcagaaccccctcaacttcatcaagaacgactacgaccgcgacaagaccaagaacaactacaacctgagcaagatgttcgactgggacgtggagcggaacggggaggtggcctggatcgcccagaagaaggacggcgaggcggggaccatcgccaccgtcaagaaggtgctgggccgcaacacgcccctcatgacccggtactccttcgaggggaagggcggcctgaccaacgagaccctgtacagcgccaagaaggccaaggaggaggggtacatccccttcaagtccagcgacgagaagatgaaggacgtgacgaagtacggcgggttcacctccgtcaccggcgcgtacttcttcctcgtggagcacaccgagaagaagaagcgcagccggatgatcgagtccgtgccgctgtacctggcccagaagatcgagcagaacccccacgagctcgagaagtactgcgagcaggtcctggggctgatcgacttcgacatccgcgtgcgcaagatcaagatcggcagcctcatcaagcggaagggctacttcttctacatcacggggaagaccggccaccgcctgatcctgcggaacgccgtgaacatgtgcctcaagaaggagtgggtcaagtacatctccaagctggagaaggccgtggacaagaacaacgtggaggggatcatcaccaaggagaagaacgagctgctctacagcgagctgatcgagaagttcaagaactccatcttcagcaaccgccccaaccccgtcggcgacaagctggacgaggccaaggagaagttcatcaacctcgacatcgagaagcagtgcatcgtgctgtgccagatcctgcagctctccagcgtgctggggtccgagtgcgacatgaccctgctcggcgagagcgcgcactgcggcaagatcctgatcagcaagaagatcggggacgaggacatctacctgatcaaccagtccgtcacgggcctctacgagaagaagatcaacctgcggaccgtgtga

SEQ ID NO: 1880 - RNA, 4065 nt, synthetic construct
  misc_feature 1..4065: note = Cas9 variant
  source 1..4065: mol_type = other RNA
atgaagaagatcctgggcctcgacctggggaccaacagcatcggctgggccttcatcaacgaggccgagaacgagatcgaggtgtccagcatcgtcaacaccggggtgcgcatcgtgcccctgacgaccgacgaggagtccgacttcaagaagggcaacaccatcagcatcaacgcggaccggaccctcaagcgcggggcccggcgcggcctgcagcggttcaagcagcgccgggaggccctgctcgagacgttcaaccgcatcaagttcatcgccaccgacttcgtctacgccgagaccggcgcggccaccacgttctccagctaccagctgcgggccaagtccgccgtggaggcggtgaccaaggaggagctggtcaaggtgctcctgatgctgaacaagaagcgcgggtacaagagctcccggaaggccaagaccgccgaggagggcgacgccatcgacgggatgaagatcgccaaggagatcttcgagaacaacctcaccccgggccagtgggtgtacaacagcctgtccaagggcgggaagttcatccccgacttctaccacagcgacctgcagaaggagctcgagaagatcgtccgcttccagaaccagttccactccgagcagatcaacgacaagctgctggcggacatccagggcaagagccggacgcagacctcccagcacttcagcaagaccctcaacatccccctggccgagaacaaggggacccgcgaggagacgaagctgcagcactaccagtggcggaacgaggccctcgccaacgagctggacatgaagatcctggccttcatcatcaccgagatcaacaaccagatcaaccagtccagcggctacctcggggcgatctccgaccgcagcaaggagctgtacttcaaccaggagaccgtgggccagtaccagtacaagcagctgcaggagaacgtgcacgccaagctcaagaaccaggtcttctaccggcaggactacctggacgagttcgagaagatctgggagacccaggccaagttccacagcgagctgaacgagaagctcaaggccgagatccgcgacatcacgatcttctaccagcggaagctgaagtcccagaagcacctggtgagcttctgcgagttcgagaagggccacaaggccatccccaagtccagcccgctgttccaggagttccgcatctggcagaacctgaacaacgtggtcgtgaagaacgagaccaccaaggaggtgttcgagctgtccgaggagctcaagcagctgatcgcggaggagctgcagttcaaggagagcatgaccgacgtccagatgctcacgttctgcgagctgaagaaggggacccacaccgtgaacttcaagaagatcgagggcaaccggaccaacacgtccatctacaaggccttcgagaagatcctggaggtggaggggtacgagatcgacttcagcaagatgaagcccctcgagatcaaggagaccgtcgcccccatcttcgagaccctgaacatcaacaccgtgatcctggacttcgaccccacgatccagggcaacgacttcgacaagcagccgtactaccagctctggcacctcctgtactccgccgaggacgacgacaagctcaaggagaccctgaagaccaagttcgggttcaaggagaaccacctccccttcatcctgaacatcaacctgcaggccgactacggcagcctgtccgcgaaggccatcaagaagatcctgccccacctcatggacggccacatctacgacaaggcctgcctgatggtggggtacaaccacagctccagcctgaccacggcccagaacaacgaccgcgtcctcaaggacaccctggagctgctcaagaagaactccctgcgcaaccccgtggtcgagaagatcctgaaccagatgatcaacgtgatcaacgcgatcatgaaggacccggccatgggcaagcccgacgagatccgggtggagctcgcccgcgagctgaaggccaacaacgagcagcggaagaaggccaccagcgacatcaacaccgcgaccacggagcacgagcgcatccggaagctgctccactccgagttcaacatcccccgcgtcacccggaacgacatcatccgctacaagctgtggctggagaccgggggcatcagcctctacaccgggaaccccatcaaggcctccgacctgttcagcaagaactacgacatcgagcacatcatccccaagagccggctgttcgacgactccttcagcaacaagacgctctgcgagcgccagctgaacatcgacaagtccaacaagaccgcctacagcttcctgcaggagaagctctccgagaacgacttcgccgcctacgagaaccgggtgaaggacctgttcaagaccggcaagatcaagagctacaccaagtacaagaagctgctcatggcggacaacgagatcccggagggcttcatcgaccgccagctgcgggagacgcagtacatcgccaagaaggccaaggagatcctgctcgaggtgtcccgcaacgtcaccgccaccatcgggagcgtgaccgacaagctgcggcaggactgggagctggtggacgtcatgaaggagctcaactgggagaagtacgacaagctgggcctgacgcacatcgaggaggggaagaacggcgagcgcctctccaagatcaaggactggaccaagcggaacgaccaccgccaccacgccatggacgcgatcaccgtggccttcaccaagcccgcctacatccagtacctgaacaacctgaacgccaagacgcagggggagaacaaggcgaacagcatcatcggcatcgagaacaagcacctctaccgggacaagaacaacaagctgcgcttcatctcccccatgaagaacttccgcgaggaggccaagaagcagctggagagcatcctcatctcctacaaggccaagaacaaggtggtcaccaagaacaagaacaccaccaagaagtccggcgggacgaaccagaagatccagctgaccccgcggggccgcctgcacaaggagaccgtgtacgggaagctccagcagtacgccaccaaggaggagaaggtgaacgccagcttcacggaggactacatccagaaggtcgcgaagaaggagtaccgggaggccctgctgaagcgcctcgaggagaacgacaacgaccccaagaaggccttcaccggcaagaacgccctgaacaagacccccatctacatcagcctgaaggacaacatcatcgtgcccgagaaggtgaagaccgtctggctcgagacggactacaccatccggaaggacatcaccccggacctgaagatcgacaaggtgatcgacgtgggcatcaagcgcatcctgcagaaccggctcaacgagttcaacggggaccccaagaaggccttcgtcaacctgggcgagtcccccatctggctgaacaaggagaaggggatcgcgatcaagcgcgtgaccatcagcggcgtgagcaacgcccaggccctccacacgaagaaggaccacctggggaacgagatcctggacaagaacggcaaccccatcccggtcgacttcatctccaccggcaacaaccaccacgtggccatctaccgggacgagaaggggaacctccaggaggaggtggtcagcttctacgacgccgtgatccgccggaacctgggcctgtccgtgatcaacaagaaccacgagaaggggtgggagttcctcttcagcatgaagcagaacgagttcttcatcttcccctccgacggcttcaacccccacgagatcgacctgctgaacccgaacaactaccacctcatcagccccaacatcttccgcgtccagaagatctccaccaagaactacatgttcaaccaccacctggagaccaaggcggtggacggggagatgctcaagagcaagaaggagctgtccaagacgagctaccacttcatccagacccccaccaacctgaacggcatcatcaaggtgcggatcaaccacctgggcaagatcgtccacctcggggagtactga

SEQ ID NO: 1881 - RNA, 4065 nt, synthetic construct
  misc_feature 1..4065: note = Cas9 variant
  source 1..4065: mol_type = other RNA
atgaagaagatcctgggcctcgacctggggaccaacagcatcggctgggccttcatcaacgaggccgagaacgagatcgaggtgtccagcatcgtcaacaccggggtgcgcatcgtgcccctgacgaccgacgaggagtccgacttcaagaagggcaacaccatcagcatcaacgcggaccggaccctcaagcgcggggcccggcgcggcctgcagcggttcaagcagcgccgggaggccctgctcgagacgttcaaccgcatcaagttcatcgccaccgacttcgtctacgccgagaccggcgcggccaccacgttctccagctaccagctgcgggccaagtccgccgtggaggcggtgaccaaggaggagctggtcaaggtgctcctgatgctgaacaagaagcgcgggtacaagagctcccggaaggccaagaccgccgaggagggcgacgccatcgacgggatgaagatcgccaaggagatcttcgagaacaacctcaccccgggccagtgggtgtacaacagcctgtccaagggcgggaagttcatccccgacttctaccacagcgacctgcagaaggagctcgagaagatcgtccgcttccagaaccagttccactccgagcagatcaacgacaagctgctggcggacatccagggcaagagccggacgcagacctcccagcacttcagcaagaccctcaacatccccctggccgagaacaaggggacccgcgaggagacgaagctgcagcactaccagtggcggaacgaggccctcgccaacgagctggacatgaagatcctggccttcatcatcaccgagatcaacaaccagatcaaccagtccagcggctacctcggggcgatctccgaccgcagcaaggagctgtacttcaaccaggagaccgtgggccagtaccagtacaagcagctgcaggagaacgtgcacgccaagctcaagaaccaggtcttctaccggcaggactacctggacgagttcgagaagatctgggagacccaggccaagttccacagcgagctgaacgagaagctcaaggccgagatccgcgacatcacgatcttctaccagcggaagctgaagtcccagaagcacctggtgagcttctgcgagttcgagaagggccacaaggccatccccaagtccagcccgctgttccaggagttccgcatctggcagaacctgaacaacgtggtcgtgaagaacgagaccaccaaggaggtgttcgagctgtccgaggagctcaagcagctgatcgcggaggagctgcagttcaaggagagcatgaccgacgtccagatgctcacgttctgcgagctgaagaaggggacccacaccgtgaacttcaagaagatcgagggcaaccggaccaacacgtgcatctacaaggccttcgagaagatcctggaggtggaggggtacgagatggacttctccaagatgaagcccctcgagatcaaggagaccgtcgcccccatcttcgagaccctgaacatcaacaccgtgatcctggacttcgaccccagcatccagggcaacgacttcgacaagcagccgtactaccagctctggcacctcctgtactccgccgaggacgacgacaagctcaaggagacgctgaagaccaagttcgggttcaaggagaaccacctccccttcctgctcaacatcaacctgcaggccgactacggcagcctgtccgcgaaggccatcaagaagatcctcccccacctgatggacggccacatctacgacaaggcctgcctgatggtggggtacaaccacagctccagcctcaccaccgcccagaacaacgaccgcgtcctgaaggacacgctggagctcctgaagaagaactccctgcgcaaccccgtggtcgagaagatcctcaaccagatgatcaacgtgatcaacgcgatcatgaaggacccggccatgggcaagcccgacgagatccgggtggagctggcccgcgagctgaaggccaacaacgagcagcggaagaaggccaccagcgacatcaacaccgcgaccaccgagcacgagcgcatccggaagctcctgcactccgagttcaacatcccccgcgtcacgcggaacgacatcatccgctacaagctgtggctcgagaccgggggcatcagcctgtacaccgggaaccccatcaagggctccgacctgttcagcaaggactacgacatcgagcacatcatccccaagagccggctgttcgacgactccttcagcaacaagaccctgtgcgagcgccagctgaacatcgacaagtccaacaagacggcctacagcttcctccaggagaagctgtccgagaacgacttcgccgcctacgagaaccgggtgaaggacctgttcaagaccggcaagatcaagagctacaccaagtacaagaagctcctgatggccgacaacgagatcccggaggggttcatcgaccgccagctgcgggagacccagtacatcgcgaagaaggccaaggagatcctcctggaggtgtcccgcaacgtcacggccaccatcggcagcgtgaccgacaagctgcgggaggactgggagctcgtggacgtcatgaaggagctgaactgggagaagtacgacaagctggggctcacccacatcgaggagggcaagaacggggagcgcctgtccaagatcaaggactggacgaagcggaacgaccaccgccaccacgccatggacgccatcaccgtggcgttcaccaagcccgcctacatccagtacctgaacaacctcaacgccaagacccagggcgagaacaaggccaacagcatcatcggcatcgagaacaagcacctgtaccgggacaagaacaacaagctgcgcttcatctcccccatgaagaacttccgcgaggaggcgaagaagcagctcgagagcatcctgatctcctacaaggccaagaacaaggtggtcacgaagaacaagaacaccaccaagaagtccgggggcaccaaccagaagatccagctgacgccgcgggggcgcctccacaaggagaccgtgtacggcaagctgcagcagtacgccaccaaggaggagaaggtgaacgccagcttcaccgaggactacatccagaaggtcgccaagaaggagtaccgggaggcgctgctcaagcgcctggaggagaacgacaacgaccccaagaaggccttcacgggcaagaacgccctgaacaagacccccatctacatcagcctcaaggacaacatcatcgtgcccgagaaggtgaagaccgtctggctggagaccgactacacgatccggaaggacatcaccccggacctgaagatcgacaaggtgatcgacgtggggatcaagcgcatcctccagaaccggctgaacgagttcaacggcgaccccaagaaggccttcgtcaacctgggggagtcccccatctggctcaacaaggagaagggcatcgccatcaagcgcgtgaccatcagcggggtgagcaacgcgcaggccctgcacaccaagaaggaccacctgggcaacgagatcctcgacaagaacggcaaccccatcccggtcgacttcatctccacggggaacaaccaccacgtggccatctaccgggacgagaagggcaacctgcaggaggaggtggtcagcttctacgacgccgtgatccgccggaacctggagctctccgtgatcaacaagaaccacgagaaggggtgggagttcctgttcagcatgaagcagaacgagttcttcatcttcccctccgacggcttcaacccccacgagatcgacctgctcaacccgaacaactaccacctgatcagccccaacatcttccgcgtccagaagatctccaccaagaactacatgttcaaccaccacctggagaccaaggccgtggacggggagatgctcaagagcaagaaggagctgtccaagaccagctaccacttcatccagacgcccaccaacctgaacggcatcatcaaggtgcggatcaaccacctcggcaagatcgtccacctgggggagtactga

SEQ ID NO: 1882 - RNA, 4065 nt, synthetic construct
  misc_feature 1..4065: note = Cas9 variant
  source 1..4065: mol_type = other RNA
atggccgacttcgccaagtaccagcccggcatggtggcggacgggcgcaagatcccgctggactggaccctctactacctgcggaagaaggccctgacccaggccatccgcaaggaggagctcgcctggatcctgctgaacttcaaccagaagcggggctactaccagctccgcggggaggaggaggaggagaacagcacgaagcacgaggagtactacgagctgaaggtcgtgtccgtggaggccgcggaggagggcaagggcgggaacacctggtacaacgtcaccctggagaacggctggatctaccggcgccagagcaagatcgagctcaacgactgggtggggaaggtgcggcccttcatcgtcaccacggagtacgagatcgacggcgtgaccatcaagaaggacaagaacggggaggtgaagcgctccttccgggcccccagcgagaacgactggggcctgcgcaagaagcggaccgagtccctgctcgaggagagcgggaagaccgtcggcgccttcatctacaaccacatcctgtccgagcccgccgacaagatccgcggcaacttcatccggacgatcgagcgcaagttctacaagaaggagctggaggcgatcctccgggagcagagcaagcaccagaaggagctgaaggacatcgacaccctgatcgcctgcatcaaggagctctacccgaacaacaagccccaccaggactccctgatcaagaaggacatgacctacctgctcatcaccgacctgatcttctaccagcgccccctcaagagcaagaagtccctcatcgccgactgcccctacgagtactacgagtacgtgatcaaggagacgggggagaacaagcggcagagcatcaagtgcatcgccaagtccaacccgtactaccaggagttccgcctgtggcagttcatcatcaacctgcggctgttcgaccgcaacaacgacaaggaggtgaccagcgagtacctgtccagcatggaggactacacccggctgttcacctacctcaacgaccgcaaggacatcaaccaggagacgctgctgaaggacttcttcaagcagaagaaggtcaagcgcggcatggagaaggagttccccatccggtggaactacatcgaggacaaggagaagaagtacccctgcaacgagacccgccacgagctcctgaccgccctggggaaggtgggcatcgaccactcctggctcgacgacaaggagctgttctaccggctgtggcacctcctgtacagcgtggagtccaaggaggaggcggagggcgccctgcgcaagctcgtcgacaacgacgacttcgtgaacgccttcctgaagatcaagcccttcaagaaggagtacggggcctacagcgagaaggccatcaagaagctgctcgcggtgatgcggatgggcaacctgtggaacgaggtcgacatctgcgagcagacccgcgaccggatccagaacatcatcaagggggacatcgacgagaagatcaaggaccgcatgggccggacgttcagccagctgtccgacttccaggggctcccggagtggctggcctgctacgtggtgtacggccagcacagcgaggccaccgacatccagcgctggaccaagcccgagaacctgatggcctacatcaacggcttcaagcagcactccctgcggaaccccatcgtcgagcagtgcatcctcgagaccctgcgcacggtgcacgacatctggaaggaggccgggcacatcgacgagatccacatcgagctgggccgggggatgaagtccaccgcggaccagcgcgcccggatgagcaagagcatcatgcagaacgagaacaccaacctccgcatcaagtccctgctgatggagctcaagaacgccaaggagttcgagaacgtgcggccctacagcccgatgcagcaggagatcctgcgcatctacgaggagggcgccctgcaggagctcaccaaggaggacgcccagtacaacgagatctccaagatcagccagatggcgcagccctccgccaacgagctgctgaagtaccggctctggctggagcagaagtactgcagcccctacacggggaagcccatctccctgagcaagctgttcacctccgcctaccagatcgagcacatcatcccgcagagccgctacttcgacgactccttcaccaacaaggtcatctgcgaggccgaggtgaaccagctcaagagcaacatgctgggctacgagttcatcaagaagcacggcggggagatcgtccgctgcaccatgatcggcgacgtgaagctcctggacgcgaaggagtactacaacttcgtgacggagcactacaccaacaaccggcgcaagaaggagaagctgctcatggaggacatcccccaggagttcctgaaccggcagatgaacgactcccgctacatcagcaagaaggtcatggccatcctgagcaacatcgtgcgggaggaggacgagcaggaggccaagtccaagttcgtgatcgcctgcagcgggggcatcaccgaccgcctcaagcaggactgggggctgaacgacgtctggaactccatcgtgtacccccggttcgagcgcctgaacaagctcaccaacacggagaacttcggccggtgggagaacaagaagggcaagcaggtcttccagaccagcgtgcccctggagctgcagaaggacttctccaagaagcgcatcgaccaccggcaccacgccatggacgcgctcgtgatcgcctgcgccagcaacaacatcatcaactacctgaacaacgagtccgccaagagccaggagaagcgcgaggacctgcggaagaagctctgcgacaagaaccgcatcatccggaagccgtgggagaccttcacccaggacgcccacaccgcgctggagaacgtggtcgtgtccttcaagaactacatccgcgtgatcaacaaggccacgaactactacgagaagtacgacaagaacgggaagaaggagatcgccgagcagaagggccaggacatgtgggccatccggaagcccatgcacaaggagaccgtcttcggccaggtgaacctgcgccggaagatcaccatcaagctcaaggacgccctggagaagatccccgcgatctgcgacaaggagctgcgcgactacatcaacatcctcgtggccaagcagttcaacaagaagcagatcctggcccacttcaagagcatcaactaccggctgaacatgaagtccgtcgacaaggtggacgtgtggcagttcagcaacgagaaggagcccatggtcgccacccgcaagtccgtggacacgagcttcgacaccaagcgcatcgcgaccatcaccgacacggggatccagaagatcctcctgaactacctgaaggccaagaacaacgacccgaacatcgccttcacccccgagggcatcgccgagatgaacaagcacatcaccgagtacaacaacgggaagcagcaccagcccatcctcaaggtgcgggtctccgagccgaagggcgccaagtaccaggtgggggagaccggcaacaagcgcagcaagttcgtggaggcgcagaaggggacgaacctgtacttcgccatctacgaggacaaggagggcaaccggtcctacaacaccatccccctgaacgaggtcatcgagcgcctcaagcagggcctgagccccgtgcccgacgccaacgagaagtccatcccgctgaagttccacctcagccccaacgacctggtgtacgtccccaagaccgacgaggagaacgagatcaagatggggcagatctacaagttcgtggacagctccggcaccacggccaacttcgtgccccaccgggtcagcaacctgatctacaacgtggacaagaagatcgccgagaacttctgcaaccacgagatcatccagaacgagtacgggatcggctccccgcagagcaagaaccagaagtccatcaccggggagatgatcaaggcggtgtgctggaagctcgaggtcgaccgcctgggcaacatccacaagatcatcaagtga

SEQ ID NO: 1883 - RNA, 4065 nt, synthetic construct
  misc_feature 1..4065: note = Cas9 variant
  source 1..4065: mol_type = other RNA
atgaagaagatcctgggcctcgacctggggaccaccagcatcggctgggccttcatcaaggagcccgagaaggacgtggtcgggtccgagatcgtggacatgggcgtgcgcatcgtcccgctgagctccgacgaggagaacgacttcgccaaggggaacacgatcagcatcaacgcggaccggaccctcaagcgcggcgcccggcgcaacctgcagcggttcaagcagcgccggaacgccctgctcgagaccttcaaggagaagaacctgatcccctccaacttccagtacgccgaggacggccccagctccaccttcagcacgctgaagctccgcgacaaggccgcgaaggagaagatcgagctggacgacttcgtgaaggtgctgctccagatcaacaagaagcgggggtacaagtccagccgcaaggccatgtccgaggaggacgagggcaccgccatcgacagcatggggatcgccaaggagctgtacgagaacgacctgacccccggccagtgggtctacgaggcgctcaagaacgggcggaagaacgtgccggacttctaccgctccgacctgcaggaggagttcaagaagatcgtgaactaccagagcgagttctaccccgacatcctgaacacctccttcgtcgaggactggatgggcaaggccagcacgcccaccaagcagtacttcaacaagcggggcgtgcagctcgccgagaacaaggggaagcgcgaggagcggcgcctgcaggagtacaagtggcgggccgaggccgtgaacttcaagatcgacctgtccgagatcgcgctcatcctgagccagatcaactcccagatcagcaacagctccggctacctgggggccatcagcgaccgctccaaggagctctacttcaagaacctgaccgtcggccagtacctgtaccagcaggtcaagaagaacccccacacccggctcaagggccaggtgttctaccgccaggactacctggacgagttcgagaagatctggagcgtgcagtccagcttctacccgcagctgaacgacgagctcaagcaggaggtgcgggacgtgacgatcttcttccagcgccgcctgaagtcccagaagcacctgatcagcaactgcgagttcgaggagcaccacaaggtcgtgcccaagtcccaccccatcttccaggagttccggatctggcagaacctcaacaacctgaccctgatcaagaaggacaacctcaacgagaagtgcgagctggccctggaggacaagaccgccctcgccaacgagctggcgttcaagaaggagctgagcgtgaaggacgccctcaaggtcctggggctgaagccctccgactgggagttcaacttcaccaagatcgagggcaaccgcacgaaccacgccttcttcgaggccttcgccaagatcatcgagctcgaggacggggagccgatcgacctgggcaacctgaaggcggacgacatcctcgaccagttcagcgaggccttcctgcggatcgggatcgacaccgagctgctccaggtgaactccgacatcgagggcgccgagtacgagaagcagagctacatccagttctggcacctcctgtactccagcgaggacgaccagaagctgaagcagaacctcatccgcaagttcggcttcaagcccgagcacgccaagatcctggcctccatcagcctgcaggacgaccacgcgtccctcagcagccgggccatcaagaagatcctgccccacctccagtccgggctgatctacgacaaggcctgcacctacgccggctacaaccacagctccagcttcaccaaggacgagaacgagaagcgcgagctgcgggcggagctggagctcctgaagaagaactccctgcgcaaccccgtggtcgagaagatcctcaaccagatgatcaacgtggtcaacgccatcctgaaggacccgaacctggggcggcccgacgagatccgcgtggagatggcccgggagctcaaggccaacgccgagcagcgcaagaacatgacgagcaacatcgcgtccgccacccgggaccacgagaagtaccgcgagatcctgaagaaggagttcggcctgaagcgggtgaccaagaacgacctcctgcgctacaagctgtggctcgagaccgacgggatcagcctgtacacgggcaagcccatcgaggcctccaagctgttcagcaaggagtacgacatcgagcacatcatccccaaggcccggctgttcgacgactccttcagcaacaagaccatctgcgagcgccagctgaacatcgacaaggccaacgtcaccgcgttctccttcctgcagaacaagctcagcgccgacgagttcgagcagtaccagtcccgggtcaagagcctgtacggcaagctgtccaaggccaagatccagaagctcctgatggccaacgacaagatcccggaggacttcatcgcccgccagctgcaggagacccgctacatcagcaagaaggcgaaggagatcctcttcgagatcacgatgcgggtgagcgtgaccaccgggaccatcacggacaagctgcgcgaggactggggcctggtggagatcatgaaggagctcaactgggagaagtacgacaagctggggctgacctacaccatcgagggcaagcacggggagcggctcaacaagatcaaggactggaacaagcgcaacgaccaccggcaccacgccatggacgccctgaccgtggccctgacgaagcccgcgtacatccagtacctcaacaacctgaacgccaaggccatcggcaacaagaagggcaccgagatcttcgccatcgagcagaagtacctgaagcgcgagaacgggaagctctgcttcatcccgcccatcgagaacatccgggccgaggcgaagaagcacctgtccaagatcctggtcagctacaaggccaagaacaaggtggtgaccatcaacaagaacaagaccaagaagaaggccggcttcaacgagcagaccgccctcacgccccgcgggcagctgcacaaggagaccgtctacggcaagtccttccactacagcaccaagttcgagaagatcggcgcctccttcgacgcgcagaagatcaacaccgtggccaagaaggaggagcgggaggccctgctcaagcgcctggccgagaacgggaacgaccccaagaaggccttcacgggcaagaacagcctgaacaagatgcccatctacctcgacctggggaagaacatcaagctgtccgagaaggtgaagaccgtcgtgctcgagcagaactacaccatccggaagaacatcgaccccgacctgaaggtggacaaggtcatcgacgtgggcatcaagcgcatcctggagagccggctcgaggagttcgggggcaacgcgaagctggccttctccaacctggaggagaacccgatctggctcaacaaggagaagggcatccccatcaagcgcgtgaagatcagcggggtctccaacgtggagagcctgcacgtgaagaaggaccacttcggcgagaagatcctggacgaggaggggaacgagatccccgtcgacttcgtgtccaccggcaacaaccaccacgtggccatctacgaggacgaggacgggaacctccaggacgaggtcgtgaacttctacgaggccgtgatccggcgcaaccagggcgagagcatcatcaagtaccggcacgaggagggctggaacttcctgtactccatcaagcagaacgagttcttcgtcttcccgagccaggacttcaaccccaacgacttcgacctgctcgaccccaagaactacgacctgatctcccccaacctgtaccgcgcgcagaagttcagcaaggtgatgtacgggaactccgccgtgcgggactacgtcttccgccaccacctcgagacggtgctgaacgacgtgaaggagctgaaggacgtcgcctacaagcagctcaagagcctgcagtacctgaacggcatcaagaaggtgcggctcaaccacctggggcagatcatccaggtgggcgagtactga

SEQ ID NO: 1884 - RNA, 4065 nt, synthetic construct
  misc_feature 1..4065: note = Cas9 variant
  source 1..4065: mol_type = other RNA
atgaccctgcactacaacgtgggcctcgacatcgggaccaacagcgtcggctacacgatcgtggacgacaacgggaagatcctccaggtgaagggcaagaacgggtacggcgtccgcgtgttcaaggagggcgccaccgccgcggagcggcgcatcttccggaccacccaccgccggctgaagcgccggaagtggcgcctccggctgctgcaggacttcttcgagccctacatcctcccgcaggacgacgggttcttcatccgccggaaggagtccaacctggtgctgaacgaccgcgacgaggacacggccagcctcttcaacgaccggtccgaccgcgacttctaccaggcctaccccaccatctaccacctccggcaggccctgatgaccgagaagcgccagttcgacgtccgggagatctacctggccatgcaccacatcatcaagtaccgcggccacttcctgctgaacgggaccgtgaacaacttcacgaacaacaagatcgacctccacagcgacttcgaggagctgaacgcgctgctcctgaacgtgatccccgagctgaagttccagatcgacctcgaccactccaccatgttccagaccaccctgctgaacacgaccatcagccggtccggccgccagcgggacctcgtcaagagcttctacaacgggtccgacgacaagcagctggccaagcagcagaagtccgtggccaccgagctgctcaaggccatcctgggcctgaaggcgaagttccacaagctgttcaacctggacctgctcgagaccacggagtgggagttcagcttcgacgccgaggacatcgacgacaagctggccaagctggagcccctcatgaccgagaaccagcagcaggtcatggacatcctgcagcgcatcttcgccgccatcaccctgaacggcatcgtgccggaggggaagaccctcagcgcgtccaaggtggacagctaccagaagcacaagcaggacctgaagctgctcaaggccatcgcccagcactccgacaagaagacggccaccgtgctgcagaccgcctacaacgagtacatcaacggcatcgcgagcaagcccctgaagcaggaggacttctacaagcgcctcaccaacgccgtcaagaagtccagcgacccccaggtggccgacatgctggccctgatcgaccaggagaagttcctccccaagcagcggacgaaggagaacggggccatcccgcaccagctgcaccagctggagctggagcgcatcatcgacaaccagaaggactactacccctggctcgcggagctgaaccccaaccaggcccggcagaaggtggccaagtacaagctgtccgagctcgtcgccttccgcgtgccctactacgtgggcccgctgatcgagcccgaggtccagcaggccaccagcaacgcgcacttcgcctggatggcccggaaggaggccggccccatcaccccctggaacttcgaccagaaggtggaccgcaacgtgagcgcggagcggttcatcaagcgcatgaccacgaaggacacctacctgctcgccgaggacgtcctgccgctgcactccctcctgtaccagcggttcatcgtgctgaacgagctcaacaacgtccgcgtgaacgggcagaagctgaccaagaagcagaagcaggccgtgtaccaggacctgttcaagcggcagccccacgtcaccaagaagcagttcaagagctacctcgtgcagacgggcgagttcgccgagtccagcaagatcgaggggctggccaacgagacctccttcaacagcggcctgaccaccgagaacgagctccgcaagatcttcggggcgcagctggacgaggcccggtaccaggtggacttcgagcagatcatcgagtgggccacgctgttcgaggacgccaagatcctccgcaccaagctggccgagatcacctggctgaccaccgagcagatcgagaagctcgcgggcatccggtaccgcggctgggggcggttctcccgcaagctgctggccggcctccgggaccagaacgggcagcagatcatcgacctgctgtgggacacgcccaacaacttcatggtcatcgtgagccaggccgccttctccgaggccatcaccaaggagaacgagaagctcatcgaccgccgcggcgcgcaggacgtgatcaccgacctgtacaccagcccccagaacaagaaggccctgcggcaggtcctcgccatcgtggccgacgtgcagaaggcgatgggcggggtcccgccccagcgcatcttcatcgagttcgcccgggaggacgagaagaacccccgccggtccgtggagcgcagccggcagctggagaagctgtaccagacgatctccaacgagttcctcatcaacagcgaggtgcgccaggagctgaaggaggccgtcgaccagaaggtgaacttcaaggaccggctgttcctctacttcctgcagggcggggtggacctgtactccggcaagcgcatcaacatcgaccagctcagccactacgacatcgaccacatcctgccccagtccttcatcaaggacgacagcctggacaaccgggtcctcgtgtcccagaagctgaaccgcagcaagagcgactccgtgccgctgagcgagttcgccaactacaagttcgggcccgccatgcaggcgaagtggctccagctgaaggaggccggcctgctctccaagcggaagtacgacaacctgaccctggaccccaccaagctcagcaagttcgcgcccctggggttcgtcaaccgccagctggtggagacccgccaggtgatcaagctcgccgccaacctgctggcctccgaggagacgaaggtcgtgaccatcaaggccaacatgacccaccaggtgcggaaggagctcgacttcccgaagaaccggaacgtcaacaactaccaccacgccttcgacgcctacctgaccgccttcgtgggcatcttcctgagcaagcgctaccccaagctcaagccctacttcacgtacggcgacttccagaaggggaacaagctgccggacctgaagaacttcaacttcctctacgagctgaagaacaaggaccggtccatcgacagcaacaccggcgagatcatctgggacaagcagcgcgacctggcgtacatgaacaagatctacaacttcaagaaggtgaccgtcgtgcacgaggtgctcaccaagtccggggccctgtacaaccagacgctgtacaaggccagcgaggacaaggcctccggccggggcaccaagcagctcatccgcaagaaggacaacatgcccaccgagctgtacgggggctacaccgggagcacgtccgcgttcatgagcatcgtccgcctgtggaagaaggacaagccctactacaaggtggtgggcatccccacccggatggccgccaagctcgccaaccaggcccagctgctggactacctcaccaagaagttcaccacgcgcaagctggtcaagaagaccggggactacaagaccaccgtggagcggttcgagctggtggtcccgaaggtgggcttcaaccagctcgtgatcgacggcgggcagcccttcatgctgggctccgcgacgtaccagtacaacgcccgcgagctgttcatcagcaaggaggccgtcaaggccctcaacaagcagctgtccacccacgtggacctggtgcaggtcttcgacgagatcctcgtccaggtgaaccggtggttccccctgtacgacaccaacgggttccgcgagaagctgagccacggccgggaccgcttcatgaagctcaacgacagcttcgaggagaagtccgacacccagatcgacgtgctgaaccggatcctgatcgggttccacgccaacgcggcccgcacgaacctcaagatcctgggcctgggcaccgacctggggttcatgacccagcaggccggcatccggctcaccgagaaggccatcctggtgcaccagagcccctccgggctgttcgagcgcaaggtggccctccgggacctgaagggcctgcgctga

SEQ ID NO: 1885 - RNA, 4068 nt, synthetic construct
  misc_feature 1..4068: note = Cas9 variant
  source 1..4068: mol_type = other RNA
atgacctacagcatcggcctggacatcgggaccggctccgtggggtgggccgtcatcggcgacgactaccgcctcaagcgggccaaggggaagaacctgatcggcgtgcgcctgttcgacagcgcgacgaccgccgccgagcggcgcggctaccggaccacccgccggcgcctctcccggcgccactggcggctgcgcctgctcaacgacatcttcgccagcgacctggccgagcaggacgagaacttcctgccccggctcaagtactcctgggtgaacccggacgacgagcagaacccccagctgaacagcgacgtcgcgaacggggccctgttcggctccagcgagacggacaaggccttccacaagaactaccccaccatctaccacctccgccacgagctgatgaccgacaccgccaagcacgacctgcgggaggtgtacctcgcgatccaccacatcgtgaagtaccgcgggaacttcctgaacacggccgacaagatcaacgccgagaactccttcaacgtcgacctgttcatcgccgccctcgacgagtacaacgagttcctggagacccccatcaccagcatcaaggacgcgcagctgttctccgacaagctcaccgacatcaacgcccggaacaagagcgtgcgcgtggagaacgccatgtccgagacgtacgacgacaagagcaagatcttcaaggccatcctgaccgccctggtcggcaacaccgcgaacttccagaccatcttcgacctctccgacctggagaaggacgaggccaagaacttcaagttcaagctggacctcgaggacgtggagacgaagctggacgtggtccgggccaagctgagcgacgagcagaacgccttcctcgaggccgtgctgatcgcgtacgacgggatcaccctgaagatgatcctcggcgactacaagtccatcagccagtccatgatcgagagctacaagagccaccagcgcgactggaagtacatcaagaacaacgtgcggctgaacgagcagaagatcgagccggacaagaactccgtcaagttcttcaagctggaccccaagaagctcatctaccccagcaacctggcctacctccaggtgatctccagcaacgaggacgagcaccgcaagggcctggactacttcaagaccgccatccaggacgccgacatcctgcagcgcatcgagaacgacaccttcctgccccggcagcgcacgaagcggaacggggtgctcccgtaccagctgcacctggccgagctcgagcagatcatcaagaagcagtccaagtactaccccttcctggcgaacatctacacccaggacaacaagaccgagaacaagctgatcggcctcctgaagttccgcgtcccctactacgtggggcccctggtggaggccgagaaggtcaccggcgacggcaagaaccactggctgatcaagaaggagctccaggagaacacgccgatcacccccttcaacttcgacgacgtggtggacaaggacaagagcggggagcagttcatcaagcggatcaccggcaccgactcctacctgatcggggagcccacgctgcccgagaacagcctcctgtaccagaagtacaacgtcctgcaggagctcaacaacgtgcgcaacgagcggcaccagcgcctgccgatcaaggtcaagcaggacatcttcgagcacgtgttcaagatcgacaagaacgtgaacgccaagaaggtcatggcctacctgaagctcaacggctacggggacttccagatcgcgggcctgtccgacacccggaccggcaagttcaacagcaacctgtccagctacaactacttcgtggacctcctggggcgcgagaagaccgagaagatccgggaggaccgcctggaggagatcatcgagatccagacggtgttcgaggacaagatcctcgtcgccaagcggctgtccaacctggacttcctcacgccccaggagaagtccaagctgagcgccaagcactacaccggctgggggcgcctgagccagaagctcctgaccacccagttcatcaagaccgccctgtccgaggccggcgacatcatcccccagagccactccatcatcgacctcctgtactacaccgacaagaacctgatggagatcctcaacgacaagaccttcaacgtgcggaactggctgaccgagcagaacaaggggacggagagcggcaacagcctgtacgaccagatcgacgcgctcgccggccccaaggacatcaagcgcgggatcacccaggtgttctccatcatcgacgacatcaagaaggccatgggcagcaacccggagaccgtctacctggagttcgcccgggagacccagacgtcccgcctgaccaacagccggctcaaccgcgtgcaggagatctacaactcccccgagctgaagaccgagttcgcctacctggcgaagaagctcgaggccgagaccaaggagagcatccacgacgaccgcctgtacctgtactacctccaggaggggcgggacatgtacacgggcaaggagatccccttcgaccagatctccagcaactacgacatcgaccacatcatcccccaggccttcaccaaggacgactccctggacaaccgcgtgctggtcaaccgggccaccaacgcccgcaagagcaactccccgaccttcacgaacgacatcatcgacaaccgcaagagctggtggcagtccctcgtgaagcgggggctgatgagcaaggagaagttcgagcggctgaccgacaagcgcaagaccttctccgagaaccagaccaaccacttcatcgcgcggcagctcgtggagacgcgccagatcatcaagaacgtcgccgacctgatcaagaacaactacgacggcacccaggccgtggccatccgggcgagcctgaccggcgagatgcgccggtacctcgactggcccaagaaccgcgacatgaacgactaccaccacgcccacgacgccctgatgatggccaccgtggggaagtacgtcgaccggcgcggcttcttcgacaacgggtccgtgagcgacggcgccggcaacgcgtacaacctgtacacgaaggactggctcgtggccgcccgggtcgggacccgcaacgacagccagcgggtgaacccctacggcttcatcgtggggtccatgaacagcaaggccgtccgccagcaggtcaacaaggagaccggcgagatcgtgtgggggaacgagaacctggactacctgcggcacgtgctctcctacaagaagatcctggtgacccgccgcctgagcggctccagcggccggctctacgccgagacgctgttctcccccaacccgaaggcgaagctgatcgcccagaaggccaaccgcagcgtggccctctacgggggcttcaccaaggccgagtccgcgtacaccgccctggtcgagttcaacaagaagggggaccggagctacaagctgatcaaggtgcccatggccatcgccaaccgcgtgaacgacaagcagatcaccgtcacggcgtacatcgcctccctcaacctgcgggacttcagccgcgtggtgctggagcacctccccctgggcaccctgatccgggagtccgacgggagcgagttctacgccgcctccagcgagtacaagcacaacgccaaggagctctgggcgccgaaggagatcctgcgctccagcaagaagctggacaaggccaccgccgacaacctcatcgacatcttcgacttcctgaccaacgacaagacgatctccaacttcaagttctacgagaaggacctgctccacctgaagaacgtccgggacaagttcgtggaggccagcgacgagatcaagatcaaggtgctgagcgacgtcatctacgagctccacaacgacgccggctggcgcgaccccttcaagcacatccaggagaagcccgcgtggaccatgctccaggtgaagggcgggatcaagctgtccgagaaggccgccatcgtgtaccagagccccaccggcctgttcgagaccatcacgatcgtcggggagtga

SEQ ID NO: 1886 - RNA, 4071 nt, synthetic construct
  misc_feature 1..4071: note = Cas9 variant
  source 1..4071: mol_type = other RNA
atgaagaagttcgaggagtactacatcggcctggacatggggaccggcagcgtggggtgggccgtgaccgactccgcctacaacatcatcaagcgccacggcaaggcgctctgggggatccggctgttcgagagcgccaagacggccgaggagcgccggatcttccgcacctcccggcgccggaccgagcgccggaagaaccgcctgcacctcctgcaggagatcttcgccgaggagatcagcaagaaggacatgggcttctaccagcggatgaaggagtccaagtactggcacgaggacaagaaggacatcaacggcaacatgcccgagctgccgtacgccctcttcgcggacgacgggttcaccgacaaggactactacaagaagtaccccacgatcttccacctccgctacgccctggccaccaacaccaccgacaagcccgacatccggctgctgtacctggccctccaccacatcatcaagcaccgcggccacttcctgttcgaggggaagaagctgagcgaggtgaaggagttctccacggcgatcgaggccctcgtgcagcaggccgaggagcaggagatcgacctcaagagcctgacccaggaggaggtcctgacccagctggagcacatcatgtccgacgcccagtgcaccaagagcgacaagaagacccaggtgtccaagctgatcgtgggcacggacaagcagaagcagaagcaggagaaggccatcgcggccctcatcaccgggtgcaccgtcaagctgagcgacatcttcgccgaccccgagctggacaaggaggagatctccaagatctgcttcagcgacaacggctacgaggagaaggaggtggagatcgagtccgtgctcgccgaccggttcctgctgatcgccgcggccaagggcgtctacgactggacggtgctccacgacatcctgggggacgcccgcttcctgagcgaggccaaggtgaagacctacgagaagcaccgggacgacctccgcaaggtcaagcagctgctgcggatggacaaggaggtgtacgaggccgtgttcggcgtctccgagaagaacgaggcgaactacagcgcctacatcgggatggccaagaagaacggcaagaagcagccgatcgagaagaagtgctcccaggaggacttctacaagttcctcaagaagcagctggaccgcctgagcgtggacgagatgggccaggagatcatcgacgagctcaaggccgagatggacctggggaccctgttccccaagcagatgatccgggacaacggcgtgatcccctaccagctccacgagaacgagctgaacgccatcctggacaacgcgcagaagttctaccccttcctcctggagaaggaccaggacgggtacaccccggtcgagaagatccagaagatcttccgcttccgcatcccctactacgtgggccccctgaacacggcccaccaggacaagggcgggcacagctggtccgtgcggaagaaggagggcaagatctacccctggaacttcagcgagatgatcgacgaggaggagtccgccaccaagttcatcgagcgcatgaccaacaagtgcacctacctcatcggggaggacgtcctgccgaaggagagcctgctctacgccaagttcaacgtgctgaacgagctgaacaacctgcggatcgacggcgagctcatcgcgcccgagctgaagcaggacatctacaacaacgtgttcaagaagtaccagcgcgtcacggggaagaaggtgaaggactacctgcggatcaacggcgtcatctccaaggagcaggagctcagcgggttcgaccagaacttcaagtccagcctgaaggcctaccacgacttcaagcagatcgtgggcaccggcgtgctgtccgagagcgagcaggaggacatcgtccgcgacatcaccctcttcgccgactcccagaagatgctgaagcagcggatccaccgcaagtaccccatgctgagcgacaagcagatcgcccagctcgccaacaagaagtacgcggggtggggccggctgtcccgcaccttcctggagaacatcgagagcgtgaacaaggagacgggggaggtgatgaacatcatcaccgccctctgggagaccaacgagaacctgatgaagctgctctccggcaagtacgactacaccaagcagatcgagcagtggaacgcccggcagatgaagaagggggagatcgagtaccaggacatcgaggagctgtacgtcagccccgccgtgaagcgcccgatctggcagacgatcaagatcgtgcgggagatcaccaacatcatgggcggcgcccccaagcgcatcttcgtcgaggtggcgcgggagcccggggagaagggcgtgcgcaaggtctcccggcgcaaccagctgctcgacctgtacaaggcctgcaagaaggaggcccccgagctgtacgaccggctcgccaacaaggagagcgacaacgccctgcgctccgacaagctgttcctctactacagccagatggggcgctgcatgtacagcggcgacgcgatcgacctggacgagctgttcaccaaccggtacgacatcgaccacatctacccgcagtccaaggtgatggacgacagcatcgacaaccgcgtgctcgtcaagcgggacctgaactccaagaagaccgacacgttccccgtgagcgaggagtaccgcaaggccggcaaggccctgtggtccaccctcctgaagaaggggctgatcagcaaggagaagtacaagcggctcacccgcaccgagcccttcggcgaggacgagctggccgggttcatcgcgcggcagctggtggagacccgccagtccacgaaggccgtcgcccacctcctggaggaggcctaccccgacgccgagatcgtgtacgcgaaggcccgggccgtgagcgagttccgccacaagttcgacatgatcaaggtccgggaggtgaacgacttccaccacgccaaggacgcctacctgaacatcgtggtcggcaacacctactacgtgaagttcaccaaggacgcggcctggttcgtgcgcaacaacccggggcggacctacaacctcaagaagatgttcgagaacgagacggtcaagcgcggcaacgagaccgcctggatccccggcgacaacgggaccatctgcaccgtgaagaagtggatgcggaagaacaacgtgctgttcacgcgccgggcctacgaggtcaagggcgggctgttcgaccagaacatcctcaagaagggcaaggggcagatccccatcaagggcggcgccgacgagcgcctgcggtcccgcgacaagtacggggcgtacaacaaggccagcggcgcctacttcatgctggtggagtccgacgggaagaagggcgagcggaagcgcaccatcgagttcgtgcccgtctacctcgccaagagcctggaggagtccgtggagctgcgccggcgctactgcgaggaggagctcgggctggtgaacccggacgtccggctgagcaagatccgcaagaacgcgctcatcgacgtggacggcttcaagatgcacctggtgggccggaccgagaaccgcctgctcctgatcggggccacccagctggtcctctccgaggacgaccagcagctgatcaagaagatcggcaagtactgcctggaccaccgggagaacaaggacgccgtgctcagcgagaagtacgagctgacgatggacctgttcgagaagctctacgacatcttcgtgttcaagctggagcagaccgtctacgccgtgaagctgtccaagcaggccaaggacctcaaggaggtgaaggaggagttcctggcgctggacgacgagcagaagtgcctcctgctgatggagatcctccacctgttccagtgcagcccccagctggccaacctcaccaacatcgggggcggcaagagcgccgggtccctgaagatcctgagcgacatcaccaagcagcagtccgtcctcctgatcaaccagagcatcacgggcttctacgagcaggtcatcgacctgaagaccatctga

SEQ ID NO: 1887 - RNA, 4071 nt, synthetic construct
  misc_feature 1..4071: note = Cas9 variant
  source 1..4071: mol_type = other RNA
atggaggtgggcaactactacctggggatcgacgccggcaccgacagcgtcgggtgggccgtgaccgacaaccagtacaacgtgatccgcaagaagggcaagtccctctgggggatccggctgttcgacggcgcgaacacggcccaggagcgccggaccttccgcgccctgcggcgccggaacgagcgcaagaagcagcggatcaacctcctgcaggagctgttctgcaaggagatctgcaagctcgaccccaacttcttcatccgcctgcgggacagctccctgtggagcgaggacaaggaggagaagcagatctactccctcttcaacgacaagaacttcaacgaccgcaactaccacaacaactacaagaccatctaccacctccgggccgacctgatcaagaacaaggagaagcacgacgcccgcctggtctacctggcgatccaccacatcatgaagaaccggggccacttcctgttcaacgggaacatcgagagcgtgacctccttcgagaacacgttcaacgagttcaagaactgcctcctggacgagctggagatcaacctcgagtgcccgagcatctccgagttcgagaacatcctgaaggaccgcaccttcaagggcacccagaagtgcaagaagctgaaggagctctgcagcatcccctccagcgacaagaagctggacaacatcttcaagctgatctccgggctcaaggccgacctgagcatcatcttcgaggacgagtccttcaaggagaacgagcacaacaagatcagcttcgccgactccaactacgaggagacccgggaggtgctgaacagcgagatccaggagaagacgctcatcatcgacatcttcaactccatctacaactgggtcatcctgagcgacatcctgagcggcggggagtacaacggcggcctctacctgtccatcgccaaggtgaacacctacaacaagcacagcaaggacctgaagatcctcaagtccgtgatcaagaagtacttcccccagaagtacaccgacatcttcgcgagcaacaaggagaacaactactgctcctacatcgggatgtacaagagcggcgggaagaagtactccgtcaagaagtgcagcgacaagcccgaggagttctacaagaccatcaagaacatcatcaacaagaacacggccgaggagatctccaacgacaaggacgtgcagtacatcctgagcgagatcgagaacaactccttcctgccgctccagatcaacaagaacaacggcgtgatcccctaccaggccaacaagatcgagctggagagcatcctgaagaacgccgagaactacctccccttcctgaaggagatcgacaccgagtgcaacaagaccacctccgagaagatcatcgacctgttcgagttccgcatcccctactacgtcggcccgctcaacacgagcaagggggagaacgcctggatgatccggaaggaggacggcaccatccgcccctggaacttcgagcagaaggtggacatcgacaagaccgcggccgagttcatcacccggatgacgaaccagtgcacctacctgaacaacgagaccgtgctgcccaagtactccctcctgtacagcgagtacaccgtcctgaacgagatcaacaacatccgcatcaacggggagaagatctccgtggagctcaagcaggacatcttcaacatcctgttcaagaacaacaagcaggtcacgtgcaagaagctgctgagccacctcaactccaacggctacaacctgaagaaggacgacctgagcgggttcgacggcaacttcaagagctccctcagctcctacatcgacctgaagaactacatcttcggcgacaacatcgacaagccccagatctacaacctggccgagaagatcatcctctggatcaccctgtacggggacgacagcaagctgctcaagcgcgtgctgcagaagaactgctccgagcagctgaacccggagcagatcaagaagatcaccaagctcaagttcaagggctgggggcggctgagcaaggccttcctgtccgagctccgcggcgccgaccgggagaccggggagacgatgaccatcatcaagggcctgcgcaacacccagaacaacctgatgcagctcctgagccagaactacaccttcacggaggagtgcgagaagatcaactccggctacttcatcaaccccaacgagatcagctacgactccatcgtgaagaacatcgtggcgagcccctccatcaagcggagcgtctggcagaccatccagatcgtggaggagatccagaaggtgatggggtccaagccccgcaagatcttcgtcgagatggcccggggcgaggaggagaaggtgcgcaccaccagccggaagcagaagctgctcgacctgtacaagaacatctccgacgagtgcgccaaggggatgtacgacgagatctacagcaaggacgagagcgacttcaagaacatccgcctgtacctctactacacgcagatgggctgctgcatgtactccgggaagcacatcgacctgagccagctgtccaacaccaacatctgggaccgggaccacatctacccgcagagcaagaccaaggacgactccctcgacaacctggtcctggtgtacaagagcatcaactccgagaagtccgacgacatcatcagccccaccatccagaacaacatgcgcaccttctggaagctcctgttcgaccggaagttcatcagcgagaagaagtaccaccgcctgacgcggaccacgcccctcaccgacgaggagctggccggcttcatcaaccgccagctggtggagacccggcagtccaccaaggtcatggccagcatcttcaagcgcatctaccccaacaccgagatcatctacgtgaaggcgaagaacgtgtccgacttccggcaccgcaaggactgcgagaacggcgtcaaggtgcgcgagctcaacgactaccaccacgccaaggacgcctacctgaacatcgtggtcgggaacgtgtacagctccaagttcaccaacaacccgctgatgtggctcaagaacaaccggaacgtgaagtacagcctgaaccgcatgtacgacttcaacctgacggtcaacaacgagaacatctgggtggtgggcaacgaggggacccagaagaccgtcaacaagtacctcggcaagaacgacatcctgtacacccggtacgccatgacgaacaagggcgagctgttcgaccagaaccccctcaaggccaccggggacaagtccaagcagaccaccctggtgcccctgaagaagggcaaggaggtgtggaagtacgggggctacaacagcatcacgccctcctacttcatgctcgtcgagagcaaggacaagaaggggaactacatccgcaccatcgagaccatgccgctgtaccgggagaaggagttcagcaagaacgaggagttcctgctcaactactgcaaggaggtgcacaagctgaaggagcccaagatcatcctgaagtgcatcaagaagaacgcgctcctgatcgtggacggcttccccatgcacctgaagggctccaccgggctccagctgaagctgcagggcgccgtccagctcatcctggagagcgacatggtgatctacctgaagaagctcatgaagttcgtgaacgagaacaacatcaacaagaacaagctggaggtcacgccctacatggagctgtccgccaaggagaacatcaagctctacgacatcttcatccagaagctgaccaccgggatctacagcaagcgcccggccaaccccgtggagaagctgatcaacgcgcgggacatcttcatcgagctcaccgtgaaggagcagtgcatcgtcctgtccgagatcctgcacctcttccagtgcaagcccctgacgagcgccaacctggtgtccatcaacctcaagaagaccgtgggcatcatccagatcgccaagaacatcaccgccaagaacgtcaagctggtgcaccagagcccgaccgggatctacgagtacacggtggacctgaacaagatctga

SEQ ID NO: 1888 - RNA, 4071 nt, synthetic construct
  misc_feature 1..4071: note = Cas9 variant
  source 1..4071: mol_type = other RNA
atgaccaagaaggagcagccctacaacatcggcctggacatcgggaccagctccgtgggctgggccgtcacgaacgacaactacgacctcctgaacatcaagaagaagaacctgtggggcgtgcgcctcttcgaggaggcccagaccgcgaaggagacccggctgaaccgcagcacccggcgccggtaccgccggcgcaagaaccggatcaactggctgaacgagatcttctccgaggagctcgccaagacggacccgagcttcctgatccgcctgcagaactcctgggtgagcaagaaggaccccgaccggaagcgcgacaagtacaacctcttcatcgacgggccctacaccgacaaggagtactaccgggagttccccaccatcttccacctccgcaaggagctgatcctgaacaaggacaaggccgacatccggctgatctacctggccctccacaacatcctgaagtaccgcgggaacttcacctacgagcaccagaagttcaacatctccaacctgaacaacaacctcagcaaggagctgatcgagctgaaccagcagctcatcaagtacgacatctccttcccggacgactgcgactggaaccacatcagcgacatcctgatcggccggggcaacgccacgcagaagtccagcaacatcctgaaggacttcaccctcgacaaggagaccaagaagctgctgaaggaggtcatcaacctcatcctggggaacgtggcgcacctgaacaccatcttcaagacgtccctcaccaaggacgaggagaagctgaacttcagcggcaaggacatcgagtccaagctggacgacctcgacagcatcctggacgacgaccagttcaccgtgctggacgccgccaaccgcatctactccaccatcacgctcaacgagatcctgaacggggagagctacttctccatggccaaggtcaaccagtacgagaaccacgcgatcgacctgtgcaagctccgggacatgtggcacaccaccaagaacgaggaggccgtggagcagagccgccaggcctacgacgactacatcaacaagcccaagtacggcaccaaggagctgtacacgagcctgaagaagttcctcaaggtggccctgcccaccaacctggccaaggaggcggaggagaagatctccaaggggacctacctcgtcaagccccggaacagcgagaacggcgtggtgccgtaccagctgaacaagatcgagatggagaagatcatcgacaaccagtcccagtactaccccttcctgaaggagaacaaggagaagctcctgagcatcctgtccttccgcatcccctactacgtcggccccctgcagagcgccgagaagaacccgttcgcctggatggagcgcaagtccaacgggcacgcccggccctggaacttcgacgagatcgtggaccgcgagaagtccagcaacaagttcatccggcgcatgaccgtgacggacagctacctcgtcggcgagcccgtgctgcccaagaactccctgatctaccagcggtacgaggtgctcaacgagctgaacaacatccgcatcaccgagaacctgaagaccaacccgatcgggagccggctcaccgtcgagacgaagcagcgcatctacaacgagctgttcaagaagtacaagaaggtgaccgtgaagaagctgaccaagtggctcatcgcccagggctactacaagaaccccatcctgatcggcctgtcccagaaggacgagttcaacagcaccctcacgacctacctggacatgaagaagatcttcgggtccagcttcatggaggacaacaagaactacgaccagatcgaggagctgatcgagtggctcaccatcttcgaggacaagcagatcctgaacgagaagctgcactccagcaagtactcctacacccccgaccagatcaagaagatcagcaacatgcggtacaagggctgggggcgcctcagcaagaagatcctgatggacatcacgaccgagaccaacacgccccagctgctccagctgtccaactacagcatcctggacctcatgtgggcgaccaacaacaacttcatctccatcatgagcaacgacaagtacgacttcaagaactacatcgagaaccacaacctgaacaagaacgaggaccagaacatctccgacctggtcaacgacatccacgtgagcccggccctcaagcggggcatcacccagtccatcaagatcgtgcaggagatcgtcaagttcatggggcacgcccccaagcacatcttcatcgaggtgacccgcgagaccaagaagtccgagatcaccacgagccgggagaagcgcatcaagcggctgcagagcaagctgctcaacaaggccaacgacttcaagccccagctgcgcgagtacctggtccccaacaagaagatccaggaggagctcaagaagcacaagaacgacctgtccagcgagcggatcatgctgtacttcctccagaacggcaagtccctgtacagcgaggagtccctgaacatcaacaagctcagcgactaccaggtggaccacatcctgccgcgcacctacatccccgacgactccctggagaacaaggccctcgtgctggcgaaggagaaccagcggaaggccgacgacctgctcctgaacagcaacgtcatcgaccgcaacctggagcgctggacctacatgctcaacaacaacatgatcggcctgaagaagttcaagaacctgacccggcgcgtgatcacggacaaggacaagctcgggttcatccaccggcagctggtgcagaccagccagatggtcaagggcgtggccaacatcctggacaacatgtacaagaaccaggggacgacctgcatccaggcccgcgccaacctctccaccgcgttccggaaggccctgagcggccaggacgacacctaccacttcaagcaccccgagctggtgaagaaccgcaacgtcaacgacttccaccacgcccaggacgcctacctcgcgtccttcctggggacctaccggctgcgccggttccccaccaacgagatgctcctgatgaacggcgagtacaacaagttctacggccaggtgaaggagctgtacagcaagaagaagaagctcccggactcccgcaagaacgggttcatcatcagccccctggtgaacggcacgacccagtacgaccggaacaccggggagatcatctggaacgtcggcttccgcgacaagatcctgaagatcttcaactaccaccagtgcaacgtgacccggaagacggagatcaagaccgggcagttctacgaccagaccatctactcccccaagaacccgaagtacaagaagctcatcgcccagaagaaggacatggaccccaacatctacggcggcttcagcggggacaacaagtccagcatcaccatcgtgaagatcgacaacaacaagatcaagcccgtcgccatccccatccgcctgatcaacgacctgaaggacaagaagacgctccagaactggctggaggagaacgtgaagcacaagaagtccatccagatcatcaagaacaacgtgccgatcggccagatcatctacagcaagaaggtcgggctgctctccctgaacagcgaccgggaggtggccaaccgccagcagctgatcctcccgcccgagcactccgccctgctgcggctcctgcagatccccgacgaggacctggaccagatcctcgcgttctacgacaagaacatcctggtggagatcctgcaggagctcatcaccaagatgaagaagttctaccccttctacaagggcgagcgcgagttcctgatcgccaacatcgagaacttcaaccaggccaccaccagcgagaaggtcaactccctggaggagctcatcacgctgctgcacgccaacagcacctccgcccacctcatcttcaacaacatcgagaagaaggcgttcggccggaagacccacgggctgaccctgaacaacacggacttcatctaccagagcgtgaccggcctctacgagacccgcatccacatcgagtga

SEQ ID NO: 1889 - RNA, 4071 nt, synthetic construct
  misc_feature 1..4071: note = Cas9 variant
  source 1..4071: mol_type = other RNA
atgaccaagaaggagcagccctacaacatcggcctggacatcgggaccggcagcgtggggtgggccgtcacgaacgacaactacgacctcctgaacatcaagaagaagaacctgtggggcgtgcgcctcttcgagggggcccagaccgcgaaggagacccggctgaaccgctccacccggcgccggtaccgccggcgcaagaaccggatcaactggctgaacgagatcttcagcgaggagctcgccaacacggacccgtccttcctgatccgcctgcagaacagctgggtgtccaagaaggaccccgaccggaagcgcgacaagtacaacctcttcatcgacaacccctacaccgacaaggagtactaccgggagttccccaccatcttccacctccgcaaggagctgatcatcaacaagaacaaggccgacatccggctggtctacctggccctgcacaacatcctcaagtaccgcggcaacttcacctacgagcaccagaagttcaacatcagcacgctgaactccaacctgagcaaggagctcatcgagctgaaccagcagctgatcaagtacgacatctccttcccggacaactgcgactggaaccacatcagcgacatcctcatcggccgggggaacgccacccagaagtccagcaacatcctgaacaacttcaccctggacaaggagaccaagaagctcctgaaggaggtgatcaacctgatcctcggcaacgtggcgcacctgaacacgatcttcaagacctccctgaccaaggacgaggagaagctcagcttctccgggaaggacatcgagagcaagctggacgacctggactccatcctcgacgacgaccagttcaccgtcctggacacggccaaccgcatctacagcaccatcaccctgaacgagatcctcaacggcgagtcctacttcagcatggccaaggtgaaccagtacgagaaccacgccatcgacctgtgcaagctgcgggacatgtggcacaccacgaagaacgagaaggcggtggggctcagccgccaggcctacgacgactacatcaacaagcccaagtacggcaccaaggagctgtacacctccctgaagaagttcctcaaggtcgccctgcccaccaacctggccaaggaggccgaggagaagatcagcaagggcacgtacctcgtgaagccccggaactccgagaacggggtggtcccgtaccagctgaacaagatcgagatggagaagatcatcgacaaccagagccagtactaccccttcctgaaggagaacaaggagaagctcctgtccatcctgagcttccgcatcccctactacgtgggccccctgcagtccagcgagaagaacccgttcgcgtggatggagcgcaagtccaacgggcacgcccggccctggaacttcgacgagatcgtggaccgcgagaagtccagcaacaagttcatccggcgcatgaccgtcaccgacagctacctcgtgggcgagcccgtgctgcccaagaactccctgatctaccagcggtacgaggtcctcaacgagctgaacaacatccgcatcaccgagaacctgaagacgaacccgaccggcagccggctcaccgtggagaccaagcagcacatctacaacgagctgttcaagaactacaagaagatcacggtgaagaagctgaccaagtggctcatcgcccaggggtactacaagaaccccatcctgatcggcctgtcccagaaggacgagttcaacagcaccctcaccacgtacctggacatgaagaagatcttcgggtccagcttcatggagaacaacaagaactacaaccagatcgaggagctgatcgagtggctcaccatcttcgaggacaagcagatcctgaacgagaagctgcactccagcaactacagctacacctccgaccagatcaagaagatcagcaacatgcgctacaagggctgggggcggctctccaagaagatcctgacctgcatcaccacggagaccaacacccccaagagcctgcagctctccaactacagcgtcctggacctgatgtggaccacgaacaacaacttcatctccatcatcagcaacgacaagtacgacttcaagaactacatcgagaaccacaacctcaacaagaacgaggaccagaacatctccaacctggtgaacgacatccacgtgagccccgccctgaagcgcggcatcacccagtccatcaagatcgtccaggagatcgtgaagttcatgggccacgccccgaagtacatcttcatcgaggtcacccgggagaccaagaagtccgagatcacgaccagccgcgggaagcggatccagcgcctccagagcaagctgctgaacaaggcgaacggcttcaagccccagctccggaagtacctggtgcccaacgagaagatccaggaggagctgaagaagcacaagaacgacctctccagcgagcgcatcatgctgtacttcctgcagaacgggaagtccctctacagcgaggagagcctgaacatcaacaagctgtccgactaccaggtggaccacatcctcccccggacctacatcccggacgacagcctggagaacaaggccctggtcctcgccaaggagaaccagcgcaaggccgacgacctgctgctcaactccaacgtgatcgacaagaacctggagcggtggacctacatgctgaacaacaacatgatgggcctcaagaagttcaagaacctgacgcgccgcgtgatcaccgacaaggacaagctggggttcatccaccggcagctcgtccagaccagccagatggtgaagggcgtggccaacatcctgaactccatgtacaagaaccagggcaccacgtgcatccaggcgcgcgccaacctgagcaccgccttccggaaggccctctccgaccaggacgaccgctaccacttcaagcaccccgagctggtcaagaaccggaacatcaacgacttccaccacgcccaggacgcgtacctggccagcttcctcgggacctaccgcctgcggcgcttccccaccgacgagatgctgctcatgaacggcgagtacaacaagttctacggccaggtgaaggagctgtactccaagaagaagaagctgcccgacagccggaagaacgggttcatcatctccccgctcgtgaacgggacgacccagtacgaccgcaacaccggcgagatcatctggaacgtcggcttccgggacaagatcctgaagatcttcaactaccaccagtgcaacgtgacccgcaagacggagatcaagaccgggcagttctacgaccagaccatctacagccccaagaaccccaagtacaagaagctgatcgcccagaagaaggacatggacccgaacatctacggcgggttctccggcgacaacaagagctccatcaccatcgtgaagatcgacaacaacaagatcaagcccgtcgccatccccatccggctcatcaacgacctgaaggacaagaagacgctgcagaactggctcgaggagaacgtgaagcacaagaagtccatccagatcatcaagaacaacgtgcccatcggccagatcatctacagcaagaaggtcgggctgctgagcctcaactccgaccgcgagatcgcgaaccggcagcagctgatcctgccgcccgagcacagcgccctcctgcgcatcctgcagatccccgacgaggaccccgaccagatcctcgccttctacgacaagaacatcctggtggagatcctgcaggagctcatcaccaagatgaagaagttctacccgttctacaagaacgagcaggagttcctggccagcaacatcgagaacttcaaccaggccaccacctccgagaagatcaacagcctggaggagctcatcacgctgctgcacgcgaactccaccagcgcccacctcatcttcaacaacatcgagaagaaggccttcggccggaagacccacgggctgaccctgaacgacacggacttcatctaccagtccgtgaccggcctctacgagacccgcatccacatcgagtga

SEQ ID NO: 1890 - RNA, 4071 nt, synthetic construct
  misc_feature 1..4071: note = Cas9 variant
  source 1..4071: mol_type = other RNA
atgagcaagaaggactccgagtactacatcggcctggacatcgggaccaacagcgtgggctgggccgtcaccaacgggaagtacgacctcctgaacatcaagaagaagaacctgtggggcgtgcgcctcttcgaggccgcggagtccgccgccgggcggcgcatcaaccggagcacgcgccggcgctaccggcgccggcgcaaccggatcaactggctgaacgagatcttcgccgacgagctgtccaaggtggaccccagcttcctcacccgcctgaactccagctggatctccaagaaggacagctcccggacccgcgacaagtacaacctgttcatggacgccgactacaccgacaagaactaccaccacaagtacccgacgatctaccacctccggcgcgacctgatgttcgacgacaagcagttcgacatccggctggtctacctcgcgctgcacaacatcatcaagtaccgcggcaacttcacctacgaccaccggaagttcaacgtgagcgagatgtccagcaacctgaccaaggccctcgagaacttcaaccaggagctgatggagttcgaggacgccttccccgacaacaccgactactccgccatcagcgaggtgctgctcaagtccaacaacgtcagcacgaagatcgacgagatcatctccaacctggagctggacaaggacaccaagaagtacctcaaggaggtgctgaagctgatcctcggcaacagcgcgaacctgaacaccatcttccacaccagcctggacaaggacgacgagaagctctccctgagcgccaaggacatcgagctgaagctcaacaacctggactccctgctcagcgacgagcagatccacttcatctccagcgccaacgagctgtactccagcatcacgctgaacgacatcctcgacgggaagacctacctgtccctggccaagatcaagcagtacgacacccactgcagcgacctccaggagctgaaggagatgtggtacaagaccacgaaccccgacctgatcaagaagtcccgcaaggcctacaaggagtacgtgcacggcagctacaacaccgaggacttctacaaggcgatctcccccttcctcaagatcgccatcccggaggacctggccaaggacgccctgaagaagatcgacgccaacacctacctccccaagcagcggaccagcaacaacggggtcatccccttccagctgaacctgatcgagctcgagaagatcatcgacaaccagtccaagtactaccccttcctgaaggagaaccgcgagaagatcatcagcatcctgtccttccgcatcccgtactacgtgggccccatccaggcgcccacggacaagaacttcagctggatggtgaagaagatccaggccaaggcccggccctggaacttcgacgaggtcatcgaccgcgagaagtccagcaacaacttcatcaagcggatgaccaccaccgacacgtacctggtgggggagccggtgctccccaagaacagcctgatctaccagaagttcgaggtcctgaacgagctcaacaacatccgcatctccaagaacctgagccaggaccccctgggctccaagctcagcgtggaggtgaagcagcagatcttcgaggagctgttcaagcggtacaagaccgtcaagtccgaccagctgaagaagtggctcatccgcaacagctacttcaccgaccccaccatcatcggcctgtccaagccgagcgagttcaactccagcctgtccacgttcatcgacatgaaggccatcttcgggatggacttcgtgaacaacccccggaacagctcccagctcgaggagctggccgagtggctgaccgtgttcgaggacaagcagatcctcagcgagaagatccgccactccaactacccctacagcgaccagcagatccggaagatctccaacatgcgctaccggggctgggggcgcatcagcaagaagctgctgtgcgacatcaaggtcgagagcaccatctacaagtcccaccagctccacccctacagcatcctggacctgatgtggtccaccaacaacaacttctacagcatcctccacaaggacaagtacaacttcgagtccatcctggaggactacaacctgggcacggacgacaagaccgacatcaacgagctcgtggacaacatccacaccagcccggcgctgaagcggggcatcatccagtccatcaacatcgtgaaggagctggtcaagttcatggggcacgcgccccagcacatcttcctcgagttcacccgcgaggacaagacgagcaccctgtccgagagccggaagaagcgcctgaagaagctctacaacaacctgtccgaggacaccaagaagttcaagctggacctccgggactacctggtgcccgacaagagcatccagaaggagctggagtcccacgacaaggacctcagcaaggagcgcctgatgctgtacttcctccagaacggcaagtccctgtacagcgacgaggccctggacatcaaccggctctccgagtaccaggtcgaccacatcctgccccgcacctacatcaaggacgacagcctggagaacaaggccctcgtgctggccaaggagaaccagcgcaaggccgacgacctgctcctgcagccgtccatcatcaacaagaacatggagcggtggatctacatgaaggaccacgggatgatcagccccaagaagttcaagaacctgacccgcacgaccatcaccgaggacgacaaggtgcacttcatcaaccggcagctcgtccagaccagccagatcatcaagaacgtggccaacatcctggacaacatgtacaaggagcagggcacgacctgcgtggagaccaaggccaacctgtccagcgccttccgcaccgcgttctccgagcaggacgacaagtaccacttcaagcaccccgagttcatcaagaaccgggacgtcaacgacttccaccacgcccaggacgcctacctcgcctgcctgctggggctctaccgcatccagcggttccccagcgacgagatgctgctgatcaagaaggagtaccgcaagttcttcgcccaggcgcagaactccgtgaagaaccacggcaagatcccggacagccagaagaacggcttcatcctcgcgcccctggtgaacggggagacgctgatcaacaacaagaccatggagaccatctggaacatggactacaagcggaaggtcatcaagatcttcaactacaagcagtacaacatcaccaagcgcacggagatcaagaccggcgagttctacaagcagaccctctacagcccccacgacgagaacgtgaagaacccgatcccccagaagaagaacctggaccccaagatctacgggggctactccggggtgcagtccagctacctggccatcatcaaggtcgaccagaagaagcccaccatggtgtccgtgccgatccggttcagcaagatgatcgacgacggcaagctctccctgcagagctggctggagaacaacatcaagcacaagaagacgatcgaggtcctcaagaccaagatccccatcggccagctgacctacaaccccaagaacgggtacctgtccgtgcagagcgagaaggagatcgccaacgcccagcagctgttcctccccttcgagcacgtggccctgctcaccctgctgcacgccccgacgtccgagtacgaccagatcctcagcttctacgacaccgacatcctgctggagatcttcgacgagatcaccaacaagatcaagaccttcttccccttctacatcgacgagcaggagtacctcgtctccatccgcgagaacttccagagcgccacggtgatcgagaaggtgaacgtcctgcagcagctgctcatcatgctgcacgccaacagctcccggatcagcatcaagctgggcgaggtgtccaagaaggacctcgggcgcaagaagaagcggatccccctggagaacaccgacctggtgtaccagagcgtcaccggcctctaccagaccaagttccacatcgactga

SEQ ID NO: 1891 - RNA, 4074 nt, synthetic construct
  misc_feature 1..4074: note = Cas9 variant
  source 1..4074: mol_type = other RNA
atgaacgaccgcaacaagaagtacaacatcggcctggacatcgggaccggcagcgtggggtgggccgtcaccgacaacaactacaacctcctgcacgccaagaagaagaacctgtggggcatccggctgttcgacggggcggagacggccgcctcccgccggaccttccgcagcacccggcgccggtaccgccggcgccggaaccgcatcaactggctgaacgagatcttcgccgacgagctggccaagaaggaccagtccttcctcgtgcggatgaacagctcctgggtgagcaagaaggacaagatccgccagcgggaccagtacaacctgttcatggactccgactacaccgacgtcgagtaccaccgcgagttccccacgatcttccacctccggaagcgcctcatcgaggacaagagccaggcggacatccggctggtgtacctggccctccacaacatcatcaagtaccgcggcaacttcacctacgagcaccagaacttcgacgtgtcccacatggacagcggcctggccctgctcctgaaccagctgaaccagcagctccaggccttcgaggtcgcgttcccggacgagaccaacttcgagtccatgagcaccatcctgctggagaagaagacgcccacccagaagatcgacgagatcgtggaccagatccagcccgagaaggacctcctgcagatcaccaagaacatcatgaagatgctgctcgggaacaaggccgacctggtgaagatcttctccctggacagcgacgacaagatcaccgtcgagttctccagcaactccatcgagcaggacctcagcaacctggaggagacgctgtccgacgagcagttcaacatcatcaccctcgccaacagcatctacagctccatcgtgctgaacgacatcctgagcggcgagacctacctctccttcgccaaggcccggcagtacagcgaccacaagaaggacctggcgaagctgaagaccatgtggcgcgagtcccccgaccgcaaggccgtggggaaggccaagaaggcctacgacgactacctccacagcggcaagtacgggatcgaggacttctacaaggacatgtccaagttcctggagacggccaccccggtcgagctggcgaaggaggccaacgagaagatcctcaacaagagctacctgctgaagcagcggaacaacgagaacggcgtgatccccttccagctcaacaagaacgagatgatcgagatcatcaacaaccaggccaagtactaccccttcctggccgagaacaaggacaagctgctctccatcctgagcttccgcatcccctactacgtgggcccgctgcagtccaagaaggacaaccccttcgcctggatggagaagaagtcccaggggaagatccggccctggaacttcgacgagatcgtcgaccgcgaggcgagcagcaacaacttcatccggcgcatgacctccaccgacacgtacctcatcggcgagcccgtgctgccgctcaagagccccatctaccagaagtacgaggtgctgaacgagctgtccaacgtccggatcaacgccgacgaggtggacaaccccctgggggacaagctgagcgtggacctcaagcaggccatctacaacgagctgttcctgaagcaccgctccgtcagcaaggccctcctgaccaagtggctgatcaaccagagctacttccagaacccccagatctccggcctcgccgacagcaagaagttcaactccggcctgaccacctaccacgacttcaagaagatcttcggggaggacttcgtgaacgacccgacgaaccagagccagctggagcagctcgcggagtggctgaccatcttcgaggacaagaagatcctgaagatcaagctcgacgactcccagttcaactgcacccccgagcagatcaagaagatcgccggcatgcggtaccaggggtggggccgcctgagcaagaagctgctctgcgacatcaagaccacgaccgtgacctccaagaaccaccagcaggccagctactccatcctggacctgatgtggaacaccaaccggaacttcatcagcgtcctcaagaacgacacgtacaagttcgaggacaagatccagaccttcaacctggacaagaacgaggccgcgacgccccaggccatgatcgacgagctgcagacctcccccgccctcaagcgcgggatccggcagagcgtgaccatcatccaggagctggtcaagttcatgggccacgccccggagcacatcttcctggagttcacccgcgaggacgacgtgtccagcctcaccaagtcccgggacagccgcctgaacaagctgtacgcccggatcgcgaagaacaccaagaagaccgacgacgagctcaagaagtccctgctgcccagcagcgacatcaaggccacgctcaaggccaacaagaacaacctgtccaacgaccgcctgatgctctactacctgcagatgggcaagagcctgtactccaaccagcccctcgacatcaaccggctgagcgagtaccagatcgaccacatcctgccccagtcctacatcaaggacaacagcctcgagaaccgcgccctggtgctggcctccgagaaccagcacaagagctccgacctcctgctgaagccggagatcatcaaccagaacatcgcgcgctggcggtacatgaaggacgccgggctcatgggccccaagaagttcaagaacctgacccgcatccagatcaccgacagcgaccagaacaacttcatcaaccggcagctggtccagacctcccagatcatcaagcacgtgagcaacatcctcgactccatgtacggggaccagggcacgcagtgcgtggagacccgcgcccacctgagcaccgagttccggaaggccttctccaacgaggacgacaactaccacttccagcaccccgagttcgtcaagaaccgcaacatcaacgactaccaccacgcccaggacgcgtacctggcctgcctcctggggctgtaccagatgaagaagtaccccaccgacaacatgatcctcctgaagaaggagtacaagcggttcttcagcaacacgaagaagatctacgacaagaagcaccacttcccggactacgtgaagaacggctggatcatcggctccatgttcaacggggagaagtacgtggacgaggagaccggccagatcatctgggaccagcagaccaaggacatggtcagctgcatcttccagtacaagcagtacaacgtgaccaagcgcacggaggccgccaacggggagttctacaaccagaccgtgtacaagaaggaccccaacgagaagcggaagctgatctccctcaagcagggcctggacaccaagctgtacgggggctacagcggcgacaaccccgcgtacatcgtcctcgtgaagatcgacgacaagaagaacaagctggtgaagatgccgatccgcctggccgagcaggtcgacaacaagaccatcgacctccagacgtggctggaggagaacgtgccccacaagaaggggatccaggtgctgaagaccaagatccccctcggccaggtcatctacagcaagaagaacgggtacctggccctgaagtccgacaccgagatcgtgaacgcccagcagctcgtgctgccctacggctacgtcgccctgctcaccctgctgcagaagatgccggagaacaagtacgacgaggtgctcgcgtgctacgacgacggcatcctggacaacatcttcgtggccatcatcgacaagatgaagcacttctacccctactacagcggggagctgaagacgctctccgacaacatcgacaacttcaaggagagccccgacgtcaacaagatcaagaccctgcagcagctgctcctgctgctccacgcctccagcaccaccgcctccatcgagttcaacaacgtgaagaagaacagcctgggccggaagcccaactccatcaacatccagaacacggacctgctcagcttctccgccaccgggctgtacgagagccgcatccacatcgactga

SEQ ID NO: 1892 - RNA, 4074 nt, synthetic construct
  misc_feature 1..4074: note = Cas9 variant
  source 1..4074: mol_type = other RNA
atggccgccaagaactacaacatcgggctggacatcgggaccagctccatcggctgggcgatcgtggacgacaactaccagctcatgcacgccaaggggaagtacggctacgggacccgcatctacagcgagggccagacggccgccgaccggcgcggcttccggaccacccgccggcgcctgaaccggcgcaagtggcggctgcgcctcctgcaggacttcttcgagccctacatcctgccgcaggacgaggccttcttcatccggcagaagcagtccaacctcgtcccccaggacaccaagaagcagtaccccgagagcgtgctgttcgacgacacgtccgacaaggacttctacaccgagtaccccaccatctaccacctccgccaggcgctcatgaccgagaaccggcagttcgacatccgcgaggtgtacctggccatccaccacatcgtcaagtaccgggggcacttcctgaacaacgccccggtgaagacgttcaagagcggcaacctcgacctggccatcaagttcaacgagctgaacgaggagttcaagtccgtgtaccccgacctcgagctgcagttcaacctggaccagatcgacgagatcaagaagatcctcctggacagcaccaagtcccgcttcgaccggcagggggaggcggtcaagctgatctacaccgtgagcgaggtgaagaccatcgagaagctccagaacaagatcgtcaagcagttcctgtccggcatcctggggctcaacacgcgcttcgacgtgctgaccaacaccgagagcgacgactccatgtggaagttcagcctggactccgagagctccgacgacgccctcgacgagatcatcgcccagctggacgaccccgccatccacgtggtcgagctggtgaacgagatccacagctccatcaccctcgccggcatcgtgcccgagggccaggggctgagcgagagcatggtcgagaagtacgaggcgcacaaggcccacctccagctcctgaaggccgtggagaagctggtggacaagaaggccgccgacaagctcgaggtcgcgtacgaccagtacatcaacggcaaggactccaagcagttcatcaaggaggacttctacaaggccgtgcagagcgagatcaagggggtggccggcgacgaggtcgccgagatcaaccagctgatcgagctggaccagttcatgccgaagcagcggacgaaggagaacggcgccatcccccaccagctccaccagcacgagctggacgtgatcatcgagaaccagtccaagtactacgactggctgggggagaaggtgggcaacgagtacaagctcgacaagctggtcagcttccgcgtgccctactacgtcgggcccctggtggacaccgcgtccaaggagaagaaggacgagacccggttcgcctggatggtgcgcaagaacccggagagcaccgaggccatcacgccctggaacttcgaggacatcgtcgacaagaacgcctccgccgagaacttcatcaagcgcatgaccaccaaggacaagtacctcctgaacgaggacgtgctgcccaagtgcagcctcctgacccaggacttcgaggtgtacaacgagctgaacaacatccgggtcaacggcgagaagttcacggcggagcagaagcagctgatccacgacgagctgttcaccaagcacgcctccgtgagcatcaagcagctgaaggacttcctggtgtccgagctcatgtacgtccgcgacaacctgaaggtggaggggctggccgacgagaagaagctcatgagctccctgagcacccagttcgactaccagaagatcatccccgaccagatcaacgacgtgaagtaccgggaggacatcgagcagatcatcgagtggtccaccatcttcgaggacgccgcgatcttcaagacgaagctgaaggagatcgactggctcaccgacgagcagcgcaacaagctggccaacaagcggtaccgcggctggggcagcctgtccaagcggctcctggcctgcctggtcgacgagaacgggcagcgcatcatcgacatcctccgggacagctccgacaacttcatgatgatcgtgaaccgcccggagttcaagcaggccatcttcgacgagaacgccaacctgaccgagaccaacagcaagaaggacatgttcgagatgatcgacaacttctacacgagcccccagaacaagaaggcgatccgccaggtgctgctcgtcgtgcaggacatccagaacgccatgggcggggtggcgccccagaagatcttcatcgagttcgcccgggaggacgaggtcaacggccggcgcaccaactcccggtacagccagatccgcgagatgtactccaaggtgaccgacgacgtgatcaacaagaccgtccgcggggagctggaggccaacaagggcagcctgaacaaggagaagctgttcctgtacttcctgcagggcgggatcgacctctactccggcaagacgatcaacatcgacaacatcagctcctacgacgtggaccacgtgctgccccagagcttcatcaaggacgactccatcaacaacaaggtcctggtgaacgccaaggggaaccgggtgaagaacgacaacgtcccgatggagctgttcggcgccaagatgtaccccacctggaagcggatggtggacaccgggatcatgagcaaggccaagttcaagaacctcaccctgaaccccgacaacgtggacaagttcaaggccgagggcttcatcaaccgccagctcgtcgagacccgccagatcatcaagctggtggcccagatcctgaacgacaagctcggcgacgacacgaagatcgtgtccgtcaaggcgaacctgacccacgacatgcgggtgttcttcgacttccccaagaaccgcaacgtgaacaactaccaccacgccttcgacgcctacctgagcgccttcgtcgggacctacctctacaagcggtacccgaagctgcagccctacttcgtgtacggcgagttcaagaagatggacaagctgaagaacatgacctccttcgacttcctccgcgacctgaagcacacggacaaggtggtcgacaaggacaccggggagatcatcgcggacaagctggccgtgatcaccaacatgaacaagatctacgacttcaagaaggtgctcgtcacccacgaggtgcacgagaacagcggcgccatgtacgaccagacgctgtaccccgccaagctggacaagtccctcggccggaagggggccaagcagctgatccccaagaaggacgacatgccgaccgcgctgtacggcgggtacaccggcagcaaggacgccttcatgtccatcgtgcgcctcaagaagaaggacgaggtctactacaaggtgatcgggatccccgtgcggatcgccgacagcgtccagcacggcaaggaggtggacgtggaggccctgacccagttcatcgagacgaagttcaccaaggagaacctgaacaagaagaccggcgagatcacccgcaaggtcgagtggttcgagctcgtgctgcccaaggtcctgttcgggcaggccgtgttcgacggcgggcagccgttcatgctcggcagctccacgtacccccacaacctgcgggagctggtgctcaccaaggacagcgtcaagaagatcgcggggaaggagtccaacaagagctacctggacgcctacgacgagatcatggaggccatgaacaagtacttccccctgtacgacaccaacaagttccgcgagaaggtgatcgagggccggtccaagttcatcgacctccccgacaaggacgagtacgagaacaacaagctggtgcaggtcggcaagagcaccatcatcgaccgcatgttcatcgggctgcacgccaacgccgcgcggacggacctcaagaacatcggcatcaccaccccgttcgggttcatgcagcaggcctccggcatcaagctgaccaaggacacggtggtgctgttccagagctccaccggcctcttcgagcgcaaggtcgccctgaaggacctgtga

SEQ ID NO: 1893 - RNA, 4077 nt, synthetic construct
  misc_feature 1..4077: note = Cas9 variant
  source 1..4077: mol_type = other RNA
atgaaggagccctacggcgtggggctggacatcggcaccaacagcgtcgggtggaccgtggtggacgcctccggccacgtccgcaagatcaaggggcagacgggcatcggcgtgcggctgttcaaggagggggccgcggccgccgaccgccggggcttccgcaccacccggcgccggctgaagcgcgtgaagtggcggctgcgcctcctgcgggagttcttcgaccagccgatcagcaaggtcgacatcaacttcttcgcccgccggaagtactccgacgtgagcccccgcgaccccaactacaacgggctggagaagaccctcttcaacgaccggtccgaccaggacttctaccacgactaccccacgatctaccacctccgcgaggccctgatgacccagcaccggaagttcgacgtgcgcgagatctacctcgcgatccaccacatcgtcaagtaccggggcaacttcctgcgcaacgacgccgccaccgcctaccggagcgggaccctggacctccagcagcacttcgagacgctgaaccacctgttctcccaggcggacctcgagctgaacctgaacctcaccaccgacgtggccctgctggacagcatcaagcagaccctcgtgcgcacggacatctcccgcagcgaccggcagaagctgatcatgccgctgctcgccgtcctgaccggcgccaccaccgccgagaagaagcgccagaaggcggtggtgacggagttcgccaaggccctggtcggcaacaagaccaagatcgacgtgctcaccctgaccgacatcgacgccacggaggccaaggactgggcgttctccctggaggagaaccaggacaagctccccgggatcgaggaccggttcagcgaggtgggccagcagatcatcgacgaggtcatccgcctgtacgcctccgtgaacctggcccagctcatccccgaggggaagcggttcagccagtccatggtggagaagtacaagcgccacggcgaggacctgaagctgctcaaggcctacatccggagccagtccgacgccaagcgcggccgggcgatccgcgccacctacgaccagtacatcgacggggtcaagagcaagcaggtcacccaggaggccttccagaaggccctgggcaagttcgtggacgccgacgtggacctgaactcctgggcggcccagatcaagcaggccatcgacagcgagcagttcatgcccaagctccggaccaagcagaacggggccatcccgtaccaggtgcagcagaacgagctggaccagatcatcagcaaccagaaggagtactacccctggctgggcgaggagaaccccgtcatcaagcgccgggggaagttcccctacaagctcgacgagctgttcggcttccgcgtgccgtactacgtgggccccctgatcacgaaggagatgcaggcggccaccgccaacgccgggttcgcctggatggtccggaaggcggacggccccatcaccccctggaacttcgacgacaaggtggaccgcgtggcctccgccaccgccttcatccagcggatgcagacgaccgacacctacctcatcggggaggaggtcctgccggcccgcagcctgatctaccagcggttcatggtgctcaacgagctgaacaacatccgcgtggacgacggccagctgacgccccgccagaagcagcggctgtacaaccaggtcttcaagaagcacaagcgcgtgaccgcgaagaacatccaggacaacctcgtggccgcccgggagttccccaccgcgccccgcatcaccgggctggccgacccgaaggtcttcaactccagcctgtccacctaccacgacctcaagcaggtcctgcccgaggccatgagcgacgtgcggaagcaggccgacatcgagaagatcatcctgtggtccacgatcttcgaggacagcaccatcttcaagcagaagctcaccgagatctcctggctgaccgccgcccagctgaagcagctcggccagctgcgctaccggggctgggggcagctgctccgcaagctgctgaccggcctcaaggacgacaacaaccggagcatcatggacgggctgtgggagacgaacgcgaacttcatgcagctgcgctcccagcccgccatcgagaaccagatcaagagcgccaaccaggccaacctcaccaccgccgacctgcaggacaccatcaacgagctgtacacgagcccccagaacaagaaggcgatccgggaggtgatggtggtgctcgccgacatcaaggacgccatgcacggccagaccccgaactggatcttcgtcgaggccgcccgcgggggcggcgtggcggggcggcgcacccagtcccggtccaagcagatcgtggccgcctaccagggcaccgcccaggccatcgtccgcgaccaggtgcagcgggagctgaaggagaagatcaagaacaaggcgaacttcaacacgcgcctggtgctctacttcctgcagaacgggcgggacctgtacaccggcgacgccatcaacatcgaccgcctcagcgagtacgacatcgaccacatcctgccccagtccctggtcaaggacgacagcctcgacaaccgggtgctgaccaacgcccgcatcaaccgcgagaagaacgacaccttcgcctccgagaagttcggcaagaagatgggggcgaagtggaaggagatgcaccggatgggcctgatgacgaagcgcaagctcgaccacctcctgatgcggcccgacgagatcagcaagtacgccaccgggttcatcaaccgccagctggtggagacccggcaggtcatcaagctggtggaggagctgatcaacgccgagtaccccagcaccgccatcgtgtccgtcaaggccaacctcacgcaccagttccgccagaccttcgacttcccgaagatccgggaggtgaacgactaccaccacgcgttcgacgccgccctgaccgccttcatcggcacctacctgctcaagcgctaccccaagctggagcggttcttcgtgtacgggaagttcgccaagcagcccgtcaacctgacgcgcttcaacgtgatccggaagctcgcgaagaccgacaccccgatcaccgacatcgacacgggcgaggtgctgtgggacaagctgaccgacatcaagtacttcgagaccctctacgactacaagcgcctgctggtcacccgggaggtgagcgagaactacggcgccatgttcgaccagacgctcctgaaggcctccgacaacgggaagcgcctgatccggaagaagcagagcttcgacaccgccatctacggcgggtacaccggcaagaccctcgcctacatggcgatcgtgaaggtctccacgaagaaggacgtgcagtaccaggtggtcggggtgcccaccaccatggtgacccagatcgagcagctggagcagcagggcatgacgaacaagcaggccgtcaccaaggtgatcgagcccctgatcgccgccaacaacaagaagatgctcacctacgaggtgctgctgcccaaggtccgcttcgagcaggtcgtgcgggaccgcatcaagggccagacccaccggttcgccctcgggaccgacacgtactaccacaacatccaggagctgtacctgccgctcaccctgcagcgcgcgttcctgggcaagcagaacgagagcgaggtgcagctcaaccagaacctgctgaccgtgttcgacgccaccctcgcccaggtcaaccgctacttccccctgtacgagatgaacaagttcaagaagatcctgaactccgcccgggaccagatcgagctcctggaggcgaagaaccagttcgtgaagaacaagctggtgctcgggaagcagggcatcctgacgaacatgttcatcgggctgcacgccaacgccagctacggcgacctcaaggtcctgggcgtgaagatcgacttcgggaagctccaggtgcccggcgggatcaagctgaccggcgacgccgagatcatctaccagtcccccaccgggctgttcgagcgcaagatcgccctgaaggacctctga

SEQ ID NO: 1894 - RNA, 4077 nt, synthetic construct
  misc_feature 1..4077: note = Cas9 variant
  source 1..4077: mol_type = other RNA
atgaacgagccctacggcgtggggctggacatcggcaccaacagcgtcgggtggaccgtggtggacatgaacggccgcgtccggaaggtgaaggggaagacggccctcggcgcccgcctgttcaaggagggcgcgaccgccgaggaccggcgcgggttccggaccacccgccggcgcctgaagcgggtgaagtggcgcctccggctgctgcgcgagttcttcgaccagccgatctccaagatcgaccccaacttcttcgcccggcgcaagtacagcgacatcagcccccgggaccccaactacaacggcctcgccaagacgctgttcaacgaccgcaccgaccaggagttctaccacgactacccgaccatctaccacctccgggacaagctgatgacctccgaccgcaagttcgacatccgggagatctacctggccatccaccacatcgtcaagtaccgcgggaacttcctgcggacgggccccgcgtcccagtacgggagcgcctccctccacctggccaccagcttccagaagctgaacgacctcttcgcccagtccgaggagagcctgaacttcaagctggtgaccgacgaggcgcagctccagcagatccagcagatcctggtgcgcaccgacctgtcccgcagcgagcagcagcggcagatctggcccctcatggtcgtgctgatgggcgccacggccgccgagaagaagcgccagaaggacttcgccaaggagctggcgaacgccctcgtgggcctgaaggccaagctgaacgtcgtgaccctcaccaacgtggacaccacggtcgtgaaggactggaccttcaccctggaggagtcccaggacaagctgcccgagatcgaggagcagctcagcgaggtggggcagcagatcatggacgaggtcatccagctgtacgcctccgtgaacctggcccagctcatcccggcgggcaagcggttcagccagcacatggtggagaagtacaaccaccacgagaagaacctggagctgctcaaggcctacatccactcccagagcgactccaagcgcgggcgggagatccgcgccacctacgaccggtacatcgacggcgtcaagagcaagcccgtgacgcaggagatgttctacaaggacctgatgaagtacgtggaggccgacgccaccagcaaccacctggcggccgagatcaaggacgagatcgactccgagcagttcatgcccaagctccgcaccaagcagaacggcagcatcccctaccaggtccagcagtacgagctggaccagatcatctcccaccagaagaagtactacccgtggctgggggaggagaaccccgtggccgagcggcgcggcaagttcccctacaagctcgacgagctggtcgggttccgggtgccctactacgtgggcccgctgatcaccaaggaggaccagcaggccacgagcggggccggcttcgcgtggatggtccgcaaggccgacggccccatcaccccctggaacttcgaccagaaggtggaccggatcgcctccgccaccgcgttcatccagcgcatgcagaccacggacacctacctcatcggggaggacgtgctgcccgcccggagcctgatctaccagcgcttcatggtcctcaacgagctgaacaacatgcgggtggaggaccagaagctggccccgcgccagaagcagcggctgtacaaccaggtgttcaagcagcaccagcacgtctccgtgaagaacatccagcagaacctcatggacgccggcgagtaccgcgagacccccaagatcaccgggctggccgaccccaagggcttcaacagctccctgagcacgtaccacgacttcaagaagatcctccccgaggcgatcgccgacgagcacaagcgcgccgacatcgagaagatcatcctgtggtccaccaccttcgaggacagcgccatcttcaagcagaagctggaggaggtggcctggctcaccgacgcgcagcggaagcagctgtccgggctgcgctaccggggctggggccagctcagccacaagctgctgacggccttcaaggacgacaacgggcgctccgtcatggacggcctctgggagaccagcgacaacttcatgcagctgcggaagcagccggccatcgagacccagatcaaggaggccaaccaggccaacctgaccgacgcggacatccaggacaccatcaacgagctctacacgagcccccagaacaagaaggccatccgcgaggtgatgctggtgctggacgacatcaagaacgccatgcacgggcagaccccctcctggatcttcatcgaggccgcgcggggcgggggcgtcgccggccgccggacccagtcccgcagcaagcagatcgtggaggcctacaagagcaccgccaaggagatcgtgtccgagaaggtccagcacgagctcaacgagaagatcaaggccaaggcggacttcaacacgcggctggtgctgtacttcctccagaacgggcgcgacctgtacaccaacgaggccatcaacatcgaccggctgagcgagtacgacatcgaccacatcctcccccagtccctggtgaaggacgacagcctggacaaccgcgtcctcacctccgcccggatcaaccgcgagaagaacgacaccttcgccagcgagaagttcggccggaagatgggggcccagtggcgcgagctgcaccggaacggcctgatgacgcagcgcaagctcaagcacctcctgatgcggccggacgagatctccaagcacgcgaccgacttcatcaaccgccagctggtggagacccgccaggtgatcaagctggtcgaggagctgatcagctccgagtaccccagcgcctccatcgtggccgtgaaggccaacctcacccaccagttccggcagacgttcaacttccccaagctgcgcgaggtcaacgactaccaccacgccttcgacgcgagcctgaccgccttcatcggcatgtacctcctgaagcagtacccgaagctggagcggttcttcgtgtacgggaagttcgccaagcagcccatcaacctcacccgcttcaacgtgatccggaagctggccgtcgcggaggagcccatcgccaacatcgagaccggcgagatcctgtgggacaagacggccgacatcaagtgcttcgagaagctctacaactacaagcgcctgctggtgacccacgaggtgcgggagaactacggggccatgttcgaccagaccatcttcaaggccaccgactcccgcaagcggctcatccagaagaagaagggcttcgcgacggagacctacgggggctacaccggccgcaccctggcctacctggccatcgtcaaggtggtgacgaacaaggacacccagtaccaggtcgtggggatccccaccaccatggtgacgcagatccagcagctcgaggccagcggcctgacctccaagcaggccgtcaccaaggcgatcggggccatgatcaacgagaacaacaagaagctgcagagctacgaggtgctcctgccgaaggtgcggttcgagcaggtcgtgcgcgacgaggtgaagggccacatccaccggttcgccctggggaccgacacgtactaccacaacatccaggagctctacctgcccctgaccatccagcgcgccttcctcggcaagcggaacgacaccgacgcccagaccgagcagaacctgctgacggtcttcgagaccaccctcgcccaggtgaaccgctacttccccctgtacgagatgaacaagttcaagcagatcctgaactccgcgcaggagaagttcgccgccctccccaccaagaacaagaccgtgaagaacaagctggtcacgggcaaggacggggtgctgaacaacctcttcatcggcctgcacgccaacgcgagcctgggggacctcaagatcctgggcatgaagaccgggttcggcaagctccaggtgccgggcgggctgaagctgaccgaccaggccgagatcatctaccagagccccaccggcctgttcgagcggaaggtcgccctcaaggacctgtga

SEQ ID NO: 1895 - RNA, 4077 nt, synthetic construct
  misc_feature 1..4077: note = Cas9 variant
  source 1..4077: mol_type = other RNA
atgaacgagccctacggcgtggggctggacatcggcaccaacagcgtcgggtggaccgtggtggacatgaacggccgcgtccggaaggtgaaggggaagacggccctcggcgcccgcctgttcaaggagggcgcgaccgccgaggaccggcgcgggttccggaccacccgccggcgcctgaagcgggtgaagtggcgcctccggctgctgcgcgagttcttcgaccagccgatctccaagatcgaccccaacttcttcgcccggcgcaagtacagcgacatcagcccccgggaccccaactacaacggcctcgccaagacgctgttcaacgaccgcaccgaccaggagttctaccacgactacccgaccatctaccacctccgggacaagctgatgacctccgaccgcaagttcgacatccgggagatctacctggccatccaccacatcgtcaagtaccgcgggaacttcctgcggacgggccccgcgtcccagtacgggagcgcctccctccacctggccaccagcttccagaagctgaacgacctcttcgcccagtccgaggagagcctgaacttcaagctggtgaccgacgaggcgcagctccagcagatccagcagatcctggtgcgcaccgacctgtcccgcagcgagcagcagcggcagatctggcccctcatggtcgtgctgatgggcgccacggccgccgagaagaagcgccagaaggacttcgccaaggagctggcgaacgccctcgtgggcctgaaggccaagctgaacgtcgtgaccctcaccaacgtggacaccacggtcgtgaaggactggaccttcaccctggaggagtcccaggacaagctgcccgagatcgaggagcagctcagcgaggtggggcagcagatcatggacgaggtcatccagctgtacgcctccgtgaacctggcccagctcatcccggcgggcaagcggttcagccagcacatggtggagaagtacaaccaccacgagaagaacctggagctgctcaaggcctacatccactcccagagcgactccaagcgcgggcgggagatccgcgccacctacgaccggtacatcgacggcgtcaagagcaagcccgtgacgcaggagatgttctacaaggacctgatgaagtacgtggaggccgacgccaccagcaaccacctggcggccgagatcaaggacgagatcgactccgagcagttcatgcccaagctccgcaccaagcagaacggcagcatcccctaccaggtccagcagtacgagctggaccagatcatctcccaccagaagaagtactacccgtggctgggggaggagaaccccgtggccgagcggcgcggcaagttcccctacaagctcgacgagctggtcgggttccgggtgccctactacgtgggcccgctgatcaccaaggaggaccagcaggccacgagcggggccggcttcgcgtggatggtccgcaaggccgacggccccatcaccccctggaacttcgaccagaaggtggaccggatcgcctccgccaccgcgttcatccagcgcatgcagaccacggacacctacctcatcggggaggacgtgctgcccgcccggagcctgatctaccagcgcttcatggtcctcaacgagctgaacaacatgcgggtggaggaccagaagctggccccgcgccagaagcagcggctgtacaaccaggtgttcaagcagcaccagcacgtctccgtgaagaacatccagcagaacctcatggacgccggcgagtaccgcgagacccccaagatcaccgggctggccgaccccaagggcttcaacagctccctgagcacgtaccacgacttcaagaagatcctccccgaggcgatcgccgacgagcacaagcgcgccgacatcgagaagatcatcctgtggtccaccaccttcgaggacagcgccatcttcaagcagaagctggaggaggtggcctggctcaccgacgcgcagcggaagcagctgtccgggctgcgctaccggggctggggccagctcagccacaagctgctgacggccttcaaggacgacaacgggcgctccgtcatggacggcctctgggagaccagcgacaacttcatgcagctgcggaagcagccggccatcgagacccagatcaaggaggccaaccaggccaacctgaccgacgcggacatccaggacaccatcaacgagctctacacgagcccccagaacaagaaggccatccgcgaggtgatgctggtgctggacgacatcaagaacgccatgcacgggcagaccccctcctggatcttcatcgaggccgcgcggggcgggggcgtcgccggccgccggacccagtcccgcagcaagcagatcgtggaggcctacaagagcaccgccaaggagatcgtgtccgagaaggtccagcacgagctcaacgagaagatcaaggccaaggcggacttcaacacgcggctggtgctgtacttcctccagaacgggcgcgacctgtacaccaacgaggccatcaacatcgaccggctgagcgagtacgacatcgaccacatcctcccccagtccctggtgaaggacgacagcctggacaaccgcgtcctcacctccgcccggatcaaccgcgagaagaacgacaccttcgccagcgagaagttcggccggaagatgggggcccagtggcgcgagctgcaccggaacggcctgatgacgcagcgcaagctcaagcacctcctgatgcggccggacgagatctccaagcacgcgaccgacttcatcaaccgccagctggtggagacccgccaggtgatcaagctggtcgaggagctgatcagctccgagtaccccagcgcctccatcgtggccgtgaaggccaacctcacccaccagttccggcagacgttcaacttccccaagctgcgcgaggtcaacgactaccaccacgccttcgacgcgagcctgaccgccttcatcggcatgtacctcctgaagcagtacccgaagctggagcggttcttcgtgtacgggaagttcgccaagcagcccatcaacctcacccgcttcaacgtgatccggaagctggccgtcgcggaggagcccatcgccaacatcgagaccggcgagatcctgtgggacaagacggccgacatcaagtgcttcgagaagctctacaactacaagcgcctgctggtgacccacgaggtgcgggagaactacggggccatgttcgaccagaccatcttcaaggccaccgactcccgcaagcggctcatccagaagaagaagggcttcgcgacggagacctacgggggctacaccggccgcaccctggcctacctggccatcgtcaaggtggtgacgaacaaggacacccagtaccaggtcgtggggatccccaccaccatggtgacgcagatccagcagctcgaggccagcggcctgacctccaagcaggccgtcaccaaggcgatcggggccatgatcaacgagaacaacaagaagctgcagagctacgaggtgctcctgccgaaggtgcggttcgagcaggtcgtgcgcgacgaggtgaagggccacatccaccggttcgccctggggaccgacacgtactaccacaacatccaggagctctacctgcccctgaccatccagcgcgccttcctcggcaagcggaacgacaccgacgcccagaccgagcagaacctgctgacggtcttcgagaccaccctcgcccaggtgaaccgctacttccccctgtacgagatgaacaagttcaagcagatcctgaactccgcgcaggagaagttcgccgccctccccaccaagaacaagaccgtgaagaacaagctggtcacgggcaaggacggggtgctgaacaacctcttcatcggcctgcacgccaacgcgagcctgggggacctcaagatcctgggcatgaagatcgggttcggcaagctccaggtgccgggcgggctgaagctgaccgaccaggccgagatcatctaccagagccccaccggcctgttcgagcggaaggtcgccctcaaggacctgtga

SEQ ID NO: 1896 - RNA, 4077 nt, synthetic construct
  misc_feature 1..4077: note = Cas9 variant
  source 1..4077: mol_type = other RNA
atgaaggagccctacggcgtggggctggacatcggcaccaacagcgtcgggtggaccgtggtggacgcctccggccacgtccgcaagatcaaggggcagacgggcatcggcgtgcggctgttcaaggagggggccgcggccgccgaccgccggggcttccgcaccacccggcgccggctgaagcgcgtgaagtggcggctgcgcctcctgcgggagttcttcgaccagccgatcagcaaggtcgacatcaacttcttcgcccgccggaagtactccgacatcagcccccgcgaccccaactacaacgggctggagaagaccctcttcaacgaccggtccgaccaggacttctaccacgactaccccacgatctaccacctccgcgaggccctgatgacccagcaccggaagttcgacgtgcgcgagatctacctcgcgatccaccacatcgtgaagtaccggggcaacttcctgcgcaacgacgccgccaccgcctaccggagcgggaccctggacctccagcagcacttcgagacgctgaaccacctgttctcccaggcggacctcgagctgaacctgaacctcaccaccgacgtcgccctgctggacagcatcaagcagaccctcgtgcgcacggacatctcccgcagcgaccggcagaagctgatcatgccgctgctcgccgtgctgaccggcgccaccaccgccgagaagaagcgccagaaggcggtcgtgacggagttcgccaaggccctggtgggcaacaagaccaagatcgacgtcctcaccctgaccgacatcgacgccacggaggccaaggactgggcgttctccctggaggagaaccaggacaagctccccgggatcgaggaccggttcagcgaggtgggccagcagatcatcgacgaggtgatccgcctgtacgcctccgtcaacctggcccagctcatccccgaggggaagcggttcagccagtccatggtggagaagtacaagcgccacggcgaggacctgaagctgctcaaggcctacatccggagccagtccgacgccaagcgcggccgggcgatccgcgccacctacgaccagtacatcgacggggtgaagtccaagcaggtcacccaggaggccttccagaaggccctgggcaagttcgtggacgccgacgtggacctgaactcctgggcggcccagatcaagcaggccatcgacagcgagcagttcatgcccaagctccggaccaagcagaacggggccatcccgtaccaggtccagcagaacgagctggaccagatcatcaacaaccagaaggagtactacccctggctgggcgaggagaaccccgtgatcaagcgccgggggaagttcccctacaagctcgacgagctggtcggcttccgcgtgccgtactacgtgggccccctgatcacgaaggagatgcaggcggccaccgccaacgccgggttcgcctggatggtccggaaggcggacggccccatcaccccctggaacttcgacgacaaggtggaccgcgtggccagcgccaccgccttcatccagcggatgcagacgaccgacacctacctcatcggggaggaggtcctgccggcccgctccctgatctaccagcggttcatggtgctcaacgagctgaacaacatccgcgtggacgacggccagctgacgccccgccagaagcagcggctgtacaaccaggtcttcaagaagcacaagcgcgtgaccgcgaagaacatccaggacaacctcgtggccgccggggagttccccaccgcgccccggatcaccggcctggccgacccgaaggtcttcaacagctccctgagcacctaccacgacctcaagcaggtcctgcccgaggccatgtccgacgtgcgcaagcaggccgacatcgagaagatcatcctgtggagcacgatcttcgaggactccaccatcttcaagcagaagctcaccgagatcagctggctgaccgccgcccagctgaagcagctcggccagctgcggtaccgcgggtggggccagctgtcccggaagctcctgaccgggctgaaggacgacaacaaccgcagcatcatggacggcctctgggagacgaacgcgaacttcatgcagctgcggtcccagcccgccatcgagaaccagatcaagagcgccaaccaggccaacctgaccaccgccgacctccaggacaccatcaacgagctgtacacgagcccccagaacaagaaggcgatccgcgaggtgatggtggtgctggccgacatcaaggacgccatgcacgggcagaccccgaactggatcttcgtcgaggccgcccggggcggcggggtggcgggccgccggacccagagccgctccaagcagatcgtggccgcctaccaggggaccgcccaggtcatcgtgagcgaccaggtgcagcgggagctcaaggagaagatcaagaacaaggccaacttcaacacgcgcctggtcctgtacttcctccagaacggccgggacctgtacaccggcgacgcgatcaacatcgaccgcctgtccgagtacgacatcgaccacatcctcccccagagcctggtgaaggacgactccctggacaaccgggtgctcaccaacgcccgcatcaaccgggagaagaacgacaccttcgccagcgagaagttcgggaagaagatgggcgccaagtggaaggagatgcaccgcatggggctgatgacgaagcgcaagctggaccacctcctgatgcggcccgacgagatcagcaagtacgcgaccggcttcatcaaccgccagctggtcgagacccgccaggtgatcaagctcgtggaggagctgatcaacgccgagtacccctccaccgccatcgtcagcgtgaaggccaacctgacgcaccagttccggcagaccttcgacttcccgaagatccgggaggtgaacgactaccaccacgccttcgacgcggccctcaccgccttcatcgggacctacctgctgaagcgctaccccaagctcgagcggttcttcgtctacggcaagttcgccaagcagcccgtgaacctgacgcgcttcaacgtgatccggaagctggccaagaccgacaccccgatcaccgacatcgacacgggcgaggtcctctgggacaagctgaccgacatcaagtacttcgagaccctgtacgactacaagcgcctcctggtgacccgggaggtgtccgagaactacggggcgatgttcgaccagacgctgctcaaggccagcgacaacggcaagcgcctgatccggaagaagcagtccttcgacaccgccatctacgggggctacaccgggaagaccctggcctacatggccatcgtcaaggtgagcacgaagaaggacgtgcagtaccaggtcgtgggcgtgcccaccaccatggtcacccagatcgagcagctcgagcagcagggcatgacgaacaagcaggcggtgaccaaggtgatcgagcccctgatcgccgccaacaacaagaagatgctgacctacgaggtcctcctgcccaaggtgcgcttcgagcaggtcgtgcgggaccgcatcaaggggcagacccaccggttcgccctgggcaccgacacgtactaccacaacatccaggagctctacctgccgctgaccctccagcgcgccttcctggggaagcagaacgagtccgaggtgcagctgaaccagaacctcctgaccgtcttcgacgcgaccctggcccaggtgaaccggtacttccccctctacgagatgaacaagttcaagaagatcctgaacagcgcccgcgaccagatcgagctgctcgaggccaagaaccagttcgtgaagaacaagctggtcctgggcaagcaggggatcctcacgaacatgttcatcggcctgcacgcgaacgcctccttcggcgacctcaagagcctgggggtgaagacctccttcggccagctccaggtgcccgggggcatcaagctgaccggggacgccgagatcatctaccagagccccaccggcctgttcgagcgcaagatcgccctgaaggacctgtga

SEQ ID NO: 1897 - RNA, 4077 nt, synthetic construct
  misc_feature 1..4077: note = Cas9 variant
  source 1..4077: mol_type = other RNA
atgaagcagggcaagcgcgggtactacctgggcctcgacatcgggaccgacagcatcggctacgccgtgaccgacgagcagtaccacctcctgcggttccacgggaacgacgcctggggctcccacgtcttcgacagcgcgtccctctgcgacgagcgccggggcttccgcagcgcccggcgccggctggaccgccggcagcagcgcgtgaagctgctccaggagatcttcgccaaggagatcgccaacatcgacccccggttcttcatccgcctgtccgagagctaccggtggcgcgacgacacggacgaccggtacatctacttcaacgaggaggagtacaccgacatccagtacatgcgcgactacccgaccatccaccacctgatctgcgagctcatggagaacgaggaggagcacgacatccggctggtgtacctggcctgcgcgtggctcgtcgcccaccgcgggcacttcctgtcccagctgagcgtggacaacatcgactccctcatcgacatcgagagcgtgtaccagaagttcctgcacttcttcatcgacaacggctgcgagaacccctggatccaggacgccgagctggtcgggggcatcctcaaggagcacatcggggtgaccgagaagcacaaccggctgggcgagatcatgctgggcaaccgcaagccctccaaggacgtgcgggacacgttcctctacagcgagtactgcatcatccgcctgctggccgggggcacgtgcaagctccgcgacctgtacgggaaggaggagtacgaggacttcggctccgtcagcctggagatggacgacgacaagctcgcggagatcatgatcaacatcggcgaggactacgagctgatcgccgtgctgcggtccctccacgactggagcgtgctggccgacatcctggacgggcagaacggcctcaccaacatctccaccgccaaggtcgccatctacgagcagcacaagaaggacctggcgacgctgaagtacttcatccgcaagtactgccccgagaagtacaacgccatcttcaaggacgcccgggaggacaactacgtggcctacagctaccactacaacaacaagctcgacgggcagatcaagaagaaggccgacaccgagaccttctccaagttcctgatcaagatcatccacagcatcaagccggacaaggaggacgagatcatctaccaggacatggacaaccgcctgggcctccggcagttcctgcccaagcagcgcaacaccgacaaccgggtgatcccccaccagctgtacgagtacgagctcaagaagatcctggagaacgcggccaagtacctgagcttcctcaaccagaaggaggacgggatctccaacacggagaagatcatcagcatcttcaagttcaagatcccctactacgtcggcccgctgaacaagcactccgagttcgcctggatcgaccgcaagagcggcaagatcctgccctggaactacgagaacatgatcgacgacgacgcctccgaggaggccttcatcaagaagatgaccaaccagtgcacctacctccccggggagagcgtgctgcccaaggactccctgtgctaccagaagttcatggtgctgaacgagatcaacaacatcaaggtcgacggccggaagatcagcgtgggggcgaagcagggcatctactccgacctcttcctgaagtacaagaaggtgaagcgcagccagatcgaggagtacctgatctccaacgggcagctcgagaagaaccggcgcgagaccctgagcggcatcgacatccagatcaagtccagcctgtccagccacatcgccttccggcgcctcctggagcagaagatcctgaacgaggccgacgtcgagcggatcatcgagcgcgcctcctacgccgaggacaagggccgggtggcgaagtggctccgcgccaagtacccgcacctgacggaggccgacatcaagtacatctgcaaggtgaagatcaaggacttcgggcggctgagccgcaccttcctcaccggcatcgagggggcctgcaaggagaccggcgaggtcgcgacgatcatctccatgatgtgggagagcaacgacaacctgatggagctgctcagcgagcgctacaccttcgccgacaccatcctggagttcaagtccgactactacaccgagcggaagcagacgctgagcgagcgcctcgacgagatgtacgtgtccaacgccgtccggcgccccatctaccggaccctggacatcgtgaaggacctggagaaggccttcgggaagcccgagaagatcttcatcgagatgacccgcggcgccatgcccgagctcaagggcaagcggaccaagagccgccagcagcagctgctggagtactacgacaagtgcaaggaggaggacgtgcgggacctcaagcagcagctggaggcgctgggggagtacgtcgacaacaagctccagtccgaccgcctgttcctgtacttcatgcagttcggcaagtgcgcctacagcgggatgccgatctccctcgagcggctgatggccggcagcaaggagtacgacatcgaccacatctacccccaggcctacgtgaaggacgactccatcatcaacaacaaggtgctggtcctcagcgtggccaacggcgagaagaaggacgtgtaccccatcaagtccgagatccgcaacaagatgcagaagacgtggagcttctggcaccacgtcgggaccatctccgacgagaagtacaagcggctgatccgcagcacccccttcaccgaggacgagaagtacggcttcatcaaccggcagctgacggagacctcccagagcaccaaggtggtggcggagctcctgaaggagcgctacccggaggccgagatcgtctactccaaggccgggctgatcagcgacttccggcacgagttcgacctctacaagagccgctcctacaacgacctgcaccacgccgtggacgcctacctgaacatcgtggtcggcaacgtgtaccacatgcggttcagccgccagtggttcaacgtgaactccagctactccatcaagaccaagaccctcttcacccacaccgtcaactgcaacgggaaggaggtgtggaacaaggacatgctgcccggcgtgctgaagaccgcgaagaagaacaccgcccacttcacgaagcacgccaccttcaagaccggcgggctgttcgaccagaaccccgtcaagaaggcccccggcctgaccccgctgaaggcggggctccccacggagaagtacggcgggtacaacaaggccggcgtgatgttcttcatccccgtgcggtacaagagcggcaagaagaccgtcctgatggtgctgtccgtggagctcctgtacgggaaccgcttcctggaggacgagatcttcgccaaggagtacgccaaggaccgcctccagcggatgatcggcaagagcgtcgacgagatcgacttccccatcgggatgcgcccgtggaaggtgaacaccatcctgtccctggacggcttccggatctgcatcaccgggaacgccagcggcggcaagtgcctcatcgcgcagcccatcatgcagttctccagcgacgagtactggaagtactacctgaagaaggtggagaagttcgtcgagaaggtgaagaacaactccagctacgtgtacgacgtcgactacgacgccgtgcagcacgaggacaacctgaagctctacgacctgtacctggacaagctccagaactccatctaccgcaagcggatcaacgcccccatccagacgctgatcgaggggcgcgagaagttcatcgactgcagcgtgatcgagcagtgccaggtcctgctcaacatccaccaggtgttcggccggatgacctccgggtgcgacctgaccctgatcggcgggaagacccgcagcgcctccacggtgaacttcagcagcatcatcctcaactggaagaagaactacaccgacgtccggatcatcgaccagtccgccagcggcctgtgggaggtggtgtccgagaacatcctggagtacctctga

SEQ ID NO: 1898 - RNA, 4077 nt, synthetic construct
  misc_feature 1..4077: note = Cas9 variant
  source 1..4077: mol_type = other RNA
atgggcaagatgtactacctggggctcgacatcggcaccaacagcgtggggtacgccgtcaccgacccctcctaccacctcctgaagttcaagggcgagccgatgtggggcgcccacgtgttcgcggccgggaaccagagcgccgagcgccggtccttccgcacgagccggcgccggctcgaccgccggcagcagcgcgtgaagctggtccaggagatcttcgcccccgtgatctcccccatcgacccccggttcttcatccgcctgcacgagagcgccctctggcgggacgacgtggcggagaccgacaagcacatcttcttcaacgacccgacctacaccgacaaggagtactactccgactaccccacgatccaccacctgatcgtcgacctgatggagagctccgagaagcacgacccccgcctcgtgtacctggccgtggcctggctggtcgcccaccggggccacttcctcaacgaggtggacaaggacaacatcggggacgtgctgagcttcgacgcgttctaccccgagttcctggccttcctctccgacaacggcgtcagcccgtgggtgtgcgagtccaaggccctgcaggccaccctgctcagccgcaactccgtgaacgacaagtacaaggccctcaagagcctgatcttcgggtcccagaagcccgaggacaacttcgacgcgaacatcagcgaggacggcctgatccagctgctggccgggaagaaggtcaaggtgaacaagctgttcccccaggagtccaacgacgccagcttcaccctgaacgacaaggaggacgccatcgaggagatcctgggcaccctcacgcccgacgagtgcgagtggatcgcccacatccggcgcctgttcgactgggcgatcatgaagcacgccctgaaggacggccggaccatcagcgagtccaaggtgaagctctacgagcagcaccaccacgacctgacccagctgaagtacttcgtcaagacctacctcgccaaggagtacgacgacatcttccgcaacgtggacagcgagacgaccaagaactacgtggcctactcctaccacgtcaaggaggtgaaggggaccctgccgaagaacaaggccacccaggaggagttctgcaagtacgtgctgggcaaggtcaagaacatcgagtgcagcgaggcggacaaggtggacttcgacgagatgatccagcggctcacggacaactccttcatgcccaagcaggtcagcggggagaaccgcgtgatcccctaccagctgtactactacgagctgaagaccatcctcaacaaggccgcctcctacctgcccttcctgacccagtgcggcaaggacgccatcagcaaccaggacaagctcctgtccatcatgaccttccggatcccgtacttcgtgggccccctgcgcaaggacaacagcgagcacgcctggctcgagcgcaaggcggggaagatctacccctggaacttcaacgacaaggtcgacctggacaagtccgaggaggccttcatccggcgcatgacgaacacgtgcacctactaccccggcgaggacgtgctgccgctcgacagcctgatctacgagaagttcatgatcctgaacgagatcaacaacatccggatcgacgggtaccccatctccgtggacgtcaagcagcaggtcttcggcctgttcgagaagaagcgccgggtgaccgtgaaggacatccagaacctcctgctgagcctcggggccctggacaagcacggcaagctgaccggcatcgacaccaccatccactccaactacaacacctaccaccacttcaagagcctcatggagcgcggggtgctgacgcgggacgacgtggagcgcatcgtcgagcggatgacctactccgacgacaccaagcgcgtgcggctgtggctcaacaacaactacggcaccctgacggccgacgacgtgaagcacatcagccgcctgcggaagcacgacttcgggcgcctctccaagatgttcctgaccggcctgaagggggtccacaaggagaccggcgagcgggcgagcatcctcgacttcatgtggaacaccaacgacaacctgatgcagctgctcagcgagtgctacacgttctccgacgagatcaccaagctgcaggaggcctactacgccaaggcccagctgagcctcaacgacttcctggactccatgtacatcagcaacgccgtgaagcgccccatctaccggaccctggcggtggtcaacgacatccgcaaggcctgcggcaccgcccccaagcggatcttcatcgagatggcccgcgacggggagtccaagaagaagcgcagcgtgacccggcgcgagcagatcaagaacctctaccggtccatccgcaaggacttccagcaggaggtggacttcctggagaagatcctggagaacaagagcgacggccagctccagtccgacgccctgtacctgtacttcgcgcagctcgggcgggacatgtacacgggcgacccgatcaagctggagcacatcaaggaccagagcttctacaacatcgaccacatctacccccagtccatggtcaaggacgacagcctggacaacaaggtgctcgtgcagtccgagatcaacggggagaagtccagccgctaccccctggacgccgccatccggaacaagatgaagcccctgtgggacgcctactacaaccacggcctcatcagcctgaagaagtaccagcgcctgacccggtccaccccgttcaccgacgacgagaagtgggacttcatcaaccgccagctcgtcgagacgcggcagagcaccaaggccctggcgatcctgctcaagcgcaagttccccgacaccgagatcgtgtacagcaaggccggcctgtccagcgacttccggcacgagttcgggctggtgaagtcccgcaacatcaacgacctccaccacgccaaggacgccttcctggcgatcgtcaccggcaacgtgtaccacgagcggttcaaccgccggtggttcatggtgaaccagccctacagcgtcaagacgaagaccctgttcacccactccatcaagaacgggaacttcgtggcctggaacggcgaggaggacctcggccgcatcgtgaagatgctgaagcagaacaagaacaccatccacttcacgcggttcagcttcgaccgcaaggaggggctgttcgacatccagccgctcaaggcctccaccggcctggtcccccggaaggccgggctggacgtggtgaagtacggcgggtacgacaagagcaccgccgcgtactacctcctggtccgcttcaccctggaggacaagaagacgcagcacaagctcatgatgatccccgtggagggcctgtacaaggcccgcatcgaccacgacaaggagttcctgaccgactacgcccagaccaccatctccgagatcctccagaaggacaagcagaaggtgatcaacatcatgttccccatgggcacgcggcacatcaagctgaacagcatgatctccatcgacgggttctacctgagcatcggcgggaagtccagcaagggcaagtccgtcctctgccacgccatggtgccgctgatcgtgccccacaagatcgagtgctacatcaaggccatggagagcttcgcgcgcaagttcaaggagaacaacaagctgcggatcgtcgagaagttcgacaagatcaccgtggaggacaacctcaacctgtacgagctgttcctccagaagctgcagcacaacccctacaacaagttcttctccacccagttcgacgtgctgaccaacgggcgcagcacgttcaccaagctctcccccgaggagcaggtccagaccctgctgaacatcctcagcatcttcaagacctgccggagctccggctgcgacctcaagagcatcaacggctccgcccaggccgcccgcatcatgatcagcgccgacctgacggggctgtccaagaagtacagcgacatccggctggtggagcagtccgcgagcggcctgttcgtgtccaagagccagaacctcctggagtacctgtga

SEQ ID NO: 1899 - RNA, 4083 nt, synthetic construct
  misc_feature 1..4083: note = Cas9 variant
  source 1..4083: mol_type = other RNA
atgaccaagctgggcaagccctacgggatcggcgtggacatcgggagcaactccatcggcttcgccgccgtcgacgagaacagccacctcatccgcctgaaggggaagaccgtgatcggcgcgcggctgttcgaggagggcaaggccgccgccgaccgccgggcctcccgcacgacccggcgccggctcagccgcaaccggtggcgcctgtccttcctgcgggacttcttcgagagccacatcaccccgaccgaccccaacttcttcatgcgccagaagtactccgagatcagccccaaggacaaggcgcggtacaagtacgagaagcgcctcttcaacgaccggacggacgccgagttctaccagcagtaccccaccatgtaccacctccgcacccggctgctgaccgacccgtccaaggccgacgtgcgcgagatctacttcgccatccaccacatcctcaagagccgggggcacttcctgacgtccggctacgcgaaggacttcaacaccaacaaggtcgccctgaacgagatcttccccgccctgcaggacgcctacgcccaggtgtaccccgacctggacatcaccttcgacgagaacaaggtgaacgagttcaagaccgtcctcctggacgagaaggcgacgcccagcgacacccagcgcgccctggtgaacctcctgctggccgaggacggggacaaggacatcctcaagcagcagaagcaggtcctgaccgagttcgccaaggccgtggtgggcctgaagaccaagctcaacgtggcgctggggacggaggtcgactccagcgaggccaccgcctggaacttctccctgggccagctcgacgacaagtgggccggcatcgagagcgccatgaccgacgaggggaccgagatcctggaccagatccgggacctgtaccgcgcgcgcctcctgaacggcatcgtgccggccgggaagacgctgtcccaggccaaggtggacgactacgagcagcaccacgaggacctcgagctgttcaaggactacctgaagcagctcgaggacgacggcatggccaaggccatccggcagctgtacgaccgctacatcgacggcgacgacgcgaagcccttcgtccgggaggacttcgtgaaggccctgaccaaggaggtgaccgcccaccccaacgccaagagccccgagctcctggagcgcctggtccagccggacttcatgctcaagcagcggaacaaggcgaacggggccatccccgtgcagatgcagcagcgcgagctggaccagatcatcaagaaccagtccgtgtactacgactggctggccgcccccaaccccgtcgagaagcaccggcagagcatgccgtaccagttcgacgagctcctgaacttccgcatcccctactacgtgggccccctggtgaccgccaaggagcagaaggcggcccagggcggggtcttcgcctggatggtgcggaaggaccccgacgggaacatcacgccgtacaacttcgacgagaaggtcgaccgcgaggccagcgccaacaccttcatccagcggatgaagaccaccgacacgtacctcatcggcgaggacgtgctgcccaagcagtccctgctgtaccagagctacgaggtgctcaacgagctgaacaacgtccgcgtgaacgacaacaagctgtccttcgaccagaagcagcaggtcctcggcgagctgttcgagcggcacaacaccgtgaccatcaagcagttcgtggacaacctgctcgcgcacggggactacgaccgcatccccgaggtgcggggcctggccgacgagaagcgcttcctgagctccctcagcacctacaaccagctgaaggggatcctgcacgaggccatcgacgactccgacaagcagacggacatcgagaagatcatcgcctggagcaccatcttcgaggacaaggccatcttcaagaccaagctcaacgagatctcctggctgaacgcgggcatgatcaacagcctggccaacatccggtaccgcgggtggggccagttctcccacaagctcctgaacgagctgaccctcagcacgggccggaccgtcttcgaggagctgctgatctccagccacaacctcatgcagatcctgaccgacgaggtgctgaagcagaagatcgccgagctcaacgcccacgagctgaaggcgtccgggatctacgccgccatcgacgacgcctacaccagcccctccaacaagaaggccctgcgccaggtgctcagcgtcatcgacgacatcaccaacgcggccggccaggccccgaactggctgtacatcgagacggccgacggggacggcgtgcccgggaagcgcaccaactcccggcagcgcaagatccaggagatctacgtgaacgccgcgcaggagctgatcaccggcagcgtccggggcgagctcgaggacaagatcgccagccgcgccgacttcaccgaccggctggtgctgtacttcatgcagggcgggcgcgacatctacacgggggagcccctcaacatcgacaacctgtccagctacgacatcgaccacatcctgccccagtccctcatcaaggacaacagcctggacaaccgggtgctggtccacccgctcgtgaaccgcgagaaggacaccatcttcgcctccacccggttcgccaagcagatgaacggcatgtggcgccagtggcacgcggccggcctgatcagctcccggaagctgcgcaacctccagatgcggcccgacgagatcgacaagtacgccagcgggttcgtggcccgccagctggtcgagacccggcagatcatcaagctgacggagcagatcgtggcggaccagtaccccgacgccaagatcatcgccgtgaaggccggcctctccagccagctgcgcaaggagctggacttcccgaagaaccgggaggtcaaccactaccaccacgccttcgacgcgttcctcgccgcccgcatcgggacctacctgctgaagcggtaccccaacctcgagcccttcttcacctacggcaagttcaagaagaccgaggtgaagaagctgaagtccttcaacttcatccgcgacatgacgcacgccaaggacaagatcgtggccaaggagaccggggagatcgtctgggacaacgcgagcgacatcaacgagctggaccggatctacaacttcaagcgcatgctcatcacccacgaggtgcgcttcgagaccgcctccctgttcaagcagacgctgtacgccgccaagaacagcaagaaccggggcggctcccgccagctcatccccaagaagaaggggtacctggtggacatctacggcgggtacacccaggagaccggcagctacctgtccgtcgtgcggctcaccaagaaggccatgtacgcggtggtcaaggtgagcacgcgcgacgccgccaagctggccgtggccaagagcatctccgagcagaaggagaacgagaccctgaagaagatcatcgacgggaagctcagcaagacctccaagaagggcaagaccacgcaccagctgttcgagatcgtcctgccgcgggtgggccagaagaccctcttcaagaacagcaagtacaaccagttcctggtgaactccgacacctacatgcacaactaccaggagctgtggatgccccgcgagtaccagcggatgtggaaggacatcctcctgagcaaccacggggacgcgcagctggagggccagctcgaccagatcttcaagttcatcgtctcccaggtgaacagctacttcaacctgtacgacatcaaccagttccgcaagaagatcgccgacgccaccgacaagttcgccaagctgcccacgcacgacaccgacaacgcgcgggggaagatcgccaccatcggccagctcctgatcgggctgcaggccaacgccatgcgctccgacctccggaacctggacatcaagacccccttcggcctgctccagatcggcacggggatcaccctggacctggacaccagcatcatctaccagtccccgaccggcctcttcgagcgcgaggtgcccctgacggacctgtga

SEQ ID NO: 1900 - RNA, 4083 nt, synthetic construct
  misc_feature 1..4083: note = Cas9 variant
  source 1..4083: mol_type = other RNA
atgaccaagctgaaccagccctacggcatcgggctcgacatcggcagctccagcatcgggttcgccgtggtcgacgccaactcccacctcctgcgcctcaagggcgagaccgcgatcggggcccggctgttccgcgagggcgagagcgccgccggccggcgcgcctcccggacgacccgccggcgcctgagccacaaccggtggcgcctccggttcctgcaggacttcttcgacccgcacatctccagcatcgaccccgacttcttcctgcgccagaagtactccgagatcagccccaaggacaaggagcggttcaagtacgagaagcgcctcttcaacgaccggaccgacgcgcagttctacaagcagtaccccaccatgtaccacctccgcctgcacctcatgaacgacgcctccaaggccgacccgcgggagatcttcttcgccatccaccacatcctcaagagccgcgggcacttcctgacgcccggcgacgcgaagaacttcaacaccgacgacgtggacctcaagcacatcttccccgccctgaccgaggcctacgcccaggcctaccccgacctgaccctctccttcgagccgagcaaggcggagaagttcaagtccatcctgctggacgaggacgccacgagcaacgacacccagaaggccctcgtgaagctgctgctctccgacgacggggacaaggaggtcctgaagcagcagaagaaggtgctgaccgagttcgccaaggccgtggcgggcctcaaggtcaagttcaacgtggccctggggatcgaggtgaccgacgccgacgtcgagaagtggcacttcggcatggcccagctggaggacaagtggagcgacatcgagccctccctcacggaccagggcatggagatcttcgagcagatccaggacctgtaccgggcccgcctgctcaacgggatcgtgcccgcgggcaagaccctgagccaggccaaggtggacgactacgaccagcactgcaaggacctgaagctgttcaaggagtacctgaagcagctgaacgaccacgacctcgccaagcggatccgcctgctgtacgaccgctacatcgacggggacgacgccaagcccttcctccgggacgacttcgtcaaggccctgaagaaggaggtgaccgcgcacccgaccgagctggccgagagcctcctggagcgcatggagcaggacaacttcatgctgaagcagcggacgaaggccaacggctccatccccgtgcagatgcagcagcgcgagctcgacaagatcatcgccaaccaggcggagtactacagctggctggccgccgagaaccccgtcaaggagcaccgggactccaagccctaccagctggacgagctgctcaacttccgcatcccgtactacgtgggccccatgatcaccaagaagcagcaggagaagtccgggcagaacgtgttcgcctggatggtccggaaggaccccagcggcaacatcaccccctacaacttcgacgagaaggtggaccgcgaggccagcgcgaacgccttcatccagcggatgaagaccacggacacctacctgatcggggaggacgtgctgccgaagcagtccctcctgtaccagaagtacgaggtcctgaacgagctcaacaacgtgcgcgtgaacggcgagagcctgtccaccgaccagaagaagcggctgatccgcgagctgttcgagcggcacagctccgtcaccctgaagcagttcgtggagaacctggtcgcccacggggacgtggccaagcgccccgacgtgcggggcctcgccgacgagaagcgcttcctgagctccctgagcacgtaccaccagctccggggcatcctgcacgacgcgatcgacgaccgcgggaagcagtccgacatcgagaacatcatcacctggagcaccgtcttcgaggacgcctccatcttcaagagcaagctgggcgagatctcctggctcgacagcaagacccggacgaccctgagcaacatccgctaccgcgggtggggccagttctcccggaagctgctcgacgggctgaagctgggcaacggccacaccatcatccaggagctcatgctgagctcccgcaacctgatgcagatcctcaccgacgagacgctgaagaaggagatggccaccctgaaccaggagcggctcaagcccgacagcatcaacgaggccatcgacgccgcgtacacctcccccagcaacaagaaggccatccgccaggtgctgaaggtggtcgacgacatcaagcacgccgccaacgaccaggcgccgtcctggctgtacatcgagaccgccgacgggggcgggcaccccggcaagcggacgctcagccgccagaagcagatccaggccatctacgagaacaccgccaaggagctgatcgactccgccgtgcgcggggagctgaaggacaagatcgcggacaagaccaacttcagcgaccggctcgtgctgtacttcatgcagggcggccacgacatctacaccgggaccgccctgaacatcgaccagctctccagctacgacatcgaccacatcctgccccagtccctgatcaaggacgacagcctcgacaaccgggtcctggtgcacgccaagatcaaccgcgagaagaacgccgagttcgcctccacgctgttcgcggccaagatggccagcacctggcaccggtggcgcgacgccggcctcatctccgggcggaagctgaagaacctgctcatgcgccccgacgaggtggacaagtacgccaagggcttcgtcgcgcggcagctggtggagacccgccagatcatcaagctgaccgagcagatcgtggccgcccagtacccggacacgaagatcatcgccgtcaaggcgggcctcagccaccagctgcggcaggagctggacttccccaagaaccgcgacgtgaaccactaccaccacgccttcgacgccttcctcgccgcccggatcgggacctacctgctgaagcgctaccccaacctcgcgccgttcttcacctacggcgagttcaccaagacgaacctgaagaagctgcagagcttcaacttcatcggggccctcacccacaccgacggcaagatcacctccaaggacacgggggaggtgctgtgggacaaccagcgggacatcgaggagctggaccagatctacaacttcaagcgcatgctcatcacccacgaggtctacttcgagaccgccggcctgttcaagcagaccgtgtacgccgccaaggacagcaaggagcgcggcgggtcccggcagctgatccccaagaagaagggctacagcacggggatctacggcgggtacacccaggagaccggctcctacaacgcgctcgtgcgcctgaccaaggccggcaaggtcgtgtaccgggtgttcaagatcagcacgcagaacgccgccgagatcgccgcggcccgctccctgagcgccgaggaggggaacgagcggctctgccagatcctggagcagtccctgctcaagaccaacaaggacaagaagaacaccgtcgacctgttcgacgtggtgatcccccgcctgggcaaggaggccctcttccacaacagcaagtacgggctgttcctggtcaactccgacacctactaccacaactaccaggagctctggctgagccgggagaaccagaagatcctgaagaagctgttctccacgaagtacgaccagagcgagatggaccgcgacgccctgcacctgttcgagaccatcgcgaagcaggtcgagcagttcttcaagctctacgacatcaaccagttccggaccaagatctccagcgccttcgacgccttcgagaagctgcccgtggagggcgaggaggggaaggtggagaccctgaagcagctcctgatcggcctgcacgccaacccggtgcgctccgacctcaagaacctgggcatcaagacgcccttcgggttcctgcaggcgggcaaggggatccacctcgacgacgacaccgagatcatccagcagagccccgccggcctgttcaagcggcgcgtgcggctggccgacctgtga

SEQ ID NO: 1901 - RNA, 4086 nt, synthetic construct
  misc_feature 1..4086: note = Cas9 variant
  source 1..4086: mol_type = other RNA
atgaccaagctgggcaagccctacgggatcggcgtggacatcgggagcaactccatcggcttcgccgccgtcgacgagaacagccacctcatccgcctgaaggggaagaccgtgatcggcgcgcggctgttcgaggagggcaaggccgccgccgaccgccgggcctcccgcaccacccggcgccggctcagccgcaaccggtggcgcctgtccttcctgcgggacttcttcgagagccacatcaccccgaccgggcccaacttcttcatgcgccagaagtactccgagatcagccccaaggacaaggcgcggtacaagtacgagaagcgcctcttcaacgaccggacggacgccgagttctaccagcagtaccccaccatgtaccacctccgcaaccggctgctcaccgacccgtccaaggccgacgtgcgcgagatctacttcgccatccaccacatcctcaagagccggggccacttcctgacctccgggtacgcgaaggacttcaacacgaacaaggtcgccctgaacgagatcttccccgccctgcaggacgcctacgcccaggtgtaccccgacctggacatcaccttcgacgagaacaaggtgaacgagttcaagaccgtcctcctgaacgagaaggcgacccccagcgacacgcagcgcgccctggtgaacctcctgctggccgaggacggcgacaaggacatcctcaagcagcagaagcaggtcctgaccgagttcgccaaggccgtggtggggctgaagaccaagctcaacgtggcgctgggcaccgaggtcgactccagcgaggccacggtgtggaacttctccctgggccagctcgacgacaagtgggccgggatcgagagcgccatgaccgacgagggcaccgagatcctggaccagatccgggacctgtaccgcgcccgcctcctgaacgggatcgtgccggcgggcaagaccctgtcccaggccaaggtcgacgactacgcccagcaccacgaggacctcgagctgttcaaggactacctgaagcagctcgaggacgacggcacggccaaggccatccggcagctgtacgaccgctacatcgacggggacgacgcgaagcccttcgtgcgggaggacttcgtgaaggccctgaccaaggaggtcaccgcccaccccaacgccaagagccccgagctcctggagcgcctggcgcagccggacttcatgctcaagcagcggaacaaggccaacggcgccatccccgtgcagatgcagcagcgcgagctggaccagatcatcaagaaccagtccgtgtactacgactggctggccgcccccaaccccgtcgagaagcaccgcaagagcatgccgtaccagctcgacgagctgctgaacttccggatcccctactacgtggggcccctcgtgaccgcgaaggagcagaaggccgcccagggcggggtcttcgcctggatggtgcggaaggaccccgacggcaacatcacgccgtacaacttcgacgagaaggtcgaccgcgaggccagcgcgaacaccttcatccagcggatgaagaccaccgacacgtacctgatcggcgaggacgtgctgcccaagcagtccctgctctaccagcgctacgaggtgctgaacgagctgaacaacgtccgggtgaacaacgagaagctcagcatcgagcagaagcagcaggtcatccgcgagctgttcgagcggcacaactccgtgaccatcaagcagttcgccgagaacctgcgcgcccacggggactacgcccacatccccgagatccggggcctcgccgacgagaagcgcttcctgagctccctgagcacctaccggcagctcaagtccctgctgcccgacgcgatcgacgacccggccaagcaggccgacatcgagaacatcatcgcctggagcaccgtgttcgaggacgcggccatcttcaagacgaagctcaaggagatcaactggctggactcccagaccatcaccaagctgagcaacatccgctaccgcgggtggggccagttctcccacaagttcctcaacgggctgaccctgggcaacggccacacgatcatccaggagctgttcctgagcaacaacaacctgatgcagatcctcaccgacgagaccctgcagaagaagatgaccgagctgaacgccgacaagctcaaggccgccaacatcaacgacgcgatcgacgacgcctacacctcccccagcaacaagaaggccctgcgccaggtgctgcgggtcatcgaggacatcaagcgggccgccgacgggcaggacccctcctggctctacgtggagacggcggacggcgggggcacccccgggaagcgcacccgggcccgccagcaccagctgcaggagatctacgccaacgccgcccacgagctgatcgacagcgcggtgcggggcgagctcgaggacaagatcgccgacaaggccgacttcaacgaccgcctggtcctgtacttcatgcagggcgggcgggacatctacaccggcacgccgctcaacatcgaccagctgtccagctacgacatcgaccacatcctgccccagtccctcatcaaggacaacagcctggacaaccgcgtgctggtgcacgccatcatcaaccgggagaagaacgcgaccttcgccagcaccatctacgcccagaagatgaacgccacctggcgccagtggcacgaggccgggctcatctccggccggaagctgcgcaacctgcagatgcggcccgaccagatcgacaagtacgcgagcggcttcgtcgcccgccagctcgtggagacgcggcagatcatcaagctgaccgagcagatcgtggccgcccagtacccggagaccaagatcatcgccgtcaaggcggggctgtcccaccagctccgcgaggagctggagttccccaagaaccgggacgtgaaccactaccaccacgccttcgacgccttcctggccgcccgcatcggcacctacctcctgaagcggttccccaacctgcaggcgttcttcacgtacgggaagttcaagaaggccgacgtgaagaagctccgcggcttcaacttcatccgcgacatcacccacgccgaggacaagatcgtcgtgaaggacaccggggaggtgatctgggacaagaagcgggacgtcgacgagctggaccgcatctacaacttcaagcggatgctgatcacccacgaggtgcacttcgagaaggccgacctcttcaagcagacggtgtacggcgccaaggacagcaaggaggcgggcgggaagaagcagctgatctccaagaagaagggctaccccgtcgacatctacgggggctacacccaggagaccgggagctacctgtccgtggtgcgcctcaccaagaaggccatgtacgccgtcgtgaaggtgagcacgcgggacgccgcgaagctggccgtcgccaagtccatcagcgagcagaaggagaacgagaccctgaacgacatcatcgacgagaagctctccaagatcagcaagaacggcaagatcacccacgagctgttcgaggtggtgctgccgcgcgtcggccagaagaccctcttcaagaactccaagtacaacctgttcctggtgaacagcgacacgtacatgcacaactaccaggagctctggatgccccgggagtaccagaagatgtggaaggacatctccctgagcaagtacggggacgcccagaccgaggaccagctggaccagatcttcggcttcatcgtgtcccaggtcaacagctacttcaacctctacgacatcaaccagttccgcaagaagctgaacgacgccgcggacaagttcgccaccctgcccatgcgggacaccgacgacatgcaggggaagatcgccacgatcggccagctcctgatcgggctgcaggccaacgccgcgcgcagcgacctccggaacctggacatcaagacgcccctgggcctcctgcagatcccgaacggcatctccctggacagcgacacctccgtggtgtaccagagccccaccgggctcctggagcgcgaggtccacctgtccgacctctga

SEQ ID NO: 1902 - RNA, 4086 nt, synthetic construct
  misc_feature 1..4086: note = Cas9 variant
  source 1..4086: mol_type = other RNA
atgaagaagccctacagcatcggcctggacatcgggaccaactccgtgggctggagcgtcgtgaccgacgactacaaggtgccggccaagaagatgaaggtcctcgggaacacggacaaggagtacatcaagaagaacctgatcggcgccctgctgttcgactccggggagaccgcggaggccacccgcatgaagcggaccgcccgccggcgctacacgcggcgccggaaccgcatcctgtacctgcaggacatcttcagccccgagctcaaccaggtggacgagtccttcctgcaccggctggacgacagcttcctcgtggccgaggacaagcgcggcgagcggcacgtcatcttcggcaacatcgccgacgaggtgaagtaccacaaggagttccccaccatctaccacctccgcaagcacctggcggactccagcgagaaggccgacctccggctggtgtacctggccctcgcccacatcatcaagtaccgcgggcacttcctgatcgacgagcccatcgacatccggaacatgaactcccagaacctgttcaaggagttcctcctggcgttcgacggcatccaggtcgactgctacctggccagcaagcacaccgacatctccgggatcatcaccgccaagatcagcaagtcccgcaaggtggaggccgtgctcgagcagttcccggaccagaagaagaacagcttcttcggcaacatggtctccctggtgttcgggctgatgcccaacttcaagagcaacttcgagctcgacgaggacgccaagctgcagttctcccgggacagctacgacgaggacctggagaacctcctgggcatcatcggcgacgagtacgcggacgtgttcgtcgccgccaagaaggtgtacgactccatcctgctcagcgggatcctgacgaccaacaaccacagcaccaaggcgcccctgtccgccagcatgatcgaccgctacgacgagcacaactccgacaagaagctcctgcgggacttcatccgcaccaacatcggcaaggaggtgttcaaggaggtcttctacgacacgagcaagaacgggtacgccggctacatcgacggcaagaccaaccaggaggacttctacaagtacctgaagaacctcctgcagaaggtggacgggggcgactacttcatcgagaagatcgagcgggaggacttcctgcgcaagcagcgcaccttcgacaacgggtccatcccccaccaggtgcacctcgacgagatgaaggccatcctgcggcgccagggcgagttctacccgttcctgaaggagaacgccgagaagatccagcagatcctcaccttcaagatcccctactacgtcgggcccctggcccggggcaacagccgcttcgcctgggcgtcctacaacagcaacgagaagatgacgccctggaacttcgacaacgtgatcgacaagacctccagcgcccaggccttcatcgagcggatgaccaacaacgacctgtacctcccggaccagaaggtgctgcccaagcactccctgctctaccagaagttcgccgtctacaacgagctgaccaagatcaagtacgtgacggagaccggcgaggcccgcctgttcgacgtcttcctgaagaaggagatcttcgacgggctgttcaagaaggagcggaaggtgaccaagaagaagatcctgaacttcctggacaagaacttcgacgagttccgcatcaccgacatccagggcctcgacaacgagacggggaacttcaacgcgagctacggcacctaccacgacctgctgaagatcatcggggacaaggagttcatggactccagcgacaacgtggacgtcctcgaggacatcgtgctgtccctgaccctcttcgaggaccgggagatgatcaagcagcgcctgctgaagtacgaggacatcttcagcaagaaggtgatcgccaacctcacccggcgccactacacgggctggggccggctgtccgccaagctgatcaacgggatcaaggacaagcacagccgcaagaccatcctcgactacctgatcgacgacggccactccaaccggaacttcatgcagctgatcaacgacgacaacctcagcttcaaggacgagatcgccaacagccaggtcatcggggacggcgacgacctgcaccaggtggtgcaggagctggcggggtcccccgccatcaagaagggcatcctccagagcctgaagatcgtcgacgagctggtgaaggtgatgggctacaaccccgagcagatcgtcgtggagatggcccgcgagaaccagaccaccgcccgggggcgcaacaactcccagcagcggctcggcagcctgacgaaggccatccaggacttcgggtccgacatcctgaagcgctacccggtggagaacaaccagctccagaacgaccagctgtacctgtactacctccagaacggcaaggacatgtacaccggcgacaccctggacatccacaacctgagccagtacgacatcgaccacatcatcccccagtccttcatcaaggacaacagcctcgacaaccgcgtcctgaccaactccaagagcaaccgggggaagtccgacaacgtgcccagcaacgaggtggtcaagcgcatgaagggcttctggctgaagcagctcgacgcgaagctgatctcccagcggaagttcgacaacctgacgaaggccgagcgcgggggcctcagcgccgaggacaaggccgggttcatcaagcggcagctggtggagacccgccagatcaccaagcacgtggcccggatcctggacgagcgcttcaaccgggacttcgacaagaacgacaagcgcatccggaacgtcaagatcgtgaccctcaagtccaacctggtgagcaacttccgcaaggagttcggcttctacaaggtccgggagatcaacaacttccaccacgcgcacgacgcctacctgaacgccgtggtggccaaggccctcctgatccgctaccccaagctggagccggagttcgtctacggcgagtaccccaagtacaactcctaccgggagcgcaagagcgcgaccgagaagatgttcttctacagcaacatcatgaacatgttcaagacgaccatcaagctcgccgacgggcgggtggtggagaagcccgtcatcgaggccaacgaggagaccggcgagatcgcctgggacaagaccaagcacttcgcgaacgtgaagaaggtgctgtcctacccccaggtcagcatcgtgaagaaggtggaggagcagaccgggggcttctccaaggagagcatcctgccgaagggcgggtccgacaagctcatcgcccgcaagacgaagaacaactacctgagcacccagaagtacggcgggttcgactcccccaccgtcgcctacagcatcatgttcgtggccgacatcgagaagggcaagtccaagcggctgaagacggtgaaggagatgatcgggatcaccatcatggagcgcagccggttcgagtccaacagcgtcaccttcctcgaggagaagggctaccgcaacatccgcgagaacaccatcatcaagttccccaagtactccctgttcgagctggagaacgggcggcgccggctcctggccagcgcgatcgagctgcagaagggcaacgagatgttcctcccccagcagttcgtgaacctgctgtaccacgcccagcacgccaacaaggaggactccgtgatctacctcgagaagcaccgccacgagctgagcgagctgttccaccacatcatcggcgtctccgagaagacgatcctcaagccgaaggtggagatgaccctgaacgaggccttcgagaagcacttcgagttcgacgaggtgagcgagctggcccagtccttcatcagcctcctgaagttcaccgcgttcggggcccccggcgggttcaagttcctggacgccgacatcaagcagagcaacctccggtaccagaccgtcacggaggtgctgtccagcaccctgatccaccagtccgtgaccggcctctacgagacccgcatcgacctgagcaagctcgggggcgagtga

SEQ ID NO: 1903 - RNA, 4086 nt, synthetic construct
  misc_feature 1..4086: note = Cas9 variant
  source 1..4086: mol_type = other RNA
atgggcaactactacctggggctcgacatcggcaccaacagcgtggggtgggccgtcaccgacgagaactacaacatcgagcgcttcaagaagaagaacatgtggggcatccggctgttcgacgaggccaagacggcggagtcccgccggatccaccgccaggcccggcgcatgcggcagcgcaagatccagcggctgaacctcctgatggagctgttcgacgtggagatcagcaaggtggacgagtccttcttcatccgcaagaaggagagcgacctccactacgaggacaagtcccaggacagccggtacgccctgttcaacgacaaggagttcaacgacaaggactaccacaacaagtaccccaccatcttccacctgatcatggacctcatcgagaacgacgagaagaaggacatccgcctgctgtacctcgcctgccactacctgatcaagaaccgggggcacttcatcttcgagggccagaagttcgacgtcaactccagcctgaacaacaacatcaacaagctcaagtcccacctggaccagttctacaacatctgcctggacttcgacaacgacaagctcatcgagatcctggtgaaccagaacctgaacatcagcgagaagtccaagaagatcaaggagctcctgcgcaagaccaacctggaggtgggcatcgccaacctcatcgccgggggcagcatcaagctgtccaacatgttcgacgacgacgagctgaagaacctcgactacaacagcctgtccttcaagaacagcaacttcgacgaggggcgggagctgttcgaggaggtcctcgaggaccgcttcgagctggtggagatcctgaaggacatccacgacgcgtccgtgctcgagaccatgctgagctccgccagcatcagcccggacggcgggaagtacatctccagctccatgatcaacagctacaacaagcacaagcgggacctgaagctcctgaagaagatcatcaagaagtacaagaagtccgagtacgacaacatcttccgcgacgagaacatcaagaacaactacctgagctacacgcggaccggcatcaacaagaacaagaaggtccaggccgaggacaacaccgactccgacggcttctacaagtacatcgtgaagatcctcaaggacatcaaggagaacgacagcgacgaggacatcaagtacatcctgtccgagatcgacaagaagaacttcgtgcccaagcagcgcaccaaggagaacagcgtcatcccctaccagctgcgggagatcgagctccgcaagatcatcgacaaccagtccaagtaccacaagttcctgaacgaggtggacgagaaggggatcagcgtgaaggagaagatcatctccctgctcacgttccgcatcccctactacatcggcccgctgaaccccagctacaacgaggagaagaacttcaccacctcctgggtcaagcggctggcgaaggggaaggtgaccccctggaacttcgaggacatggtggacatcgacgccagccgcgaggccttcatcgagaacaagctcaacaagtgctccttcctgctggacgagacggtcctgcccaaggacagcctcctgtaccaggagtacatggtgctgaacgagctcaacaacctgaagatcaacggccagtccatcaacaccgacctgaagaagtccatctacgaggagctgttcaagaagtacaagaaggtgacccggaagcgcctgatcagctacatcaaggagaaggagaacatgagcggcgacatcgtcatcaccgggatcgacggcgacttcaagcaggggctcaagagctacatcgccttcaaggacatcatcggcgagaagatcgacgacgacatctaccggaaggaggtggagaagatcatccgcgacatctccctctacggggacgacaagagcttcatccagaagaagatcaagaacgagaacaagctggacctgtccgacgaccagatcagcaagatcgccaagctcaagttcaaggactggggccggttctccaagaagctgctggtgggcatcaaggcgagcgacaagaacacgggggagatcgacaacatcatcggcttcatgcgcaactacaactacaacatcatgcagctcatggccaacgtcttcaccttcaaggacgagatcgagaagctgaactccaagtactacaccgacgagaagatcaacatcgactacctggacgacctctacctgagctccccggccaagcggatgctgtggcagagcttccagatcgtggacgagatcaagaacatcaagaactccgaccccaagaagatcttcatcgagatggcccgcagcaaggaggacaagcccacccggaagatgtcccgcaagagccggctcgagaagctgtacacggactccaagaagcagttcatcaagctgttcgggcccgacgagtacgacaagctcaacaacgagatcaagaacaagagcgagagcgacttccgctgggacaacctgtacctgtactacacccagttcggccggtgcatgtactccctcgacccgatcgacctggaggagctgagcaacaagaacctctacgaccaggaccacatctaccccaagtccaagatctacgacgacagcatcgagaaccgcgtcctggtgaagaagcagctgaacctcgacaagtccaacgagtaccccatccccgaccgggtgctgaacaaggacaagaacaagctgctcgccttctggaagatgctgaacgagaaggagctgatcggggacaagaagtacgcgcgcctcatccgcaagagcccgttcaccgacgaggagctgggcgacttcatcgcccggcagctggtcgagacccgccaggccacgaaggagaccgccaacatgctcaagcggctgtgccccgactccaagatcgtgtacgtgaaggccaagaacgtcagcgacttccgccggaagttcgacatcctgaagtgccgctccatcaacgacctccaccacgcgcacgacgcctacctgaacatcgtggtgggcaacgtcttcgacaccaagttcaccagcaaccccctgaacttcatcaagaacaactccaagaaccggagctacaacctcgagaagatctacgactacgacgtgatccgcaacgagaagatcgcctggctggccgagcggaaggaggagaaccaggacgggtccatcgccacggtgctgaagaacctcagcaagaacgacatccgcgtcacccggcgcacctacatcaagtgcgaggacctgttcgacgagaacatcgtgcggaagggcaacgggaagttccccatcaaggagaacaacaacaagtccgacaccaacaagtacggcgggtacagcggcatcaagaacgcgtacttcgtgctgctcgaggacgagaagcacaaccgcatcctggaggccatcccgtccttcatctacaagaaggagaagaacggcgagaaggggagcgtcatcaactacctgcagaacatcctcggcatcaagtccgccaagatcctgcgggacaagatcaagatcgggagcctgctcaagatcgacaagttcccctacaacctggccggcaagagcggcaacgggatcctgatctccggcggggtgcagctcatcctggacaagaacacgagcaagtacatcaagaagatcgagaactacaagtacaagctggacgagaacaaggactaccagatcaacatcttcgacaagctctccaaggaggagaacatcaagctgttcgacctgttcgtggacaagttcgagaacagcatctacaagaaccgcgtcaacatcaagctcaaggagatcaagctggcgcggcccaagttcgagcacctgtccatcgaggagcagatcaagaccctcacccagatgctgatcctgttcggccgcgagaacaacgccgtgaacctcgagtacatcgggctgcccaagaacaccggcaagacgaagatcaacaagaagatcaacaacaaggacatcaagatcatcaaccagagcatcaccggcctgtacgagaccgaggaggacctcgccaacatctga

SEQ ID NO: 1904 - RNA, 4086 nt, synthetic construct
  misc_feature 1..4086: note = Cas9 variant
  source 1..4086: mol_type = other RNA
atgaccaagctgaaccagccctacggcatcgggctcgacatcggcagcaactccatcgggttcgccgtggtcgacgccaacagccacctcctgcgcctcaagggcgagaccgcgatcggggcccggctgttccgcgagggccagtccgccgccgagcggcgcgagagccggacgacccgccggcgcctgtcccggacccgctggcggctcagcttcctgcgcgacttcttcgccccgcacatcaccaagatcgaccccgacttcttcctgcggcagaagtactccgagatcagccccaaggacaaggaccgcttcaagtacgagaagcggctgttcaacgaccgcacggacgcggagttctacgaggactacccctccatgtaccacctccggctgcacctgatgacccacacccacaaggccgacccgcgcgagatcttcctggccatccaccacatcctcaagagccggggccacttcctgacccccggggccgcgaaggacttcaacacggacaaggtggacctggaggacatcttccccgccctgaccgaggcctacgcccaggtgtaccccgacctcgagctgaccttcgacctggccaaggcggacgacttcaaggccaagctcctggacgagcaggccaccccgtccgacacgcagaaggccctggtcaacctcctgctgagctccgacggcgagaaggagatcgtgaagaagcgcaagcaggtcctcaccgagttcgccaaggcgatcaccgggctgaagaccaagttcaacctggccctcggcacggaggtggacgaggccgacgccagcaactggcagttctccatggggcagctggacgacaagtggagcaacatcgagacctccatgaccgaccagggcaccgagatcttcgagcagatccaggagctgtaccgggcccgcctcctgaacggcatcgtgcccgcggggatgagcctgtcccaggccaaggtggccgactacggccagcacaaggaggacctcgagctgttcaagacgtacctgaagaagctcaacgaccacgagctggccaagaccatccgcgggctgtacgaccggtacatcaacggcgacgacgccaagcccttcctccgcgaggacttcgtcaaggcgctgaccaaggaggtgaccgcccaccccaacgaggtgagcgagcagctgctcaaccggatgggccaggccaacttcatgctgaagcagcgcacgaaggccaacggggcgatcccggtccagctgcagcagcgggagctcgaccagatcatcgccaaccagagcaagtactacgactggctggccaagcccaaccccgtggagaagcaccgcgcctccaagccctaccagctggacgagctgctcaccttccggatcccgtactacgtgggccccctgatcacccccaaggagcaggccgagagccgcgagaacgtcttcgcgtggatgatccggaaggacccctccgggaacatcaccccgtacaacttcgacgagaaggtggactgccccgccagcgccaacatgttcatccagcgcatgaagaacacggacacctacctgatcggcgaggacgtgctccccaagcggtccctgctgtaccagaagtacgaggtcctcaacgagctgaacaacgtgagcatcgacgggcgccggctgggcgccgaccagaagcagcgcctcatccgggaggtgttcgagcgccactccagcgtcaccatcaagcaggtcgccgagaacctggtggcgcacggcgacttcgccaagcggcccgagatccgcgggctggccgacgagaagcggttcctctccagcctgtccacctaccaccagctgaagaagatcctccacgaggccatcgacgacccgacgaaggagcacgacatcgagaacatcatcacctggagcaccgtgttcgaggacgccgcgatcttcaagaccgagctggccaagatctcctggctggacagcgacacgatcaaggccctctccaacatccgctaccgcggctgggggcagttcagccggaagctgctggacggcctcaagctggggaacggccacaccgtgatccaggagctgatgctctccaaccacaacctgatgcagatcctgaccgacgagaccctcaagaccacgatggccgagctgaaccaggacaagctgaaggcggacgacatcgaggacgtcatcaacgacgcctacaccagcccctccaacaagaaggccctccgccaggtgctgcgggtggtcgaggacatcaagcacgccgccaacggccaggaccccagctggctgtacatcgagaccgcggacgggcccggcaccgccgggaagcgcacgcagagccggcagaagcagatccagaccgtgtacgccaacgccgcccaggagctcatcgactccgcggtgcgcggcgagctggaggacaagatcgccgacaaggccagcttcaccgaccggctggtcctctacttcatgcagggcgggcgcgacatctacaccggcgccccgctgaacatcgaccagctgtcccactacgacatcgaccacatcctcccccagagcctgatcaaggacgactccctggacaaccgggtgctcgtgaacgccacgatcaaccgcgagaagaacaacgtcttcgcgagcaccctgttcgcctccaagatggccgccacctggcggaagtggcacgaggcggggctgatcagcggccgcaagctccggaacctgatgctgcgccccgacgagatcgacaagttcgcccacgggttcgtggcccggcagctcgtggagacccgccagatcatcaagctgacggagcagatcgccgccgcgcagtacccgaacaccaagatcatcgccgtcaaggccggcctgtcccaccagctccgggaggagctggacttccccaagaaccgcgacgtgaaccactaccaccacgccttcgacgccttcctggcggcccggatcggcacctacctcctgaagcgctaccccaagctggcccccttcttcacctacggggagttcgccaaggtggacgtcaagaagttccgggagttcaacttcatcggcgccctcacgcacgcgaagaagaacatcgtggccaaggacaccggggagatcgtgtgggacaaggagcgcgacatccaggagctggaccgcatctacaacttcaagcggatgctgatcacccacgaggtctacttcgagaccgccgacctcttcaagcagacgatctacgccgccaaggacagcaaggagcgcggcgggtccaagcagctgatcccgaagaagcagggctaccccacccaggtgtacggcgggtacacccgggagaacaccgcgtacctggccgtggtcaagacggtggagaagaaggccgacgtgtaccgcgtcgtgcggatcgccaccagccaggtggcggccctcaaggaggcccgcgcccagtccaccgtcaaggagcgggagctgctgaagaagttcctcaccacgaagttcaccaagatcggcaagaacgggaagaaggccatcacccccttcgacatcgtgatcccccgcgtgccgcgggagcagctgttccacaacaagcgctacggcttcttcatggtcaacagcgacaccctgatgcacaactaccaggagctctggatgtcccggagcgaccagcagatcctgtccaagctggtgaagtccgcgaagacggtggagaacgggcaggtcggccgcctcttcgagaacatcgtggagcagatcaacaagtacttccccctgtacgacatcaaccagttccggaagaagctggaccagagcaaggacatcttcagcaagctccccctggagggcaacgggaccaccagcggcaagcgcgagaccatccagaacatcctgacgggggccggcaccggggccaagaacggcgacctcaagaacctgggcatcaagacccccttcgggttcctccaggtgccgtccggcatcgtcctggacgacgacaccaccctgatctaccagagccccacggggatgctgaaccggatcgtgcgcctctccgagctgtga

SEQ ID NO: 1905 - RNA, 4086 nt, synthetic construct
  misc_feature 1..4086: note = Cas9 variant
  source 1..4086: mol_type = other RNA
atgaagaacgaggagaacatctacctgggcctcgacatcgggaccgacagcgtgggctacgccgtcaccgacgacaagtacaagatcatgaagtaccacgggaacgccgcgtggggctccacgatcttcgacgccggggccctgggcgccgaccgccgggtgttccgcagcgcccggcgccggctggaccgccggcaggagcgcatccagctcctgcaggagatcttcgcgaacgagatcgccaaggtggacgagcggttcttcatccgcctgctcgagtccggcctgtggcgggccgacgccgaggaccgctacgtcttcttcaacgacaaggagtacaccgacgtgcagtacatgcgggactaccccaccatccaccacctgatctgcgagctcatctacaacccgaacaagcacgacgtgcgcctggtctacctggcgtgcgcctggctcgtgacccaccgggggcacttcctgagcaacatcaacacggagaacatcgccgacctggtggacatccacaacgtctacaacggcttcatgcgcttcttcgaggagaacgagatcatctgcgactggcgggaggtgaacgtggaggagctcgggcgcgtcctggccgccaacatcggcatcaacgagaagtaccggaacctgtccaccgtcctcttcgcgacccgcaagcccgacaagaaggccaaggaggggttcccctacagcgaggacgccatcgtgcggctgctggccggcgggacctgcaagctcaaggacgtgtacatcaaggaggagtacgacgagttcgggtccatcacgctgggcatggacgacgagaagatgaccgagatcatggccgacatcggggacgacttcgacctgatcaaggcgctccgcagcctgtacgactggggcatcctggccaacatcctcgtgaacgagaacaacagccccctgatcagccagtccaaggtgaaggtctacgagcagcaccgcgaggacctggccaacctcaagtacctggtgcacaagtacatcccgcacaagtacaacgagatcttccgggagatccgcggcgacaactacgtggcctacagctaccactacgagctgaagaacgacgagaagatggggaagaaggccgacgtcgagaagttctccaagttcctcctgaagatcctggagggcatcagcgtggacgagcaggacaaggtggtctacgacaacatgatcgagcggctcaccctgcgcctgttcctccccaagcagaagaacaccgacaaccgggtgatcccccaccagctgtacgagtacgagctgaagtccatcctcaagaacacgaagaactacctgcccttcctgaaggagaaggacagcgacgggatctccaacgaggacaagatcatcagcatcttcaagttcaagatcccgtacttcgtcggccccctcaactgcaactcccagttcgcgtggatccagcgcaaggccgacgggaagatcttcccctggaacttcgaggacaaggtggacttcgacgccagcgagcaggccttcatccagcggatgaccaaccagtgcacctacctgcccgaggagagcgtgctgccgaagcagtccctctactaccagaagttcatggtcctgaacgagatcaacaacatcaagatcgacggccgcaagatcagcgtggccatgaagcaggagctgtacaacgagatcttcgagaagaagaagcgggtgcgcaagaaggacgtcatcgacttcttcgtgtccaacggctacctggagggcggcaaggaggcgctcatcagcgggctggacgagcagatccacaccaacctgtccagcttccacgccttccggcgcctcctgcagaaccacatcctgtccgtggaggacgtcgagagcatcatcgagcgggcctcctacagcgacgacaagcgccgggtgctcctgttcctgaagaacaagtactccttcctcacggacgaggacatcaagtacatctgcaagatcaagatcaaggacttcggccgcctgagcaagaagttcctggtggacttcgaggggacctgcaaggagaccggcgagatctccaccgtcctccggctgatgtgggagacgaacaacaacctgatggagctcctgagcgacaagtacaccttcgccaacggcatcaaggagaaccgcaagaagtactacaccgagcagcagaagaccctggacgaccggctcgacgagatgtacatctccaacagcgtgaagcgcacgatctaccgcaccctgtccgtggtcaaggacgtgaccaaggcgttcggggtgcccaagaagatcttcgtcgagatggcccggaccaacaaccccgacctgaagggcaagcgcacgcggacccgccagcagcaggtcatcgagctctacgccaagtgcgacgaggaggacgtgcgggagctgaagcaccagatggagagcctgggggagtacgtggacaacaagctccagtccgacaagctgttcctgtacttcatccagttcggcaagagcgcctacagcgggaagatgatcgacctcgagaagctgatgtccggcagcaaggtgtacgacatcgagcacatctacccccaggcctacgtgaaggacgactccatcatcaacaacaaggtcctggtgttcagcgaggagaacggcgcgaagcaggacatctacccgatcaagaccgagatccgcaagcagatgtccgggatctggaccacgtggcaccacgtgggcgccatcagcgacgagaagtacaagcggctcacccgctccacccccttcaacgaggacgagaagtacgggttcatcaaccggcagctgaccgagacgagccagtccaccaaggccatcgcccagatcctgaacgagaagtaccccgagaccgagatcgtctacgtgaaggccggcctcgtgagcgacttccgccacgagttcggcctgtgcaagtgccggtcctacaacgacctgcaccacgcgatcgacgcctacctcaacgtcgtggtggggaacgtctacaacatgaagttcaaccgcaagtggttcagcgtggactccaagtacagcatcaagaccaagaccatcttctcccacagcctggtgtgcaacggcaagatcatctgggacaaggagaagatgctgcccatggtcctcaagaacgccaagaagaacaacgcccacttcacgaagtaccagttcatgaagaccgggggcttcttcgaccagatgccgtgcaagaaggcctccgggctggtgccccggaagaagggcctggacaccgagcgctacggcgggtacaacaagagcggcatcatgttcctcacccccatgcggtacaagatcgggaagaagtccgacatcatcatcctgtccatcgagctgctctacggcaagctgttcctgaaggacgaggtgttcgcgaagaagtacgccgaggagcgcctccagaagatcatcgggaagaaggccgacgaggtcagcttccccatgggcatgaagccgtggaagatcaacacggtgctgtccctggacggcttcaacgtgtgcatcaccgggatcggcgggggcgggaagtgcctcagcgcccagcccatcatgcagctgtccctgccctacgagctcgcgaagtacctgaagaagatcgagaagttcgtcgagaagaacaagaacaacgccaactacatctacgacgagcagtacgacagcgtgtccgtggacgagaacatcaagctgtacgacgtctacctcgacaagctggagaacagcatctacaacaagcggatcaactcccccgaggccatcctgaagaacggccgcgagaagttctgcaagctcaacgtgctggagcaggccgtgaccctgatcaacatccagagcatcttcggccggatgaccgggggctgcgacctcgagaacatcgggggcaagaagcactccgccgcgacggtcaacttcagctccaacgtgagcaactggaagaagtactacaacgacgtgcgcgtcgtgtaccagtccccgagcgggatctgggagcggcgctcccagaacatcctggagctgctctga

SEQ ID NO: 1906 - RNA, 4086 nt, synthetic construct
  misc_feature 1..4086: note = Cas9 variant
  source 1..4086: mol_type = other RNA
atgaacgagccctacggcgtggggctggacatcggcaccaacagcgtcgggtggaccgtggtggacatgaacggccgcgtccggaaggtgaaggggaagacggccctcggcgcccgcctgttcaaggagggcgcgaccgccgaggaccggcgcgggttccggaccacccgccggcgcctgaagcgggtgaagtggcgcctccggctgctgcgcgagttcttcgaccagccgatctccaagatcgaccccaacttcttcgcccggcgcaagtacagcgacatcagcccccgggaccccaactacaacggcctcgccaagacgctgttcaacgaccgcaccgacaaggagttctacgacgactacgccaccatctaccacctccgggacaagctgatgacctccaaccgcaagttcgacatccgggagatctacctggcgatccaccacatcgtcaagtaccgcgggaacttcctgcggacgggcccggcctcccagtacgggagcgcctccctccacctggccaccagcttccagaagctgaacgacctcttcgcgcagtccgaggagaccctgaacctgaagctcgtgaccgacgaggccctgctgcagcagatccagcagatcctcgtgcgcacggacctgagccgctccgagcagcagcggcagatctggcccctgatggccgtcctcaccggcgccagcgccgcggagaagaagcgccagaagaacgtggtggtcgagctgtccaaggccctggtgggcctcaaggccaagatgaacgtggtcaccctgaccgaggtggacgccgccgtggtcaaggactggacgttcaccatggaggagagccaggacaagctgcccgagatcgaggagcagctctccgaggtggggcagcagatcatggacgaggtgatccagctgtacgcgagcgtcaacctggcccagctcatccccgccggcaagcggttctcccagcacatggtggagaagtacaagcaccacgagaagaacctggagctgctcaaggcctacatccacagccagtccgacagcaagcgcgggcgggagatccgcgccacctacgaccggtacatcgacggcgtggacagcaagccggtcacccaggagatgttctacaaggacctgatgaagtacgtggaggcggacgccacgtccaaccacctggccgccgagatcaaggacgagatcgacagcgagcagttcatgcccaagctccgcaccaagcagaacggctccatcccctaccaggtccagcagtacgagctggaccagatcatcagccaccagaagaagtactacccctggctgggggaggagaacccggtggccgagcggcgcggcaagttcccctacaagctcgacgagctggtggggttccgggtcccctactacgtgggccccctgatcaccaaggaggaccagcaggcgacctccggggccggcttcgcctggatggtgcgcaaggccgacggcccgatcacgccctggaacttcgaccagaaggtcgaccggatcgcgagcgccaccgccttcatccagcgcatgcagaccaccgacacgtacctcatcggggaggacgtgctgcccgcccggtccctgatctaccagcgcttcatggtgctcaacgagctgaacaacatgcgggtcgaggaccgcaagctggcgccccagcagaagcagcggctgtacaaccaggtgttcaagcagcaccagcacgtgagcgtcaagaacatccagcagaacctcatggacgccggcgagtaccgcaagaccccgcagatcaccgggctggccgaccccaagggcttcaactccagcctgtccacctaccacgacttcaagaagatcctcctggaggccatcgccgacgagcacaagcgcgccgacatcgagaagatcatcctgtggagcacgaccttcgaggactccgcgatcttcaagcagaagctcgaggaggtggcctggctgaccgacgcccagcggaagcagctgagcgggctccgctaccggggctggggccagctgtcccacaagctgctcaccgccttcaaggacgacaaggggcgcagcatcatggacggcctgtgggagacgtccgacaacttcatgcagctgcggaagcagcccgccatcgagacccagatcaaggaggcgaaccaggccaacctcaccgacgccgacatccaggacaccatcaacgagctgtacaccagcccccagaacaagaaggccatccgcgaggtgatgctggtcctcgacgacatcaagaacgcgatgcacgggcagacgccgtcctggatcttcgtggaggccgcccggggcgggggcgtggccggccgccggacccagagccgcagctcccagatcgtcgaggcctacaaggggaccgcgaaggagatcgtgagcgagaaggtgcagcacgagctgaacgagaagatcaaggccaaggccgacttcaacacccggctggtcctctacttcctgcagaacggccgcgacctgtacacgaacgaggccatcaacatcgaccggctctccgagtacgacatcgaccacatcctgccccagagcctggtgaaggacgactccctcgacaaccgcgtgctgaccagcgcccggatcaaccgcgagaagaacgacaccttcgcgtccgagaagttcgggcggaagatgggcgcccagtggcgcgagctgcaccggaacggcctcatgacccagcgcaagctgaagcacctcctgatgcggcccgacgagatcagcaagcacgccacggacttcatcaaccgccagctggtcgagacccgccaggtgatcaagctggtggaggagctcatctccagcgagtaccccgccgcctccatcgtcgcggtgaaggccaacctgacccaccagttccggcagaccttcaacttcccgaagctgcgcgaggtgaacgactaccaccacgccttcgacgccagcctcacggcgttcatcgggatgtacctgctgaagcagtaccccaagctcgagcggttcttcgtctacggcaagttcgccaagcagcccatcaacctgacccgcttcaacatcatccggaagctggccgtggccgagaagccgatcgccaacatcgagaccggggagatcctctgggacaagaccgcggacatcaagtacttcgagaagctgtacaactacaagcgcctgctcgtgacgcacgaggtccgggagaactacggcgccatgttcaagcagaccctgttcaaggcctcctacaacaagagcaagaccctggtgcccaagaagaaccacatggagacctccgtgtacgggggctacagcaaccaggagacggcctacctcgccatcgtccgcatccccttcaagtccggcttcaagttcatcgtggtggggatccccacccggatggtcgcgaagatcaagcactaccagagcctgggcgccaccctgaaccaggccacccacaaggtgatcgagccgaagttcacgaagatcagccgcaagaccaagcagaccgtgatctccgactacgaggtcgtgctccccaaggtgtacctggaccaggtcgtgcgggaccaggtgaaggggcagatgtaccgcttcagcctgggctccgacaaggagtaccacaacgtccaggagctctacctgcccctgagcatccagcaggccttcgtggggcactacgacgagtccgacgaccagcggagcaacgacctcgtgaaggtctacgacgccgcgctgaagcagctgcagcgctacttccccctccacctgtcccggaacttcgaccaggtggccagccaggcccaccagtccttcgagggcctgaagaacaacgtccagaccagcgacaagcagctcggcaagaaggaggtgctgaactccctgttcgtggggctccacgccaacgccacgcgcagcaacctgtccgtcctgggcatgagcaaggacttcgggcggatcaagtccaacggcatcaccctcaccgaccaggcggagatcatctaccagagcccgaccgggctgttcgagcgcaaggtggccctgaaggacctctga

SEQ ID NO: 1907 - RNA, 4086 nt, synthetic construct
  misc_feature 1..4086: note = Cas9 variant
  source 1..4086: mol_type = other RNA
atgggcaactactacctggggctcgacatcggcaccaacagcgtggggtgggccgtcaccgacgagaactacaacatcgagcgcttcaagaagaagaacatgtggggcatccggctgttcgacgaggccaagacggcggagtcccgccggatccaccgccaggcccggcgcatgcggcagcgcaagatccagcggctgaacctcctgatggagctgttcgacgtggagatcagcaaggtggacgagtccttcttcatccgcaagaaggagagcgacctccactacgaggacaagtcccaggacagccggtacgccctgttcaacgacaaggagttcaacgacaaggactaccacaacaagtaccccaccatcttccacctgatcatggacctcatcgagaacgacgagaagaaggacatccgcctgctgtacctcgcctgccactacctgatcaagaaccgggggcacttcatcttcgagggccagaagttcgacgtcaactccagcctgaacaacaacatcaacaagctcaagtcccacctggaccagttctacaacatctgcctggacttcgacaacgacaagctcatcgagatcctggtgaaccagaacctgaacatcagcgagaagtccaagaagatcaaggagctcctgcgcaagaccaacctggaggtgggcatcgccaacctcatcgccgggggcagcatcaagctgtccaacatgttcgacgacgacgagctgaagaacttcgactacaacagcctctccttcaagaacagcaacttcgacgaggggcgggagctgttcgaggaggtcctggaggaccgcttcgagctcgtggagatcctgaaggacatccacgacgcgtccgtgctggagaccatgctcagctccgccagcatcagcccggacggcgggaagtacatctccagctccatgatcaacagctacaacaagcacaagcgggacctgaagctgctcaagaagatcatcaagaagtacaagaagtccgagtacgacaacatcttccgcgacgagaacatcaagaacaactacctgagctacacgcggaccggcatcaacaagaacaagaaggtccaggccaaggacaacaccgactccgacggcttctacaagtacatcgtgaagatcctgaaggacatcaaggagaacgacagcgacgaggacatcaagtacatcctctccgagatcgacaagaagaacttcgtgcccaagcagcgcaccaaggagaacagcgtcatcccctaccagctgcgggagatcgagctgcgcaagatcatcgacaaccagtccaagtaccacaagttcctcaacgaggtggacgagaaggggatcagcgtgaaggagaagatcatcgcgctgctgacgttccgcatcccctactacatcggcccgctcaacccctcctacaacgaggagaagaacttcaccaccagctgggtcaagcggctggccaaggggaaggtgaccccctggaacttcgaggacatggtggacatcgacgcctcccgcgaggccttcatcgagaacaagctgaacaagtgcagcttcctcctggacgagacggtcctgcccaaggactccctgctctaccaggagtacatggtgctgaacgagctgaacaacctcaagatcaacggccagagcatcaacaccgacctgaagaagtccatctacgaggagctgttcaagaagtacaagaaggtgacccggaagcgcctcatcagctacatcaaggagaaggagaacaccagcggcgacatcgtcatcacggggatcgacggcgacttcaagcaggggctgaagtcctacatcgccttcaaggagatcatcggcgagaagatcgacaacgacatctaccggaaggaggtggagaagatcatccgcgacatcagcctgtacggggacgacaagtccttcatccagaagaagatcaagaacgagaacaagctcgacctgagcgacaaccagatctccaagatcgcgaagctgaagttcaaggactggggccggttcagcaagaagctcctggtgggcatcaaggcctccgacaagaacaccggggagatcgacaacatcatcggcttcatgcgcaactacaactacaacatcatgcagctgatggccaacgtcttcaccttcaaggacgagatcgagaagctcaacagcaagtactacacctacgagaagatcaacgtggactacctggacgacctgtacctctccgccccggccaagcggatgctgtggcagagcttccagatcgtcgacgagatcaagaacatcaagaactccgcgcccaagaagatcttcatcgagatggcccgcagcaaggaggacaagcccacgcggaagatgtcccgcaagagccggctggagaagctctacaccgactccaagaagcagttcatcaagctgttcgggcccgacgagtacgacaagctgaacaacgagatcaagaacaagagcgagtccgacttccgctgggacaacctctacctgtactacacccagttcggccggtgcatgtacagcctggacccgatcgacctcgaggagctgagcaacaagaacctgtacgaccaggaccacatctaccccaagtccaagatctacgacgacagcatcgagaaccgcgtgctcgtgaagaagcagctgaacctggacaagtccaacgagtaccccatccccgaccgggtcctcaacaaggacaagaacaagctgctggccttctggaagatgctcaacgagaaggagctgatcggggacaagaagtacgcccgcctgatccgcaagagcccgttcaccgacgaggagctcggcgacttcatcgcccggcagctggtggagacgcgccaggcgaccaaggagaccgccaacatgctgcggcgcctctgccccgactccaagatcgtgtacgtcaaggccaagaacgtgagcgacttccggcgcaagttcgacatcctgaagtgccggtccatcaacgacctgcaccacgcccacgacgcctacctcaacatcgtggtcggcaacgtgttcgacaccaagttcacgagcaaccccctgaacttcatcaagaacaactccaagaaccgcagctacaacctggagaagatctacgactacgacgtgatccggaacgagaagatcgcgtggctcgccgagcgcaaggaggagaaccaggacgggtccatcgccaccgtcctgaagaacctgagcaagaacgacatccgggtgacccgccggacctacatcaagtgcgaggacctcttcgacgagaacatcgtgcgcaagggcaacgggaagttccccctgaaggagaacaacaacaagtccgacacgaacaagtacggcgggtacagcggcatcaagaacgcctacttcgtcctgctcgaggacgagaagcacaaccggatcatcgaggcgatcccgtccttcatctacaagaaggagaagaacggcgagaaggggagcgtgatcaactacctgcagaacatcctgggcatcaagtccgccaagatcctccgcgacaagatcaagatcgggagcctgctgaagatcgacaagttcccctacaacctcgccggcaagtccggcaacgggatcctgatcagcggcggggtgcagctgatcctcgacaagaacaccagcaagtacatcaagaagatcgagaactacaagtacaagctggacgagaacaaggactaccagatcaacatcttcgacaagctgtccaaggaggagaacatcaagctgttcgacctcttcgtcgacaagttcgagaacagcatctacaagaaccgggtgaacatcaagctgaaggagatcaagctcgcccgctccaagttcgagcacctgagcatcgaggagcagatcaagaccctgacccagatgctcatcctgttcggccgggagaacaacgccgtgaacctggagtacatcgggctccccaagaacacgggcaagaccaagatcaacaagaagatcaacaacaaggacatcaagatcatcaaccagtccatcaccggcctgtacgagaccgaggaggacctggcgaacatctga

SEQ ID NO: 1908 - RNA, 4089 nt, synthetic construct
  misc_feature 1..4089: note = Cas9 variant
  source 1..4089: mol_type = other RNA
atgaagaagccctacagcatcggcctggacatcgggaccaactccgtgggctgggccgtcatcaccgaggactacaaggtgccggccaagaagatgaaggtgctcgggaacacgagccgcgacttcatcaagaagaacctgctgggcgcgctcctgttcgactccggggagaccgccgaggcccggcgcctgaagcggaccgcccgccggcgctacacccggcgccggaaccgcctccggtacctgcaggagatcttcctggacgagatgaacaagctcgacagcggcttcttccaccgcctggacgactccttcctggtccccgaggagaagcggggcagccgctaccccatcttcgggacgctccaggaggaggtgaactaccacgagaacttccccaccatctaccacctccggaagaagctggccgactccaaggagaaggcggacctccgcctgatctacctggccctcgcccacatgatcaagtaccggggccacttcctgtacgaggagagcttcgactccaacaacaacagcatccaggagatcttcaacgagttcaccgccgagtaccacaacaccatcgaggggtcctgcctgagcggccagatcgagcaggtcgaggcgatcctcacggacaagatctccaagagcgccaagcgcgagcggatcctgaagctgttcccggccgagaagtccaccgggctgttcagcgagttcctgaagctgatcgtgggcaaccaggccgacttcaagaagcacttcgacctcgaggagaagaccccgctgcagttctccaaggacacctacgaggaggacctggagaacctcctggagcagatcggcgacgagttcgccgacctgttcctcctggcgaagaagctgtacgacgccacgctcctggccgggatcctgaccgccaccgacgtgagcaccaaggcgcccctctccgccagcatgatcaaccgctacgagacgcaccagcaggacctggccgccctgaagcagttcatcaagaacaagctccccgagaagtacagcgaggtgttctccgacctgagcaaggacggctacgccgggtacatcaacggcaagaccacccaggaggccttctacaagtacatcaagaacctgctcatcaagttcgagggcgcggtcgacttcctggagaagatcgagcgggaggacttcctgcgcaagcagcgcaccttcgacaacgggtccatcccgcaccagctccacctccaggagatgaacgccatcctgcggcgccagggcgaccactaccccttcctgaaggagaaccgggagaagatcgagaagatcctcacgttccgcatcccctactacgtggggcccctggcccggggcaaccgcgacttcgcctggctgacccggaacagcgaccaggccatccgcccgtggaacttcgaggaggtggtcgacaagacctccagcgcggaggacttcatcaacaagatgaccaactacgacctctacctgcccgaggagaaggtgctgcccaagcactccatcctctacgagacgttcgccgtgtacaacgagctgaccaaggtcaagttcatcgccgaggggctgcgggactaccagttcctcgacagcggccagaagaagcagatcatcaacctgctgttcaaggacaagcgcaaggtgaccgagaaggacatcatccactacctccacaccgtggacggctacgacgggatcgagctgaagggcatcgacaagcagttcaacgcctccctgagcacgtaccacgacctcctgaagatcatcaaggacaaggacttcatggacgacgcggacaacgaggccatcctggagaacatcgtccacaccctcaccatcttcgaggaccaggagatgatcaagcagtccctggcccagtacgacgccatcttcgaccggaaggtgatgaaggccctgacccgccggcactacacggggtggggcgagctcagcgcgaagctgatcaacgggatccgcgacaagcagaccggcaagatgatcctggagtacctcaaggacgacggcgagatcaaccggaacttcatgcagctgatcaacgacgactccctgagcttcaaggagaccatccagaaggcccaggtgatcggggagaccgagaacatcaagcagatcgtccaggagctccccggctccccggccatcaagaaggggatcctgcagagcatcaagatcgtggacgagctggtggagatcatgggctacaaccccgagtccatcgtcgtggagatggcccgcgagaaccagttcacgaaccaggggcggcgcaacagccagcagcggctcaagaagctgaccgactccatcaacaagctgggcagcagcatcctcgaggagcaccccgtcgacaactcccagctgcagaacgaccgcctgttcctctactacctgcagaacggcaaggacatgtacaccggggaggccctggagctcagcaagctgtccagctacgacgtggaccacatcatcccccaggcgttcatcaaggacgactccctggacaaccgcgtgctcgtcagctacgccaagaaccggggcaagtccgacgacgtgccgagcctggagatcgtgcagaagcgcaaggccttctggcggcagctgctcgactcccagctgatcagcgagcgcaagttcaacaacctgaccaaggccgagcgcgggggcctcaccgaggacgacaaggccggcttcatcaagcggcagctggtcgagacgcggcagatcaccaagcacgtggcgcagatcctggacgcccgcttcaacaccgaggtgaccgagaaggggaagaagaagcgggccgtcaagatcatcacgctcaagtccaacctggtgagcaacttccgcaaggacttcgagctgtacaaggtgcgggagatcaacgactaccaccacgcccacgacgcgtacctcaacgccgtcgtgggcaccgccctgctgaagaagtaccccaagctcgagcccgagttcgtgtacggggactaccccaagtacaactcctaccgcgagcggaagaccgccaccgagaaggtctacttctacagcaacatcatgaacttcttcaagacgaccgtgaagctggccgacggctccgagaagaagcgccaccagatcgagaccaacgaggagaccggggagatcgtgtgggacaagacgaagcacttcgagatcgtccggaaggtgctgagctacccccaggtgaacatcgtcaagaagaccgaggagcagaccgtgggccagaacggcgggctgttcgacaacaacatcgtgtccaagaacaaggtcgtggacgcgagcaagctgatccccatcaagagcggcctgtcccccgagaagtacgggggctacgcccgccccaccatcgcctacagcgtgctcgtcatcgccgacatcgagaaggggaaggccaagaagctgaagcggatcaaggagatggtgggcatcacgatccaggacaagaagaagttcgaggcgaacccgatcgcctacctggaggagtgcggcttcaagaacatcaactccaaccacatcatcaagctccccaagtacagcctgttcgagttcgacgacgggcagcgccggctgctcgcctccagcatcgagctgcagaagggcaacgagctgatcctcccctaccacctgaccgccctgctctaccacgcccagcgcatcaacaagatctccgagccgatccacaagcagtacgtggaggcgcaccagaacgagttcgaggagctgctgaccaccatcatcagcctctccaagaagtacatccagaagcccaacgtcgagagcctgctgcagcaggccttcgaccagacggacgaggacatctaccagctctccgagagcttcatctccctgctgaagctcatcagcttcggggcccccggcgccttcaagttcctgggggtggacatctcccagagcaacgtgcggtaccagtccgtcagctcctgcttcaacgcgaccctgatccaccagagcatcaccggcctctacgagacccgcatcgacctgagcaagctgggcgaggactga

SEQ ID NO: 1909 - RNA, 4089 nt, synthetic construct
  misc_feature 1..4089: note = Cas9 variant
  source 1..4089: mol_type = other RNA
atgaacgagccctacggcgtggggctggacatcggcaccaacagcgtcgggtggaccgtggtggacatgaacggccgcgtccggaaggtgaaggggaagacggccctcggcgcccgcctgttcaaggagggcgcgaccgccgaggaccggcgcgggttccggaccacccgccggcgcctgaagcgggtgaagtggcgcctccggctgctgcgcgagttcttcgaccagccgatctccaagatcgaccccaacttcttcgcccggcgcaagtacagcgacatcagcccccgggaccccaactacaacggcctcgccaagacgctgttcaacgaccgcaccgacaaggagttctacgacgactacgccaccatctaccacctccgggacaagctcatgacctccaaccgcaagttcgacatccgggagatctacctggcgatccaccacatcgtcaagtaccgcgggaacttcctgcggacgggcccggcctcccagtacgggagcgcctccctccacctggccaccagcttccagaagctgaacgacctcttcgcgcagtccgaggagaccctgaacctgaagctcgtgaccgacgaggccctgctgcagcagatccagcagatcctcgtgcgcacggacctgagccgctccgagcagcagcggcagatctggcccctgatggccgtcctcaccggcgccagcgccgcggagaagaagcgccagaagaacgtggtggtcgagctgtccaaggccctggtgggcctcaaggccaagatgaacgtggtcaccctgaccgaggtggacgccgccgtggtcaaggactggacgttcaccatggaggagagccaggacaagctgcccgagatcgaggagcagctctccgaggtggggcagcagatcatggacgaggtgatccagctgtacgcgagcgtcaacctggcccagctcatccccgccggcaagcggttctcccagcacatggtggagaagtacaagcaccacgagaagaacctggagctgctcaagacctacatccacagccagtccgacagcaagcgcgggcgggagatccgcgccacctacgaccggtacatcgacggcgtggacagcaagccggtcacgcaggagatgttctacaaggacctgatgaagtacgtggaggccgacgcgacctccaaccacctggccgccgagatcaaggacgagatcgacagcgagcagttcatgcccaagctccgcaccaagcagaacggctccatcccctaccaggtccagcagtacgagctggaccagatcatcagccaccagaagaagtactacccctggctgggggaggagaacccggtggccgagcggcgcggcaagttcccctacaagctcgacgagctggtggggttccgggtcccctactacgtgggccccctgatcaccaaggaggaccagcaggccacgtccggggcgggcttcgcctggatggtgcgcaaggccgacggcccgatcaccccctggaacttcgaccagaaggtcgaccggatcgccagcgcgaccgccttcatccagcgcatgcagaccacggacacctacctcatcggggaggacgtgctgcccgcccggtccctgatctaccagcgcttcatggtgctcaacgagctgaacaacatgcgggtcgaggaccgcaagctggcgccccagcagaagcagcggctgtacaaccaggtgttcaagcagcaccagcacgtgagcgtcaagaacatccagcagaacctcatggacgccggcgagtaccgcgaggccccgaagatcaccgggctggccgaccccaagggcttcaactccagcctgtccacctaccacgacttcaagaagatcctccccgaggccatcgccgacgagcacaagcgcgccgacatcgagaagatcatcctgtggagcacgaccttcgaggactccgcgatcttcaagcagaagctggaggaggtggcctggctcaccgacgcccagcggaagcagctgagcgggctgcgctaccggggctggggccagctctcccacaagctgctgatcgccttcaaggacgacaacgggcgcagcatcatggacggcctctgggagacctccgacaacttcatgcagctgcggaagcagcccgccatcgagacgcagatcaaggaggcgaaccaggccaacctgaccgacgccgacatccaggacaccatcaacgagctctacaccagcccgcagaacaagaaggccatccgcgaggtgatgctggtcctggacgacatcaagaacgcgatgcacgggcagaccccctcctggatcttcgtggaggccgcccggggcgggggcgtggccggccgccggacgcagagccgcagctcccagatcgtcgaggcctacaaggggaccgcgaaggagatcgtgagcgagaaggtgcagcacgagctcaacgagaagatcaaggccaaggccgacttcaacacccggctggtcctgtacttcctccagaacggccgcgacctgtacaccaacgaggccatcaacatcgaccggctgtccgagtacgacatcgaccacatcctcccccagagcctggtgaaggacgactccctggacaaccgcgtgctcacgagcgcccggatcaaccgcgagaagaacgacaccttcgcgtccgagaagttcgggcggaagatgggcgcccagtggcgcgagctgcaccggaacggcctgatgacccagcgcaagctcaagcacctcctgatgcggcccgacgagatcagcaagcacgccaccgacttcatcaaccgccagctggtcgagacgcgccaggtgatcaagctggtggaggagctgatctccagcgagtacccggccgcctccatcgtcgcggtgaaggccaacctcacccaccagttccggcagaccttcaacttccccaagctgcgcgaggtgaacgactaccaccacgccttcgacgccagcctgaccgcgttcatcgggatgtacctcctgaagcagtaccccaagctggagcggttcttcgtctacggcaagttcgccaagcagccgatcaacctcacgcgcttcaacatcatccggaagctggccgtggccgagaagcccatcgccaacatcgagaccggggagatcctgtgggacaagaccgcggacatcaagtacttcgagaagctctacaactacaagcgcctgctggtgacccacgaggtccgggagaactacggcgccatgttcaagcagacgctgttcaaggcctccgacaacaagagcaagaccctggtgcccaagaagaaccacatggagacctccgtgtacgggggctacagcaaccaggagaccgcctacctggccatcgtccgcatccccttcaagtccggcttcaagttcatcgtggtggggatcccgacgcggatggtcgcgaagatcaagcactaccagagcctcggcgccaccctgaagcaggccacccacaaggtgatcgagcccaagttcaccaagatcagccgcaagacgaagcagaccgtgatctccgactacgaggtcgtgctgcccaaggtgtacctcgaccaggtcgtgcgggaccaggtgaaggggcagatgtaccgcttcagcctgggctccgacaaggagtaccacaacgtccaggagctgtacctccccctgagcatccagcaggccttcgtggggcactacgacgagtccgacgaccagcggagcaacgacctggtgaaggtctacgacgccgcgctcaagcagctgcagcgctacttcccgctgcacctctcccggaacttcgaccaggtggccaaccaggcccaccagagcttcgagggcctgaagaacaacgtccagaagtccgacaagcagctgggcaagaaggaggtgctcaacagcctgttcgtggggctgcacgccaccgccacccgctccaacctcagcgtcctgggcatgtccaaggacttcgggcggctgcagagccgctccggcatcacgctcaccgaccaggcggagatcatctaccagagccccaccgggctgttcgagcggaaggtggccctgaaggacctctga

SEQ ID NO: 1910 - RNA, 4089 nt, synthetic construct
  misc_feature 1..4089: note = Cas9 variant
  source 1..4089: mol_type = other RNA
atgaccaagctgggcaagccctacgggatcggcgtggacatcgggagcaactccatcggcttcgccgccgtcgacgagaacagccacctcatccgcctgaaggggaagaccgtgatcggcgcgcggctgttcgaggagggcaaggccgccgccaagcgccgggccgggcgcacgacccggcgccggctctcccgcaaccggtggcgcctgagcttcctgcgggacttcttcgagtcccacatcaccccgaccgaccccaacttcttcatgcgccagaagtacagcgagatctcccccaaggacaaggcgcggtacaagtacgagaagcgcctcttcaacgaccggacggacgccgagttctaccagcagtacagcaccatgtaccacctccgcaaccggctgatgaccgacccctcccgcgccgacgtgcgggagatctacttcgccatccaccacatcctcaagagccgcggccacttcctgaccccgggggacgcgaaggacttcaacacgaacgacgtcgccctggacgagatcttccccgccctgcaggacgcctacgcccaggtgtaccccgacctgggcatcaccttcgacgaggacaaggcgaacgagttcaagaccatcctgctcaacgagatcgccacctccatcgacacgcagcgggccctggtgaagctgctcctggccgaggaggacgacaaggacatcctgaagcagcagaagcaggtcctcaccgagttcgccaaggcggtggtggggctgaagaccaagctgaacctcgccctgggcaccgaggtcgacagctccgaggccacggcctggaacttcagcctgggccagctcgacgacaagtgggccgggatcgagtccgcgatgaccgacgagggcaccgagatcctggaccagatccgcgacctgtaccgcgcccggctcctgaacgggatcgtgcccaccggcaagacgctgagccaggccaaggtggacgactacacccagcaccacgaggacctccagctgttcaaggcctacctgaagcagctcgaggacgacggcaccgccaaggcgatccgccagctgtacgaccggtacatcgacggggacgacgccgccccgttcctgcgcgagaacttcgtcaaggccctcaccaaggacgtgacggcgcaccccaacaccaagtcccccgagctgctggagcggctcgcccagcccgacttcatgctgaagcagcgcaacaaggccaacggcgccatcccggtgcagatgcagcagcgggagctggaccagatcatcaagaaccaggccgtctactacgactggctcgcggcccccaaccccgtggagaagcaccgcaagagcatgccctaccagctggacgagctgctcaacttccggatcccgtactacgtggggcccctggtcaccgccaaggagcagaaggccgcccagggcggggtgttcgcgtggatggtgcgcaaggaccccgagggcaacatcaccccctacaacttcgacgagaaggtcgaccgggaggcctccgccaacacgttcatccagcgcatgaagaccaccgacacctacctgatcggcgaggacgtgctgccgaagcagagcctcctgtaccagcggtacgaggtgctgaacgagctcaacaacgtccgcgtgaacaacgagaagctgagcatcgagcagaagcagcaggtcatccgggagctgttcgagcgccacaactccgtgacgatcaagcagttcgccgagaacctccgggcccacggggactacgcgcacatccccgagatccgcggcctggccgacgagaagcggttcctgagctccctcagcacctaccgccagctgaagtccctgctccccgaggccatcgacgaccccgccaagcaggcggacatcgagaacatcatcgcctggagcaccgtgttcgaggacgccgccatcttcaagaccaagctgaaggagatctcctggctggggagcgaggccatcacgaagctctccaacatccgctaccggggctgggggcagttcagccgcaagttcctgaacggcctgaccctcggcaacgggcacaccatcatccaggagctgctgctctccaccaacaacctgatgcagatcctgaccgacgagacgctccagaagaagatgaccgagctgaacgcggacaagctgaagaccgccaacatcaacgacgccatcgacaacgcctacaccagcccgtccaacaagaaggccctccggcaggtcctgcgcgtggtggacgacatcaagcgggcggccgacggccaggaccccagctggctgtacgtcgagacggccgacgggggcgggacccccggcaagcgcacccgggcccgccagcaccagctccaggagatctacgccaacgcggcccacgagctgatcgacaccgccgtgcggggcgagctggaggacaagatctccgacaaggccgacttcaacgaccgcctcgtgctgtacttcatgcagggcgggcgggacatctacacgggggcgcccctgaacatcgaccagctcagctcctacgacatcgaccacatcctgccgcagagcctgatcaaggacaactccctcgacaaccgcgtcctggtgcacgccatcatcaaccgggagaagaacgccaccttcgccagcaccatctacgcccagaagatgaacgcgacctggcgccagtggcacgaggccggcctgatcagcggccggaagctccgcaacctgcagatgcggcccgaccagatcgacaagtacgcctccgggttcgtggcccgccagctggtcgagacgcggcagatcatcaagctcaccgagcagatcgtggccgcgcagtaccccgacaccaagatcatcgccgtgaaggccggcctgagccaccagctgcgcgaggagctcgagttcccgaagaaccgggacgtcaaccactaccaccacgccttcgacgccttcctggcggcccgcatcgggacctacctgctcaagcgcttccccaacctgcaggccttcttcacgtacggcaagttcaccaaggccgacgtgaagaagctgcgggggttcaacttcatccgcgacatcacccacgccgaggacaagatcgtggcgaaggacaccggcgaggtcgtgtgggacaagcagcgggacgtggacgagctcgaccgcatctacaacttcaagcggatgctgatcacgcacgaggtccgcttcgagaccgccgacctgttcaagcagaccgtgtacggcgcccgggactccaaggaggccgggggcagcaagcagctcatccccaagaagaaggggtaccccgtggacatctacggcgggtacttccgcgagaacaccgcgtacctggccgtcgtgaaggtgacgaagaagaccgagaccatcttcaaggtcgtgaagatcgccacctcccaggtggccgccctgaacaaggcgcggagccgctccacggccgaggagctcagcgtcctgaccgagctgctcaagccgaagttctccaaggtgggcaagaacggcaagatcaccgacacccccttcgaggtggtcctgccccgggtgccccgcgagcagctgttctacaacgccaagtacgggttcttcatggtgaacagcgacacgatgttccacaacttccaggagatctgggtctcccggagcgaccagaagatcctccagcagatccgcaaggccaagatcgactacccgaacgtggaccaggacctggacaacctgttccacaacctcgccgaccagatcgtgaagtacttcgacctgtactccatcgcgggcttcaaggagaagatcagccagtcccagaacaccttcaacgacctggccgtcgacgacaccgaccagagcgtggggaagatcaccgtgatcaacgagctcctgaagggcgcccaggccaacgggatgacgggctccctgaaggtcctcaagatcagcacccccttcggcttcacccaggacaagagcggggtgctgaccaaggactccagcatcatctaccagtcccccaccggcctgttcgagcggagcgtgcgcctcacggacctgtga

SEQ ID NO: 1911 - RNA, 4089 nt, synthetic construct
  misc_feature 1..4089: note = Cas9 variant
  source 1..4089: mol_type = other RNA
atgaccaagctgggcaagccctacgggatcggcgtggacatcgggagcaactccatcggcttcgccgccgtcgacgagaacagccacctcatccgcctgaaggggaagaccgtgatcggcgcgcggctgttcgaggagggcaaggccgccgccaagcgccgggccgggcgcacgacccggcgccggctctcccgcaaccggtggcgcctgagcttcctgcgggacttcttcgagtcccacatcaccccgaccgaccccaacttcttcatgcgccagaagtacagcgagatctcccccaaggacaaggcgcggtacaagtacgagaagcgcctcttcaacgaccggacggacgccgagttctaccagcagtacagcaccatgtaccacctccgcaaccggctgatgaccgacccctcccgcgccgacgtgcgggagatctacttcgccatccaccacatcctcaagagccgcggccacttcctgaccccgggggacgcgaaggacttcaacacgaacgacgtcgccctggacgagatcttccccgccctgcaggacgcctacgcccaggtgtaccccgacctgggcatcaccttcgacgaggacaaggagaacgagttcaagaccatcctgctcaacgagatcgcgacctccatcgacacgcagcgggccctggtgaagctgctcctggccgaggaggacgacaaggacatcctgaagcagcagaagcaggtcctcaccgagttcgccaaggccgtggtggggctgaagaccaagctgaacctcgcgctgggcaccgaggtcgacagctccgaggccacggcctggaacttcagcctgggccagctcgacgacaagtgggccgggatcgagtccgccatgaccgacgagggcaccgagatcctggaccagatccgcgacctgtaccgcgcgcggctcctgaacgggatcgtgcccaccggcaagacgctgagccaggccaaggtggacgactacacccagcaccacgaggacctccagctgttcaaggcctacctgaagcagctcgaggacgacggcaccgccaaggccatccgccagctgtacgaccggtacatcgacggggacgacgcggccccgttcctgcgcgagaacttcgtcaaggccctcaccaaggacgtgacggcccaccccaacaccaagtcccccgagctgctggagcggctcgcgcagcccgacttcatgctgaagcagcgcaacaaggccaacggcgccatcccggtgcagatgcagcagcgggagctggaccagatcatcaagaaccaggccgtctactacgactggctcgccgcgcccaaccccgtggagaagcaccgcaagagcatgccctaccagctggacgagctgctcaacttccggatcccgtactacgtggggcccctggtcaccgccaaggagcagaaggccgcccagggcggggtgttcgcctggatggtgcgcaaggaccccgagggcaacatcaccccctacaacttcgacgagaaggtcgaccgggaggcgtccgccaacacgttcatccagcgcatgaagaccaccgacacctacctgatcggcgaggacgtgctgccgaagcagagcctcctgtaccagcggtacgaggtgctgaacgagctcaacaacgtccgcgtgaacaacgagaagctgagcatcgagcagaagcagcaggtcatccgggagctgttcgagcgccacaactccgtgacgatcaagcagttcgccgagaacctccgggcccacggggactacgcccacatccccgagatccgcggcctggcggacgagaagcggttcctgagctccctcagcacctaccgccagctgaagtccctgctccccgaggccatcgacgaccccgccaagcaggccgacatcgagaacatcatcgcgtggagcaccgtgttcgaggacgccgccatcttcaagaccaagctgaaggagatctcctggctggggagcgaggccatcacgaagctctccaacatccgctaccggggctgggggcagttcagccgcaagttcctgaacggcctgaccctcggcaacgggcacaccatcatccaggagctgctgctctccaccaacaacctgatgcagatcctgaccgacgagacgctccagaagaagatgaccgagctgaacgccgacaagctgaagaccgcgaacatcaacgacgccatcgacaacgcctacaccagcccgtccaacaagaaggccctccggcaggtcctgcgcgtggtggacgacatcaagcgggccgcggacggccaggaccccagctggctgtacgtcgagacggccgacgggggcgggacccccggcaagcgcacccgggcccgccagcaccagctccaggagatctacgccaacgccgcgcacgagctgatcgacaccgccgtgcggggcgagctggaggacaagatctccgacaaggccgacttcaacgaccgcctcgtgctgtacttcatgcagggcgggcgggacatctacacgggggcgcccctgaacatcgaccagctcagctcctacgacatcgaccacatcctgccgcagagcctgatcaaggacaactccctcgacaaccgcgtcctggtgcacgccatcatcaaccgggagaagaacgccaccttcgccagcaccatctacgcccagaagatgaacgccacctggcgccagtggcacgaggcgggcctgatcagcggccggaagctccgcaacctgcagatgcggcccgaccagatcgacaagtacgcctccgggttcgtggcccgccagctggtcgagacgcggcagatcatcaagctcaccgagcagatcgtggccgcccagtaccccgacaccaagatcatcgcggtgaaggccggcctgagccaccagctgcgcgaggagctcgagttcccgaagaaccgggacgtcaaccactaccaccacgccttcgacgccttcctggccgcgcgcatcgggacctacctgctcaagcgcttccccaacctgcaggccttcttcacgtacggcaagttcaccaaggccgacgtgaagaagctgcgggggttcaacttcatccgcgacatcacccacgccgaggacaagatcgtggccaaggacaccggcgaggtcgtgtgggacaagcagcgggacgtggacgagctcgaccgcatctacaacttcaagcggatgctgatcacgcacgaggtccgcttcgagaccgcggacctgttcaagcagaccgtgtacggcgcccgggactccaaggaggccgggggcagcaagcagctcatccccaagaagaaggggtaccccgtggacatctacggcgggtacttccgcgagaacaccgcctacctggcggtcgtgaaggtgacgaagaagaccgagaccatcttcaaggtcgtgaagatcgccacctcccaggtggccgccctgaacaaggcccggagccgctccacggcggaggagctcagcgtcctgaccgagctgctcaagccgaagttctccaaggtgggcaagaacggcaagatcaccgacacccccttcgaggtggtcctgccccgggtgccccgcgagcagctgttctacaacgccaagtacgggttcttcatggtgaacagcgacacgatgttccacaacttccaggagatctgggtctcccggagcgaccagaagatcctccagcagatccgcaaggccaagatcgactacccgaacgtggaccaggacctggacaacctgttccacaacctcgccgaccagatcgtgaagtacttcgacctgtactccatcgccggcttcaaggagaagatcagccagtcccagaacaccttcaacgacctggcggtcgacgacaccgaccagagcgtggggaagatcaccgtgatcaacgagctcctgaagggcgcccaggccaacgggatgacgggctccctgaaggtcctcaagatcagcacccccttcggcttcacccaggacaagagcggggtgctgaccaaggactccagcatcatctaccagtcccccaccggcctgttcgagcggagcgtgcgcctcacggacctgtga

SEQ ID NO: 1912 - RNA, 4089 nt, synthetic construct
  misc_feature 1..4089: note = Cas9 variant
  source 1..4089: mol_type = other RNA
atgaccaagctgggcaagccctacgggatcggcgtggacatcgggagcaactccatcggcttcgccgccgtcgacgagaacagccacctcatccgcctgaaggggaagaccgtgatcggcgcgcggctgttcgaggagggcaaggccgccgccgaccgccgggcctcccgcacgacccggcgccggctcagccgcaaccggtggcgcctgtccttcctgcgggacttcttcgagagccacatcaccccgaccgaccccaacttcttcatgcgccagaagtactccgagatcagccccaaggacaagtcccggtacaagtacgagaagcgcctcttcaacgaccggacggacgcggagttctacaagtacgagaactgccccaccatgtaccacctccgcaaccggctgatgaccgacccgagcaaggccgacgtgcgcgagatctacttcgccatccaccacatcctcaagtcccgggggcacttcctgacccccggcgacgccaaggacttcaacacgaacaaggtcgcggtgaacaagatcttccccgccctgcaggacgcctacgcccaggtgtaccccgacctcgacatcaccttcgacgagaacaaggtcaacgagttcaagaccgtgctgctgaacgagaaggccaccccgagcgacacgcagcgcgcgctcgtgaacctgctgctcgccaaggagggggaccgggacatcctgaagcagcagaagcaggccctgaccgagttcgccaaggccgtcgtgggcctcaagaccaagctgaacgtggcgctggggaccgaggtcgactccagcgaggccacggcctggaacttctccctcggccagctggacgacaagtggaccggcatcgagagcgccatgaccgacgaggggaccgagatcctggaccagatccgcgacctctaccgcgcccggctgctgaacggcatcgtgcccgcggggaagacgctctcccaggccaaggtggacgactacgcccagcaccacgaggacctggagctgttcaaggactacctcaagcagctggaggacgacggcaccgccaaggccatccgccagctgtacgaccggtacatcgacggcgacgacgcgaagcccttcgtccgcgaggacttcgtgaaggccctcaccaaggaggtgaccgcccaccccaacgccaagagcccggagctgctggagcggctcgcgcagcccgacttcatgctgaagcagcgcaacaaggccaacggggccatccccgtccagatgcagcagcgggagctggaccagatcatcaagaaccagtccgtgtactacgactggctcgccgcccccaacccggtggagaagcaccgcaagagcatgccctaccagctggacgagctgctcaacttccggatcccctactacgtcggccccctggtgacggcgaaggagcagaaggccgcccagggcggggtgttcgcctggatggtccgcaaggacccggacgggaacatcaccccctacaacttcgacgagaaggtggaccgggaggccagcgcgaacaccttcatccagcgcatgaagaccacggacacctacctgatcggcgaggacgtcctccccaagcagtccctgctgtaccagagctacgaggtgctgaacgagctcaacaacgtgcgggtcaacgacaacaagctgtccttcgaccagaagcagcaggtcctgggcgagctgttcgagcgccacaacaccgtgaccatcaagcagttcgtggacaacctgctggcccacggggactacgaccggatccccgaggtgcgcggcctcgccgacgagaagcggttcctgagctccctgagcacgtacaaccagctcaaggggatcctgcacgaggccatcgacgactccgacaagcagaccgacatcgagaacatcatcgcctggagcaccatcttcgaggacaaggcgatcttcaagaccaagctgaacgagatctcctggctcaacgccggcatgatcaacagcctggccaacatccgctaccgggggtggggccagttctcccacaagctgctcaacgagctgacgctgagcaccggccgcaccgtgttcgaggagctcctgatctccagccacaacctgatgcagatcctcaccgacgaggtcctgaagcagaagatcgccgagctgaacgcgcacgagctcaaggcctccgggatctacgccgccatcgacgacgcctacaccagcccgtccaacaagaaggcgctgcgccaggtgctgagcgtgatcgacgacatcacgaacgccgccggccaggcccccaactggctctacatcgagaccgccgacggggacggcgtccccgggaagcggaccaactcccgccagcggaagatccaggagatctacgcgaacgccgcccaggagctgatcaccggcagcgtgcgcggcgagctggaggacaagatcgccagccgggccgacttcacggaccgcctcgtgctgtacttcatgcagggcgggcgggacatctacaccgggaagcccctgaacatcgacaacctctccagctacgacatcgaccacatcctgccgcagtccctgatcaaggacaacagcctcgacaaccgcgtcctggtgcaccccctggtgaaccgggagaaggacaccatcttcgcgtccacccgcttcgccaagcagatgaacggcatgtggcggcagtggcacgccgccggcctcatcagctcccgcaagctgcggaacctgcagatgcgccccgacgagatcgacaagtacgcgagcgggttcgtcgcccggcagctcgtggagacgcgccagatcatcaagctgaccgagcagatcgtggccgaccagtacccggacaccaagatcatcgccgtcaaggccggcctgtccagccagctccggaaggagctggacttccccaagaaccgcgaggtgaaccactaccaccacgcgttcgacgccttcctggccgcccggatcgggacctacctcctgaagcgctaccccaacctggagcccttcttcacgtacggcaagttcaagaagaccgaggtgaagaagctcaagtccttcaacttcatccgggacatgacccacgccaaggacaagatcgtcgcgaaggagaccggggagatcgtgtgggacaacgccagcgacatcaacgagctggaccgcatctacaacttcaagcgcatgctgatcacgcacgaggtgcggttcgagaccgcctccctcttcaagcagaccctgtacgccgccaagaacagcaagaaccgcggcggctcccggcagctgatcccgaagaagaaggggtacctcgtcgacatctacggcgggtacacccaggagacgggcagctacctgtccgtggtgcgcctgaccaagaaggcgatgtacgccgtcgtgaaggtgagcacccgggacgccgccaagctcgccgtcgccaagagcatctccgagcagaaggagaacgagaccctgaagaagatcatcgacgggaagctgagcaagacgtccaagaagggcaagaccacccaccagctgttcgagatcgtgctcccccgcgtgggccagaagaccctgttcaagaacagcaagtacaaccagttcctcgtcaactccgacacgtacatgcacaactaccaggagctgtggatgccccgggagtaccagcgcatgtggaaggacatcctgctcagcaaccacggggacgcgcagctggagggccagctggaccagatcttcaagttcatcgtgtcccaggtgaacagctacttcaacctctacgacatcaaccagttccggaagaagatcgccgacgccaccgacaagttcgcgaagctgcccacccacgacaccgacaacgcccgcgggaagatcgccacgatcggccagctgctcatcgggctgcaggccaacgccatgcggtccgacctgcgcaacctcgacatcaagaccccgttcggcctgctgcagatcggcaccgggatcaccctcgacctggacacgagcatcatctaccagtcccccaccggcctgttcgagcgggaggtccccctcaccgacctgtga

SEQ ID NO: 1913 - RNA, 4089 nt, synthetic construct
  misc_feature 1..4089: note = Cas9 variant
  source 1..4089: mol_type = other RNA
atgaaccaggagccctacgccatcggcctggacatcgggaccagctccctcggctgggccaacgcggacatggacgggtacatcgcccgcgtgaagggccagaccgggctgggcgtccggctgttcgaggagggccagccggccgccgaccgccggagcttccgcacgacccggcgccggctctcccgccggcgctggcggctgcgcctgctccgggagatcttcgacgagcccatcagctccatcgaccccaacttcttcgcccgccagaaggcgagctccatcagccccaaggacgaccggttcgagaccacctaccagctgttcaacgacaagacggaccaggagttctactccaagtacccgaccatctaccacctccgctgggccctgatgaccgagcaccggaagttcgacctgcgcgagatctacctggccgtgcaccacatcgtgaagtaccgggggaacttcctccgcagcggcaaccccaagtccttcaagcccagcgagctggacttctcccagcggttcaaggaggtcaacgggctgtggcacctcatcttcgacgaggtggcgccccagctgccgaccgacaacctggaggagatcacgaagctcgtgctggacaccacccgcacccgcgccgaccggcagcgcgagagcgtcaagctgctcatggccgccacggacaaccacaaggactggaagccctacctgaccgagttcaccaaggccatcctgggcctcaagaccaagctgtacctgctcacgggggtggacgtggccaaggcggaccagaagacctggaccttctccctggaggacatcgaggaccaccgggccgacctggagaccgccttcgacgaccgcagcctcgagctgatcgagaagctggtcgacctccaggccgccatccagctgacggagatcatgccctccggccagtacttcagccagtccatgatctaccggtacgaccagcacaaggagcacctccgctggctgaaggactacgcggagcagcagaccgacgccaacaagcggaaggccgtgcgcctggcctacgaccactacatcgagggcgacgccaaggggaagcccgagatcgcggacgacttctacaaggagctgaaccggatcctcaagggcgacaccagcgagctggccaagaagatcaaccacgagatcgccctggagcacttcatgccgaagcagcgcaccaaggagaacggggtgatcccctaccagatccaccagcaggagctcgacagcatcatcgacaaccagaagaagtactaccagttcctgggcgaggacaaccccgtcgtgtcccaccacggcagccagccctacaagatcgacgagctggtgtccttccgggtcccgtactacgtggggcccatgatcacggccgaccagcagaagaagaccgccgcgggccagttcgcctggatggtgcgcaaggacagcggggacatcaccccctggaacttcgacgacaaggtcgaccggaccgcctccgccacgaacttcatccagcgcatgaagaccaccgacacctacctcatcggcgaggacgtgctgcccctgcagagcctcacgtaccagaagttcatggtgctgaacgagctgaacaacatccggatcaacggggagctgctcacccgcgagcagaagcagcggacctacaacgacgtcttcaagggccacggcaccgtgaacgtgaagtccctgatcaagagcctggagtgccactccgaggtcacgggggcgatcaaggtggagggcctcgccgacccgaagcgcttcaacagcgccctgaccacctaccgggacttcaagaagatcctgcccgtcgccatcgaccagccccagcgccaggccgacatcgagcgcatcatcaactggtccaccatcttcgaggacgcggacatcttcaaggccaagctccaggagatcgactggctgaccgacacgcagcgggaccgcctgagcaccaagcggtaccgcgggtggggccggctctccgccaagctgctgctcaacatcaaggacacccaggggctgagcatcatggaccagctgtggaacacccagcacaacttcatgcagatcgtgcacgagcccgactacgccgagaagatcgagaagacgaacgccaagggcctcaagcagcaggacatcttcgagaccatcaacgagatgtacacctccccgcagaacaagaaggcgctgcgccagatcctggccgtggtccgggacatccagaaggcccaccacggccaggcccccagccgcatcttcatcgaggccgcgcgcggggccgagcagaacccccagcggacccggcagcgccagaagcagctcgccgacctgttcgccgaccaggcgaaggagatcgtgaacgagacggtggcccaggagctgaacgacgagaccgacaacaaggcccggttcaccgaccgcctcatgctgtacttcctgcagaacggccaggacatgtacaccggggagaagctcaacatcgacaagctgtccacgtacgacatcgaccacatcctgccccagagcctcgtcaaggacgactccctggacaaccgggtgctggtgagcaaggtcgagaacctcaagaagaacgaccacttcgccagcgagctgtacgcccgcaagatgcagggcacctgggagctgtggcggtccgcggggctcatcagcgcccgcaagctgaagcacctcctgatgcggccggacgagatcaacaagtacgccaccggcttcatccgccggcagctggtggagacccgccaggtgatcaagctggtcacggacgtgctctccaacgagtacgacagcgacaagaccaagatcatctccgtgaaggccggcctgagccaccagctgcgcatggagctcgacctgcccaaggtccgggagctgaacgactaccaccacgccttcgacgcgttcctcgccgtgcgcatcgggacctacctgctgaagcggtaccccaagctcgagcgcttcttcgtgtacggccagtaccaggtcgccccgcagctggacctgcggcgcttcaacttcatccacgacctcgtgtccgggaagcaggagaagatcgtggccgaggagaccggcgagatcgtctggaaccgggagaaggacgtgagctacatgaagcacctcctgtccctgaagcacctcctggtgacgcacgaggtcaaggaggaccacggcgccctgttcaaccagaccatctacaaggcgaagaaggacaacgggaacgtgggcgggaagatgaagctgctgcccaccaagagcaaccgccccaccgagatctacggcgggcactccagccaggccatcgcctacctcgccatcgtgcgggtcaacggcaaggagccctcctaccgcgtgatgggcgtgccgatccggatcctggaccagctgaagcaggcgaagaagcagggggagtacgccgagcgcctcgccctgaagcagttcttcacgcccgacttcaccaagggcaaggggaagatcgtcagcgacttcgacgtggtgatcccccacatccccctgctccagccggtcatcgacgagatctccggccagagccaccggttcgccctggggaccaacacctactaccgcaacctgcagcagctcatcctgacgctggccgaccagaaggtgctcatctccaaggagaccggcgtggacgaggagaagaagctggtcgaggtgtacagccacatctgccagcaggtcatgaagttcttccccctgtacgaccggaacaagttccgcgagctcctggtggacagccggtcccacttcgagcagctgcccatcgtgaaccgctacagcgacgcgggcaagctcgagatcgccgggaagcggggcatcctgcagcagatcatggtggggctgcacgccaacgccacccccggcgacctcaaggagctgggggtcaagaccccgttcggcaagctccaggtgcccggcgggatcaagctgacggagaacgccaagctgatctacgagtcccccaccggcctgttcaagcgcgaggtgaagatcaccaccgagtga

SEQ ID NO: 1914 - RNA, 4089 nt, synthetic construct
  misc_feature 1..4089: note = Cas9 variant
  source 1..4089: mol_type = other RNA
atgaagaagaaggccgagaagatctacctgggcctcaacgtggggaccaacagcatcggctacgccgtcaccgacgagcagtaccgcctgctgaagttcaacgggaacgacgcgtggggctccatcgtgttcgacgccgccagctccaacgaggaccggcgcaaccaccggctcgcccgccggaacctggaccgccggcagcagcgcatcgtgtggctgcaggagatcttcgccaaggagatcagcaaggtcgacgaccggttcttcatccgcctctccgagagcttccggtggcgcgaggacgtgcaggaccggtacgtgttcttcaacgacaaggagtacacggacgtccagtacatgaaggagtaccccaccatccaccacctgatctgcgagctgatggacaacaagaccccgcacgacgtgcgcctcgtgtacctggcgtgcgcctggctgatcacccaccgggggcacttcctcaacaacctgaacgtcgagaagctggacgagatcatggacttctccagcgtgtaccagaacttcatcaactacttcacggagaacggctacaagcgcccctggggcgagatcgacgtgtccgccctcagcgaggtcctgaagcagaagaccgggatcaccgtgaagaacaaggagctgcagaacatcctcctggagggcaagaagcccgagaagtccgggaccgaggagttccccttcagccaggactccatcatccggctgctcgccggcgggcagtgcaagctgaaggacgtgttctgcaaggaggagtacctggacctcggcagcgtctccctgggcatggacgaggagaagttcgacgagatcagcgggtccatcggcgaggactacgacctgctcatcgcgctgcgcgggctgtacgactggagcgtgctcgccaacctgctgaacggccactccgagacgatcagcatggccaaggtgcagatgtacgagcagcacggcaaggacctccagatcctgaagtacttcgtccggaagtacgtgccggacaagtacaacgaggtgttccgcaaggccaaggccgacaactacgtcgcgtacaccgggcacatggacaaggacaccgccagccagatcaagaagaaggccaaggccgaggagttctccaagtacgtgctgaagctcatgagccccatcaagcccgagaagaccgacctgcagtcctacgaggacatgtgcgagcggctgaagctcaaccgcttcctgcccaagcagaagaacacggacaaccgcgtgatcccgcaccagctgtacgagtacgagctcatccagatcctgaagaacgccagcgtctacctgcccttcctcaacgacaccaacaacggcatctccgaggcggacaaggtgctgagcgtcttccggtacaagatcccctactacgtggggcccctgaacgaggagtccagcttcgcctggatctcccgcaagcagggcaagatcaccccgtggaacttcaaggagatggtggacgaggacgccagcgagaacgccttcatccggcgcatgaccaacaagtgcacgtacctccccaccgaggacgtcctgcccaaggactccctgtgctaccagaagttcatggtgctgaacgagatcaacaacctccagatcgacgggctgaagatccccgtgaaggccaagcagggcatctaccacgagctgttcgagaagaacaagaaggtcaagcggaaggacatcgaggagtacctcatccgcaacaactacctggacaaggacagcaccgagctgatctccggcatcgacgagcagatccacagcgggctctccagctactgcgcgttcttcaacctgctgaacaagaagatcctctccgaggacgacgtggagcggatcatcgagcgcgccagctacgccgaggacaagtcccgggtgatcaagtggctgcgcaaggagtacccgggcctgagcgaggacgacatccggtacatcgcccgcatcaagatccgggacttcgggcgcctcagcaagaccttcctgacgggcctgaaggggtgcgacgtctccaagggcttcgacggccaggacgtggagatgatcagcatcctccagaccatgtgggagaccaacgacaacctgatggagatcctgtccgacaagtacaccttcctcgaggccctggaggcgttcacgcaggagtactacaccgggaagaagaagtccctgaaggagcggctcgacgagatgcgcgtgagcaacagcgtccggcgccccgtgtaccggaccctggccgtggtcaaggacatcgagaaggccttcggcaagcccaacaagatcttcgtggagatgacccgcgggggccaggccgaccagaaggggaagcgcatcaagtcccggaagcagcagatcctggacctctacgacaagtgcaaggacgacgtgcacgacctgatgtggcagctggagagcctcggcgagtacgcggactcccgcctgcagagcgaccggctgtacctctacttcatgcagttcggcaagtgcgcctactccggggcccacatcggcttcgagcagctgatggccgggagcgtcgagtacgacatcgaccacatctacccccagtcctacgtgaaggacgacagcctgaacaacaaggtgctcgtcctgtccgacctgaacggcacgaaggacaacatctacccggtgagccccgagatccgcggcaagatgcaggggctctggtcctggtggaaccacgtgggcgccatcagcgacgagaagtacaagcggctgatccgcagcgcgcccttcaccgacgaggagaagatggggttcatcaaccggcagctgaccgagacctcccagagcacgaagttcatcgccgacctcctgaaggagcgcttccccgacgccgaggtcgtgtacgtgaaggccggcctggtctccgacttccggcacgagttcgacctccccaagagccgctcctacaacgacctgcacaacgccgcggacgccttcctgagcgtggtggccgggaacgtctacgacatgcggttctccaagaagtggttccgcatcgacgagaagtacagcgtgaaggtgaagaccatcttcacccacgaggtcaagtgccggggcgacatcatctgggacggcatgccgatgctcgagaaggtggaggacaccgcccgcaagaacacggcccacttcgtgaagtacgcggccttcaagaccgggggcctgttcgaccagaaccccgtcaagaaggggaccggcctgatccccctcaaggccgggctgccgaccgagaagtacggcggctacaacaaggccgggatcatgttcctgatccccgtgcggtacaacatcggcaagaagtccgagatcctcatcctgcccgtggagctgatgcacgggaagcacttcctcgaggacaaggtcttcgcgcgcaactacaccttcacgcggctggagaacatcctgggcaagaaggtgggggaggtgagcttcccgatgggcatgcgcccctggaagatcaacaccatgctctccttcgacggcttccgggtctgcctgaccgggaccagcggccgcgggaagtgcctggtggcccagcccgtgatgcagttctccgccgacgagcactggcggttctacgtcaagcgcctcgagcgcttcgtggagaagatcggcatcaaccccgacctgctgtacgacaaggaccacgacaaggtgagcaaggacgagaacctcaagctgtacgagctgtacgtcgacaagctccagaacacgatctacaagaagcgggtgaactccccggtgcagaccctgctgaaggggaaggaggagttcaagaagctcagcatcgaggagcagtgccaggtcctgctgaacatccagtccgtgttcggccgcatgaccggcgggtgcgacctcaccctgatcggcgggagcgcccactccgccgcgacgggcagcctgagcaccaccatctccaactggaagaagaagtacagcaccgtccggatcatcgaccagtcccccagcggcatgtgggagaagtccagcgagaacctcctggacttcctgtga

SEQ ID NO: 1915 - RNA, 4092 nt, synthetic construct
  misc_feature 1..4092: note = Cas9 variant
  source 1..4092: mol_type = other RNA
atgaccaagctgggcaagccctacgggatcggcgtggacatcgggagcaactccatcggcttcgccgccgtcgacgagaacagccacctcatccgcctgaaggggaagaccgtgatcggcgcgcggctgttcgaggagggcaaggccgccgccgaccgccgggcctcccgcacgacccggcgccggctcagccgcaaccggtggcgcctgtccttcctgcgggacttcttcgagagccacatcaccccgaccgaccccaacttcttcatgcgccagaagtactccgagatcagccccaaggacaaggcgcggtacaagtacgagaagcgcctcttcaacgaccggacggacgccgagttctaccagcagtaccccaccatgtaccacctccgcaaccggctgctcaccgacccgtccaaggccgacgtgcgcgagatctacttcgccatccaccacatcctcaagagccgggggcacttcctgacctccggctacgcgaaggacttcaacacgaacaaggtcgccctgaacgagatcttccccgccctgcaggacgcctacgcccaggtgtaccccgacctggacatcaccttcgacgagaacaaggtgaacgagttcaagaccgtcctcctggacgagaaggcgacccccagcgacacgcagcgcgccctggtgaacctcctgctggccgaggacggggacaaggacatcctcaagcagcagaagcaggtcctgaccgagttcgccaaggccgtggtgggcctgaagatgaagctcaacgtggcgctggggaccgaggtcgactccagcgaggccaccgcctggaacttctccctgggccagctcgacgacaagtgggccggcatcgagagcgccatgacggacgaggggaccgagatcctggaccagatccgggacctgtaccgcgcgcgcctcctgaacggcatcgtgccggccgggaagaccctgtcccaggccaaggtggacgactacgagcagcaccacgaggacctcgagctgttcaaggactacctgaagcagctcgaggacgacggcatggccaaggtcatccggcagctgtacgaccgctacatcgacggcgacgacgccaagcccttcgtgcgggaggacttcgtgaaggcgctgaccaaggaggtcacggcccaccccaacgccaagagccccgagctcctggagcgcctggtgcagccggacttcatgctcaagcagcggaacaaggccaacggggcgatccccgtgcagatgcagcagcgcgagctggaccagatcatcaagaaccagtccgtctactacgactggctggccgcccccaaccccgtggagaagcaccggcagagcatgccgtaccagctcgacgagctgctgaacttccgcatcccctactacgtgggccccctcgtcaccgccaaggagcagaaggccgcgcagggcggggtgttcgcctggatggtccggaaggaccccgacgggaacatcaccccgtacaacttcgacgagaaggtggaccgcgaggccagcgccaacaccttcatccagcggatgaagacgaccgacacctacctgatcggcgaggacgtgctgcccaagcagtccctgctctaccagagctacgaggtcctgaacgagctgaacaacgtgcgcgtgaacgacaacaagctctccttcgaccagaagcagcaggtcctgggcgagctgttcgagcggcacaacaccgtgacgatcaagcagttcgtggacaacctcctggcccacggggactacgaccgcatccccgaggtccggggcctggcggacgagaagcgcttcctcagctccctgagcacctacaaccagctgaaggggatcctccacgaggccatcgacgactccgacaagcagaccgacatcgagaagatcatcgcctggagcaccatcttcgaggacaaggccatcttcaagacgaagctgaacgagatctcctggctgaccgccggcatgatcaacagcctcgcgaacatccggtaccgcgggtggggccagttctcccacaagctgctgaacgagctcaccctgagcaccggccggacggtgttcgaggagctgctcatctccagccacaacctgatgcagatcctgaccgacgaggtgctcaagcagaagatcgccgagctgaacgcccacgagctgaaggcctccgggatctacgcggccatcgacgacgcctacaccagcccctccaacaagaaggccctccgccaggtcctgagcgtgatcgacgacatcaccaacgccgcgggccaggccccgaactggctgtacatcgagaccgccgacggggacggcgtgcccgggaagcgcacgaactcccggcagcgcaagatccaggagatctacgccaacgccgcgcaggagctcatcaccggcagcgtccggggcgagctggaggacaagatcgccagccgcgccgacttcaccgaccggctggtgctctacttcatgcagggcgggcgcgacatctacaccggggagcccctgaacatcgacaacctgtccagctacgacatcgaccacatcctcccccagtccctgatcaaggacaacagcctggacaaccgggtgctcgtccacccgctggtgaaccgcgagaaggacacgatcttcgcctccacccggttcgccaagcagatgaacggcatgtggcgccagtggcacgcggccggcctgatcagctcccggaagctccgcaacctgcagatgcggcccgacgagatcgacaagtacgccagcgggttcgtggcccgccagctggtcgagacccggcagatcatcaagctcaccgagcagatcgtggcggaccagtaccccgacgccaagatcatcgccgtgaaggccggcctgtccagccagctgcgcaaggagctcgacttcccgaagaaccgggaggtcaaccactaccaccacgccttcgacgcgttcctggccgcccgcatcgggacgtacctgctcaagcggtaccccaacctggagcccttcttcacctacggcaagttcaagaagaccgaggtgaagaagctgaagtccctcaagagcttcaacttcatccgcgacatgacccacgccaaggacaagatcgtggccaaggagacgggggagatcgtctgggacaacgcgtccgacatcaacgagctggaccggatctacaacttcaagcgcatgctgatcacccacgaggtgcgcttcgagaccgccagcctcttcaagcagaccctgtacgccgccaagaactccaagaaccggggcggcagccgccagctgatccccaagaagaaggggtacctcgtggacatctacggcgggtacacgcaggagaccggctcctacctgagcgtcgtgcggctgaccaagaaggccatgtacgcggtggtcaaggtgagcacccgcgacgccgccaagctcgccgtggccaagtccatcagcgagcagaaggagaacgagacgctgaagaagatcatcgacgggaagctgtccaagaccagcaagaagggcaagaccacccaccagctgttcgagatcgtcctgccgcgggtgggccagaagacgctgttcaagaactccaagtacaaccagttcctcgtgaacagcgacacctacatgcacaactaccaggagctgtggatgccccgcgagtaccagcggatgtggaaggacatcctgctctccaaccacggggacgcgcagctggagggccagctggaccagatcttcaagttcatcgtcagccaggtgaactcctacttcaacctctacgacatcaaccagttccgcaagaagatcgccgacgccaccgacaagttcgccaagctgcccacccacgacacggacaacgcgcgggggaagatcgccaccatcggccagctgctcatcgggctgcaggccaacgccatgcgcagcgacctgcggaacctcgacatcaagacccccttcggcctgctgcagatcggcaccgggatcacgctcgacctggacacctccatcatctaccagagcccgaccggcctgttcgagcgcgaggtgcccctcaccgacctgtga

SEQ ID NO: 1916 - RNA, 4092 nt, synthetic construct
  misc_feature 1..4092: note = Cas9 variant
  source 1..4092: mol_type = other RNA
atgcgcggcaactaccacatcgggctggacatcggcaccagctccatcgggtgggccgtgatcgacgacaacgccaaggtcatgcgggcgaagggcaagaccgccatcggggcccgcctctacaacgagggccagacggccgccgaccggcgcctgttccggaccacccgccggcgcctgaaccggcgcaagtggcggctcaagctgctggacgagatcttcgacccctacatcaccccggtggacgcggccttcttcgcccgcctcaagcagagcaacctgtcccccaaggaccagaaccgggactggacgggcagcatgctgttccccgaccgcaccgaccggaagttccacaaggactaccccaccatctaccacctccgccacaagctgatgaccgaggaccaccagttcgacatccgggagatctacctggccatccaccacatcgtgaagtaccgcgggaacttcctcaacacgaccccggtctccagcttctccgtgagcgacgtgaagttcgacgagcagttcgaccggctgaacgagctgtacgcggccgtctcccccgacgagcccttcgccatcaacggcgacaacagcaaggccatcgagaccctcctgctgtccgacgagaccaagaagttcgacaagcagaagcagagcgccaagctcatcctgtccgagacgggggacaaggcgctggacaaggagaacaccaaggtggccacccagatcagcaaggccatcctcggctacaagacccagctggacgtgctgctcaagtacgacgccatcaactccagcgcctggaagatcgagctggacgacgagaacatcgacgacacgctgcccgggctcctgtcccagctggacgagaaccgccaggagatggtcagcatcatccagaacctctacgcccaggtgaccctgaaccagatcgtgccgaacggcatgtccctgagcgagagcatgatcgagaagtacaacgcgcaccgggaccacctcaagctgctgaagcagctcgaggacaagatcgacgaccccaagaagaagaagggcctggaggccgcctacgacgcctacgtcgggaagaacatgaaggtggcgaaccaggacgtgttctacgcctccgtcaagaagaacctggacgacagcgacctcgccaagcagatcgccgacctgatcgaggcccagaagttcatgcccaagcagcgcacctcccagaacggcgtgatcccccaccagctgcaccagctcgagctggaccagatcatcgagaaccagagcaagtactacccgtggctgaccgcggccaaccccaaccccaagcgcatccaccaggccaagtacaagctcgacgagctggtggccttccggatcccctactacgtcgggccgctggtgacgcccgaggagcaggagaagtccgcgaaccaggtgttcgcctggatgaagcgcaagcagcccggcaccatcaccccctggaacttcgaccagaaggtcgaccggatggccagcgccaaccgcttcatccggcgcatgaccacgaaggacacctacctcatcggcgaggacgtgctgccggacgcctccctgatctacgagcggttcaaggtgctgaacgagctcaacctggtcaaggcgaactaccaccgcctggcccccgcccagaagcaggccgcctaccgggacctcttcgagaaccagaagtccatctccaccaagaagctgcagaactacctggtggaccaggggtacttcaccgcgaagcccaagatcacgggcctcagcgaccccgagcgcttcaactccagcctggggacctacatcgacttcaaggagatcttcggcgaccaggtcgacaacccggaccggcaggacgactacgagaagatcatcgagtggtccaccgtgttcgaggaccgccagatctacgaggccaagctgcggaccctcgactggctgacggaggaccagatccaggccctgaagaccaagcgctacaacgggtggggccggctcagcaagaagctgctgaccggcatcgtggacgagaacggggagcgcatcatcgacgtcctctggaacaccaaccagaacttcatgcaggtccagtcccaggagagcttcgccaagcggatccacgaggccaacgcgaagcagatgaaggtgacgggcgtggaggacatcctggccgacgcctacaccagcccccagaacaagaaggccatccgccaggtgatccgggtggtcgacgacatccagaaggcgatgggcggggtggcccccaccagcgtgtccatcgagttcacccgcagcgaggaccagaacccccgccggacccagagccgcgagtcccagctgcagaacacgttcaaggtcgacgccaaggagatcgtggacagcgacctcgtgaccgagctggagaccgtctccaagagcaagaaggggctgaccgaccggctctacctgtacttcacgcagctgggcaaggacatgtacaccggcgacccgctcaacatcgacgagctgtccacctacgacatcgaccacatcctgccccaggccttcatcaaggacgacagcctcgacaaccgcgtgctggtgtccaaggccgtcaacaacgggaagtccaacaacgtgcccgtgaagctgttcggcgggaagatgggcgggttctggaaggagctcgcggaccaccggctgatcagcaagcgcaagctgaagcacctcctgaccgacccggacacgatcgacaagtacaccatgcggggcttcatccgccggcagctggtcgagaccagccaggtgatcaagctcgtggcccagatcctgggcgacaagtaccagaacgacgacaccaagatcatcgaggtcacggccaagatgaaccaccagatgcgcgagaacttcaagctgatcaagaaccgggaggtgaacgactaccaccacgccgtggacgcctacctcaccgcgttcgtcgggcagtacctgtacaagcgctaccccaagctgcggccctacttcgtgtacggcaacttcaagaagttcaacgaggaccacgtgtccttccgctacttcaacttcctccacgagctgatggacgagaacaacaagcggatcgtcgagcccgagaccggggaggtggtgctggagcgcgagccggccatcgcctacatgaagcgggtctaccacttcaagttcatgctcatcagccaggaggtgtacacccgccgggacgccatgttcaaccagacgatctaccccgccaaggaggcgaaccgccggaagctgatcgccatcaagcacggcaagcccgtggacgtctacggcgggtactccggcagcgtggacgcctacatggccatcgtgcgcatccacgacaagaagggggacaagtacaaggtcgtgggcgtgcccatgcgcgcgctggagatcctcaacgccacccacgacaagaaggactacgacgccaagctgaagcagatcctggtcccgaagttcaccaaggtgaagaagtcccggaagaccggggagatcacgaagaaggtggaggacttcgagatcgtcctcggcaaggtgatgtaccgccagctggtgatcgacggcgacaagaagttcatggtcgggagctccacctacctgtacaacgcccggcagctcgtgctgagcgacagctccctggacaccctcgccagcaagggcaccctggactccgacgcggacagcaagcgcctggtggccgtctacgacgagatcgtggagaaggtcgacaagtacttccccctctacgacaagaacgccttccggtccgggctgcacaagggccgcgacaagtacctgctcctgcccaaccggagcacgttcaacggggccaagaaggtgcactccggcaagcgcgagatcctgaacgagatcctcaacggcctgcacgccaacgcgaccctcgggggcctgaaggacctgaagatcagcacccccttcgggaagatgcagggccagtccgggatcccgctgagctccaacaccatcatctgctaccagagccccacgggcctcttcgagcaccgggtgtccctgaaggacctgtga

SEQ ID NO: 1917 - RNA, 4092 nt, synthetic construct
  misc_feature 1..4092: note = Cas9 variant
  source 1..4092: mol_type = other RNA
atggagaacaaccgctacaacgtgggcctggacatcgggaccagctccatcggcttcgccgtcaccgacgagcaggacgagctcgtccaggtgaaggggaagaactacatcggcgtgcggctgttcaaggaggggcagacggccagcgagcgccggtccttccgcaccacccggcgccggctgaagcgccggaagtggcgcctcggcctgctggaggagatcttcgcgccctacctcgcccagggcgacccgtacttcctggcccggatgaaggagagcaacatcagcccccgcgacgagcggaagaagtactacgggagcctgctgttctccgacgacaccgtgttctacgacaagtaccccacggtgtaccacctccgccacgccctgatgaccgaggaccggaagttcgacatccgcgagatctacctcgccgtccaccacatcatcaagtaccggggcaacttcctgatcaacaccctgatcaacgagttcagctccaaggcggtggacttcaagaaggacgccgacatcctcaacgacctgttcgagcagttctacatcagcgacatcaacgactccttccagctgaacaccgccgacatgaacgagatcagcgagctcctgctggacaactccaagacgcgcctcgaccggcagcgcgagagcctgaagaagctggccaagaaggtggacgacatctccgtcgcgaagaagcaccagaagatcgccaccgagttcagcaaggccatcctcgggaacaaggccaagttcgacgtgatcctgaacgtgaccaccgactccagcaacgactggtccttcaagctggaggacgaggacgccgacgagaagatcgtcgtgctcctggaggagctgaacacgccccagcaggaggcgctcaacatcatccaccagtggtacagccagatcagcctgaacggcatcgtgccggacgggaagtccatcagcgaggccatgatctccagctacgagctgcacaaggagcacctcgccctgctgaagcagcagatcaacaacaccaaggacaagaagaaggcccacggcctccacgaggcctacaacgagtacgtccacggcaacaacaacaagaagctgaaccaggcggacttctactccaaggtgaagcagaacctggagagctccctcatcaccgacgagatcctggagctgatcaacgccgagaacttcatgcccaagcagcggaccagcgccaacggggtgatcccccaccagctccaccagcaggagctggaccgcatcatccagaaccaggccaagtactaccccttcctggccgagacgaacccgaacgagaagcgctccaaggtcgcgaagtacaagctcgacgagctggtggccttccgggtgccctactacgtcggccccctgatcaccgccaccgaccagaagaagaccagcgggaaggagttcgcctggatggtgcgcaagcagcccggccggatcacgccgtggaacttcgacgagaaggtgaacaagatggagtccgccaacaccttcatccgccggatgaccaccaaggacagctacctcatcgcggaggacgtcctgcccgacgagtccctgctgtaccagaagttcaaggtgctcaacgagctgaacaacctgcgcgccgacggccggaagctcaaggtcagcgtgaagcagaaggtgttcaaggagctgttccagcagcagaagacgatcaccatcgtcaagctgcagaactacctcaaggccgagtgctccttcctgaccacccccgagatcagcgggctgtccaagcccgagcacttcgtgagctccctcgccacgtacatcgacctgaagaagatcttcggcgaggacatcgacaacccggcgcgccagaacgacttcgagcggatgatcgagtgggccaccatcttcgaggacaagaacatctacagcgagaagctgaacgagatcaagtggctcaacgaccgccagaagaaggagctgaagaacaagaactaccacgggtggggcaagctgagcgccaagctcctgaaggggctgcgggactccgacgagtgcagcatcatcgagcacatgtggaacacccagcagaacttcatgcaggtccaggccgaggaggacttcgcccagcgcatccaggaggagaacaaccagcacctcaagggcaacaccctggaggaggtgctggcggacgcctacacgagcccccagaacaagaaggccatccgccaggtggtgaaggtcatcgaggacatccagaaggccatgggcgggatcgcgccccagaagatctccatcgagttcacccgggcccccgaggagaagccgcggcgctccgtggagcggcagcagcagatcgagaagatctacaagagcgtggccaacgaggtcgagaacgccggcgtgaaggacgagctccagcgcttctccgaccggaagcagaccctgaccgacaagtacttcctgtacttcacgcagctcgggaaggacatgtacaccggcaagagcatcaacatcgaccagatcgggaactaccagatcgaccacatcctgccccaggccttcatcaaggacgactccctggacaaccgcgtgctcgtcagcgccgcggtgaacaacggcaagtccgacaacgtgcccaccaagaacgaccgctacaaggtccgggagcacggccagcgcctgtacgaccaggggctgatcagcaagcggaagttcaacaacctcatcaccgaccccgactccatcaacaagttcaccgcccgcggcttcgtgaagcggcagctggtggagacgagccaggtcatccgcctggtggccgagttcctctacaacaagtaccagtccaagagcgagatcatcgaggtgcgggccaagatgaactcccagctgcgcaaggacttcgggctgatcaagaaccggaacgtcaacgactaccaccacgcgctcgacgcctacctgaccaccttcatcggcaactacctgtaccgccggtacccgaagctccgcgcctacttcacctacgggtgcttcaagaaggtggacgacagccagctgaagtacttcaacttcctgcacgacatcgaggacgacaagaagaagatcatcaaggacaacgacacgggcgagatcctctggcaccgggacgagggcatcgcccgcttcaagcggatctacaacttcaagtacatgctggtgacccacgaggtcctgacccgccagggggccatgttcaagcagaccgtgtacagcgcggccgtggccggctccaagaagctcatccccgtcaaggaggaccggcccatcgacatctacgggggctacacgaacaacaacgacgccttcctggccatcgtgaaggtgaccaagaagaagcagtacatggtcgtgggcatcccccagcgcgcggtggtcaagctgaacgacgccgccaagcaggggagcaaggcctaccagaaggtgctctacaacgtgatcaagccgcagttcatcaagaagaagaaggaccggaagaccggcaagatcacccagaagctggagaacttcgagatcgtcgtgtccaagacgctgtaccgccagctcatcatcgacggggaccagaagtacatgctgggcagctccgcctacaagtacaacgcgaagcagctggtgctcagcgagtacgccctggaggtcctggaccggtccatcttcgagaagaaggagtacaccaccgtggacctcgacaacgtgtacgacgagatcctggcccaggtcgacaagtacttcagcctgtacgacaagaacaagttccgccagaagctccacgagtcccgcaagatcttcaccgagctgcccatcaacaacctgttcagcgggacgaagctcctgaagtccggcaagcgggagaccctgaacgagatcctcgagggcctgcacgccaacgcgaccaagaaggacctgaagtccctcaagttctccacgcccctggggatgatccagtacccgagcggcatcatcctgtccgagaacgccatcctctgctaccagagccccaccgggatcttcgagcgccgggtgaccctgaaggacctgtga

SEQ ID NO: 1918 - RNA, 4092 nt, synthetic construct
  misc_feature 1..4092: note = Cas9 variant
  source 1..4092: mol_type = other RNA
atgaccaagctgggcaagccctacgggatcggcgtggacatcgggagcaactccatcggcttcgccgccgtcgacgagaacagccacctcatccgcctgaaggggaagaccgtgatcggcgcgcggctgttcgaggagggcaaggccgccgccgaccgccgggcctcccgcacgacccggcgccggctcagccgcaaccggtggcgcctgtccttcctgcgggacttcttcgagagccacatcaccccgaccgaccccaacttcttcatgcgccagaagtactccgagatcagccccaaggacaagtcccggtacaagtacgagaagcgcctcttcaacgaccggacggacgcggagttctacaagtacgagaactgccccaccatgtaccacctccgcaaccggctgatgaccgacccgagcaaggccgacgtgcgcgagatctacttcgccatccaccacatcctgaagtcccgggggcacttcctgacccccggcgacgccaaggacttcaacacgaacaaggtcgcggtgaacaagatcttccccgccctgcaggacgcctacgcccaggtgtaccccgacctcgacatcaccttcgacgagaacaaggtcaacgagttcaagaccgtgctgctgaacgagaaggccaccccgagcgacacgcagcgcgcgctcgtgaacctgctgctcgccaaggagggggaccgggacatcctgaagcagcagaagcaggccctgaccgagttcgccaaggccgtcgtgggcctcaagaccaagctgaacgtggcgctggggaccgaggtcgactccagcgaggccacggcctggaacttctccctcggccagctggacgacaagtggaccggcatcgagagcgccatgaccgacgaggggaccgagatcctggaccagatccgcgacctctaccgcgcccggctgctgaacggcatcgtgcccgcggggaagacgctctcccaggccaaggtggacgactacgcccagcaccacgaggacctggagctgttcaaggactacctcaagcagctggaggacgacggcaccgccaaggccatccgccagctgtacgaccggtacatcgacggcgacgacgcgaagcccttcgtccgcgaggacttcgtgaaggccctcaccaaggaggtgaccgcccaccccaacgccaagagcccggagctgctggagcggctcgcgcagcccgacttcatgctgaagcagcgcaacaaggccaacggggccatccccgtccagatgcagcagcgggagctggaccagatcatcaagaaccagtccgtgtactacgactggctcgccgcccccaacccggtggagaagcaccgcaagagcatgccctaccagctggacgagctgctcaacttccggatcccctactacgtcggccccctggtgacggcgaaggagcagaaggccgcccagggcggggtgttcgcctggatggtccgcaaggacccggacgggaacatcaccccctacaacttcgacgagaaggtggaccgggaggccagcgcgaacaccttcatccagcgcatgaagaccacggacacctacctgatcggcgaggacgtcctccccaagcagtccctgctgtaccagcggtacgaggtgctgaacgagctcaacaacgtgcgcgtcaacaacgagaagctgagcatcgagcagaagcagcaggtcatccgggagctgttcgagcgccacaactccgtgaccatcaagcagttcgccgagaacctccgggcccacggcgactacgcccacatgcccgagatccgcgggctggccgacgagaagcggttcctgagctccctcagcacctaccgccagctgaagtccctgctcccggaggcgatcgacgaccccgccaagcaggccgacatcgagaacatcatcgcctggagcacggtgttcgaggacgcggccatcttcaagaccaagctgaaggagatcaactggctggactcccagaccatcaccaagctcagcaacatccgctaccggggctgggggcagttctcccacaagttcctgaacggcctgacgctcgggaacggccacaccatcatccaggagctgttcctgagcaacaacaacctcatgcagatcctgaccgacgagaccctgcagaagaagatgaccgagctcaacgccgacaagctgaaggccgccaacatcaacgacgcgatcgacgacgtgtacacgtcccccagcaacaagaaggccctgcgccaggtgctccgggtcatcgaggacatcaagcgcgccgccgacggccaggacccctcctggctgtacgtggagaccgccgacgggggcgggaccccgggcaagcggacccgcgcgcggcagcaccagctgcaggagatctacgccaacgccgcccacgagctcatcgacagcgccgtgcgcggggagctggaggacaagatcgcggacaaggccgacttcaacgaccggctggtcctctacttcatgcagggcggccgcgacatctacacggggacgcccctgaacatcgaccagctgtccagctacgacatcgaccacatcctcccccagtccctgatcaaggacaacagcctggacaaccgggtgctcgtgcacgccatcatcaaccgcgagaagaacgccaccttcgcgagcaccatctacgcccagaagatgaacgccacctggcggcagtggcacgaggccggcctgatctccgggcgcaagctgcggaacctccagatgcgcccggaccagatcgacaagtacgccagcggcttcgtcgcgcggcagctggtggagacccgccagatcatcaagctgaccgagcagatcgtggccgcccagtaccccgagaccaagatcatcgccgtcaaggccggcctctcccaccagctgcgggaggagctggagttccccaagaaccgcgacgtgaaccactaccaccacgcgttcgacgccttcctcgccgcccggatcgggacgtacctgctgaagcgcttccccaacctccaggccttcttcacctacggcaagttcaagaaggcggacgtgaagaagctgcgcgggttcaacttcatccgggacatcacccacgccgaggacaagatcgtcgtgaaggacaccggcgaggtgatctgggacaagaagcgcgacgtcgacgagctggaccggatctacaacttcaagcgcatgctcatcacgcacgaggtgcacttcgagaaggccgacctgttcaagcagaccgtgtacggggccaaggacagcaaggaggccggcggcaagaagcagctgatctccaagaagaaggggtacccggtcgacatctacggcgggtacacccaggagaccggcagctacctctccgtggtgcggctgacgaagaaggcgatgtacgccgtcgtgaaggtgagcacccgcgacgccgccaagctggcggtcgccaagtccatcagcgagcagaaggagaacgagaccctcaacgacatcatcgacgagaagctgtccaagatcagcaagaacgggaagatcacccacgagctgttcgaggtggtgctcccccgggtcggccagaagacgctgttcaagaactccaagtacaacctgttcctcgtgaacagcgacacctacatgcacaactaccaggagctgtggatgccccgcgagtaccagaagatgtggaaggacatctccctgagcaagtacggcgacgcccagaccgaggaccagctcgaccagatcttcgggttcatcgtgtcccaggtcaacagctacttcaacctgtacgacatcaaccagttccggaagaagctgaacgacgccgccgacaagttcgcgaccctccccatgcgcgacacggacgacatgcagggcaagatcgccaccatcgggcagctgctgatcggcctccaggccaacgccgcccggagcgacctgcgcaacctggacatcaagaccccgctcgggctgctgcagatccccaacggcatctccctcgacagcgacacctccgtggtgtaccagagccccacgggcctgctggagcgggaggtccacctctccgacctgtga

SEQ ID NO: 1919 - RNA, 4092 nt, synthetic construct
  misc_feature 1..4092: note = Cas9 variant
  source 1..4092: mol_type = other RNA
atgaccaagctgaaccagccctacggcatcgggctcgacatcggcagcaactccatcgggttcgccgtggtcgacgccaacagccacctcctgcgcctcaagggcgagaccgcgatcggggcccggctgttccgcgagggccagtccgccgccgaccggcgcgagagccggacgacccgccggcgcctgtcccggacccgctggcggctcagcttcctgcgcgacttcttcgccccgcacatcaccaagatcgaccccgacttcttcctgcggcagaagtactccgagatcagccccaaggacaaggaccgcttcaagtacgagaagcggctgttcaacgaccgcacggacgcggagttctacgaggcctacccctccatgtaccacctccggctgcgcctgatgaccgacgccagccaggccgacccgcgggagatcttcctggcgatccaccacatcctgaagtcccgcggccacttcctcacccccggggccgccaaggacttcaacaccgacgaggtggacctgaagcacatcttccccgccctggccgaggcgtacgcccaggtgtaccccgacctcgagctgaacttcgacagcgccctggccgacgacttcaaggccaagctcctggacgaggacgcgaagccgtccgacatccagaaggccctggtcaacctcctgctgagctccgacggcgagaaggagatcgtgaagaagcggaagcaggtcctcacggagttcgccaaggccatcaccgggctgaagaccaagttcaacctggccctcggcaccgaggtggacgaggcggacgccagcaactggcagttctccatggggcagctggacgacaagtggagcaacatcgagacgtccatgaccgaccagggcaccgagatcttcgagcagatccaggagctgtaccgcgcccgcctcctgaacggcatcgtgcccgccgggatgagcctgagccaggccaaggtggcggactacggccagcacaaggaggacctcgagctgttcaagacctacatcaagaagctgaacgaccacgagctcgccaagacgatccgggggctgtacgaccgctacatcaacggcgacgacgccaagcccttcctgcgggaggacttcgtcaaggccctcaccaaggaggtgaccgcgcaccccaacgaggtgtccgagcagctgctgaaccgcatgggccaggccaacttcatgctcaagcagcggaccaaggccaacggggccatcccggtccagctgcagcagcgcgagctggaccagatcatcgccaaccagagcaagtactacgactggctcgcgaagcccaaccccgtggagaagcaccgggcctccaagccctaccagctggacgagctgctgacgttccgcatcccgtactacgtgggccccctcatcacccccaagcagcaggccgagagcggggagaacgtcttcgcctggatggtgcggaagaacccctccggcaacatcaccccgtacaacttcgacgagaaggtggaccgcgaggccagcgcgaacaccttcatccagcggatgaagacgaccgacacctacctgatcgacgaggacgtcctgcccaagcagtccctcctgtaccagaagtacgaggtgctgaacgagctcaacaacgtgcgcatcaacaacgaggccctgagcaccgaccagaagcagcggctgatccgcgaggtcttcgagcggcactccagcgtgacgatcaagcaggtcgccgacaacctcgtggcccacggggacttcgcccagcgccccgagatccggggcctggcggacgagaagcgcttcctgtccagcctctccacctaccaccagctgaaggagatcctgcacggcgccatcgacgaccccaccaagctccacgacatcgagaacatcatcacctggagcacggtgttcgaggacgccgccatcttcaagaccaagctggcggagatcgactggctggacccggccaccatcaagaagctctccaacatccggtaccgcgggtggggccagttcagccgcaagctgctggacgggctcaagctgggcaacgggcacaccgtcatccaggagctgatgctctccaaccacaacctgatgcagatcctggccgacgagacgctcaaggagaccatgaccgagctgaaccaggacaagctgaagaccgacgacatcgaggacgtgatcaacgacgcctacaccagcccctccaacaagaaggccctccgccaggtgctgcgggtcgtggaggacatcaagcacgcggccaacggccaggaccccagctggctgtacatcgagacggccgacggccccgggaccgccggcaagcggacccagagccgccagaagcagatccagaccgtgtacgccaacgcggcccaggagctcatcgactccgccgtccgcggggagctggaggacaagatcgccgacaaggccagcttcacggaccggctggtgctctacttcatgcagggcgggcgggacatctacaccggcgcgccgctgaacatcgaccagctgtcccactacgacatcgaccacatcctcccccagagcctgatcaaggacgactccctggacaaccgcgtgctcgtcaacgccaccatcaaccgggagaagaacaacgtgttcgccagcaccctgttcgccggcaagatgaaggcgacgtggcgcaagtggcacgaggccgggctgatctccggccggaagctccgcaacctgatgctgcggcccgacgagatcgacaagttcgccaaggggttcgtggcccgccagctcgtcgagacccggcagatcatcaagctgaccgagcagatcgccgcggcccagtacccgaacaccaagatcatcgccgtgaaggccggcctgagccaccagctccgcgaggagctggacttccccaagaaccgggacgtgaaccactaccaccacgccttcgacgcgttcctggccgcccgcatcggcacgtacctcctgaagcggtaccccaagctgacccccttcttcacctacggggagttcgccaaggtcgacgtgaagaagttccgcgagttcaacttcatcggcgccctcacccacgcgaagaagaacatcatcgccaaggacacgggggagatcgtgtgggacaaggagcgggacatccaggagctggaccgcatctacaacttcaagcgcatgctgatcacccacgaggtccacttcgacatggccgacctcttcgaccagaccatctacgccgccaaggactccaaggagcggggcgggagcaagaacctgatccagaagaagcagggctacctgaccggcatctacgggggctactccacggagcgcgggagctacgtgtccatcatccggaccttcaagaagggcgcgccgatctacaacatcgtgaacatcagcaccgccgacgtctccctcctgagcgacaagcagcgcgtgtccgaggccagcgccgacgtgctgctcaaggagctgatcaagaagaagctggcgaagcgcaagagcggggagaacaccaagtccggcgccttcgagatcgtcctcccccgggtgggcaagaacacgctgttcaagaacaagaagtacgggctgttcctcgtggagagcaccaccgagttccacaactaccaggagctgtggctgccccggaacgaccagatgctcatcaagtccatccagagccacaagatcgaggagtccaaggccgactacgagctgacccgcatgtaccggaacatcgccagccaggtcgaccactacttcggcctgtacacgatccgcaagttctccgagaagctcaccgccagcatcaacgactacggggcgctgcccgtgtacaagtccgagaccaccgacggcaagtacgaggtgctgagcaacctcttcgaggggctgggctccggcacgagcaccgggaacctgaccgccgtcaagctccagccgaacttcggccgggtgtacctgacctccgggatcgtgctggaggacgacacgagcatcatctaccagtcccccaccggcctcttcgagcgcagcgtcaagctggccgacctgtga

SEQ ID NO: 1920 - RNA, 4092 nt, synthetic construct
  misc_feature 1..4092: note = Cas9 variant
  source 1..4092: mol_type = other RNA
atgaccaagctgaaccagccctacggcatcgggctcgacatcggcagcaactccatcgggttcgccgtggtcgacgccaacagccacctcctgcgcctcaagggcgagaccgcgatcggggcccggctgttccgcgagggccagtccgccgccgaccggcgcggcagccggacgacccgccggcgcctgtcccggacccgctggcggctcagcttcctgcgcgacttcttcgccccgcacatcaccaagatcgaccccgacttcttcctgcggcagaagtactccgagatcagccccaaggacaaggaccgcttcaagtacgagaagcggctgttcaacgaccgcacggacgcggagttctacgaggactacccctccatgtaccacctccggctgcacctcatgacccacacccacaaggccgacccgcgcgagatcttcctggccatccaccacatcctcaagagccgggggcacttcctcacccccggcgccgcgaaggacttcaacacggacaaggtggacctggaggacatcttccccgccctgaccgaggcctacgcccaggtgtaccccgacctcgagctgaccttcgacctggccaaggcggacgacttcaaggccaagctcctggacgagcaggccaccccgtccgacacgcagaaggccctggtcaacctcctgctgagctccgacggggagaaggagatcgtgaagaagcgcaagcaggtcctcaccgagttcgccaaggcgatcaccggcctgaagaccaagttcaacctggccctcgggacggaggtggacgaggccgacgccagcaactggcagttctccatgggccagctggacgacaagtggagcaacatcgagacctccatgaccgaccagggcaccgagatcttcgagcagatccaggagctgtaccgggcccgcctcctgaacgggatcgtgcccgcgggcatgagcctgtcccaggccaaggtggccgactacgggcagcacaaggaggacctcgagctgttcaagacgtacctgaagaagctcaacgaccacgagctggccaagaccatccgcggcctgtacgaccggtacatcaacggcgacgacgccaagcccttcctccgcgaggacttcgtcaaggcgctgaccaaggaggtgaccgcccaccccaacgaggtgagcgagcagctgctcaaccggatggggcaggccaacttcatgctgaagcagcgcacgaaggccaacggcgcgatcccgatccagctgcagcagcgggagctcgaccagatcatcgccaaccagagcaagtactacgactggctggccgcccccaaccccgtcgaggcccaccgctggaagatgccctaccagctggacgagctgctcaacttccacatcccgtactacgtggggcccctgatcacccccaagcagcaggcggagtccggcgagaacgtgttcgcctggatggtccggaaggaccccagcgggaacatcaccccgtacaacttcgacgagaaggtggaccgcgaggcctccgccaacaccttcatccagcggatgaagacgaccgacacctacctgatcggcgaggacgtgctccccaagcagagcctgctgtaccagaagtacgaggtcctcaacgagctgaacaacgtgcgcatcaacaacgagtgcctgggcaccgaccagaagcagcggctcatccgcgaggtgttcgagcggcactccagcgtcacgatcaagcaggtcgccgacaacctggtggcgcacggggacttcgcccgccggcccgagatccgcggcctggccgacgagaagcggttcctctccagcctgtccacctaccaccagctgaaggagatcctccacgaggccatcgacgaccccaccaagctgctggacatcgagaacatcatcacctggagcacggtgttcgaggaccacaccatcttcgagaccaagctcgccgagatcgagtggctggacccgaagaagatcaacgagctgtccgggatccgctaccggggctgggggcagttcagccgcaagctcctggacggcctgaagctcggcaacgggcacaccgtgatccaggagctgatgctgtccaaccacaacctcatgcagatcctggcggacgagaccctgaaggagacgatgaccgagctcaaccaggacaagctgaagaccgacgacatcgaggacgtcatcaacgacgcctacaccagcccctccaacaagaaggccctgcgccaggtgctccgggtggtcgaggacatcaagcacgccgcgaacggccaggaccccagctggctgttcatcgagacggccgacgggaccggcaccgccgggaagcgcacccagtcccggcagaagcagatccagacggtgtacgccaacgccgcgcaggagctgatcgacagcgccgtgcgcggcgagctcgaggacaagatcgccgacaaggcctccttcaccgaccggctggtcctgtacttcatgcagggcgggcgcgacatctacaccggcgcgcccctcaacatcgaccagctgagccactacgacatcgaccacatcctgccgcagagcctcatcaaggacgactccctggacaaccgggtgctggtgaacgccaccatcaaccgcgagaagaacaacgtcttcgccagcacgctgttcgccgggaagatgaaggccacctggcggaagtggcacgaggccggcctgatctccggccgcaagctgcggaacctcatgctgcgccccgacgagatcgacaagttcgcgaaggggttcgtggcccggcagctggtggagacccgccagatcatcaagctcaccgagcagatcgccgccgcgcagtaccccaacacgaagatcatcgccgtcaaggccggcctgagccaccagctgcgggaggagctcgacttcccgaagaaccgcgacgtgaaccactaccaccacgccttcgacgccttcctggcggcccggatcgggacctacctgctcaagcgctaccccaagctggcccccttcttcacctacggcgagttcgccaaggtggacgtcaagaagttccgggagttcaacttcatcggggccctgacccacgcgaagaagaacatcatcgccaaggacacgggcgagatcgtgtgggacaaggagcgcgacatccgggagctcgaccgcatctacaacttcaagcgcatgctgatcacccacgaggtgtacttcgagaccgccgacctgttcaagcagaccatctacgccgccaaggactccaaggagcggggcgggagcaagcagctcatccccaagaagcagggctacccgacgcaggtctacgggggctacacccaggagtccgggagctacaacgcgctggtgcgcgtggccgaggccgacaccaccgcctaccaggtcatcaagatctccgcccagaacgcgagcaagatcgcctccgccaacctcaagagccgggagaagggcaagcagctcctgaacgagatcgtggtgaagcagctggccaagcgccggaagaactggaagccctccgcgaacagcttcaagatcgtcatcccccgcttcggcatggggacgctgttccagaacgccaagtacggcctgttcatggtgaactccgacacctactaccggaactaccaggagctgtggctcagccgcgagaaccagaagctgctgaagaagctgttctccatcaagtacgagaagacccagatgaaccacgacgccctccaggtgtacaaggccatcatcgaccaggtcgagaagttcttcaagctgtacgacatcaaccagttccgggccaagctgagcgacgcgatcgagcgcttcgagaagctgcccatcaacaccgacgggaacaagatcggcaagacggagaccctgcggcagatcctcatcgggctgcaggccaacggcacccgcagcaacgtgaagaacctgggcatcaagaccgacctcgggctgctccaggtgggctccgggatcaagctggacaaggacacgcagatcgtctaccagagcccgtccggcctgttcaagcggcgcatccccctggccgacctctga

SEQ ID NO: 1921 - RNA, 4095 nt, synthetic construct
  misc_feature 1..4095: note = Cas9 variant
  source 1..4095: mol_type = other RNA
atgggcgaccgcaagtacaacctggggctcgacatcggcaccagctccatcgggttcgccgccgtggacgagaacaaccagcccatccgggtcaagggcaagaccgcgatcggggtgcgcctgttcgaggagggcaagacggccgccgaccggcgcggcttccggaccacccgccggcgcctgagccggcgccggtggcgcatcaacctcctgaacgagatcttcgacgcccacctggccgaggtggacccgaccttcctcgcgcggctgaaggagtccaaccgcagcaacctggaccccaagaagtccttccaggggagcctcctgttccccgagcggaaggactaccagttctacgaggagtaccccacgatctaccacctccgcaaggccctgatggagaaggaccggaagttcgacttccgcgagatctacctggccgtccaccacatcatcaagtaccggggcaacttcctgaacgggaccccgatgcgctccttcaaggtggagaacatcgagctcgacaccctgttcgaccagctgaaccagctctacgccgagatcgtgcccgacaacgagctggcgttcgacctggcccaggtcgccgacgtgaaggacgtgctcagctccaccacgatctacaagatggacaagaagaagcagctggtcaagatgatgctgctccccgccagcaacaaggccctgcagtccgagaacaagaagatcgtgacccagttcgtgaacgcgatcctgaactacaagttcaagctcgacgtcctgctccaggtggagaccgacgccgactggagcctgaagctgaacgacgagggcgccgacgacaagctggaggagttcaccggggacctcgacgagaaccggctggagatcatcgacctgctccagcgcctgcacaactggttctccctgaacgagatcacgaaggacggcaacagcctctccgccgccatggtggagaagtacgagaaccaccaccaccacctgggcctgctcaagaaggtcatcgagaaccaccccgacgcgaagaaggccaaggccctgaaggagacctacaccgcctacgtggggaagaccgacgacaagacgcagaaccaggacgacttctacaaggccgtggagaagaacctggacgacagcccggacgcgaaggagatcaagcgcctcatccagctggaccagttcatgcccaagcagcggaccggccagaacggggccatcccccaccagctgcaccagcaggagctcgaccagatcatcgagaagcagtccaagtactaccccttcctggccgagccgaaccccaacgtcaagcgccggaaggacgccccctacaagctggacgagctgatcgccttcaagatcccctactacgtgggcccgctcgtgacccccgaggagcaggcgcagaacggcgagaacgtcttcgcctggatgaagcgcaaggccgccgggcccatcaccccctggaacttcgacgagaaggtggaccggatggagagcgcgaaccgcttcatccggcgcatgacgaccaaggacacctacctgttcggcgaggacgtgctgccggccgagtccatgatctaccagaagttcgtcgtgctcaacgagctgaacaacctgaagatcaacgggcggcacctcagcctgaaggacaagcaggacgtctacaacgacctgttcaagcagcagaagaccgtgagcatcaaggccctccagaactactacgtgacgaagaagaaggccgccaccgcgcccaccgtcggcgggctggccgaccccaagaagttcctgtccagcctctccacctacatcgacttcaagaacatgttcggcgagcgcgtgaacgacccccagttccaggaggacctggagcagatcgtggagtggagcacgatcttcgaggaccggggcatcttcaaggccaagctgcaggccctcgggtggctgtccgagaagcagatccagcagctggtcgccaagcgctacaagggctgggggcggctcagcaagaagctgctgaccggcctcaagaacgcggaggggtactccatcctggacgagatgtggcgcagcaccggcaacttcatgcagatccagtcccggccggagttcgccgccctgatccagcaggccaacgagaagcagttcgagggcaacgaccccgacaacgtgtgggagaacatcgagaacatcctcggggacgcctacaccagcccccagaacaagaaggcgatccgccaggtggtcaaggtggtgcaggacatcgagaaggccgtcggcaacccgcccgagaagatcgccatcgagttcacgcgggaggccgcggccaacccccagcgcacccagtcccggctgcgcaccctggagaagctctacgagagcgccgaggaggtggtggacgccgggctgaccgccgagctggcggagttcaaggagaacaagcacgtcctctccgacaagtactacctgtacttcacgcagctgggccgcgacgtgtacaccggggacaccatcagcctcgacaagctgaacgactacgacgtggaccacatcctgccccagtccttcatcaaggacgacagcctcgacaaccgggtcctgaccatccgcgccgtgaacaacggcaagtccgacaacgtgccggccaagatgttcggcaagaagatggggagcttctggcggtacctgctcgacaacggcatgatctccaagcgcaagtacaacaacctgatcaccgaccccgacaacatcagcaagtacgcccagaaggggttcatcaaccggcagctggtcgagacgagccaggtgatcaagctcaccgccaacatcctgaacggcatctacgacaaggacaccgagatcatcgaggtgcccgcgaagatgaactcccagatgcgcaagatgttcgacctggtcaaggtgcgggaggtgaacgactaccaccacgccttcgacgcctacctcaccatcttcatcggcaactacctgtacaagtgctaccccaagctgcagccgtacttcgtctacgacaacttcaagaagttcgggaacaaggaggacatcggccacaagcgcttcaacttcctcgggaagatcgagcgggagaagaaggtggtggcccccgagacgggcgagatcctgtggagcaacgtcgcccccaacgagaccatcaagcagatcaagaaggtgtacgactacaagttcatgatcgtgtcccgcgagatcaccacccggcgcgcggagctgttcaaccagacggtctaccccaagaactaccacgggaagctcatcccgatcaaggaggaccggcccaccgacctgtacggcggctacagcgggaacaccgacgcctacctggccatcgtggccctcgaggacaagaagaagggcaagtacttcaaggtggtcgggatccccacccgcgtggcggccaagctggagaagctgaagcagcaggactcccagcagtacctccaggccctgcacaaggtgatcgcgccccagttcaccaagagcacgaagaagggcatcaagaagaccgagttcgagatcgtcctggacaaggtgcactaccggcagctcgtgcaggacgggccggtcaagatgatgctgggctccagcacctacaagtacaacgccaagcagctggtgctctccgagaaggccctccaggtgatcgccgacgaccgcaagttcgacgagacgcagaaggacgacaacctgatcgccgtctacgacgagatcctgagcatcgtgaaccagtccttcgacctgtacgacatcaacggcttccggaagaagctgaacgacaaccgcgaccagttcatcgacctccccgccgagaccaagtacgaggggcggaaggtggtcgcccacggcaagcgcgagatgatcctggagatcctgaaggggctccacgcgaacgccgccttcggcaacctgaagcccatcgggttcagcaccgccttcggccagctccaggtgcccaacggcatcatcctgtccaagaacgccatcctgatccaccagagcccgtccgggctgttcgagcggaagatcaagctcagcgacctgtga

SEQ ID NO: 1922 - RNA, 4095 nt, synthetic construct
  misc_feature 1..4095: note = Cas9 variant
  source 1..4095: mol_type = other RNA
atggagaagcaggagtactacctgggcctcgacatggggatcagctccgtgggctgggccgtcaccaacgacaagtacgagctgctgcgcaagaaggggaaggacatgtggggcatccgggagttcgaggaggccgacagctccgcggagcgccggacccaccgcgtgaaccggcgccggcgccagcgccaggtggcccggatggggctcctgaaggagtacttcagcgacgccatcgagaaggtcgactccaacttcttcatccggatcgagaacagcaagtacttcttcgaggacaaggacggccgcctgtccagcaagaacggcatcttcgacgacgccgactacaaggacgtggactactacacggagtaccccaccatcttccacctccggaaggccctgctggacatcgaggacaccgggaaggagtacgacgtgcgcctcgtctacctggcgctggtgaacatgttcaagcaccggggccacttcctcctgaacaccgagggggacgccctgtccagcgagcaggtcaacacgacctaccaggagctcctggagatcctggagaacaactacgacatctccctcgagagccgcgacatcaaggacgtgatcgacatcatctccagctccgacaacggccggaagaagaagcacgagcagatcctggagctgttcggggtgaagaagtccgacaagcgcgccaacgagctcctgaagtgcctgtgcggcctcagcgtgaacgccaagctgatcttcgacgagaactacgaggagaaggtcgacctgtgcttccacgacttcagctacaccgacaagatcccggacctcatggagaagctgtccgaggaggagtactacgtggtggagcagctcaagagcatctacgactacagcatcctcgcgggcaccctgaaggggtacgactacctgtcctgcgcccgggtcgagctctacgagaagcaccgcgaggacctgaagctgctcaaggccctgtaccggcgctacaagacgaacgaggagtacaacgacatgttcaagagcgacaaggagggcacctactccgcctacgtgaacagcttcaactccagcgactccagcgtgaagatcaagaagtaccgctggaacatgaaggggcggaccatcgacaacctgtacggcaccatcaagaaggccttcaaggacaacacggacgacaaggacgtccagtccatgatggagagcatcgacaaggagcagttcctccccaagcagctgaccggcgcgaacggggtgatccccaaccaggtgcacaagaaggagatggagcgcatcctgaagaaggcccagaactacctccccttcctgaaggagaaggacgagtccgagctgaccgtcagcgagcggatcctccgcctgttcaccttccagatcccgtactacgtgggccccctgggggagaactccaagacgggctgggtggtccggcgcgagggcgggcgggtgctcccctggaacatcgacgagaagatcgacatgagcgccacctccgaggccttcatcggcaacctgatccgcaagtgcacctacctgagcgacgagaaggtcatgcccaaggcctccctgagctacgagcggtactgcgtgctcaacgagatcaacaacatctgcatcgacggggagcgcctggacaccgagctgaagcagaagatctacacggagtgcttcatgaagggcaagcgggtgacccgcaagcagatctgcaactacctcgtcgcgcaggggtgcatcaagtccgacgagcaggtcaccggcatcgacatcaacgtgaacagcagcctgtccagctacgggaagatgttcgccatcttcggcgagcacctgaaggaggacgccatccggaaggtggccgaggagatcatctactggggcaccatcttctccgacagcaagaagatgttccgcaagcacctcacgaagtacgtggagcaggggatcctgggcgagtcccaggtgaagcggatcctggggtacaagttcaaggactggggccgcttcagcaaggccctcctgaccctgcaggggatcgacaagtccaccggcgagctcctgagcctggagaacgcgatgtgggagtactccctcaacttcatggagctgatcaacagcgacgacttcaccttcaaggacgagctggccaaccggcgcacgtccgccatcaagagcctctccgagttcacctacgaggacctggaggacacctacttcagcgtcccggtgaagcggatgatctggcagaccatcctggtggtccgcgagatcgagcagatcatgggctacgcccccaagaaggtgttcgtggagatggcccgctccgaggaggagaagggggacaagggccggaaggacagccgcgggacgcagctcctggagctgtacaagaacatcaagaacaccgagaaccacgactggaagaaggagatctccgaggcgaacgagagcggcaagctccggagcaagaagctgtacctgtactacacccagatgggccgcgacatgtacaccggggaggagatcaacatcgacatgctctacgacgactccatgtacgacatcgaccacatctacccccggcactacgtcaaggacgacagcatcgtgaacaacctggtgctggtcaaccgccgggccaaccaggacatcaagaaggacctctaccccatcccggacaagatcatctccaaccccaaggtgcaggagctgtggaagatgctgcacaagcagaacctcatcacggacgagaagtacaagcgcctgatgagccggtcccccttcaccgagaagcagctgggcgacttcatcgcccgccagctcgtggagacccggcaggggaccaagggcatcgccgagctgctggggcagctgttcaaggacaccgagatcgtctacgcgaaggccacgaacgtgagcgacttccgccgggacaacggcttcgtgaagtcccgcctggtcaacgacttccaccacgcccaggacgcctacctgaacatcgtggtgggcaacgtctactacaccaagttcaccaagaacccctggaacttcatcaagaaggacttcgacaaggaccggaacaagaacgggtacaacctcgccaagatgttcgaccgcgacgtggtgcggggcgacgacaccgcgtggatcgccagcaagaaggacacgcaggggaccatcgagaccgtccgcaagatgatgcggaagaacaccccgctgatgacgcgcatgtccttcgagcagcacggcgggatcgccaacgccaccctgtacagcgccaagaaggcgaaggtggagaactacatccccctcaagtccagcgacatccggctgtccgacgtgaagaagtacggcggcttcaccagcgccaccgtcgcctactacttcatcgtgcaccacaaggaggggaagaaggagaacacgaccatcgaggccctgcccctctactgcaagcgcaaggtggagaacgaggagaacggcctgctgaagtactgcgaggaggtcctcgggtacggcgacgtgaagatcctgttcaacaagctgaagatccagtccctcctggacatcaacgggtaccaggcccacctgagcggcaagaccggcaaccagctcaccctgcgcaacgcgatgaacctgtgcgtgcccgagaagtggacggcctacatcaagaagctcgagaagctggtcgtggggcacgtgaaggagcaggagatctccagcgaggccaacatcgagctgtacgacctcctgaccgacaagcacctgaactccgtctacgccaagcggccgaacgcgtacggccagaagctcatcgacaaccgcagccggttcgtgaacctgaagcccgagagccagtgcgaggccatcctgcagatcctcaagctgaccaagatcgggaacaacgagaccaacctgaagctcatcggcgagtccgagcacagcgggaagatgctgatctccaagaacctgaaggacacggacaagcccgccatcatctgccagagcgtgaccggcctctacgagcgcaagatctacatcttcgacgagcagctggacaagtga

SEQ ID NO: 1923 - RNA, 4095 nt, synthetic construct
  misc_feature 1..4095: note = Cas9 variant
  source 1..4095: mol_type = other RNA
atgaacaagcgctacaacatcggcctggacatcgggaccaacagcatcggctggtccgtggtcaacgaccagagccagctcgtgcggatcaaggggaagctgggctacggggtgcgcctgtacgacgagggccagaccgccgaggaccggcgcctcttccggacgacccgccggcgcctgaagcggcgcaagtggcggctgggcctcctgcgcgagatcttcgagccctacatcaccccgcaggacgccaccttcttcctgcggcagaagcagtccaacctcagccccaaggacctgcagaagcagcagccccagatcgggctgttcaacgaccgcctcgactccgacttccactaccagtaccccacgatctaccacctccggtacgcgctgatgaccgagaagcgccagttcgacctccgggagatctacctggccatgcaccacatcgtcaagtaccgcggccacttcctgaacgccgccgccgcgagctccttcaagagcggggagatcgacctcgccaaggacttcgccgccctgaaccagatcttcggcaccatcttctccgaggtggggttcagcctgtccgagagcaacctcgacgagatcaagtccatcctgctggacaacaacctcagcgcgtccgtgcggcagcgcaaggccctgccgctgatctaccagaccgccgccagcaaggactccgagaagcagtacaaggccatcgcgacggagctcctgaaggccatcctgggcctcaaggccaagttcaacctgatcaccggcatcgaggtcgaggacgtgaaggcctggaccctgagcttcaacgccgaggacttcgacgcgaagctctccgacctgaacatcgccgacaacgacgacgccgtgcagatcatcgagatcctgcgggccctctacagcggggtcctgctgaccggcatcgtgcccgaggggcagagcatctcccaggccatgatcgacaagtacgaggcgcacaaggcccacctcatcatgctgcgcagcatccgcgagcagctgtccgacaaggagaacaaggccctcgagaaggcctacgacgactacatcgaccaccccgaggacaagcagcacggcagccgggaggacttctacgccgcgatcacgaaggtgctgaagaaggactccgaggacaccaacatcatcgagatcctgaagctcatcgagctggaccagttcatgcccaagcagcgcaccaaggacaacggcgccatcccgcaccagctgcaccagcaggagctcgaccagatcatcgagaaccagaagcagtactacccctggctggccgacatcaaccccaacgagcagcggcagaagatggccccctacaagctggacgagctggtcaccttccgcgtgccgtactacgtggggcccatgatcacggcggaggagcagttccagaccagcaacaagaagttcgcctggatgatccggaaggagcccggcgccatcaccccctggaacttcgaccagaaggtcgaccgccaggcctccgccaacgagttcatcaagcggatgaccacgaccgacacctacctcctggcggaggacgtgctgccgaagcagagcctcctgtaccagcgcttcgaggtgctgaacgagctcaacgggatcaagatcgacgaccagcccatcaccgtcgagcagaagcaggccatcttcaacgacaagttcatgcagcaggcccacgtgacggtgaagaacatccaggcctacctggtctccgagggccagtacgccagccggcccaacatcaccgggctgtccgacggcgagaagttcaacagctccctcagcacctaccacgacctgaagaagatcttcggcgacatgatcgacgaccccaacaagcagaccgacttcgagaagatgatcgagtggtccacgatcttcgaggacgggaagatcttcgcggacaagctgcgcgagatcaactggctcaccgacgagcagcggcagcgcctgagcaacaagcggtaccgcggctgggggcagctgtccaccaagctcctgaccaagatcgtggaccagaacggccagcggatcatcgacatcctgtggaacacgaacgacaacttcatgcgcatcatccacagcgacgacttcgaccaggccgtgacccaggccaaccagatgctcctggccgacaacgacacccaggacgtcatcaacgagctgtacacctccccgagcaacaagaaggccctccggcagatcctgctggtggtcgcggacatccagaaggccatgaaggggcaggcccccgcccgcatcctcatcgagttcgcgcgggagaagcaggccaacccccgcctgagcacgcagcgccggcgccaggtggagcaggtctaccaggagctgaacaacgaccagctcaacaaggagctggccgacccccagtacgccaacctgtccaaggaccggctgttcctgtacttcatgcagggcggccgcgacatgtacaccggggagagcctgaacatcgaccggctctccgagtacgacatcgaccacatcctgccgcaggccttcatcaaggacaacagcctggacaaccgcgtgctcgtgtccgcgaagatgaaccggagcaagtccgaccacgtgcccctggacttcaccgaggagcgcttcggccagaagatgcggagccagtgggagcagatgctgcgcgccgggctcctgacccggcgcaagtacaacaacctgaccctcaaccccgactccctgaacaagtacacgatgagcggcttcatcaaccggcagctggtcgagacccgccaggtgatcaagctcgccaccaacctgctggtggaccagtacgccgacgaggacgtccagctcgtgaccgtgaagtccgggctgacgcaccagatgcgggaggacttcgacttccccaagaaccgcaacctgaacaactaccaccacgccttcgacgcgtacctcaccgccttcgtcggcctgtacctgctcaagaagtacccgaagctggcccactacttcgtgtacggccagtaccagcaggggttcaaggccaacgaccagtggcggaacttcaacttcctgaacggcctccgccaggagcagcaggtcgacgccgagaccggggagctgatctggcagaaggaccacgacctggcgtacatgaacaagatctacgacttcaagaagatcctcgtgacccgggaggtgcacacgaaccacggcgccctgtacaaccagaccctgtacaaggccaaggacgacaaggccagcggccagggcgggcgccagctcatcgcggccaaggagaaccggcccaccgccatctacgggggctactccgggaagaccgtggcctacatgtgcctggtccgcatcacggagaagaagggcgacttctaccgcatctgcggcgtgcagaccgcctgggtggacgagctggagcacatcgaggacgcgaccatcaagctccagcggctgaccgccctgctcacgccccagttcagcgccaccaagaagcagaaggacgaggtcgtgaccgtggtcaagccgttcgaggtgctgctgcccaagatcctcatcaaccagcgcttctacgacgggggccaggagctgaccctggcctccgccacgtacaagaacaacgcgcaggagctcgtgctggacaagaaggccgtccaggtgctgaacgggcagctccccaaggccgagctggaggcccaggccaccgtggtctacgaccagatcctggagcgggtgcagaagtacttccccctctacgacatgaacagcttccgcgagaagctgttcgtgggccgggacaagttcaacgagctgccgtggcaggaccagtgggagaaccacaagctcatccaggtcgggcagaagaccatcctggaccgcatcctgatcggcctccacgcgaacgccgccatgggcgacctgaaggccctgaacatgtccacccccttcgggaagctccagaagtccaacggcatcagcctgagccccgagacgcagatcatctaccagagccccaccgggctgttcgagcggcgcgtggccctcaaggacctgtga

SEQ ID NO: 1924 - RNA, 4095 nt, synthetic construct
  misc_feature 1..4095: note = Cas9 variant
  source 1..4095: mol_type = other RNA
atgaagaacctgaaggagtactacatcggcctcgacatcgggaccgccagcgtgggctgggccgtcaccgacgagtcctacaacatccccaagttcaacgggaagaagatgtggggcgtgcgcctgttcgacgacgcgaagacggccgaggagcggcgcacccagcgggggagccgccggcgcctgaaccggcgcaaggagcggatcaacctcctgcaggacctgttcgccaccgagatctccaaggtggacccgaacttcttcctccgcctggacaacagcgacctgtaccgggaggacaaggacgagaagctcaagtccaagtacaccctgttcaacgacaaggacttcaaggaccgcgactaccacaagaagtaccccacgatccaccacctgatcatggacctcatcgaggacgagggcaagaaggacatccggctgctgtacctcgcctgccactacctgctgaagaaccgcggccacttcatcttcgaggggcagaagttcgacaccaagaacagcttcgacaagtccatcaacgacctcaagatccacctccgggacgagtacaacatcgacctggagttcaacaacgaggacctgatcgagatcatcaccgacaccacgctgaacaagaccaacaagaagaaggagctgaagaacatcgtcggcgacaccaagttcctcaaggccatcagcgcgatcatgatcgggtccagccagaagctggtggacctgttcgaggacggcgagttcgaggagaccacggtgaagtccgtcgacttcagcaccaccgccttcgacgacaagtactccgagtacgaggaggccctcggggacaccatcagcctgctgaacatcctcaagtccatctacgacagctccatcctggagaacctgctcaaggacgccgacaagagcaaggacggcaacaagtacatctccaaggcgttcgtgaagaagttcaacaagcacggcaaggacctgaagacgctgaagcgcatcatcaagaagtacctccccagcgagtacgccaacatcttccggaacaagagcatcaacgacaactacgtggcctacaccaagtccaacatcaccagcaacaagcgcaccaaggcctccaagttcacgaagcaggaggacttctacaagttcatcaagaagcacctggacaccatcaaggagaccaagctgaacagctccgagaacgaggacctcaagctgatcgacgagatgctgaccgacatcgagttcaagacgttcatccccaagctcaagagctccgacaacggggtcatcccgtaccagctgaagctgatggagctcaagaagatcctggacaaccagagcaagtactacgacttcctgaacgagtccgacgagtacggcaccgtgaaggacaaggtggagagcatcatggagttccggatcccctactacgtcgggcccctcaaccccgactccaagtacgcctggatcaagcgcgagaacaccaagatcaccccgtggaacttcaaggacatcgtggacctggacagctcccgggaggagttcatcgaccgcctgatcggccgctgcacgtacctgaaggaggagaaggtgctccccaaggcgagcctgatctacaacgagttcatggtcctgaacgagctcaacaacctgaagctgaacgagttcctcatcaccgaggagatgaagaaggccatcttcgaggagctgttcaagaccaagaagaaggtgaccctgaaggccgtgtccaacctcctgaagaaggagttcaacctgacgggcgacatcctcctgagcgggaccgacggcgacttcaagcaggggctgaactcctacatcgacttcaagaacatcatcggcgacaaggtcgaccgggacgactaccgcatcaagatcgaggagatcatcaagctcatcgtgctgtacgaggacgacaagacctacctgaagaagaagatcaagagcgcctacaagaacgacttcaccgacgacgagatcaagaagatcgccgcgctcaactacaaggactgggggcggctgtccaagcgcttcctgacgggcatcgagggcgtggacaagaccaccggggagaagggcagcatcatctacttcatgcgggagtacaacctcaacctgatggagctgatgagcgggcactacaccttcaccgaggaggtcgagaagctcaaccccgtggagaaccgcgagctgtgctacgagatggtggacgagctgtacctctcccccagcgtcaagcggatgctgtggcagtccctgcgcgtggtcgacgagatcaagcggatcatcggcaaggacccgaagaagatcttcatcgagatggcccgcgccaaggaggccaagaacagccggaaggagtcccgcaagaacaagctcctggagttctacaagttcgggaagaaggccttcatcaacgagatcggcgaggagcggtacaactacctgctcaacgagatcaacagcgaggaggagtccaagttccgctgggacaacctgtacctgtactacacgcagctcggccggtgcatgtacagcctggagcccatcgacctggcggacctcaagtccaacaacatctacgaccaggaccacatctaccccaagagcaagatctacgacgactccctggagaaccgcgtgctggtgaagaagaacctcaaccacgagaaggggaaccagtaccccatcccggagaaggtcctgaacaagaacgcctacggcttctggaagatcctgttcgacaaggggctcatcggccagaagaagtacacccggctgacccgccggacccccttcgaggagcgcgagctggccgagttcatcgagcgccagatcgtggagacgcggcaggccaccaaggagaccgccaacctcctgaagaacatctgccaggacagcgagatcgtgtactccaaggcggagaacgccagccgcttccggcaggagttcgacatcatcaagtgccgcaccgtcaacgacctgcaccacatgcacgacgcctacctcaacatcgtggtggggaacgtctacaacacgaagttcaccaagaaccccctgaacttcatcaaggacaaggacaacgtgcggtcctacaacctggagaacatgttcaagtacgacgtggtccgcggcagctacaccgcctggatcgcggacgactccgagggcaacgtgaaggccgccaccatcaagaaggtgaagcgggagctcgaggggaagaactaccgcttcacgcggatgagctacatcggcaccgggggcctgtacgaccagaacctgatgcgcaagggcaaggggcagatcccccagaaggagaacaccaacaagagcaacatcgagaagtacggcgggtacaacaaggcctccagcgcctacttcgcgctcatcgagtccgacggcaaggccgggcgggagcgcaccctggagacgatcccgatcatggtctacaaccaggagaagtacggcaacaccgaggccgtggacaagtacctgaaggacaacctcgagctgcaggaccccaagatcctgaaggacaagatcaagatcaacagcctcatcaagctggacggcttcctgtacaacatcaaggggaagaccggcgactccctcagcatcgccgggtccgtgcagctgatcgtcaacaaggaggagcagaagctgatcaagaagatggacaagttcctcgtgaagaagaaggacaacaaggacatcaaggtgaccagcttcgacaacatcaaggaggaggagctgatcaagctgtacaagacgctctccgacaagctgaacaacggcatctacagcaacaagcggaacaaccaggccaagaacatctccgaggcgctggacaagttcaaggagatcagcatcgaggagaagatcgacgtcctcaaccagatcatcctgctgttccagtcctacaacaacgggtgcaacctcaagagcatcggcctgtccgccaagaccggcgtggtgttcatccccaagaagctgaactacaaggagtgcaagctcatcaaccagagcatcaccgggctgttcgagaacgaggtcgacctgctcaacctgtga

SEQ ID NO: 1925 - RNA, 4098 nt, synthetic construct
  misc_feature 1..4098: note = Cas9 variant
  source 1..4098: mol_type = other RNA
atgtacaagaaggactacaccgtgggcctggacatcgggagcacctccgtcggcttcgccgccatcgacgacgactaccagcccatccgcctcaaggggaagcgggtgatcggcgtgcgcctgttcgaggaggggaagacggcggccgagcggcgcaacttccggaccacccgccggcgcctgaaccggcgcaagtggcggctcagcctgctggaggagatcttcgacccgtacatggccaaggtcgaccccaccttcttcgcccgcctcaagcagtccaacctgttccccaaggacaagaacaagaagttcacgggcagcctcctcttccccaagaccaccgactccaagttctacgacgagtacccgaccatctaccacctccggtaccacctgatgaacgacagccgcaagttcgacctccgggagatcttcctggccatccaccacatcgtgaagtaccgcggcaacttcctgaactccgcgcccatcgccagcttctccacggacaagatcaacctcgtggacgacttcgagaccgtcaacgccgcctacctgcagatcaacagctccaaccccgtgcagctggacaccgaccaggcggaccaggtgagccggatcctcctggacaacaagctgtccaacctcgacaagcagaagcaggccgccaaggccctggcccagaagtccggggacaagaagcaggacaagatcaacaacaccacgatcaagcagatctgcaaggcgctgctcggctacaagttcgacctggccgtcgtgctgaacatcgacagcgacgaccacaacaagtggaagctccagctgagcgacgagaacatcgactcccgcctggccgagctcaccggggagctgaacgaggcccagctggacatcctcaacgtgctgagccggctgtactcccagatcaccctcaacgacatcgtccccagcggcatgaccctgagcgaggccatgatcgagaagtacaaggcgcacaagaagcacctgaagatgctcaaggacttcgcccgctccctgagcaagaaggactacggccaggtgatggaggcctacgccgagtacatcgggaacatcccggagtccgccagctccaaggcgcagaagaagatcagccaggacgacttctacaagaagatcaagcggtacctggacgactccaagctcggccagaagatcgccgagctgatcgccaagaacgagttcatgcccaagcagcgcacgaaccagaacggggtgatcccctaccagctgcacctcaaggagctgaaccagatcatcgagaaccagagcaagtactacccctggctggccgagctcaacccgaacgagaagcgccggggcaaggccaagtacaagctgtccgagctggtcgcgttccgcatcccctactacgtggggcccctgatcacccaggaggagcagcagaagaccagcaacgccaacttcgcctggatgatccggaagtccgagggccgcatcaccccctggaacttcgacgagaaggtggaccggatcgccacggcgaaccgcttcatcaagcggatgaccaccaaggacacctacctcatcggcgaggacgtcctgccggcccacagcctgctctacgagcgcttcaaggtgctgaacgagctgaacatgatccgggtgaacaaccaccgcctctccgtcgggcagaagcaggacgtgttcgagaagctgttccagaagcacaagacggtgaagacccgggagctgatcaagcagctcatggccagcggcctgcccacccagccccgcatcaccgggctgtccgaccccgccaagttcaacacgagcctcggcacctacaacaacttcgccaagatcctgggggacgagatcaaccagccggaccggcaggaggacttcgagaagatcatcgagtggatcaccatcttcgacgacaaggacatcctgaagaccaagctctccgagctgagctggctggacgagaagcagatcaacgcgctcatcaacaagaactactccggctggggccgcctgagccggaagctgctcacggagctgaccaacaagaaggggcagagcatcatcgaccgcatgtggaacacccagaagtccttcatcgagatcatcaacgagcccgtcttcgccgagcagatcaaggacgccaaccaggaccagctggacgaggacgactacgagaccgtgctccacgacgcctacacgagcccccagaacaagaaggccatccggcaggtcatcaaggtggtggacgacatcgtccgcgcggccggccgggcccccaagttcatctccctggagttcgcccgcgaggaccaggagagccgccggacccagtcccgcctgagccggatcaagaagatctacgagaccaccaccaaggagctcgtggccaacgaccagatccgcgaggagctggggaacgtgaaggacctgaacgaccggctgttcctgtacttcacgcagctgggccgcgacgcgtacaccggggagcggatcaacatcgacgacatctccaccaagtacgacatcgaccacatcttcccgcgcgccttcatcaaggacgacagcctcgacaacaaggtcctggtgaagcgggccgtgaacaacggcaagtccaacaacgtccccctgaagctgttcggcgccaagatgaagcccatctggaagatgtggaaggaccaccagctgatcagcaagcgcaagtacgagcacctgatgaccaaccccgacgcgatcgacaagtacaaggccaacgggttcatcaaccggcagctcatcgagacgcgccagatcatcaagctggccgccaacatcctggccaaccggtactccaccgaggacaccaagatcatcgaggtgaaggcgaacctcaaccaccagctgcgccagagcctgcacctctacaagaaccgccaggtgaacgactaccaccacgccgtcgacggctacctgtccgccttcgtggggcagtacctgtaccaccggtacccgagcctccagtcctacttcgtgtacggccagtaccagcggttcttcgacaagcaggtccaggagaacatgaagttcaaccgcttcaacttcctgtacgacctgaccgaccgggacaacgaccagatcgtggtcaagagcacgggggagatcgtgggcgagaagtccaagctcatcgagcagatcaagtgggtgtaccgctacaagttcatgctggtgagccaggaggtcttcaccaagaccggccccctgttcgaccagaccatctaccccgccgggagcaacaagtcccggctcatcccgatcaagaaggaccgccccacggacatctacggcgggtacagctccagcaccgacgcctacatgtccctgatccgcgtgcccgacaagaaggaggacaagtacaaggtggtcggcgtgcccagccggtccctggcgagcctcaaccgcgccgagaagcggggccacgacgcctacctggaccagctgcgccaggtgatcgccaagtcccagaagaaggagttccagatcatcatcccgaagctccggtaccgccagctgatcatcgacgggggcctgaagtacaccctcgggagctccgcctaccagtacaacgcgcggcagctggtcctgagcgagaagtccatggaggtgctcgtgaccgacttcagcaaggtcacgaccgacctggacaagcagaaccagaagctgatcgccgtgtacgacgacatcctcgacaaggtgaaccgctgcctgcccctgtacgacaagaaccagttccggaaggccctcaacggcgcccgcgacaagttcgtccagctgcccatcctgcccaagttcaacgggaacaagaaggaggaggcgggcaaggtggagatcctcaacgagatcctgctgggcctccacgacgacgcctccaccgggaacctgaagccgctgggcatcaagacccccttcgggatgctccagacgcagagcggcatcaccatgtccagcaacgccgtgatcgtcaaccagtcccccaccgggctgttcgagcaccggatctacctgaaggccctcctgaacaagctgaacaagtga

SEQ ID NO: 1926 - RNA, 4098 nt, synthetic construct
  misc_feature 1..4098: note = Cas9 variant
  source 1..4098: mol_type = other RNA
atgaccaagctgaaccagccctacggcatcgggctcgacatcggcagcaactccatcgggttcgccgtggtcgacgccaacagccacctcctgcgcctcaagggcgagaccgcgatcggggcccggctgttccgcgagggccagtccgccgccgaccggcgcggcagccggacgacccgccggcgcctgtcccggacccgctggcggctcagcttcctgcgcgacttcttcgccccgcacatcaccaagatcgaccccgacttcttcctgcggcagaagtactccgagatcagccccaaggacaaggaccgcttcaagtacgagaagcggctgttcaacgaccgcacggacgcggagttctacgaggactacccctccatgtaccacctccggctgcacctgatgacccacacccacaaggccgacccgcgcgagatcttcctggccatccaccacatcctcaagagccgggggcacttcctgacccccggcgccgcgaaggacttcaacacggacaaggtggacctggaggacatcttccccgccctgaccgaggcctacgcccaggtgtaccccgacctcgagctgaccttcgacctggccaaggcggacgacttcaaggccaagctcctggacgagcaggccaccccgtccgacacgcagaaggccctggtcaagctcctgctgagctccgacggggagaaggagatcgtgaagaagcgcaagcaggtcctcaccgagttcgccaaggcgatcaccggcctgaagaccaagttcaacctggccctcgggacggaggtggacgaggccgacgccagcaactggcagttctccatgggccagctggacgacaagtggagcaacatcgagacctccatgaccgaccagggcaccgagatcttcgagcagatccaggagctgtaccgggcccgcctcctgaacgggatcgtgcccgcgggcatgagcctgtcccaggccaaggtggccgactacgggcagcacaaggaggacctcgagctgttcaagacgtacctgaagaagctcaacgaccacgagctggccaagaccatccgcggcctgtacgaccggtacatcaacggcgacgacgccaagcccttcctccgcgaggacttcgtcaaggcgctgaccaaggaggtgaccgcccaccccaacgaggtgagcgagcagctgctcaaccggatggggcaggccaacttcatgctgaagcagcgcacgaaggccaacggcgcgatcccggtccagctgcagcagcgggagctcgaccagatcatcgccaaccagagcaagtactacgactggctggccaagcccaaccccgtggagaagcaccgcgcctccaagccctaccagctggacgagctgctcaccttccggatcccgtactacgtggggcccctgatcacccccaagcagcaggccgagagcggcgagaacgtcttcgcgtggatggtgcgcaagaacccctccgggaacatcaccccgtacaacttcgacgagaaggtggaccgggaggccagcgccaacacgttcatccagcgcatgaagaccaccgacacctacctgatcgacgaggacgtcctccccaagcagtccctgctgtaccagaagtacgaggtgctcaacgagctgaacaacgtgcggatcaacaacgaggccctgagcacggaccagaagcagcgcctcatccacgaggtcttcgagcggcactccagcgtgaccatcaagcaggtcgtggacaacctggtggcccacggcgacttcgcgcagcgccccgagatccggggcctggccgacgagaagcgcttcctctccagcctgtccacctaccaccagctgaaggagatcctccacggggccatcgacgacagcaccaagctgcacgacatcgagaacatcatcacgtggtccaccgtcttcgaggacgccgccatcttcaagaccaagctggcggagatcgactggctcgaccccgccaccatcaagaagctgagcaacatccggtaccgcggctgggggcagttctcccggaagctgctcgacggcctgaagctggggaacggccacaccgtgatccaggagctcatgctgagcaaccacaacctgatgcagatcctcgccgacgagacgctgaaggagaccatgaccgagctgaaccaggacaagctcaagaccgacgacatcgaggacgtgatcaacgacgcctacacgtccccgagcaacaagaaggcgctgcgccaggtcctgcgcgtggtggaggacatcaagcacgccgccaacggccaggacccctcctggctctacatcgagaccgccgacgggaccggcaccgccgggaagcggacgcagagccgccagaagcagatccagaccgtctacgcgaacgccgcccaggagctgatcgacagcgccgtgcggggcgagctggaggacaagatcgccgacaaggcgtccttcaccgaccgcctcgtgctgtacttcatgcagggcgggcgggacatctacaccggcgcgcccctgaacatcgaccagctcagccactacgacatcgaccacatcctgccccagtccctgatcaaggacgacagcctcgacaaccgcgtcctggtgaacgccacgatcaaccgggagaagaacaacgtgttcgcctccaccctgttcgccagcaagatggccgccacctggcgcaagtggcacgaggccgggctcatctccggccggaagctgcgcaacctgatgctccggccggacgagaccgacaagttcgcccacgggttcgtcgcgcgccagctggtggagacgcggcagatcatcaagctgaccgagcagatcgccgccgcccagtaccccaacaccaagatcatcgccgtgaaggcgggcctcagccaccagctgcgcgaggagctggacttccccaagaaccgggacgtcaaccactaccaccacgccttcgacgccttcctcgccgcccgcatcggcacctacctgctgaagcggtacccgaagctcgcgcccttcttcacgtacggggagttcgccaaggtggacgtgaagaagttccgcgagttcaacttcatcggcgccctgacccacgccaagaagaacatcatcgccaaggacaccggggagatcgtctgggacaaggagcgggacatccaggagctggaccgcatctacaacttcaagcggatgctcatcacccacgaggtgcacttcgagacggcggacctgttcgaccagaccatctacgccgccaaggactccaaggagcgcggcgggcgcatgagcctgatccccaagaagctcggctacctgaccggcatctacgggggctaccagaccgagcgggggtcctacgtgagcatcatccgcacgttcaagaagggcgagaccatctacaaggtcgtgaacatcctgaccgccgacgtgtccctcctgagcgagaaggagaaggtctccaagaccctggccgacatctacctcaaggagctgatcgcgaagaagctgagcaaggggaagtccggcaagaacatcgccagcgagcccttcgagatcgtgctcccgcgggtgggcaaggacagcctgttcaagaacaagaagtacgggctgttcctcatcgagtccgccacggagctgcacaactaccaggagctgtggctcccccgcaacgaccagctgctgatcaagcggatccaggcccgccagatcgaggagagcaaggcggactacgagctcacccggatgtaccgcaacatcgcctggcaggtcgaccactacttccggctgtacaagatccgcaagttcgccgagaagctgcaggcctccgtggaggacttcgccggcctccccgtgtacaagaacgagaccagcgacgggaaggtcgaggtgctggcgtccgtgctgaagcggctcaacggcgccgccgacaaggggcgcaccaaccccacgaccgtcaagctgcagagcgacttcggccggaccctgctcaccaacggcatcgtgctggaggacgactccagcatcgtgtaccagtccccgaccgggctgttcaagcgcagcgtcaagctcgtggacctgtga

SEQ ID NO: 1927 - RNA, 4098 nt, synthetic construct
  misc_feature 1..4098: note = Cas9 variant
  source 1..4098: mol_type = other RNA
atgaccaaggagtactacctgggcctcgacgtggggaccaacagcgtcggctgggccgtgacggactcccagtacaacctgtgcaagttcaagaagaaggacatgtgggggatccgcctgttcgagagcgccaacaccgcgaaggaccggcgcctccagcggggcaaccgccggcgcctggagcggaagaagcagcgcatcgacctgctccaggagatcttctcccccgagatctgcaagatcgacccgaccttcttcatccggctgaacgagagccgcctgcacctcgaggacaagtccaacgacttcaagtaccccctgttcatcgagaaggactacagcgacatcgagtactacaaggagttccccaccatcttccacctccggaagcacctgatcgagtccgaggagaagcaggacatccgcctgatctacctggccctccacaacatcatcaagacgcgggggcacttcctgatcgacggcgacctgcagagcgccaagcagctccgccccatcctggacaccttcctgctctccctgcaggaggagcagaacctgagcgtgtccctcagcgagaaccagaaggacgagtacgaggagatcctgaagaaccggtccatcgccaagagcgagaaggtcaagaagctgaagaacctcttcgagatctccgacgagctggagaaggaggagaagaaggcccagagcgcggtgatcgagaacttctgcaagttcatcgtgggcaacaagggggacgtctgcaagttcctgcgcgtgtccaaggaggagctcgagatcgacagcttctccttcagcgagggcaagtacgaggacgacatcgtgaagaacctggaggagaaggtcccggagaaggtgtacctgttcgagcagatgaaggccatgtacgactggaacatcctcgtggacatcctggagaccgaggagtacatcagcttcgccaaggtcaagcagtacgagaagcacaagaccaacctgcggctcctgcgcgacatcatcctgaagtactgcacgaaggacgagtacaaccggatgttcaacgacgagaaggaggccgggtcctacaccgcgtacgtgggcaagctcaagaagaacaacaagaagtactggatcgagaagaagcgcaaccccgaggagttctacaagagcctggggaagctgctcgacaagatcgagcccctgaaggaggacctggaggtgctcaccatgatgatcgaggagtgcaagaaccacaccctgctgcccatccagaagaacaaggacaacggcgtcatcccgcaccaggtgcacgaggtggagctcaagaagatcctggagaacgccaagaagtactactccttcctgacggagaccgacaaggacggctacagcgtcgtgcagaagatcgagtccatcttccggttccgcatcccctactacgtggggcccctgagcacccgccaccaggagaagggctccaacgtctggatggtgcggaagcccgggcgcgaggaccggatctacccgtggaacatggaggagatcatcgacttcgagaagtccaacgagaacttcatcacccgcatgacgaacaagtgcacctacctcatcggcgaggacgtgctgcccaagcacagcctgctctacagcaagtacatggtcctgaacgagctgaacaacgtgaaggtccggggcaagaagctccccacctccctgaagcagaaggtgttcgaggacctgttcgagaacaagagcaaggtgaccgggaagaacctcctggagtacctgcagatccaggacaaggacatccagatcgacgacctctccggcttcgacaaggacttcaagacgagcctgaagtcctacctggacttcaagaagcagatcttcggggaggagatcgagaaggagagcatccagaacatgatcgaggacatcatcaagtggatcaccatctacggcaacgacaaggagatgctcaagcgcgtcatccgggccaactactccaaccagctgaccgaggagcagatgaagaagatcaccgggttccagtacagcggctggggcaacttctccaagatgttcctgaaggggatcagcggcagcgacgtgtccacgggggagaccttcgacatcatcaccgccatgtgggagaccgacaacaacctcatgcagatcctgagcaagaagttcacgttcatggacaacgtggaggacttcaactccggcaaggtcgggaagatcgacaagatcacctacgacagcaccgtgaaggagatgttcctgtcccccgagaacaagcgcgccgtgtggcagaccatccaggtcgcggaggagatcaagaaggtgatgggctgcgagccgaagaagatcttcatcgagatggcccggggcggggagaaggtgaagaagcgcaccaagagccggaaggcccagctcctggagctgtacgccgcctgcgaggaggactgccgcgagctcatcaaggagatcgaggaccgggacgagcgcgacttcaactccatgaagctgttcctgtactacacgcagttcggcaagtgcatgtacagcggggacgacatcgacatcaacgagctcatccggggcaactccaagtgggaccgcgaccacatctacccccagagcaagatcaaggacgactccatcgacaacctggtcctggtgaacaagacctacaacgcgaagaagtccaacgagctcctgagcgaggacatccagaagaagatgcacagcttctggctgtccctcctgaacaagaagctgatcaccaagagcaagtacgaccggctcacgcgcaagggggacttcaccgacgaggagctgtccggcttcatcgcccggcagctggtggagacccgccagagcaccaaggccatcgccgacatcttcaagcagatctacagctccgaggtcgtgtacgtcaagagctccctcgtgagcgacttccgcaagaagcccctgaactacctgaagtcccggcgcgtgaacgactaccaccacgccaaggacgcgtacctcaacatcgtggtcggcaacgtgtacaacaagaagttcaccagcaaccccatccagtggatgaagaagaaccgggacacgaactactccctgaacaaggtgttcgagcacgacgtcgtgatcaacggggaggtgatctgggagaagtgcacctaccacgaggacaccaacacctacgacggcgggacgctggaccgcatccggaagatcgtcgagcgcgacaacatcctctacaccgagtacgcctactgcgagaagggcgagctgttcaacgccaccatccagaacaagaacggcaacagcaccgtgtccctgaagaaggggctcgacgtgaagaagtacggcgggtacttcagcgccaacacgtcctacttcagcctgatcgagttcgaggacaagaagggcgaccgggcccgccacatcatcggggtcccgatctacatcgcgaacatgctggagcactcccccagcgccttcctcgagtactgcgagcagaagggctaccagaacgtgcggatcctggtggagaagatcaagaagaactccctgctcatcatcaacggctaccccctgcgcatccgcggggagaacgaggtcgacaccagcttcaagcgggccatccagctgaagctcgaccagaagaactacgagctggtgcggaacatcgagaagttcctggagaagtacgtggagaagaagggcaactaccccatcgacgagaaccgcgaccacatcacccacgagaagatgaaccagctctacgaggtcctgctgtccaagatgaagaagttcaacaagaaggggatggccgacccgagcgaccggatcgagaagtccaagcccaagttcatcaagctcgaggacctgatcgacaagatcaacgtgatcaacaagatgctgaacctcctgcgctgcgacaacgacaccaaggcggacctgagcctcatcgagctgcccaagaacgccggcagcttcgtggtcaagaagaacacgatcgggaagtccaagatcatcctggtgaaccagagcgtgaccggcctctacgagaaccggcgcgagctgtga

SEQ ID NO: 1928 - RNA, 4098 nt, synthetic construct
  misc_feature 1..4098: note = Cas9 variant
  source 1..4098: mol_type = other RNA
atggacaccgccaagaccaacaagcagccctactacatcggcctggacatggggacgagctccgtgggctgggccgtcaccgacgcgagctacaacgtggtgaagaagcacgggaaggccctctggggcgtccgcctgttcgaggaggcccagaccgccgccgaccggcgcctgcaccggaccgcgcgccggcgcatccagcggcgcaagcagcggctcgccctgctgcaggagctgttcgccaaggagatctgcaaggtggacccggggttcttcatccgcctgcacgagtcccggctgtggcaggaggacaagagcatcgaccagcccaacaccctcttcaacgacgaggacttcgacgacaaggcctaccacaaggcgtaccccaccatctaccacctccgctacgccctgatgaccgagaacaagtccttcgacgtgcggctcgtctacctggccatccaccacatcatcaagcaccgcggccacttcctgctcgagaactacgacctgagcaaccaggagacctccggcttcgacgagagctacatcgccctgacgaacgccatcaaggagctcctgcagaaggagatccccgtggggcacgtggagaagatccagatcatcctgaaggacaagtccctcagcaagcgggagaagaccgagaagatcctgcaggtctgggacgtgatcaaggacaagcagctgaaggaggtggtccagctcatctgcggcgggaccgcgaacctgtccaccctgttcatggacgagagcctcaaggaggccctgaaggtgttcgagatcaaggactccaagatcagcttctccacggccgtgtacgaggagaaggagagcgacctgcagtccgtcctcgagcagcgcttcgacctggtgtacgccgccaagatgctgtacgactggagcctcctggcggagctgatgggcgaccggaagaccctctccgaggccaagatcgccatctacgagacccacaagaaggacctggaggtgctgaagcgcctcacccggcaggacaagagcctgtaccgcaagctgttccgggggacggacaaggacagctactccgcctacgtcggcagctgcatgatccacggcgagaagctcgtgatcgagaagcgcgggtccaccgaggagttctacaagttcctgaagaaggagatcagcaagctgccggactgcgaggacaagatctacgtgctctccaagatcgaggccgagaacttcctgcccaaggcggtcagcaccatcaacggcatcatcccctaccagctgcaggagcaggagctcgacatcatcctgaagaaggccgagcagtacctgcccttcctgatggagaaggacgcctacgggaccatctccgagaagatcaagcagctcctgacgttccgcatcccgttctacgtgggccccctgaaccggcacagcgacaagtcctgggccgtgcacaccgacaaggagggccgcatcctcccctggaacttcaacgagcggatcaacgaggagaagtccgccgagaagttcatcacccgcatgaccaacaagtgcacgtacctgctggggaaggacgtcctccccaagaacagcctgctgtacaccgagtacatgctgttcaacgagctcaacaacgtgaagatcggcaaggcggggacctacctgaccgaggagcagaaggagaagctctggaaggagctgttcctgacgaccaagaaggtcaccctcagcaagttctccaagttcctgatcaaggagggcatcgacaaggaggaggccgtggagatcaaggggctggacggcggcttcaagagctccctcgccccgtggatcgacctgaagaacatcctgggggaggacttcacccgggacaaggccgaggagatcatcaaggcgatcaccctcttcagcatggacaagaagatcctgaagaagtacctgatgcgcatcgtgtccgagcccgtcgccaagcagctcagcaagctgcggtacacgggctgggggcgcttctccaaggagttcctgaccgagatcacgccccgggtgacggacgacgtgcaggtcctcgtggacaccagcaccggcgagatcatgaacatcatcaccgccctgaagaagaccagcctgaacctcatggagatcctgtccagcacgtacgggtactccgccgccatcagcgaggcgaacaaggagctggtgggcaacaccgtcctctcctacgagaccgtgaaggagctgaccgtgagccccgccgtcaagcgcccgatctggcagacgctgaagatcatcaaggagatcacccacatcatgggcgccgagcccgcccggatcttcatcgagatggcccgcgacaagcagcccgacaaggggcggaccgactcccgcaagaagcagctcatcgagctgtacaagaagtgcaaggaggacgtgcggagctggtccaaccgcgagagcaaggactgggtggaggagatcgagtccaagagcgactcccagctgcggagcaacaagctgttcctctactacacccagatgggcaagtgcatgtacacggggaagcccatcgacctgggcgcgctcctgaaggggcagctgtacgaccgcgaccacatctacccgcagtcccagaccaaggacgacagcctcgacaacctggtcatcgtggacaaccgggagaaccgcgacaagtccaacacctaccccctgagcaagaacatccgcgagcggcagatcggcttctggaagctcctgcgcgacaagggcttcatcagcaaggagaagtacttccggctgacccgcaacacgcccttctccgacgccgagaaggccgagttcatcgcccggcagctcgtggagacccgccagagcaccaaggccgtcgcggagatcctgaagcgggtgctgcccaagtccatcatcgtgtacgtcaaggccgggctcaccagccgcttccggcagtacggcgagttcatcaaggtgcgcgacctgaacgactaccaccacgccaaggacgcctacctgaacatcgtgacggggaacgtccactacaccaagttcacctccaacccgatccggttcgtgaaggactgccagatctacagcctcaacgagcacgcgctgtacaagtacaccgtggagcgcaacggcgtcgtggcctgggcccccaacgaggagggcatgatgccctccgtgacgcggtggatgaacaagaacaacatcctggtcacccgcatgagctacgtggggcagggcgagctgttcgaccagctccccctgaagaaggggaagggccaggtgtccctcaagaaggagggggccatcagcgacatctccaagtacggcggctacaacagcgcctccaccgcgtacttcatgtacgtcgagggggaggacaacaagggcaagccggtgtacgtgatcgagaccatgcccctgcacctggccgcccggctcacgaccctggaggagaagcagaagtactgcgaggagctgtggatgagcaccgggggcaagctcaagaaccccaaggtcctgatcgagcagatcccgatccagtccctgttcagcgtggacgggttccgcgtgaccatcgccggcaagacgggcaagcagtacgggtgccggctcgccgaggagctggtcctgaacaacggctacgcgatgaccctcaaggccgtgctgaagttcgtgaaccgccggaagatgaacaaggaggccctgatcacctcctacgaccacctcgaggagagccagctgctggccctctacgacgtcttcctggacaagctggagcactcctgcttcagcaagcgcttcagcacccagcgggacgtgctcaagaacgggcgcgagtcctacatcgccctgagcctggaggacaagtgccagatcctctccgagatcctgcacctgttccagtgcaacgcgacgctcagcaacctgtccctgctcggcagctccaagcagagcgggcgcctgtacatgtccaagaacctgagcgacaaggactcctggtacatcatccaccagagcgtgaccggcttctacgagcagcacatccccctggccccctacaagaagtcctga

SEQ ID NO: 1929 - RNA, 4098 nt, synthetic construct
  misc_feature 1..4098: note = Cas9 variant
  source 1..4098: mol_type = other RNA
atggtgaagaagaagtacgccatcggcatcgacatcgggaccaacagcgtcggctggtccgtggtgaccgacgactacaaggtccccagcaagaagatgaaggtgttcgggaacacggagaagcgctacatcaagaagaacctgctcggcaccctgctgttcgacgaggggaacaccgccgagaaccggcgcctcaagcggaccgcgcgccggcgctacacgcggcgccggaaccgcatcctgtacctgcaggagatcttcgccgaggagatcaacaagatcgacgactccttcttccagcggctcgacgacagcttcctgatcgtggaggacaagcagggctccaagcacccgatcttcggcaccctgcaggaggagaagaagtaccacaagcagttccccaccatctaccacctccgcaagcagctggccgacagctcccagaaggccgacatccggctgatctacctcgccctggcgcacatcatcaagtaccgcgggcacttcctgttcgagggcgacctcaagagcgagaacaaggacgtccagcacctgttcaacgacttcgtggagatgttcgacaagaccgtggaggggtcctacctgagcgagaacctccccaacgtcgccgacgtgctggtggagaaggtctccaagagccggcgcctggagaacatcctccactacttccccaacgagaagaagaacggcctgttcgggaacttcctggccctcgccctgggcctgcagccgaacttcaagacgaacttcgagctcgcggaggacgccaagatccagttctccaaggagacctacgaggaggacctggaggagctgctcggcaagatcggggacgactacgccgacctgttcatcgccaccaagagcctgtacgacggcatcctcctggccgggatcctgtccaccacggacagcaccaccaaggcgcccctctccagctccatggtgaaccggtacgaggagcacaagaaggacctggccctgctcaagaacttcatccaccagaacctgagcgacagctacaaggaggtgttcaacgacaagctgaaggacggctacgccggctacatcgaggggaagaccacgcaggagaacttctaccgcttcatcaagaaggccatcgagaagatcgagggctccgactacttcatcgacaagatcgaccgggaggacttcctccgcaagcagcggaccttcgacaacgggagcatcccccaccagatccacctccaggagatgcacgccatcatccgccgccaggcggagttctaccccttcctggtcgagaaccaggacaagatcgagaagatcctcaccttccggatcccgtactacgtgggccccctggcccgcgggaagtccgagttcgcctggctgaaccgcaagagcgacgagaagatccggccctggaacttcgacgagatggtggacaaggagacctccgccgagaacttcatcacgcggatgaccaactacgaccagtacctccccgaccagaaggtcctgccgaagcacagcctgctgtacgagaagttcgccgtgtacaacgagctcaccaaggtgaagttcatcgcggagggcatgcgcgactaccagttcctggactccggccagaagaaggacatcgtcaagaccctgttcaagacgaagcggaaggtgaccgccaaggacatcaaggcctacctcgagaacagcaacgggtacgccggcgtggagctgaaggggctggaggagcagttcaacgcctccctccccacctaccacgacctgctgaagatcctccgcgacaaggcgttcatcgacgccgaggagaaccaggagatcctggaggacatcgtcctgaccctcacgctgttcgaggaccgggagatgatccgcaagcggctggagaagtacaaggacatcctcaccgaggagcagcgcaagaagctggagcggcgccactacaccggctgggggcggctgagcgccaagctcatcaacggcatcctggacaaggtgacccgcaagacgatcctgggctacctcatcgacgacgggacctccaaccggaacttcatgcagctgatcaacgacgacaccctgagcttcgtcgacgagatccgcctcgcccagggctccggggaggcggaggactaccgggccgaggtgcagaacctggccggcagccccgccatcaagaaggggatcctgcagtccctcaagatcgtggacgagctgatcgaggtcatgggctacgaccccgagcacatcgtggtggagatggcccgcgagaaccagttcaccaaccagggccgccggaacagccagcagcgctacaagaagatcgagaacgcgatcaagaacctggactccaacctcaacagcaagatcctgaaggagtacccgacgaacaaccaggccctgcagaacgaccggctgttcctgtactacctgcagaacgggaaggacatgtacaccgacgaggagctcgacatcgaccagctgtcccagtacgacatcgaccacatcatcccccaggccttcatcaaggacgacagcctggacaacaaggtcctcaccaagagcgccaagaaccgcggcaagtccgacgacgtgcccagcctggagatcgtgcacaagaagaagaacttctggaagcagctgctcgactcccagctgatcagccagcggaagttcgacaacctgaccaaggccgagcgcgggggcctcaccaacgaggacaaggcgcggttcatccagcgccagctggtcgagacgcggcagatcaccaagcacgtggcccgcatcctggacacccggttcaacaccaagctcgacgaggccggcaaccgcatccgggaccccaaggtgaacatcatcacgctgaagtccaacctggtcagccagttccgcaaggactaccagctctacaaggtgcgggagatcaacaactaccaccacgcccacgacgcctacctgaacgcggtggtcgccaccgccctgctcaagaagtacccgcagctggcccccgagttcgtgtacggggactaccccaagtacaactcctacaagagccgcaagtccgcgaccgagaaggtgctgttctacagcaacatcatgaacttcttccggcgcgtcctcgtgtactccaagaccggcgaggtgcggatccgccccgtcatcgaggtgaacaaggagacgggggagatcgtgtgggacaagaagtccgacttccggaccgtccgcaaggtgctgagctacccccaggtgaacgtcgtgaagaaggtggagatgcagaccggcgggttcagcaaggagtccatcctgcagcacggcgacagcgacaagctcatcccccgcaagaccgagaagttctacctggacacgaagaagtacggcgggttcgactcccccaccatcgcctacagcgtcctgctcatcgccgacatcgagaagggcaaggccaagaagctgaagcgggtgaaggagctgatcgggatcaccatcatggagcgcatggccttcgagaagaaccccatcgagttcctcgagcacaagggctacaagaacatcctggagaagaacatcatcaagctgccgaagtacagcctcttcgagctggagaacgggcggcgccggctgctcgcgtccgccaaggagctgcagaagggcaacgagatgatcctgccgccccacctcgtgaccctgctgtaccacagctccaacatccacaagatcacggagccgatccacctcaactacgtcaacaagaacaagcacgagttcaaggagctgctgcgccacatcagcgacttctccacccggtacatcctcgcccaggaccgcctgagcaagatcgaggagctgtacgacaagaacgacggcgacgacatctccgacctcaccagctccttcgtgaacctgctgaccttcacggccatcggggcccccgcggccttcaagttcctcggcagcgtgatcgaccggaagcgctacacctccatcgccgagatcctggaggccaccctgatccaccagagcgtcaccgggctctacgagacgcggatcgacctgtccaagctgggcggggactga

SEQ ID NO: 1930 - RNA, 4101 nt, synthetic construct
  misc_feature 1..4101: note = Cas9 variant
  source 1..4101: mol_type = other RNA
atgaagaagccctacagcatcggcctggacatcgggaccaactccgtgggctgggccgtcatcaccgacgactacaaggtgccggccaagaagatgaaggtgctcgggaacacgaacaagaagaccatcaagaagaacctgatcggcgcgctgctgttcgacgccgggaacaccgccgccgaccgccggctgaagcgcaccgcccggcgccggtacacgcgccggcgcaaccggatcctgtacctccaggagatcttcgcggccgagatgaacaagctggacgagagcttcttccaccgcctggacgactccttcctcgtccccgaggacaagggcggcagcaagtaccccatcttcgggaccctggaggaggagaaggagtaccacaagcagttccccaccatctaccacctccggaagtccctcgccgacagcaaggagaaggccgacctgcgcctgatctacctcgcgctggcccacatcatcaagtaccggggccacttcctgtacgaggacaccttcgacatcaagaacaacgacatccagaagatcttcaacgagttcacgtccatctacaacaacatcttcgaggagagctccctcagcaacgagaacgcccaggtggaggagatcttcaccgacaagatctccaagagcgccaagaaggaccgcgtgctgaagctgttcccggacgagaagtccaccgggctgttcagcgagttcctgaagctgatcgtcggcaacaaggccgacttcaagaagcacttcgacctcgaggagatggcgcccctgcagttctccaaggacacctacgacgaggacctggagagcctcctggggcagatcggcgacgactacgccgacctgttcgtggtggccaagaagctctacgacgccatcctgctggccggcatcctctccgtcaaggaccccgcgacgaaggcgcccctgagcgcctccatgatcgagcggtacgacaaccaccagaacgacctgagcgccctcaagcagttcatccgcagcaacctgccggagaagtacgccgaggtgttctccgacgacagcaaggacgggtacgccggctacatcgacgggaagaccacccaggagggcttctacaagtacatcaagaaccagatctccaagttcgagggcaccaagtacttcctggagaagatcgagcgggaggacttcctccgcaagcagcggacgttcgacaacgggagcatcccccaccagatccacctccaggagatgaacgccatcctgcagaaccagggcgggtactaccccttcctcaaggccaacaaggagcgcatcgagcagatcctgaccttccggatcccctactacgtgggcccgctggcccgcgggaactccgacttcgcctggctcacccgcaacagcgacgacgcgatccggccctggaacttcgaggaggtcgtggacaaggcctccagcgccgaggacttcatcaacaagatgaccaactacgacctgtacctgcccgaggagaaggtgctccccaagcactccctgctgtacgagacgttcgccgtctacaacgagctgaccaaggtgaagttcatcgcggaggccatgaaggactacgagttcctcgacagcggccagaagcgcaagatcgtggagaacatcttcaagaaccaccggaaggtcaccgagaaggacatcatcaactacctgcacaacgtggacggctacgacgggatcgagatcaagggcatcgagaagcagttcaacgcctccctgagcacctaccacgacctcctgaagatcatcaaggacaaggagttcatggacaacccgaagaacggggagatcctggagtccatcatccacacgctcaccatcttcgaggaccgcgagatgatcaagcagctgctggcccagtacaacagcgtgttcgacgagaaggtcatcaaggccctctcccggaagcactacaccggctgggggaagctgagcgcgaagctgatcaacggcatccgcgacaagcagaccggcaactccatcctcgactacctgatggacgacggcaagagcaaccggaacttcatgcagctgatcaaggacgacgggctctccttcaaggagatcatcgacaaggcccaggtggtgggggagacggacaacctgcgccaggtcgtgcagaacctgcccggcagccccgccatcaagaaggggatcctccagagcatcaagctggtcgacgagctggtgaaggtgatgggctccgaccccgagagcatcgtcatcgagatggcccgggagaaccagaccaccaacaagggcaagtccaagagccagcagcgcctcaagaccctgtccgacgccatcagcgagctggggtccaacatcctcaaggagcacccgacggacaacatccagctgcagaacgaccggctgttcctctactacctgcagaacggcaaggacatgtacaccggggaggcgctggacatcaaccagctcagcaactacgacatcgaccacatcatcccccaggccttcatcaaggacgactccctggacaacagcgtgctgacctccagcaaggacaaccgcggcaagtccgacaacgtgcccagcctcgagatcgtcgagaagatgaagggcttctggcagcagctgctggactccaagctcatcagcgagcggaagttcaacaacctgaccaaggtggagcgcgggggcctggacgagcgggacaaggtggggttcatcaagcgccagctcgtcgagacgcggcagatcaccaagcacgtggcccagatcctggacgcccgcttcaacgccgaggtgaacgagaagaaccagaagctgcggtccgtcaagatcatcaccctcaagagcaacctggtgagcaacttccgcaaggagttcggcctgtacaaggtgcgcgagatcaacgactaccaccacgcgcacgacgcctacctcaacgccgtcatcgccaaggcgatcctgaaggagtaccccaagctggagccggagttcgtgtacggggactaccagaagtacgacctcaagcggtacatctcccgcaccaaggaccccaaggagatcgagaaggccaccgagaagtacttcttctacagcaacctgctgaacttcttcaaggacaaggtgtactacgccgacggcacgatcatccagcggggcaacgtcgagtactccaaggacaccggggagatcgcctggaacaagaagcgcgacttcgccatcgtgcggaaggtgctcagctacccccaggtcaacatcgtgaagaagaccgaggagcagaccggcgggttctccaaggagagcatcctgcccaagggcaactccgacaagctgatcccgcgcaagacgaagaacatccagctcgacaccaccaagtacgggggcttcgacagccccgtgatcgcgtactccatcctgctggtcgccgacgtggagaagggcaagagcaagaagctcaagaccgtgaagtccctgatcgggatcacgatcatggagaaggtcaagttcgaggccaaccccgtggccttcctggagggcaaggggtaccagaacgtggtcgaggagaacatcatccggctcccgaagtacagcctgttcgagctggagaacggccgccggcgcatgctcgcctccagcaaggagctgcagaaggggaacgagatggtgctgccctcctacctcctggcgctgctctaccacgccaagaagatccagaagaaggacgagcccgagcacctggagtacatcaagcagcaccacagcgagttcaacgacctgctcaacttcgtgtccgacttcagccagaagtacgtcctggccgagtccaacctggagaagatcaagaacctctacatcgacaacgagcagaccaacctggaggagatcgccaacagcttcatcaacctgctcaccttcaccgccttcggcgcgcccgccgtgttcaagttcttcggcaaggacatcgagcggaagcgctacagcacggtgaccgagatcctgaaggccaccctgatccaccagtccatcaccgggctctacgagacgcggatcgacctgagcaagctgggcgaggagtga

SEQ ID NO: 1931 - RNA, 4101 nt, synthetic construct
  misc_feature 1..4101: note = Cas9 variant
  source 1..4101: mol_type = other RNA
atggacaagaagtacaacatcggcctggacatcgggaccagctccatcggcttcgtggccaccgacgaggacaaccacgtcatccgcgccaaggggaagaacgtgatcggcgtgcggctgttcgacgaggggcagagcgcggccgagcgccggggcttccgcacgacccggcgccggctgaaccgccggaagtggcgcctgaacctcctgcgggagatcttcgagccccacatctacccgatcgacgcctccttcttcatgcgccagaagtacagcaacctgtccaagcaggaccccaaccagaagatcgagttcaaggacatcctcttcagcgacaagtccgacgccgagttctaccggcagtaccccaccatctaccacctccgccaggccctgatgaccgagaagcggcagttcgacctccgcgagatctacctggcgatccaccacatcgtcaagtaccggggccacttcctggacgagacgcccaccgacaagttcagcttcgaccagctcgacctgacccaggagttcgagcgcctgaacgtcctcttctccgagcagaacccggaggagcccttcgagatcgtggtgaaccagaaccagagcatcgaggacatcctgtccaaccagagcatgaccgcctccgaccggcgcaagcaggccctggtggtgttctaccagcagagcgagaacaaggagaacgagaagcagtacaaggccatcgcgacggagatcctcaacctgctgctcgggaacaaggccaagctgaacgtcatcctggcccaggaggtggacaaggaggccgccaaggactggtccctcagcctgtccagcgagaccttcgacgacgacctggagaaggcgtccagcggcctcaacgacagccagctggagatggtggggatcttcgagcggatctactccagcctgatcctcaagtccatcatcggcgaccacaacagcctgtccgccgccatggtcgacaagttcaagacccacgcccagcaccgcgacctgctcaaggacgtgatcaagaacagcgacgccaccaagggggagcagctgcagttcgcgtacgaccactacctgcagcgccactccgccgacggcaaggcctacggcaaggacgacttctacaaggaggtgaagaagaacctcgacgacagcgacgccgcccagcagatccagcagctgatcgacacggaccagttcatgcccaagcagcggaccaaggcgaacggggccatcccccaccaggtccagcagaaggagctggacctcatcatcgagaaccagtgccagtactacccgtggctggccgaggagaaccccaactccgagcgccacaacgtggccaagtacaagctggacgagctcgtgagcttccgggtcccctactacgtgggccccctgatctccccggccgacgacgagaccgacccccaggcgatccagaacaccaagttcgcctggatgatccgcaaggacgcccaggggcggatcacgccctggaacttcgacgacaaggtggaccgcgagaagtccgccgacaagttcatcaagcggatgaccaccaccgacacgtacctgatcggcgaggacgtcctccccgaccagagcctgatctaccagcgctacaaggtgctgaacgagctcaacaacgtgcggatcaacggccgcccgatcgaggtccagatcaagcagaacatctacaccgacctgttcaagaagttcaagagcgtgtccgtcaagaagctgcggagctacctggaggagatgtcctactaccccgggagcttcaagatctccggcctcaccaaccccgggaagttcgacaacggcctgaccagctacctggactacaagaacatcctcggggacagcgtggacgcgaacgacaagcgcgccgacatcgagcagatgatcgagtggtccacgatcttcgaggacaacaagatcttcgcccagaagctggagagcatgacctggctgaccgccgagcagcggaaggccatctcccgcaagcggtacaccggctggggccgcctcagcaacaagctgctgacgcagctcaagaaccaggacaaccggtccatcatggacctgctgtgggagaccgaggagaacttcatgaagatccagagcgcgcccgacttctccaagatgatcgaggcccacaaccagcagttcatcaagaacgaggccaacatccagcaggtcatcagcgacctctacacctccccgcagaacaagaaggccatccgccagatcctgctggtggtggacgacatccagaaggccgtggggcacgcgcccgagcacatcgccatcgagttcgccaagggcgaggacaagaacccccggcgcaccatcagccgcgagatgaagatccaggacgtctaccagcagatctccgacgacatcctcgtgagccccgaggtgcgggcccagctgaacgagaagatcgagaaccgccacgggcggctgtccgaccgcctcttcctgtacttcatgcagggcgggcgggacatgtacacgggcaagccgatcaacatcaacaacatcagccactacgacatcgaccacatcctgccccaggccttcatcaaggacgactccctcgacaaccgcgtcctggtgagcgacaagctgaaccgggagaagtccgacaccgtgccccgcgacctcttcggccgggagatgatgagcacctgggagaagatggcggaccgcgggctgatcaccaagcggaagctggccaacctcaagacgatccccggcagcatcgacgcccacaaggcccaggggttcatcaaccgccagctggtcgagacccgccaggtgatcaagctggcggtgggcatcatgatcgaccagtacccggagacccagatcgtctccgtgaaggccaacctcacccacgagatgcgggagatgttcgacctggtgaagaaccgggacgtcaacgactaccaccacgccttcgacgcctacctgaccgccttcgtggggaactacctcctgcagcgctaccccaagctggagccctacttcgtgtacgacaagttcaagaagctcaaggaccagaacatcagcatgcgggacttcaacctgctgtacgacctcaagaagaacgaggacgtctacgaccagcgcacgggccactccgcgcacaagatctgggaccagcacggcagcatcgactacatccggcacctgttcgcctacaagaagatcctggtgtcccacgaggtgcaccagaacgggggcgccctctacaacatgaccgtctacgggaaggccgacgacgccaagcgcaagctgatcccgatcaaggcggacaagcccaccgagctgtacggcggctacaccagccggaagctcgcctacatggccatcgtgaagacgaagaaggggaagaaggagcagtaccaggtgaccggcgtccccgtgtccgccctgaccaccctgcgccagttcaaggaggacagccccgagcagaagcaggccctcgaggagatcgtgcgccggaacttcgacgagaagacggaggtcgagatcatcgtgccgaaggtgctgttcaaccagctgatcgtcgacgagaagtgccgcttcatggtggggtccgacacctaccggtacaacgcgcagcagctcgtgctgagcgccgacgacctggagatcatcaacgcctcccacaaggacatccagaccatcgacagctccgactacagccagcagctcgaccaggtctaccagaacatcctgaccatcgtggacaagcacttccccatgtacgacatcaacaagttccgcacgaagctgcacgacatctacgagcagtacatcgagctccccaacgaggacgtgtgggagaacaacaagctgaccaccctgggcaagcacaccatcatcatccggatcctccaggggctgcacgccaacgcgacggtcgtggacctgaagcagctcggcatcaagacccccttcggcttcatgcagcaggcccgcgggatcgtggtctccccggacgcccagctgatctaccagagccccaccggcctgtacgagcggcgcgtgcggctcggggacctgtga

SEQ ID NO: 1932 - RNA, 4101 nt, synthetic construct
  misc_feature 1..4101: note = Cas9 variant
  source 1..4101: mol_type = other RNA
atgggcgaccgcaagtacaacctggggctcgacatcggcaccagctccatcgggttcgccgccgtggacgagaacaaccagcccatccgggtcaagggcaagaccgcgatcggggtgcgcctgttcgaggagggcaagacggccgccgaccggcgcggcttccggaccacccgccggcgcctgagccggcgccggtggcgcatcaacctcctgaacgggatcttcgacgcccacctggccgaggtggacccgaccttcctcgcgcggctgaaggagtccaaccgcagcaacctggaccccaagaagtccttccagggcagcctcctgttccccgagcggaaggactaccagttctacaaggagtaccccacgatctaccacctccgcaaggccctcatggaggaggaccggaagttcgacatccgcgagatctacctggccgtccaccacatcatcaagtaccgggggaacttcctgaacggcaccccgatgcgctccttcaaggtggagaacatcgagctcgacaccctgttcgaccggctgaaccagctctacgaggagatcatccccgacaacgagctggccttcgacctggagcaggtcgcggacgtgaaggaggtgctcagctccaccacgatctacaagatggacaagaagaagcagctggtgaagatgatgctgctccccaccagcaacaaggccctgcagtccgagaacaagaagatcgtcacccagttcgtgaacgccatcctgaactacaagttcaagctcgacgtgctgctgcaggtcgagaccgacgccgactggagcctcaagctgaacgacgagggggccgacgacaagctggaggagttcacgggcgacctcgacgagaaccgcctggagatcatcgacctgctccagcgcctgcacaactggttctccctgaacgagatcaccaaggacggcaacagcctctccgcggccatggtggagaagtacaaggaccaccggcaccacctggagctgctcaagaaggtgatcgaggaccaccccgacgccaagaaggccaaggccctgaaggagacctacaccgcgtacgtcgggaagacggacgacaagacccagaaccaggacgacttctacaaggccgtggagaagaacctggacgacagcccggacgccaaggagatcaagcgcctcatccagctggaccagttcatgcccaagcagcggaccggccagaacggggccatcccccaccagctgcaccagcaggagctcgaccagatcatcgagaagcagtccaagtactaccccttcctggccgagccgaaccccaacgtgaagcgccggaaggacgcgccctacaagctggacgagctgatcgccttcaagatcccctactacgtcggcccgctcgtgacccccgaggagcaggcccagaacggcgagaacgtgttcgcctggatgaagcgcaaggtcgccgggcccatcacgccctggaacttcgacaagaaggtggaccggatggagagcgcgaaccgcttcatccggcgcatgaccaccaaggacacctacctgttcggcgaggacgtgctgccggccgagtccatgatctacgagaagttcgtcgtgctcaacgagctgaacaacctgaagatcaacgggcggcacctcagcctgaaggacaagcaggacatctacaacgacctgttcaagcagcagaagacggtcagcatcaaggccctccagaactactacgtgaccaagaagaaggccgcgaccgcccccaccgtgggcgggctggccgaccccaagaagttcctgtccagcctctccacgtacatcgacttcaagaacatgttcggcgagcaggtcaacgacccccagttccaggaggacctggagcagatcgtggagtggagcaccatcttcgaggaccgcggcatcttcaaggccaagctgcaggccctcgggtggctgtccgagaagcagatccagcagctggtggcgaagcggtacaagggctgggggcgcctcagcaagaagctgctgaccggcctcaagaacgccgaggggtactccatcctggacgagatgtggcggagcaccgagaacttcatgcagatccagtcccgcccggagttcgccgccctgatccagcaggccaacgagaagcagttcgagggcaacgaccccaacaacgtctgggagaacatcgagaacatcctcggcgacgcgtacacgagcccccagaacaagaaggccatccgccaggtggtgaaggtcgtgcaggacatcgagaaggccgtggggaacccgcccgagaagatcgccatcgagttcacccgggaggccgcggccaacccccagcggacccagtcccgcctgcgcaccctggagaagctctacgagagcgccgaggaggtcgtggacgcccggctgacggcggagctggccgagttcaaggagaacaagcacgtgctctccgacaagtactacctgtacttcacccagctgggccgcgacgtctacaccggggacaccatcagcctcgaccggctgaacgactacgacgtggaccacatcctgccccagtccttcatcaaggacgacagcctcgacaaccgcgtgctgaccatccgggccgtcaacaacggcaagtccgacaacgtgccggccaagatgttcgggaagaagatgggcagcttctggcgctacctgctcgacaacggcatgatctccaagcggaagtacaacaacctgatcacggaccccgacaacatcagcaagtacgcccagaaggggttcatcaaccgccagctggtggagaccagccaggtcatcaagctcaccgcgaacatcctgaacggcatctacgacaaggacaccgagatcatcgaggtgcccgccaagatgaactcccagatgcggaagatgttcgacctggtgaaggtccgcgaggtgaacgactaccaccacgccttcgacgcctacctcacgatcttcatcgggaactacctgtacaagtgctaccccaagctgcggccgtacttcgtgtacggcaagttcaagaagttcagcgacaacgaggacatcgaggtcggcgacgggcgcttcaacttcctcaaccggatcgagcgcctgaagaacgtgaccgaccccgagaccggcgagatcctgtggtccaacgtggcccccaacgagaccatcaagcggatcaagaaggtctacaactacaagttcatgatcgtgagccgcgagatcacgacccggcgcgcggagctgttcaaccagaccgtgtaccccaagaactaccgggggaagctgatcccgatcaaggaggaccgccccaccgacctgtacggcgggtactccggcaacacggacgcctacctcgccatcgtcgccctggaggacaagaagaagggcaagtacttcaaggtggtggggatccccacccgggccgcggccaagctggagaagctcaagcagcaggacagccagcagtacctgcaggccgtccacgaggtgatcgcgccccagttcaccaagtccaccaagaagggcatcaagaagacggagttccgcatcgtgctggacaaggtccactaccgccagctcgtgcaggacgggccggtgaagatgatgctgggcagctccacctacaagtacaacgccaagcagctggtcctcagcgagaaggccctccaggtgatcaaggacgaccggaagttcgacgagacccagaaggacgacaacctgatcgccgtgtacgacgagatcctgtccatcgtcaaccagagcttcgacctgtacgacatcaacgggttccgcaagaagctgaacgacaaccggaaccagttcatcgacctccccgccgagaccaagtacgagggccgcaaggtggtggcccacggcaagcgggagatgatcctggagatcctgaaggggctccacgcgaacgcctccttcggcaacctgaagcccatcgggttcgccacgcccttcggccagatgcagagcaagaacgggatcgagctgtccgagaacgccttcctcatccaccagagcccgtccggcctgttcgagcacaagatcaagctgagcgacctctga

SEQ ID NO: 1933 - RNA, 4101 nt, synthetic construct
  misc_feature 1..4101: note = Cas9 variant
  source 1..4101: mol_type = other RNA
atgaccaagctgggcaagccctacgggatcggcgtggacatcgggagcaactccatcggcttcgccgccgtcgacgagaacagccacctcatccgcctgaaggggaagaccgtgatcggcgcgcggctgttcgaggagggcaaggccgccgcctaccgccgggcctcccgcacgacccggcgccggctcagccgcaaccggtggcgcctgtccttcctgcgggacttcttcgagagccacatcaccccgaccgaccccaacttcttcatgcgccagaagtactccgagatcagccccaaggacaaggcgcggtacaagtacgagaagcgcctcttcaacgaccggacggacgccgagttctaccagcagtaccccaccatgtaccacctccgcacccggctgctcaccgacccgtccaaggccgacgtgcgcgagatctacttcgccatccaccacatcctcaagagccgggggcacttcctgacgcccggctacgcgaaggacttcaacaccaacaaggtcgccctgaacgagatcttccccgccctgcaggacgcctacgcccaggtgtaccccgacctggacatcaccttcgacgagaacaaggtgaacgagttcaagaccgtcctcctgaacgagaaggcgacgccgtccgacacccagcgcgccctggtgaacctcctgctggccaaggagggggaccgggacatcctcaagcagcagaagcaggtcctgaccgagttcgccaaggccgtggtgggcctgaagaccaagctcaacgtggcgctggggacggaggtcgacagctccgaggccaccgcctggaacttcagcctgggccagctcgacgacaagtgggccggcatcgagtccgccatgaccgacgaggggaccgagatcctggaccagatccgcgacctgtaccgcgcgcggctcctgaacggcatcgtgcccgccgggaagacgctgagccaggccaaggtggacgactacgcccagcaccacgaggacctcgagctgttcaaggactacctgaagcagctcgaggacgacggcaccgccaaggcgatccgccagctgtacgaccggtacatcgacggcgacgacgccaagcccttcgtccgcgaggacttcgtgaaggccctgaccaaggaggtgaccgcccaccccaacgcgaagtccccggagctcctggagcggctggcccagcccgacttcatgctcaagcagcgcaacaaggccaacggggccatccccgtccagatgcagcagcgggagctggaccagatcatcaagaaccaggccgtgtactacgactggctggcggcccccaacccggtggagaagcaccgccagagcatgacgtaccagctcgacgagctgctgaacttccggatcccctactacgtcggccccctcgtgaccgccaaggagcagaaggccgcccagggcggggtgttcgcgtggatggtccgcaaggaccccgacgggaacatcaccccgtacaacttcgacgagaaggtggaccgggaggcctccgccaacaccttcatccagcgcatgaagacgaccgacacctacctgatcggcgaggacgtcctgcccaagcagagcctgctctaccagagctacgaggtgctgaacgagctgaacaacgtgcgggtcaacgacaacaagctctccttcgaccagaagcagcaggtcctgggcgagctgttcgagcgccacaacaccgtgacgatcaagcagttcgtggacaacctcctggcccacggggactacgaccggatccccgaggtgcgcggcctggccgacgagaagcggttcctcagctccctgagcacctacaaccagctgaaggggatcctccacgaggcgatcgacgacgccgacaagcagaccgacatcgagaacatcatcgcctggtccaccatcttcgaggacaaggccatcttcaagacgaagctgaacgagatcagctggctgaacgcgggcatgatcaactccctcgccaacatccgctaccgggggtggggccagttcagccacaagctgctgaacgagctcaccctgtccaccggccgcaccgtgttcgaggagctgctcatcagctcccgcaacctgatgcagatcctgaccgacgaggtcctcaagcagaagatcgccgagctgaacgcccacgagctgaaggccagcgggatctacgcggccatcgacgacgcctacacgtcccccagcaacaagaaggccctccgccaggtgctgtccgtgatcgacgacatcaccaacgccgcgggccaggccccgaactggctgtacatcgagaccgccgacggggacggcgtccccgggaagcggaccaacagccggcagcgcaagatccaggagatctacgccaacgccgcgcaggagctcatcacgggctccgtgcggggcgagttcgaggacaagatcgccagccgcgccgacttcaccgaccggctggtgctgtacttcatgcagggcgggcgcgacatctacaccggggagcccctcaacatcgacaacctgtccagctacgacatcgaccacatcctgccccagagcctcatcaaggacaactccctggacaaccgggtcctggtgcacccgctcgtgaaccgcgagaaggacaccatcttcgccagcacgcggttcgcgaagcagatgaacggcatgtggcgccagtggcacgccgccggcctgatctccagccggaagctgcgcaacctccagatgcggcccgacgagatcgacaagtacgcctccgggttcgtcgcccgccagctggtggagacccggcagatcatcaagctgaccgagcagatcgtggcggaccagtaccccgacaccaagatcatcgccgtcaaggccggcctcagctcccagctgcgcaaggagctggacttcccgaagaaccgggaggtgaaccactaccaccacgccttcgacgccttcctcgcggcccgcatcgggacgtacctgctgaagcggtaccccaacctcgagcccttcttcacctacggcaagttcaagaagaccgaggtgaagaagctcaagagcctgaagtccctcaagagcttcaacttcatccgcgacatgacccacgccaaggacaagatcgtcgccaaggagacgggggagatcgtgtgggacaacgcctccgacatcaacgagctggaccgcatctacaacttcaagcggatgctgatcacccacgaggtgcgcttcgagaccgcgagcctgttcaagcagaccctgtacgccgccaagaactccaagaaccggggcggcagccgccagctgatccccaagaagaaggggtacctcgtcgacatctacggcgggtacacgcaggagaccggctcctacctgagcgtggtgcggctgaccaagaaggccatgtacgccgtcgtgaaggtgtccacccgcgacgcggccaagctcgccgtcgccaagagcatcagcgagcagaaggagaacgagacgctgaagaagatcatcgacgggaagctgtccaagaccagcaagaagggcaagaccacccaccagctgttcgagatcgtgctgccgcgggtgggccagaagacgctgttcaagaactccaagtacaaccagttcctcgtcaacagcgacacctacatgcacaactaccaggagctgtggatgccccgcgagtaccagcggatgtggaaggacatcctgctctccaaccacggggacgcgcagatcgagggccagctggaccagatcttcaagttcatcgtgagccaggtgaactcctacttcaacctgtacgacatcaaccagttccgcaagaagatcgccgacgccaccgacaagttcgccaagctccccacccacgacacggacaacgcccgggggaagatcgcgaccatcggccagctgctgatcgggctccaggccaacgccatgcgcagcgacctgcggaacctggacatcaagacccccttcggcctcctgcagatcggcaccgggatcacgctggacctcgacacctccatcatctaccagagcccgaccggcctgttcgagcgcgaggtccccctgaccgacctctga

SEQ ID NO: 1934 - RNA, 4101 nt, synthetic construct
  misc_feature 1..4101: note = Cas9 variant
  source 1..4101: mol_type = other RNA
atgaccaaggactacagcctgggcctcgacatcgggaccggctccgtggggttcgccgccctggacacgaactaccgcctgctccgggcgaagggcaacaacgtcatcggggtgcgcctgttcacccccgccgagaccgccgaggagcggcgcggcttccggaccgcccgccggcgcctgagccggcgccggtggcgcctcggcgccctgaacgggatcttcgcgccggagctggccaaggtggaccccaacttcctccaccggctgaagtacgcctgggtccaccccgccgaccagcagaacaagggcaagtactccgcggcgcccctgttcaacgacgccgccctcgaccgccagttccacgacgactacccgacgatctaccacctccggctgaagctgatgaccgacaccagccagcacgacctgcgcgaggtgtacctggccatccaccacatcatcaagttccgggggaacttcctccgcggcgaggggcccatcaacgcctccgaggccttcgacatcaacaccttcatcgaccagatgacggccttctacgaccaggccttccccgacttcaagatcgtggaccaggtcgaccagcagatcatcttcaagggcctgaccgacatgaccctgagccccgccgaccgggcgaacaaggccctcatgggcttcaacaacgccgcccagcagccgaacaagcgcatcttcaaggccatcctgtccgggctggtgggcaaccaggtggacctcatggcgatcttccagctggacgggatccccaaggaggaccagaaggagttcaagttcaagttcgtcgacaacgacatcgaggagaagctggccgccctcggcgacaaccccgccctgagcgacgagcagaacgagttcctgaccacgctctacgccgcgttctccggcctgaccctgaaggggctcctgggcgacgccaccagcatctccgccgccatggtggcgcggtacgccagccaccgcaccgactggacgtacatcaaggaccacgtgctgacgccccagaacaaccgcgagctccggctggcctacgccgacctgatgaccgacaacgaggacgtccgcctcaaggccgggaagaagttcgcgaaggccatcgaggccgccgacatcccggccgcgaagaagtccgagttcagcctgaagatcgacaacaacgagttcctgccccggcagcgcaccaaggccaacggcaccatcccccaccagctccacctgaacgagctgcagcagatcatcgagaaccaggggcagtactaccccttcctcaaggccaccttcgagcaggacggccacaccctgaacaagatcgagggcctggtgaagttccgggtgccgtactacgtcgggcccctcgtgcccaagcacaaggtggccggcaacaacgccaaccactggatggtccccaaggagccgggggcgatcaccccctggaactacacggagaaggtggaccgcgacaagtccggcaacgagttcatccggcgcatgaccgggaccgacacctacctgctgggcgagcccacgctgcccaagaacagcctcgtgtaccaggagttcaacgtcctgcaggagctgaacaacctccggatcgagaagcgccggctggacatcgccgtgaagcaggacatcttcgagcacgtgttcaagaccaacaagaccgtcaccgtgaagcgcatcgaggagtacctgacgaccgagttcggctccccggtcaccctcagcgggttcgccaacgtgaacgagcggaagctgaactccagcctgagcacctaccactacttcgtgggcatcttcggggccgagttcgtcgacgaccccaagaacctcacgctgctggagcagatcgtggagctccagaccgtgttcgaggaccgcaaggcgctgcagcggcagctgaagctccgccccgagctgtccgagaagcaggtcaagcagctggcccggacccactacaccggctgggggcgcctcagccagaagctgctgacctccaagatcgtgcacgtggccctcgagggcgagcgggagcccggccagtacagcatcctggagacgctgtacgggacccagatgaacttcatggagatcgtcaacgacatgaaggaccgctacggcgtgaagtcctggctcgaccaggagaacagcgggtccgagaacaacctgagcctgaagcagcgcatcctcgacatgccgggccccaagaacatcaagcggggcatcaaccaggccttccacatcatcgacgagatcacccgcgccgtggggaacgcgccctcccggatctacatcgagttcgcccgcgagagccagcagtccaacctgaccaacgcccgggtcaaccgcctgaagcagctctacagcaaccaggccctgaagaaggagttcgccaagctggcgtccgagatcaaggacctcacgaaggagcagctgaaggacgaccggctgtacctctactacctgcagcagggcaaggacatgtacaccgagaccgacatcgacatcaccaagatcagctccaactaccagatcgaccacatcatcccgcaggcctacacgaagaacaacagcctggacaaccgcgtgctcgtgaactccgagatgaacgcccgcaagagcgactcccccaccttcctgcccagcctgatccaggagcggaaggcctggtggcggcagctccgcgacaccgggctgatgagcaccatcaagtacaacaacctgacgcggacctccgacgacttcagcgccgaccagaaggagcgcttcatcgcgcggtccctcgtcgagacccgccaggtgatcaagaacgtggccaccctgatcaaggagtactacgacgacagccaggtcgaggccctgccctccgagatcacggccgagatgcggcgctacctcaacgtgcggaagaaccgcgacatcaacgactaccaccacgcgcacgacgccctgctgttcgccaccgccggcgagttcagccggaaggtggggatcatggagaagggccgcgtctccgacggcgccgggaacatctacaaccgctacaccaaggacatcatccagcgggcgcgcgccaaggccggccaggacaagaaggtgcggccgttcaccttcatcgtggggagcatggccaaccccgacacgaagttccagaccaaccagaccaccggcgagatcgtctggacgcccgaggacgtggcctacctccgcaaggtgatcgactacaagaagatgctggtcaccaagatgaccctggaccagaccgggacgctctacaacgagacccggtacggctccggcgacaagcacgtggcggtggccctgagcaaggacaaggccgccgacctgtacgggggcttcgggtccctcaagcccgcctacgcggccctggtctacagcaagaagaagttccgcctggtgaacgtgctccggctgtggctgccggagatcaagaagaacgcctccgtcctcgagcgcaaggtgcagagcgtgctgggcgacgacaacgccaaggtcatccgggcccacgtgccctgcgggcagctgctcatcaaggacggcgcgctggtgaccgtctccagcgccaccgagctgcacaacttccgccagctctggctgcccaaggccgactaccaggacatctccatcctgctcggcgcccccgacaaggtgacggcggagaaccggctgcaggccgagagccacttcgacgacgtggaccagcgcttcgagagcctgctcaaggacgtcatcgaccaggcccggcagtactacccgctgaagacccaccagacctccctggagaagctcatcgggaagatcggcaagttcgacgagctgaagttcgcccagaagcagcaggtcttcagccgcctgctctccgccctgcacgcgaacgccaccaacagcgacctgaagcagatcgggctctccacggcctggggccggctgatctaccccaagggggtgagcctgaccgacgaggacaagctcatcaactccagcttcaccggcctgttcaacgacgtgatgtccatcaaggagttccacgacttcagcatcaactga

SEQ ID NO: 1935 - RNA, 4104 nt, synthetic construct
  misc_feature 1..4104: note = Cas9 variant
  source 1..4104: mol_type = other RNA
atgaagaagcagaagttcagcgactactacctgggcttcgacatcgggaccaactccgtgggctggtgcatcaccgacctcgactacaacgtcctgcgcttcaacaagaaggacatgtgggggagccggctgttcgaggaggccaagacggccgcggagcgccgggtgcagcgcaactcccggcgccggctcaagcgccggaagtggcgcctgaacctgctcgaggagatcttcagcaacgagatcctgaagatcgactccaacttcttccggcgcctgaaggagagctccctctggctggaggacaagagctccaaggagaagttcaccctgttcaacgacgacaactacaaggactacgacttctacaagcagtaccccaccatcttccacctccggaacgagctgatcaagaacccggagaagaaggacatccgcctggtgtacctcgccatccacagcatcttcaagtcccggggccacttcctgttcgaggggcagaacctgaaggagatcaagaacttcgagaccctctacaacaacctgatcgccttcctggaggacaacggcatcaacaagatcatcgacaagaacaacatcgagaagctcgagaagatcgtctgcgacagcaagaagggcctgaaggacaaggagaaggagttcaaggagatcttcaactccgacaagcagctggtggccatcttcaagctcagcgtggggtccagcgtctccctgaacgacctgttcgacacggacgagtacaagaagggcgaggtggagaaggagaagatcagcttccgcgagcagatctacgaggacgacaagcccatctactactccatcctcggggagaagatcgagctgctggacatcgccaagagcttctacgacttcatggtgctcaacaacatcctggcggacagccagtacatctccgaggccaaggtcaagctgtacgaggagcacaagaaggacctcaagaacctgaagtacatcatccggaagtacaacaagggcaactacgacaagctgttcaaggacaagaacgagaacaactacagcgcctacatcgggctcaacaaggagaagggcaagaaggaggtggtggagaagtcccgcctgaagatcgacgacctgatcaaggtcatcaagggctacctccccaagcccgagcggatcgaggagaaggacaagaccgtgttcaacgagatcctgagcaagatcgagctgaagaccatcctcccgaagcagcgcatctccgacaacgggaccctgccctaccagatccacgaggtggagctggagaagatcctcgagaaccagagcaagtactacgacttcctgaactacgaggagaacggcgtctccacgaaggacaagctgctcaagaccttcaagttccggatcccctactacgtggggcccctgaacagctaccacaaggacaagggcggcaactcctggatcgtgcgcaaggaggaggggaagatcctgccgtggaacttcgagcagaaggtcgacatcgagaagtccgccgaggagttcatcaagcgcatgaccaacaagtgcacctacctgaacggcgaggacgtgatccccaaggacacgttcctctacagcgagtacgtgatcctgaacgagctgaacaaggtccaggtgaacgacgagttcctcaacgaggagaacaagcggaagatcatcgacgagctgttcaaggagaacaagaaggtgagcgagaagaagttcaaggagtacctgctcgtcaagcagatcgtggacgggaccatcgagctgaagggcgtcaaggactccttcaacagcaactacatctcctacatccgcttcaaggacatcttcggggagaagctgaacctcgacatctacaaggagatcagcgagaagtccatcctgtggaagtgcctgtacggcgacgacaagaagatcttcgagaagaagatcaagaacgagtacggcgacatcctcaccaaggacgagatcaagaagatcaacaccttcaagttcaacaactgggggcggctgagcgagaagctgctcacgggcatcgagttcatcaacctggagaccggggagtgctactccagcgtgatggacgcgctgcgccggaccaactacaacctcatggagctgctgagctccaagttcaccctccaggagagcatcaacaacgagaacaaggagatgaacgaggcctcctaccgcgacctgatcgaggagagctacgtgtcccccagcctgaagcgggccatcttccagacgctcaagatctacgaggagatccgcaagatcaccggccgggtccccaagaaggtgttcatcgagatggcccgcgggggcgacgagtccatgaagaacaagaagatcccggcccggcaggagcagctgaagaagctgtacgacagctgcggcaacgacatcgcgaacttctccatcgacatcaaggagatgaagaacagcctcatctcctacgacaacaacagcctgcgccagaagaagctgtacctctactacctgcagttcgggaagtgcatgtacaccggccgggagatcgacctggaccgcctcctgcagaacaacgacacctacgacatcgaccacatctacccccggtccaaggtgatcaaggacgacagcttcgacaacctggtcctcgtgctgaagaacgagaacgccgagaagtccaacgagtaccccgtgaagaaggagatccaggagaagatgaagtccttctggcgcttcctgaaggagaagaacttcatcagcgacgagaagtacaagcggctcacggggaaggacgacttcgagctgcgcggcttcatggcccggcagctggtcaacgtgcgccagaccaccaaggaggtggggaagatcctccagcagatcgagcccgagatcaagatcgtctacagcaaggccgagatcgccagctccttccgcgagatgttcgacttcatcaaggtgcgggagctgaacgacacccaccacgcgaaggacgcctacctgaacatcgtggccggcaacgtctacaacacgaagttcaccgagaagccgtaccgctacctccaggagatcaaggagaactacgacgtgaagaagatctacaactacgacatcaagaacgcctgggacaaggagaacagcctggagatcgtgaagaagaacatggagaagaacaccgtcaacatcacccggttcatcaaggaggagaagggccagctgttcgacctcaaccccatcaagaagggggagacgtccaacgagatcatcagcatcaagcccaaggtgtacaacggcaaggacgacaagctgaacgagaagtacgggtactacaagtccctgaaccccgcctacttcctctacgtggagcacaaggagaagaacaagcgcatcaagagcttcgagcgggtcaacctggtggacgtgaacaacatcaaggacgagaagtccctggtcaagtacctcatcgagaacaagaagctggtggagccgcgcgtgatcaagaaggtctacaagcgccaggtgatcctgatcaaccactacccctacagcatcgtgaccctcgactccaacaagctgatggacttcgagaacctgaagcccctcttcctggagaacaagtacgagaagatcctgaagaacgtcatcaagttcctcgaggacaaccagggcaagagcgaggagaactacaagttcatctacctgaagaagaaggaccggtacgagaagaacgagaccctggagtccgtgaaggaccggtacaacctcgagttcaacgagatgtacgacaagttcctggagaagctggacagcaaggactacaagaactacatgaacaacaagaagtaccaggagctcctggacgtgaaggagaagttcatcaagctgaacctcttcgacaaggcgttcaccctgaagtccttcctggacctcttcaaccgcaagacgatggccgacttcagcaaggtcggcctgaccaagtacctggggaagatccagaagatctccagcaacgtgctctccaagaacgagctgtacctgctcgaggagagcgtgaccggcctgttcgtcaagaagatcaagctgtga

SEQ ID NO: 1936 - RNA, 4104 nt, synthetic construct
  misc_feature 1..4104: note = Cas9 variant
  source 1..4104: mol_type = other RNA
atgaagaagcagaagttcagcgactactacctgggcttcgacatcgggaccaactccgtgggctggtgcgtcaccgacctcgactacaacgtgctgcgcttcaacaagaaggacatgtgggggagccggctgttcgacgaggccaagacggccgcggagcgccgggtgcagcgcaactcccggcgccggctcaagcgccggaagtggcgcctgaacctgctcgaggagatcttcagcgacgagatcatgaagatcgactccaacttcttccggcgcctgaaggagagctccctgtggctcgaggacaagaacagcaaggagaagttcaccctgttcaacgacgacaactacaaggactacgacttctacaagcagtaccccaccatcttccacctccgggacgagctcatcaagaacccggagaagaaggacatccgcctgatctacctggccctccactccatcttcaagagccggggccacttcctgttcgaggggcagaacctgaaggagatcaagaacttcgagaccctctacaacaacctgatctccttcctggaggacaacggcatcaacaagagcatcgacaaggacaacatcaagaagctcgagaagatcatctgcgactccggcaaggggctgaaggacaaggagaaggagttcaaggagatcttcaacagcgacaagcagctggtcgccatcttcaagctctccgtgggcagctccgtgagcctgaacgacctgttcgacacggacgagtacaagaaggaggaggtcgagaaggagaagatctccttccgcgagcagatctacgaggacgacaagcccatctactacagcatcctcggggagaagatcgagctgctggacatcgccaagagcttctacgacttcatggtgctcaacaacatcctgtccgacagcaactacatctccgaggccaaggtgaagctgtacgaggagcacaagaaggacctcaagaacctgaagtacatcatccggaagtacaacaaggagaactacgacaagctgttcaaggacaagaacgagaacaactaccccgcgtacatcggcctcaacaaggagaaggggaagaaggaggtcgtggagaagtccggcctgaagatcgacgacctgatcaaggtgatcaagggctacctccccaagccggagcgcatcgaggagaaggacaagaccatcttcaacgagatcctgaacaagatcgagctgaagaccatcctccccaagcagcggatcagcgacaacgggaccctgccctaccagatccacgaggtcgagctggagaagatcctcgagaaccagagcaagtactacgacttcctgaactacgaggagaacggcgtgtccacgaaggacaagctgctcaagaccttcaagttccgcatcccctactacgtggggccgctgaacagctaccacaaggacaagggcggcaactcctggatcgtccggaaggaggaggggaagatcctgccctggaacttcgagcagaaggtggacatcgagaagtccgccgaggagttcatcaagcgcatgaccaacaagtgcacctacctgaacggcgaggacgtgatccccaaggacagcttcctctacagcgagtacatcatcctgaacgagctgaacaaggtccaggtgaacgacgagttcctcaacgaggagaacaagcgcaagatcatcgacgagctgttcaaggagaacaagaaggtgtccgagaagaagttcaaggagtacctgctcgtcaaccagatcgccaaccggacggtggagctgaaggggatcaaggacagcttcaactccaactacgtgagctacatcaagttcaaggacatcttcggcgagaagctgaacctcgacatctacaaggagatctccgagaagtccatcctgtggaagtgcctgtacggggacgacaagaagatcttcgagaagaagatcaagaacgagtacggcgacatcctcaacaaggacgagatcaagaagatcaacagcttcaagttcaacacctggggccgcctgagcgagaagctgctcaccgggatcgagttcatcaacctggagaccggcgagtgctacagctccgtcatggaggccctgcggcgcacgaactacaacctcatggagctgctgagctccaagttcaccctccaggagagcatcgacaacgggaacaaggagatgaacgaggtgtcctaccgggacctgatcgaggagagctacgtctcccccagcctgaagcgcgcgatcctccagaccctgaagatctacgaggagatcaagaagatcaccggccgggtgccgaagaaggtgttcatcgagatggcccgcgggggcgacgagacgatgaagaacaagaagatccccgcccggcaggagcagctgaagaagctctacgactcctgcggcaacgacatcgccaacttcagcatcgacatcaagaagatgaagtccagcctgtccagctacgacaacaactccctgcgccagaagaagctctacctgtactacctgcagttcgggaagtgcatgtacaccggccgggagatcgacctcgaccgcctgctgcagaacaacgacacctacgacatcgaccacatctacccccggagcaaggtcatcaaggacgactccttcgacaacctcgtgctggtgctgaagaacgagaacgccgagaagtccaacgagtaccccgtcaagaaggagatccaggagaagatgaagtccttctggcgcttcctcaaggagaagaacttcatcagcgacgagaagtacaagcggctgaccgggaaggacgacttcgagctgcgcggcttcatggcgcggcagctcgtgaacgtgcgccagacgaccaaggaggtcgggaagatcctgcagcagatcgagccggagatcaagatcgtgtacagcaaggccgagatcgccagcagcttccgggagatgttcgacttcatcaaggtgcgcgagctgaacgacacccaccacgccaaggacgcctacctcaacatcgtcgcgggcaacgtgtacaacaccaagttcacggagaagccctaccgctacctgcaggagatcaaggagaactacgacgtgaagaagatctacaactacgacatcaagaacgcctgggacaaggagaactccctggagatcgtcaagaagaacatgaagaagaacaccgtgaacatcacccggttcatcaaggaggagaagggccagctgttcgacctgaaccccatcaagaagggggagaccagcaacgagatcatctccatcaagcccaagctgtacaacggcaaggaggagaagctcaacgagaagtacgggtactacaagagcctgaacccggcctacttcctgtacgtggagcacaaggagaagaacaagcgcatcaagtccttcgagcgggtcaacctcgtggacgtgaacaacatcaaggacgagaagtccctggtcaagtacctgatcgagaacaagaagctcgtggagccccgcctgatcaagaaggtgtacaagcggcaggtcatcctgatcaacgactacccctacagcatcgtggccctcgacagcaacaagctgatggacttcgagaacctgaagcccctcttcctggagaacaagtacgagaagatcctgaagaacgtgatcaagttcctcgaggacaaccagggcaagtccgaggagaactacaagttcatctacctgaagaagaaggaccgctacgagaagaacgagacgctggagagcgtcaaggaccggtacaacctcgagttcaacgagatgtacgacaagttcctggagaagctggactccaaggactacaagaactacatcaacaacaagaagtacaagaacctcctggacgtgaaggagaagttcatcaagctgaacctcttcgacaaggccttcaccctcaagagcttcctggacctgttcaaccgcaagaccatggcggacttctccaaggtgggcctgaccaagtacctggggaagatccagaagatcagctccaacgtcctcagcaagaacgagctgtacctgctcgaggagagcgtgacgggcctgttcgtgaagaagatcaagctgtga

SEQ ID NO: 1937 - RNA, 4104 nt, synthetic construct
  misc_feature 1..4104: note = Cas9 variant
  source 1..4104: mol_type = other RNA
atgaagaagcagcagttcagcgactactacctgggcttcgacatcgggaccaactccgtgggctggtgcgtcaccgacttcaactacaacgtgctccgcttcaacaagaaggacatgtgggggagccggctgttcgacgaggccaagacggccgcggagcgccgggtgcagcgcaactcccggcgccggctgaagcgccggaagtggcgcctcaacctgctggaggagatcttcagcgacgagatcctcaagatcgactccaacttcttccggcgcctgaaggagagctccctgtggctcgaggacaagagctccaaggagaagttcaccctgttcaacgacgacaactacaaggactacgacttctacaagcagtaccccaccatcttccacctccggaacgagctgatcaagaacccggagaagaaggacatccgcctggtctacctggccctccacagcatcttcaagtcccggggccacttcctgttcgaggggcagaacctgaaggacatcaagaacttcgagaccctctacaacaacctgatggccttcctggaggacaacgacatctacaagaacatcgacagctcctacatcggcaacctcgagaacatcatctgcgacagcaagaagggcctgaaggacaaggagaaggagttcaaggagatcttcaactccgacaagcagctggtggggttcttcaagctcagcgtgggctccagcgtctccctgaacgacctgttcgacacggacgagtacaagaagggggaggtggagaaggagaagatcagcttccgcgagcagatctacgaggacgacaagcccatctactacagcatcctcggcgagaagatcgagttcctggacatcgccaagtccttctacgacttcatggtgctgaacaacatcctcgccgacagccagtacatctccgaggcgaaggtcaagctgtacgacgagcacaagcgggacctgaagaacctcaagtacatcatccgcaagtacaacaaggagaactacgacaagctgttcaaggacaagaacgagagcaactactccgcctacatcgggctgaacaaggagaagggcaagaaggaggtgatcgagaagtcccggctcaagatcgacgacttcgccaagatcatcaagggctacctgcccaaggccgagaagatcgacgagaaggaccgcagcatcttcaacgagatcctggacaagatcgagctcaagaccatcctgcccaagcagcggatcagcgacaacgggaccctgccgtaccagatccacgaggcggagctcgagaagatcctggagaaccaggccaagtactacgacttcctgaaccacgaggagaacggcatctccaccaaggacaagctcctgatgacgttcaagttccgcatcccctactacgtggggcccctgaacagctaccacaagaacaagggcggcaactcctggatcgtccgcaaggaggaggggaagatcctcccctggaacttcgagcagaaggtggacatcgagaagtccgccgaggagttcatcaagcggatgaccaacaagtgcacctacctgaacggcgaggacgtgatcccgaaggacagcttcctgtacagcgagtacatcatcctgaacgagctcaacaaggtccaggtgaacgacgagttcctgaacaaggagatcaagaagaagatcatcgaggacctgttcaagaagtccaagaagatcagcgagaagaacttccgcgagtacctcctggtgaaccagatcaccaacaagacggtcgagctgaagggggtgaaggacgccttcaactccaactacgtgagctacatcaagttcaaggacatcttcggcgacaagctcaacctggacatctacaaggagatctccgagaagtccatcctgtggaagtgcctctacggggacgacaagaagatcttcgagaagaagatcaagagcgtctacggcgacatcctgaccaaggacgagatcaagaagatcaacagcttcaagttcaacacctggggccggctgagcgagaagctcctgaccgagatcgagttcatcgacctggagacgggggagtgctactccagcgtgatggacgccctccgccggaccaactacaacctgatggagctgctctccagcaagttcaccctgcaggagaacatcgacaacgagaacaaggaggtgtccgagttcagctaccgcgacctggtcgaggagtcctacgtgagcccctccctcaagcgggcgatcctgcagaccctgaagatctacgaggagatccgcaagatcacgggccggatccccaagaaggtcttcatcgagatggcccgcgggggcgacgagaccatgaagaacaagaagatccccgcccggcaggagcagctcaagaagctgtacgacagctgcgggaaggacatctccaacttcagcatcgacatcaaggagatgaagaactccctgaacagctacgacaacaactccctccgccagaagaagctgtacctgtactacctccagttcggcaagtgcatgtacaccggcaaggagatcgacctgaaccggctgctccagaacaacgacacctacgacatcgaccacatctacccgcgcagcaaggtgatcaaggacgacagcttcgacaacctggtgctggtcctcaagaacgagaacgccgagaagtccaacgagtaccccctgaagaaggagatccaggagaagatgaagtccttctggaagttcctgaaggagaagaacttcatcagcgacgagaagtacaagcggctcacggggaaggacgagttcgagctgcgcggcttcatggcccggcagctggtgaacgtgcgccagaccaccaaggaggcggggaagatcctccagcagatcgagcccgagatcaagatcgtctacagcaaggccgagatcgcctccagcttccgggagatgttcgacttcatcaaggtgcgcgagctgaacgacacccaccacgccaaggacgcctacctgaacatcgtggcgggcaacgtctacaacacgaagttcaccgagaagccctaccgctacctccaggagatcaaggagaactacgacgtgaagaagatctacaactacgacatcaagaacgcctgggacaaggagaagtccctggagatcgtgaagaagaacatggagaagaacaccgtcaacatcacccggttcatcaaggaggagaaggggcagctgttcgacctcaacccgatccgcaagggcgagacgagcaacgagatcatcgccatcaagcccaagttctacgagggctccaccgagaagctgaacgagaagtacgggtactacaagagcctgaaccccgcctacttcatctacgtggagcacaaggagaagaacaagatcatccggtccttcgagcgcgtgaacctcgtcgacgtgaacaagatcaaggacgagaagtccctgatcaagtacctgatcgagaacaagggcctcatcgagcccaaggtgatcaagaaggtctacaagcgccaggtgatcctgatcaacaacttcccgtacagcatcgtggccctggacagcaacaagctcatggacttcgagaacctgaagcccctgttcctcgagcggaagtacgagaagatcctgaagaacgcgatcaagttcctggaggacaaccaggggaagaccgaggagtactacaagttcctctacctgaagaagaaggaccggaacgagaagaacgagaccatcgactccgtcaaggagcgctacaacatcgagttcaacgagatgtacgacaagttcctggagaagctcgacagcaaggactacaagaactacatcaacaacaagaagtactccgagctggtgaacgtgaaggagaagttcatcaagctgaacctcttcgacaaggccttcacgctcaagagcttcctggacctgttcaaccggaagaccatggccgacttctccaaggtcggcctgaccaagtacctgggcaagatccagaagatcagcagcaacgtgctctccaagaacgagctgcacctcctggaggagagcgtgaccgggctgttcgtcaagaagatcaagctgtga

SEQ ID NO: 1938 - RNA, 4104 nt, synthetic construct
  misc_feature 1..4104: note = Cas9 variant
  source 1..4104: mol_type = other RNA
atgaaggactactacctgggcctcgacatggggagctccagcgtgggctgggccctgtccgacgagcgctacaacctgctccgggccaaggggaaggacctgtggggcgtccgcctgttcgacgaggcgaagaccgccgccgagcggcgcaccttccggagccagcgccggcgcctcgagcggtccaagtggcgcctgagcctgctcacgtccctgttcgaggaggagatcagcaagatcgacgacaagttcttcgaccggctgaaggactccaagttcttcatcgacgacaagagcgaccagcagcccaacaccctcttcaacgacgtgaacttcaccgacaaggagtaccacaagcgctacccgtccatctaccacctccggaacgccctgttcaaccagaacgacaagttcgacatccgcctcatcttcctggccctgagccacatcgtgaagaagcgggggcacttcctcttcgacggcgacaaggcgggcttcggggaggacatcgacgtcatcctggacgagctgaaggcctacctccaggacgccttccacaccaagctggagttcacgtccgagttcaagagcatcatgctggacaagaacctccgcaagaagcagaaggaggaggagctgaagaactccatcaagatcagctccgacaccatcaacagcaaggacggcaagtccatcctgatcaagctgttcctggggtacgaggccaacctgaagcccttcttcctcgagtacaaggtggagaaggacaacgagtacaagatcaacttcagcaaggaggactacgaggagaagctgctggacatgaccagcaagttcgaggagaccacgtacttcatcgagatcgcgaagaagatccacgactacttcctcctggaggagatcatgctgggcttcaagaacatctccgccagcaaggtgtccatctaccagaagcacaagaacgacctcaagaccctgaagaacatcgtcaagaaccagatcaacaacagctacaacgccatcttcaaggacatcgggctggacaactaccccgcctacgtgtcctgctggaacagcaagaagcacaaggagaagcagaagggctgcaccaaggacaagttctacgccttcctcaagaccaagctgaagaacatcaacaacgcgaaggagatcctggactccatcgacaacgacgacttcctcccccggctggtggacaagaacagcatcatcccgcaccagatccacctggccgagctcatcaagatcatcgacaaccagtcccagtactaccccttcctgaaggagatcaaggacaagatcatcagcatcttcaagttccgcatccccttctacgtcggccccctgaacaacttccacaaggacaagggcgggaacgcctggatcgagaagctcaaggacgagcggatcttcccgtggaacttcaacgacgtggtggacctgaacaagtccgccgccaacttcatcgagaagatgatcaacgagtgcagctacctgaagggggagaaggtcctggcgaagaactccctcctgtacacgaagtacagcgtgctgaacctcatcaacaagctgaagatcaacggcaccgccgtgtccgtcgagaccaagcagaagatctacaacgagctgctcctgaagcagaagaacatcaagaagaccgccatcaagaagttcctgatcaacaacagcatcatcgacaagaacgacgagatctccggcatcgacgacagcctcacgtccaacctggccgtgttcatcgacttcgagaagatcagcaaccgcctgcggtacgaccagaaggaggacatcatcaagagcatctccctcttcgggtacgacaacgccatgctgaagaagcagatcatcaccatcgcgcccgacctgagcgaggacgagctcgagaagctgtccaagctgcgctacagcggcttcgggcgcctctccaagcggctgctgaccagcatcaagcacaacggcaagtccatcatcgagatgctctgggacaccaacgacaacctgatggagctgctcagcgaccgctacacgttcatcgagcagatcaacaagcacaacgacgggttcaaggaggacatcaacctgaacttccagaacgtggacaccctgtacgtctcccccagcgtgaagcggcagatctggcaggccttcaaggtgatcaacgagctcatctccgtcatgggccgcgagcccaagaagatcttcgtggagatggcccgggaggagggcgagaagaagcgcacccaggcccggaaggacaaggtgctggagctgtacaagagcatcaagaacaacgagatctccaccttcctcacgaacttcaaggacatcaagaccaagctggagggggagagcaacctgaactccaagaagctctacctgtactacctgcagctcggcgtcgacatctacaccggggagaagatcccgttcgagaagctgttcgaccagaacatctacgacatcgaccacgtgatcccccgcagcctgaagaaggacgactccttcgacaacctcgtcctgaccagcaagacgaacaacgccaagaagaccgacgagttccccgtgagctccgagatccagagcaagatgcagaccttctggaaggtgctgaaggacaaggacctcatgtccgagatcaagtacaccaacctgacgcggaagacccacctgagcgacgacgagctcggcgacttcatcgcgcgccagctggtcgagacccggcagtccaccaaggccctgacgcagatcctcaagaacgtgtacgccaacagcgacatcgtgtacgtcaaggccgggatcgtgtccgagttccgccagcagttcgacatgctgaagatccgggagctgaacgacttccaccacgcgaacgacgcctacctcaacatcgtgatcggcaacgtctacaacatcaagttcaccaagaacccccgcaactacgtgaaggagtactacaagaagggcgagcactacaacctgaagatcgagaagatgctggagaaggacatcgcccgcgggggcaacttcgggtgggacaagaagcacagcatcgagaccgtgcagaagaccatgaagaagcagtccccgctcatcacctaccggacgttcgagaacaagggcgagttcttcaaccagcagcccagcaaggcctccgccaacctgctggcgctcaagagctccgacaagcggctgctggacaccgtccgctacgggggctacaagggcacccagtacgcccacatgttcctcgtggagcacttcaacgggaagatcatcaaggagatcatgggcgtgcccatctacctgagcaaggagatcaaggacgacaaggccaagctgctcgagtactgcaacgacgtcctgaagctgaagaaccccaagatcctcttctccaagatcccgtacaacagcctgatcgtgtacaacgggtaccccatcctgctccggggcctgaccggcgtgcgcggggccgcccagctgaagctcgaccagacgtccacccaggtcgtgaagaacatcgtgaagctgtacgactggctgagccagaagcagaaggagctctccgacctgagcaagaagatcgagttcttccaggagaacaacaagaaggacgaggtcaaggcggccatgctggaggccgacaacatcctcttcatcctgaacgaccgcttcaagaacaccaagatcggcaaggacatcatgaacgacaaccacctgaacaacctctacgacaccttcatcaacaagctggagaacagcatctacaagaacaagcccgggggcaagcaggacgtgctgatgaaggagaagcgggacctcttcctgtccttcagcatgtccaagaagtgcatcacgctgtacaagatcatcaagatcttcgggagctgcgaccagggcgtggacttctccgacatcgccgagaagatcagcaagtccggcgggatcggcgggaagaacctcggcaagaacaccttcgacctggtcttcaaggagaacagcacctacaccctggtgcagtccagcgtgacggggctctacgccaagaagaccgacctgcacaagctgtga

SEQ ID NO: 1939 - RNA, 4104 nt, synthetic construct
  misc_feature 1..4104: note = Cas9 variant
  source 1..4104: mol_type = other RNA
atgaagaagcagaagttcagcgactactacctgggcttcgacatcgggaccaactccgtgggctggtgcgtcaccgacctcgactacaacgtgctgcgcttcaacaagaaggacatgtgggggagccggctgttcgaggaggccaagacggccgcggagcgccgggtgcagcgcaactcccggcgccggctcaagcgccggaagtggcgcctgaacctgctcgaggagatcttcagcaacgagatcctgaagatcgactccaacttcttccggcgcctgaaggagagctccctctggctggaggacaagagctccaaggagaagttcaccctgttcaacgacgacaactacaaggactacgacttctacaagcagtaccccaccatcttccacctccggaacgagctgatcaagaacccggagaagaaggacatccgcctggtctacctcgccatccacagcatcttcaagtcccggggccacttcctgttcgaggggcagaacctgaaggagatcaagaacttcgagaccctctacaacaacctgatcgccttcctggaggacaacggcatcaacaagatcatcgacaagaacaacatcgagaagctcgagaagatcgtgtgcgacagcaagaagggcctgaaggacaaggagaaggagttcaaggagatcttcaactccgacaagcagctggtggccatcttcaagctcagcgtcgggtccagcgtgtccctgaacgacctgttcgacacggacgagtacaagaagggcgaggtggagaaggagaagatcagcttccgcgagcagatctacgaggacgacaagcccatctactactccatcctcggggagaagatcgagctgctggacatcgccaagaccttctacgacttcatggtcctcaacaacatcctggcggacagccagtacatcagcgaggccaaggtgaagctgtacgaggagcacaagaaggacctcaagaacctgaagtacatcatccggaagtacaacaagggcaactacgacaagctgttcaaggacaagaacgagaacaactactccgcctacatcgggctcaacaaggagaagtccaagaaggaggtgatcgagaagtcccgcctgaagatcgacgacctgatcaagaacatcaagggctacctccccaaggtcgaggagatcgaggagaaggacaaggccatcttcaacaagatcctgaacaagatcgagctgaagaccatcctccccaagcagcggatcagcgacaacggcaccctgccgtaccagatccacgaggcggagctggagaagatcctcgagaaccagagcaagtactacgacttcctgaactacgaggagaacgggatcatcacgaaggacaagctgctcatgaccttcaagttccgcatcccctactacgtgggccccctgaacagctaccacaaggacaagggcgggaactcctggatcgtgcggaaggaggagggcaagatcctgccctggaacttcgagcagaaggtcgacatcgagaagtccgccgaggagttcatcaagcgcatgaccaacaagtgcacctacctgaacggggaggacgtgatcccgaaggacacgttcctctacagcgagtacgtgatcctgaacgagctgaacaaggtccaggtgaacgacgagttcctcaacgaggagaacaagcgcaagatcatcgacgagctgttcaaggagaacaagaaggtgagcgagaagaagttcaaggagtacctgctcgtcaagcagatcgtggacggcaccatcgagctgaagggggtgaaggactccttcaacagcaactacatctcctacatccggttcaaggacatcttcggcgagaagctgaacctcgacatctacaaggagatcagcgagaagtccatcctgtggaagtgcctgtacggggacgacaagaagatcttcgagaagaagatcaagaacgagtacggcgacatcctcaccaaggacgagatcaagaagatcaacaccttcaagttcaacaactggggccgcctgagcgagaagctgctcacggggatcgagttcatcaacctggagaccggcgagtgctactccagcgtcatggacgccctgcggcgcaccaactacaacctcatggagctgctgtccagcaagttcaccctccaggagagcatcaacaacgagaacaaggagatgaacgaggcctcctaccgggacctgatcgaggagagctacgtgtcccccagcctgaagcgcgccatcttccagacgctcaagatctacgaggagatccggaagatcaccgggcgcgtccccaagaaggtgttcatcgagatggcgcggggcggggacgagtccatgaagaacaagaagatccccgcccgccaggagcagctgaagaagctgtacgacagctgcggcaacgacatcgccaacttctccatcgacatcaaggagatgaagaacagcctcatctcctacgacaacaacagcctgcggcagaagaagctgtacctctactacctgcagttcggcaagtgcatgtacaccgggcgcgagatcgacctggaccggctcctgcagaacaacgacacctacgacatcgaccacatctacccgcgctccaaggtgatcaaggacgacagcttcgacaacctggtcctcgtgctgaagaacgagaacgccgagaagtccaacgagtaccccgtgaagaaggagatccaggagaagatgaagtccttctggcggttcctgaaggagaagaacttcatcagcgacgagaagtacaagcgcctcacgggcaaggacgacttcgagctgcgggggttcatggcccgccagctggtcaacgtgcggcagaccaccaaggaggtgggcaagatcctccagcagatcgagcccgagatcaagatcgtctacagcaaggcggagatcgcctccagcttccgcgagatgttcgacttcatcaaggtgcgcgagctgaacgacacccaccacgccaaggacgcctacctgaacatcgtggccgggaacgtctacaacacgaagttcaccgagaagccctaccggtacctccaggagatcaaggagaactacgacgtgaagaagatctacaactacgacatcaagaacgcgtgggacaaggagaacagcctggagatcgtgaagaagaacatggagaagaacaccgtcaacatcacccgcttcatcaaggagaagaagggccagctgttcgacctcaacccgatcaagaagggcgagacgtccaacgagatcatcagcatcaagcccaaggtgtacaacgggaaggacgacaagctgaacgagaagtacggctactacaagtccctgaaccccgcctacttcctctacgtggagcacaaggagaagaacaagcggatcaagagcttcgagcgcgtcaacctggtggacgtgaacaacatcaaggacgagaagtccctggtcaagtacctcatcgagaacaagaagctggtggagccccgggtgatcaagaaggtctacaagcgccaggtgatcctgatcaacgactacccgtacagcatcgtgaccctcgactccaacaagctgatggacttcgagaacctgaagcccctcttcctggagaacaagtacgagaagatcctgaagaacgtcatcaagttcctcgaggacaaccagggcaagagcgaggagaactacaagttcatctacctgaagaagaaggaccggtacgagaagaacgagaccctggagtccgtgaaggaccgctacaacctcgagttcaacgagatgtacgacaagttcctggagaagctggacagcaaggactacaagaactacatgaacaacaagaagtaccaggagctcctggacgtgaaggagaagttcatcaagctgaacctcttcgacaaggccttcaccctgaagtccttcctggacctcttcaaccggaagacgatggccgacttcagcaaggtcgggctgaccaagtacctgggcaagatccagaagatctccagcaacgtgctctccaagaacgagctgtacctgctcgaggagagcgtgaccgggctgttcgtcaagaagatcaagctgtga

SEQ ID NO: 1940 - RNA, 4104 nt, synthetic construct
  misc_feature 1..4104: note = Cas9 variant
  source 1..4104: mol_type = other RNA
atgaagaagcagaagttcagcgactactacctgggcttcgacatcgggaccaactccgtgggctggtgcgtcaccgacatgaactacaacgtgctccgcttcaacaagaaggacatgtgggggagccggctgttcgaggaggccaagacggccgcggagcgccgggtgcagcgcaactcccggcgccggctgaagcgccggaagtggcgcctcaacctgctggaggagatcttcagcaacgagatcctcaagatcgactccaacttcttccggcgcctgaaggagagctccctgtggctcgaggacaagagctccaaggagaagttcaccctgttcaacgacgacaactacaaggactacgacttctacaagcagtaccccaccatcttccacctccggaacgagctcatcaagaacccggagaagaaggacatccgcctggtctacctggccatccacagcatcttcaagtcccggggccacttcctcttcgaggggcagaacctgaaggagatcaagaacttcgagaccctgtacaacaacctcatcgccttcctggaggacaacggcatcaacaagagcatcgacaaggacaacctggagaagctcgagaagatcgtgtgcgactccggcaaggggctgaaggacaaggagaaggagttcaaggagatcttcaacagcgacaagcagctggtggccatcttcaagctctccgtcggcctgagcgtgtccctgaacgacctcttcgacacggacgagtacaagaagggggaggtggagaaggagaagatcagcttccgcgagcagatctacgaggacgacaagcccatctactactccatcctgggcgagaagatcgagctgctcgacatcgccaagagcttctacgacttcatggtcctgaacaacatcctggcggacagccagtacatctccgaggccaaggtgaagctctacgaggagcacaagcgggacctgaagaacctgaagtacatcatccgcaagtacaaccgggagaactacgacaagctgttcaaggacaagaacgagagcaactaccccgcctacatcgggctgaacaaggagaagtccaagaaggaggtgatcgagaagtccaagctgaagatcgacgacctcatcaagagcatcaagggctacctgcccaaggtcgaggagatcgaggagaaggacaaggccatcttcaacgagatcctgaacaagatcgagctcaagatcatcctgccgaagcagcgcatcagcgacaacggcaccctgccctaccagatccacgaggcggagctcgagaagatcctggagaaccagtccaagtactacgacttcctgaactacgaggagaacgggatcatcaccaaggacaagctcctgatgaccttcaagttccggatcccctactacgtgggccccctgaacagctaccacaaggacaagggcgggaactcctggatcgtgcgcaaggaggagggcaagatcctgccgtggaacttcgagcagaaggtcgacatcgagaagtccgccgaggagttcatcaagcgcatgacgaacaagtgcacctacctcaacggggaggacgtgatccccaaggacagcttcctgtacagcgagtacatcatcctgaacgagctcaacaaggtgcaggtcaacgacgagttcctgaacgaggagaacaagcggaagatcatcgaggagctgttcaagggcaacaagaaggtgtccgagaagaagttcaaggagtacctcctggtgaaccagatcaccaccgggacgatcgagctgaagggcatcaaggacagcttcaactccaactacatcagctacatcaagttcaaggacatcttcggggagaagctcaacctggacatctacaaggagatctccgagaagtccatcctgtggaagtgcctctacggcgacgacaagaagatcttcgagaagaagatcaagaacgagtacggcgacatcctgaccaaggacgagatcaagaagatcaacaccttcaagttcaacaactgggggcgcctgagcgagaagctcctgaccggcatcgagttcatcaacctggagacgggggagtgctacagcagcgtcatggaggccctccggcgcaccaactacaacctgatggagctgctctccagcaagttcaccctgcaggagaacatcgacaacgagaacaaggacatctcccagttcagctaccgggacctggtggaggagtcctacgtgagcccctccctcaagcgcgccatcctgcagaccctgaagatctacgaggagatcaagaagatcacgggccgggtccccaagaaggtgttcatcgagatggcccgcgggggcgacgagagcatgaagaacaagaagatcccggcgcggcaggagcagctcaagaagctgtacgactcctgcggcaacgacatcgccaacttcagcatcgacatcaaggagatgaagtccagcctgtccctctacgacaacaacagcctgcgccagaagaagctgtacctctactacctgcagttcgggaagtgcatgtacaccggccgggagatcgacctggaccgcctcctgcagaacaacgacacctacgacatcgaccacatctacccccggtccaaggtcatcaaggacgacagcttcgacaacctggtgctcgtgctgaagaacgagaacgccgagaagtccaacgagtaccccgtcaagaaggagatccaggagaagatgaagtccttctggcgcttcctgaaggagaagaacttcatcagcgacgagaagtacaagcggctcaccgggaaggacgacttcgagctgcgcggcttcatggcccggcagctggtgaacgtgcgccagacgaccaaggaggtcgggaagatcctccagcagatcgagcccgagatcaagatcgtgtacagcaaggccgagatcgcgagctccttccgggagatgttcgacttcatcaaggtgcgcgagctgaacgacacccaccacgccaaggacgcctacctgaacatcgtcgccggcaacgtgtacaacaccaagttcacggagaagccgtaccgctacctccaggagatcaaggagaactacgacgtgaagaagatctacagctacgacatcaagaacgcctgggacaaggagaactccctggagatcgtcaagaagaacatggagaagaacaccgtgaacatcacccggttcatcaaggaggagaagggccagctgttcgacctcaaccccatcaagaagggggagaccagcaacgagatcatctccatcaagcccaaggtgtacaacggcaaggacgacaagctgaacgagaagtacgggtactacaagagcctgaaccccgcgtacttcctctacgtcgagcacaaggagaagaacaagcgcatcaagtccttcgagcgggtgaacctggtggacgtcaacaacatcaaggacgagaagtccctgatcaagtacctcgtggagaacaagaagctggtggagccgcgcgtcatcaagaaggtgtacaagcgccaggtgatcctgatcaacgactacccctacagcatcgtcgccctcgacagcaacaagctgatggacttcgagaacctgaagcccctcttcctggagcggaagtacgagaagatcctgaagaacgtgatcaagttcctcgaggacaaccagggcaagtccgaggagaactacaagttcatctacctgaagaagaaggaccggtacgagaagaacgagacgctggagagcgtgcgcgagcggtacaacatcgagttcaacgagatgtacgacaagttcctcgagaagctgaactccaaggactacaagaactacatcaacaacaagaagtaccaggacctgctcgacgtcaaggagaagttcatcaagctgaacctgttcgacaaggccttcaccctcaagagcttcctggacctgttcaaccgcaagaccatggccgacttctccaaggtgggcctcaccaagtacctggggaagatccagaagatcagctccaacgtgctgagcaagaacgagctctacctgctggaggagagcgtcacgggcctcttcgtgaagaagatcgagctgtga

SEQ ID NO: 1941 - RNA, 4104 nt, synthetic construct
  misc_feature 1..4104: note = Cas9 variant
  source 1..4104: mol_type = other RNA
atggtgaagaagaagtacgccatcggcatcgacatcgggaccaacagcgtcggctggtccgtggtgaccgacgactacaaggtccccagcaagaagatgaaggtgttcgggaacacggagaagcgctacatcaagaagaacctgctgggcaccctgctgttcgacgaggggaacaccgccgagaaccggcgcctcaagcggaccgcgcgccggcgctacacgcggcgccggaaccgcatcctgtacctgcaggagatcttcgccgaggagatcaacaagatcgacgactccttcttccagcggctcgacgacagcttcctgatcgtggaggacaagcagggctccaagcacccgatcttcggcaccctgcaggaggagaaggagtaccacaagcagttccccaccatctaccacctccgcaagcagctggccgacagctcccagaaggccgacatccggctgatctacctcgccctggcgcacatcatcaagtaccgcgggcacttcctgttcgagggcgacctcaagagcgagaacaaggacgtccagcacctgttcaacgacttcgtggagatgttcgacaagaccgtggaggggtcctacctgagcgagaacctccccaacgtcgccgacgtgctggtggagaaggtctccaagagccggcgcctggagaacatcctccactacttccccaacgagaagaagaacggcctgttcgggaacttcctgacgctcgccctgggcctgcagccgaacttcaagaccaacttcgagctcgccgaggacgcgaagatccagttctccaaggagacctacgaggaggacctggaggagctgctcggcaagatcggggacgactacgccgacctgttcatcgccaccaagagcctgtacgacggcatcctcctggccgggatcctgtccacgaccgacagcaccaccaaggcgcccctctccagctccatggtgaaccggtacgaggagcaccagaaggacctggccctgctcaagaacttcatccaccagaacctgagcgacagctacaaggaggtgttcaacgacaagctgaaggacggctacgccggctacatcgaggggaagacgacccaggagaacttctaccgcttcatcaagaaggccatcgagaagatcgagggctccaactacttcatcgacaagatcgaccgggaggacttcctccgcaagcagcggaccttcgacaacgggagcatcccccaccagatccacctccaggagatgcacgccatcatccgccgccaggccgagttctaccccttcctggtcgagaaccaggacaagatcgagaagatcctgaccttccggatcccgtactacgtgggccccctggcgcgcgggaagtccgagttcgcctggctgaaccgcaagagcgacgagaagatccggccctggaacttcgacgagatggtggacaaggagacgtccgccgagaacttcatcacccggatgaccaactacgaccagtacctccccgaccagaaggtcctgccgaagcacagcctgctgtacgagaagttcgccgtgtacaacgagctcaccaaggtgcgctacgtcacggagcagggcaagtccttcttcttcgacgccaacatgaagcaggagatcttcgacggcgtgttcaaggtgtaccggaaggtcaccaaggagaagctgatggacttcctggggaaggagttcgacgagttccgcatcgtggacctcctgggcctggacaaggacaacaagagcttcaacgcgtccctcgggacctaccacgacctgaagaagatcgtcagcaaggacctgctcgacaaccccgagaacgaggacatcctggagaacgtggtgctgaccctcacgctgttcgaggaccgggagatgatccgcaagcggctggagaagtacaaggacgtcctcaccgaggagcagcgcaagaagctggagcggcgccactacaccggctgggggcggctgtccgccaagctcatcaacggcatccgcgacaaggtgacccggaagacgatcctggactacctgatcgacgacggcaccagcaaccgcaacttcatgcagctcatcaacgacgacaccctgtccttcgtggacgagatccggctggcccaggggagcggcgaggccgaggactaccgcgccgaggtccagaacctcgcggggtcccccgccatcaagaagggcatcctgcagagcctgaagatcgtggacgagctcatcgaggtgatggggtacgaccccgagcacatcgtcgtggagatggcccgcgagaaccagttcaccaaccagggccggcgcaactcccagcagcggtacaagaagatcgagaacgccatcaagaacctggacagcaacctgaactccaagatcctcaaggagtacccgacgaacaaccaggcgctgcagaacgaccgcctgttcctctactacctgcagaacggcaaggacatgtacaccgacgaggagctggacatcgaccagctcagccagtacgacatcgaccacatcatcccccaggccttcatcaaggacgacagcctggacaacaaggtgctgaccaagtccgccaagaaccgggggaagtccgacgacgtccccagcctcgagatcgtgcacaagaagaagaacttctggaagcagctgctggacagccagctcatctcccagcgcaagttcgacaacctgaccaaggccgagcggggcgggctgaccaacgaggacaaggcccgcttcatccagcggcagctcgtggagacgcgccagatcaccaagcacgtcgcgcggatcctggacacccgcttcaacaccaagctggacgaggccggcaaccggatccgcgaccccaaggtgaacatcatcacgctcaagagcaacctggtgtcccagttccggaaggactaccagctgtacaaggtccgcgagatcaacaactaccaccacgcccacgacgcctacctcaacgccgtggtggcgaccgccctgctgaagaagtacccgcagctcgcccccgagttcgtctacggcgactaccccaagtacaacagctacaagtcccgcaagagcgccaccgagaaggtgctgttctactccaacatcatgaacttcttccggcgggtgctggtctacagcaagaccggggaggtgcgcatccggcccgtgatcgaggtcaacaaggagacgggcgagatcgtgtgggacaagaagtccgacttccgcaccgtgcgcaaggtcctcagctacccccaggtgaacgtggtcaagaaggtggagatgcagaccgggggcttctccaaggagagcatcctgcagcacggggactccgacaagctgatcccccggaagaccgagaagttctacctcgacacgaagaagtacggcggcttcgacagccccaccatcgcctacagcgtgctgctgatcgcggacatcgagaaggggaaggccaagaagctcaagcgcgtcaaggagctgatcggcatcaccatcatggagcggatggccttcgagaagaaccccatcgagttcctggagcacaaggggtacaagaacatcctcgagaagaacatcatcaagctgccgaagtactccctgttcgagctcgagaacggccgccggcgcctgctggccagcgcgaaggagctccagaaggggaacgagatgatcctgccgccccacctggtgaccctcctgtaccactccagcaacatccacaagatcacggagccgatccacctgaactacgtgaacaagaacaagcacgagttcaaggagctcctgcggcacatctccgacttcagcacccgctacatcctggcccaggaccggctctccaagatcgaggagctgtacgacaagaacgacggcgacgacatcagcgacctgacctccagcttcgtcaacctcctgaccttcacggccatcggcgcccccgccgcgttcaagttcctggggtccgtgatcgaccgcaagcggtacaccagcatcgccgagatcctcgaggccaccctgatccaccagtccgtgaccggcctgtacgagacgcgcatcgacctcagcaagctcgggggcgactga

SEQ ID NO: 1942 - RNA, 4104 nt, synthetic construct
  misc_feature 1..4104: note = Cas9 variant
  source 1..4104: mol_type = other RNA
atggtgaagaagaagtacgccatcggcatcgacatcgggaccaacagcgtcggctggtccgtggtgaccgacgactacaaggtccccagcaagaagatgaaggtgttcgggaacacggagaagcgctacatcaagaagaacctgctgggcaccctgctgttcgacgaggggaacaccgccgagaaccggcgcctcaagcggaccgcgcgccggcgctacacgcggcgccggaaccgcatcctgtacctgcaggagatcttcgccgaggagatcaacaagatcgacgactccttcttccagcggctcgacgacagcttcctgatcgtggaggacaagcagggctccaagcacccgatcttcggcaccctgcaggaggagaaggagtaccacaagcagttccccaccatctaccacctccgcaagcagctggccgacagctcccagaaggccgacatccggctgatctacctcgccctggcgcacatcatcaagtaccgcgggcacttcctgttcgagggcgacctcaagagcgagaacaaggacgtccagcacctgttcaacgacttcgtggagatgttcgacaagaccgtggaggggtcctacctgagcgagaacctccccaacgtcgccgacgtgctggtggagaaggtctccaagagccggcgcctggagaacatcctccactacttccccaacgagaagaagaacggcctgttcgggaacttcctggccctcgccctgggcctgcagccgaacttcaagacgaacttcgagctcgcggaggacgccaagatccagttctccaaggagacctacgaggaggacctggaggagctgctcggcaagatcggggacgactacgccgacctgttcatcgccaccaagagcctgtacgacggcatcctcctggccgggatcctgtccaccacggacagcaccaccaaggcgcccctctccagctccatggtgaaccggtacgaggagcaccagaaggacctggccctgctcaagaacttcatccaccagaacctgagcgacagctacaaggaggtgttcaacgacaagctgaaggacggctacgccggctacatcgaggggaagaccacgcaggagaacttctaccgcttcatcaagaaggccatcgagaagatcgagggctccaactacttcatcgacaagatcgaccgggaggacttcctccgcaagcagcggaccttcgacaacgggagcatcccccaccagatccacctccaggagatgcacgccatcatccgccgccaggcggagttctaccccttcctggtcgagaaccaggacaagatcgagaagatcctgaccttccggatcccgtactacgtgggccccctggcccgcgggaagtccgagttcgcctggctgaaccgcaagagcgacgagaagatccggccctggaacttcgacgagatggtggacaaggagacctccgccgagaacttcatcacgcggatgaccaactacgaccagtacctccccgaccagaaggtcctgccgaagcacagcctgctgtacgagaagttcgccgtgtacaacgagctcaccaaggtgcgctacgtcaccgagcagggcaagtccttcttcttcgacgcgaacatgaagcaggagatcttcgacggcgtgttcaaggtgtaccggaaggtcacgaaggagaagctgatggacttcctggggaaggagttcgacgagttccgcatcgtggacctcctgggcctggacaaggacaacaagagcttcaacgcctccctcgggacctaccacgacctgaagaagatcgtcagcaaggacctgctcgacaaccccgagaacgaggacatcctggagaacgtggtgctgaccctcaccctgttcgaggaccgggagatgatccgcaagcggctggagaagtacaaggacgtcctcacggaggagcagcgcaagaagctggagcggcgccactacaccggctgggggcggctgtccgccaagctcatcaacggcatccgcgacaaggtgacccggaagaccatcctggactacctgatcgacgacggcacgagcaaccgcaacttcatgcagctcatcaacgacgacaccctgtccttcgtggacgagatccggctggcccaggggagcggcgaggccgaggactaccgcgcggaggtccagaacctcgccgggtcccccgccatcaagaagggcatcctgcagagcctgaagatcgtggacgagctcatcgaggtgatggggtacgaccccgagcacatcgtcgtggagatggcccgcgagaaccagttcaccaaccagggccggcgcaactcccagcagcggtacaagaagatcgagaacgcgatcaagaacctggacagcaacctgaactccaagatcctcaaggagtacccgaccaacaaccaggccctgcagaacgaccgcctgttcctctactacctgcagaacggcaaggacatgtacacggacgaggagctggacatcgaccagctcagccagtacgacatcgaccacatcatcccccaggccttcatcaaggacgacagcctggacaacaaggtgctgaccaagtccgccaagaaccgggggaagtccgacgacgtccccagcctcgagatcgtgcacaagaagaagaacttctggaagcagctgctggacagccagctcatctcccagcgcaagttcgacaacctgaccaaggccgagcggggcgggctgaccaacgaggacaaggcgcgcttcatccagcggcagctcgtggagacccgccagatcacgaagcacgtcgcccggatcctggacacccgcttcaacaccaagctggacgaggccggcaaccggatccgcgaccccaaggtgaacatcatcaccctcaagagcaacctggtgtcccagttccggaaggactaccagctgtacaaggtccgcgagatcaacaactaccaccacgcccacgacgcctacctcaacgcggtggtggccacggccctgctgaagaagtacccgcagctcgcccccgagttcgtctacggcgactaccccaagtacaacagctacaagtcccgcaagagcgccaccgagaaggtgctgttctactccaacatcatgaacttcttccggcgggtgctggtctacagcaagaccggggaggtgcgcatccggcccgtgatcgaggtcaacaaggagaccggcgagatcgtgtgggacaagaagtccgacttccgcacggtgcgcaaggtcctcagctacccccaggtgaacgtggtcaagaaggtggagatgcagaccgggggcttctccaaggagagcatcctgcagcacggggactccgacaagctgatcccccggaagaccgagaagttctacctcgacaccaagaagtacggcggcttcgacagccccacgatcgcgtacagcgtgctgctgatcgccgacatcgagaaggggaaggccaagaagctcaagcgcgtcaaggagctgatcggcatcaccatcatggagcggatggccttcgagaagaaccccatcgagttcctggagcacaaggggtacaagaacatcctcgagaagaacatcatcaagctgccgaagtactccctgttcgagctcgagaacggccgccggcgcctgctggcgagcgccaaggagctccagaaggggaacgagatgatcctgccgccccacctggtgaccctcctgtaccactccagcaacatccacaagatcaccgagccgatccacctgaactacgtgaacaagaacaagcacgagttcaaggagctcctgcggcacatctccgacttcagcacgcgctacatcctggcccaggaccggctctccaagatcgaggagctgtacgacaagaacgacggcgacgacatcagcgacctgacctccagcttcgtcaacctcctgaccttcaccgccatcggcgcccccgcggccttcaagttcctggggtccgtgatcgaccgcaagcggtacacgagcatcgccgagatcctcgaggccaccctgatccaccagtccgtgaccggcctgtacgagacccgcatcgacctcagcaagctcgggggcgactga

SEQ ID NO: 1943 - RNA, 4107 nt, synthetic construct
  misc_feature 1..4107: note = Cas9 variant
  source 1..4107: mol_type = other RNA
atggacaagaagtacagcatcggcctggacatcgggacctccagcatcggcttcgtgggggtcgacgagaacggctggcccctcaacatcaaggggaagcgcgccatcggcgcccacctgttccgggagggcgaggcggccgccgagacccgcgggttccggacgacccgccggcgctacaaccggcgcaagtggcggctgcgcctcctgcgggagatcttcgacgagccgatctcccgcgtggaccccaccttcttcgcccggatgaaggagagctccgtgagccccaaggaccccaactacgacggcctggccaaggagatcctcatcccgcgcgacaaggacgggaagatcctgtaccccaccatctaccacctccggcacgcgctcatgtacgaggaccaccagttcgacatccgcgagatctacctggccatccaccacatcgtcaagtaccggggccacttcctgctcgacggggccgccaagaacttcgagtccagcaacctggacctgaagtccgacatccacgagatcaacgcgatcctcgtgggcatcttcggcaacgagcaggtccagttcaacgaccagtacgtggagaagctgaaggaggtgctgctcgacagcacgcagtcccgcagcgaccggcagaaggccgccgccaaggtgctgctgcccaccaacgacctcgacaaggacaccaccaagatcctgaagacggtctccaccgagatcaccaaggccatcaccgggctgaaggcgaagttcttcgtgatcacgggcaacgacatcgccaaggaccagcagaaggactggaccttcagcatcgacaccctcgacgagaagatgtccgtgatcgagcccagcttctccgagaagaacttcagcctgatcaccatcctgcagaagctctactccagcgtcacgctggccgggatcgtgccgaacggcctgagcctctccgaggccatgatccagaagtacgaccgccacgccagcgacctggtgctgctcaagaagtactgggacaccaagcccaaggtcctgaagcaccagctgcagaacacctacgcggagtacatcgagatccaccaggtggtggacgagttctactccgacctcagcaagctgatcaagaacgacgacgacaccctggcccaggagatcaagtccaagatcacgatcggcaacttcctccccaagcagcggaccaccgagaacggggtcatcccctaccagctgcagcagcgcgagctggacaccatcatcaagaaccagcaggagtactacccgtggctcgccgaggagaaccccgtggccgaccaccagatcgccttcccctacaagctggacgagctggtgggcttccgcatcccctactacgtcgggccgatgatcgcgaaggaggacacgagcaactccaagaacagcaagttcgcctggatgatccggaagcagtccggcgaggtgaccccctggaacttcgacgagaagatcgaccgcaccgccagcgccaccgccttcatcgaccggatgacgaccaccgacacctacctcatcggggaggacgtgctgcccaagcagtccctgatctaccagcgcttcgaggtcctcaacgagctgaacaagatcagcatcgacggccagcccatcacgcggaagcagaagcagtccgtgtacacccacgtcttcgagaagaagaagaccgtccaggtgaaggacgtgcagaagttcctggtgagctccggcgaggtgatgagcctgccgaagatcgggggcctcgcgaacgagaagcagttcaactccagcctgtccaccctgtacgactacaacaagatcatccccgacgccctcgaggaccgcaacaaggtcgacgacatcgagaagatcatcctgtggagcacgatcttcgaggacaacagcatcttcgtggagaagctggactccatcgactggctcaccagctcccagcggaagcgcctggcccagaagcggtaccgcgggtggggccggctgagcctccgcctgctgaccaccttcaagaacaaggacgggtactccatcctcgacgagctgtggaacagcaaccacaacttcatggagatccaggcccagtccgacttcagcgagcagatcgcgaccgccaacaacaacaacctgtcccaggtgctccccgccaagtgggagcccggccggaagaacctggccagcctggacgagttcatctccaacctctacacgagcccgcagaacaagaaggccctgcgcaaggcgatccgggtcgtgcaggacatgatgaccgccgccggccacatgcccgagaagatcttcatcgaggtggcccgcgacacctccaacagccaccagcagaccatcgcccggcagcgccagctgcagcagctctaccagtccgaggcgaaggaggtcatcgacagctccgtgcggagcgagctggacgacatcctgaagaaccgcgccaacatcaaggaccagctgttcctgtacttccagcagggcgggcgcgacctgtacacggggaaggccatcaacatcgacaagctcagcctgtaccacatcgaccacatcctgccccagtccctcgtgaaggacgacagcctggacaaccgggtcctggtgtcccagaagaccaacgaggacaagggcgtgaccttcgtcagcgacaagtacatgaacaacatgctccccacctggaagcgctggcacgagatggggctgatctccgcccggaagctgaagaacctcacgatgcgcccggacgagatcgacaagtacgcccccggcttcatccagcggcagctggtggagacccgccaggtgaccaagctggtcatcgagctcctggacgcgctgctcggcaacagccagaccgagatcatcacgatcaaggcctccctgagccaccagttccggcagcagttcgacctggtgaagatccgcgaggtgaacgacaaccaccacgccttcgacgccttcctcgcggcccggatcgggacctacctgtacaagcgctaccccaagctgcggccgtacttcgtctacggccagtacatgcagaaccacaagaacctcaagtccatcaacctgatcaagaccctggacagcgacaaggccatcgtggacgaggggaccggcgagatcctctgggacaagaagtccgacctggccaagatgatcaagatctacaactaccagcgcctgctcatcacgcacgagagccggacctccttcggcgccatgtacaagcagaagatcctgaaggcgaccgacgccaagcagaacgggggcgggttcaagctggtgcccaccaagcgcaactggcccgtcgacatctacggcgggtacacgggccagaccgccgcctacctcaccatcgtgcgggtgtacagcaagaagacctccgagctgcgcgtcctgcccatctacacgaacaaggtgcagcagatcgagaaggccatgacccagggcgacaaggcgaccatgctcgccttcaagaaggtgatcgccccgcagctggggaaggagaacaagaagacccacgagatcaagatccccgagttcgacgtcgtgatccccaaggtgctgctcgaccagctggtcatcgacgacatcgccggcagcccccaccggttccgcctggggacggacacctactaccacaactcccagcagctgttcctcccgctgagcatgcagcggcagctcatggaccgcgagtccgacgacaaggtgtacctggacatcttcaacgacgtgctgaagcaggtcgacagctacttcaacctctacgacgtgaacggcttccgggccgcgctgcagaagtccaagaaggccttcgagcagctgcccatcaacgacttccccaaggacgtgcccgacaacaagaagaagaaggggaagcgcagcatcctcaaggagatcttcatcggcctgcacgccaacgccaccctgggcaacctcaagcagatggggatcaagaccgacttcggcaagctgcagaagtccaacgggctgcgcatcacggagaactgcaagatcatccaccagagcccgaccggcctcttcgagcggatcgtccccatcaagtga

SEQ ID NO: 1944 - RNA, 4107 nt, synthetic construct
  misc_feature 1..4107: note = Cas9 variant
  source 1..4107: mol_type = other RNA
atgagccgcccctacaacatcggcctggacatcgggacctccagcatcggctggtccgtggtcgacgaccagagcaagctcgtgtccgtgcgggggaagtacggctacggggtccgcctgtacgacgagggccagaccgccgccgagcggcgcagcttccggacgacccgccggcgcctgaagcggcgcaagtggcggctcggcctgctgcgcgagatcttcgagccgtacatcacccccgtggacgacaccttcttcctccggcagaagcagtccaacctgagccccaaggaccagcgcaagctgtacccccagacgtccctcttcaacgaccggaccgaccgcgcgttctacgacgactacccgaccatctaccacctccggtacaagctgatgaccgagaagcgccagttcgacatccgggagatctacctggccatgcaccacatcgtgaagtaccgcgggcacttcctgaacgaggcccccgtcagctccttcaagagctccgagatcaacctggtggcccacttcgaccggctcaacacgatcttcgccgacctgttcagcgagtccggcttccagctggagaccgacaagctcgcggaggtgaaggccctgctgctcgacaaccagcagagcgcctccaaccgccagcgccaggccctgagcctgatctacaccccctccaccaacaaggcggtcgagaagcagaacaaggccatcgccacggagctcctgaaggccatcctggggctcaaggccaagttcaacgtgctgaccggcatcgaggcggaggacgtgaaggcctggaccctgaccttcaacgccgagaacttcgacgaggagatggtcaagctcgagagcagcctggacgacaacgcccaccagatcatcgagtccctgcaggagctctacagcggggtgctgctggccggcatcgtgcccgagaaccagtccctcagccaggcgatgatcacgaagtacgacgaccaccagaagcacctgaagatgctgaaggccgtccgggaggccctcgccccggaggaccgccagcggctgaagcaggcctacgaccagtacgtggacggccaggagaacaccaaggcgtactccaaggaggacttctacggggacatcaccaaggccctgaagaacaaccccgaccaccccatcgtgagcgagatcaagaagctcatcgagctggaccagttcatgcccaagcagcgcaccaaggacaacggcgccatcccgcaccagctgcaccagcaggagctcgaccggatcatcgagaaccagcagcagtactacccctggctggccgagctgaaccccaactccaagcgccagacggtcgccaagtacaagctcgacgagctggtggcgttccgggtgccctactacgtcgggccgctgatcaccgccgagcagcagcgccagagctccgacgccaagttcgcctggctgatccggaaggcggagggccgcatcaccccctggaacttcgacgacaaggtggaccggcaggccagcgccaacgagttcatcaagcgcatgaccacgaccgacacctacctcctggccgaggacgtgctgcccaagcagtccctcatctaccagcggttcgaggtcctgaacgagctgaacggcctcaagatcgacgaccagcccatcaccacggagctgaagcaggccatcttcaccgacctgttcatgcagaagatcagcgtgaccgtcaagaacatccaggactacctcgtgtccgagaagcgctacgcgagccggccggccatcaccgggctgtccgacgagaacaagttcaacagccgcctgtccacgtaccacgacctcaagatgatcgtgggcgacgccgtcgacgacgtggacaagcaggccgacctggagaagtgcatcgagtggagcaccatcttcgaggacgggaagatctactccgccaagctgaacgagatcgactggctcaccgaccagcagcgggtgcagctggcggccaagcgctaccggggctgggggcgcctgagcgccaagctcctgacccagatcgtcaacgccaacggccagcgcatcatggacctgctctgggacacgaccgacaacttcatgcggatcgtgcacagcgaggacttcgacaagctgatcaccgaggccaaccagatgatgctggcggagaacgacgtgcaggacgtcatcaacgacctctacaccagcccccagaacaagaaggccctgcgccagatcctgctcgtggtgaacgacatccagaaggccatgaagggccaggcccccgagcggatcctgatcgagttcgcgcgcgaggacgaggtcaacccccggctgtccgtgcagcgcaagcgccaggtggagcaggtctaccagaacatctccaacgagctcctgaacaacaccgagatccggaacgagctgaaggacctcagcaactccgccctgagcaacacgcggctgttcctctacttcatgcagggcgggcgcgacatgtacaccggggactccctgaacatcgaccggctgagcacctacgacatcgaccacatcctcccgcagtccttcgtgaaggacaacagcctggacaaccgcgtgctggtctcccagaagatgaaccggagcaaggccgaccaggtgcccaccgacttcacgtccgtggagctcggcaagaagatgcagctgcagtgggagcagatgctgcgcgccgggctcatcaccaagaagaagtacgacaacctgaccctgaaccccgaccacatcagcaagtacgccatgaagggcttcatcaaccggcagctcgtcgagacccgccaggtgatcaagctggcgacgaacctgctcatggagcagtacggcgaggacaacatcgagctgatcaccgtgaagtccgggctgacccaccagatgcggaccgagttcgacttccccaagaaccgcaacctcaacaaccaccaccacgccttcgacgcctacctgacggccttcgtcggcctgtacctcctgaagcggtacccgaagctgaagccctacttcgtgtacggggagtaccagaaggccagccagcaggacaagtggcgcaacttcaacttcctcaacggcctgaagaaggacgagctggtggacgagaacaccgaggcggtcatctgggacaaggagtccgggctcgcctacctgaacaagatctaccagttcaagaagatcctggtgacccgggaggtgcacgagaacagcggcgccctcttcaaccagaccctgtacgccgccaaggacgacaaggcgagcggccagggcgggaagcagctgatccccgccaagcaggaccgcccgacggccctctacgggggctactccggcaagaccagcgcctacctgtgcctggtcaagatcaagaacaagtccgagtacatctaccgcatcttcggggtgaacaccagctggtccagcgagctcaagcagatccaggaccccgcggagcggctggtgcgcctggagaagctcctgacgccccagctgaccatcaacaagaagaagaagggcgagcccgtcccggtgaccaaggacttcaagatcatcctcccccggatcctgatcaaccagaagttctactcccgcgggcaggacatcagcatcgcctccgagttctacctgcacaacgagcaggagctcgtgctggacaagagcgacatcaagatcctgaacggcgccatcaaggtcaacaactccaacaagcaggtcatcaacctcttcaaccacatcctggagcaggtcaaccagtacttccccgtgtacgacatctacaagagccgggaggtgctgaactccagcaaggagatcttcgagaacctcacctggaacgaccagtggcgcaaccggaagctgatcaacgtggggcagaagaccatcctgaaccgcatcctcatcggcctgcacgccaacgccgcgcggatcaagatctccgagctgggcttcaagaacgacttcgggctcctgacgcagaccagcggcatcaccttcacccccgacacgcagatcatctaccagtccccgaccgggctgttcgagcgccgggtggccctgcgcgacctctga

SEQ ID NO: 1945 - RNA, 4107 nt, synthetic construct
  misc_feature 1..4107: note = Cas9 variant
  source 1..4107: mol_type = other RNA
atgaagcgcagctacaacatcggcctggacatcgggaccaactccatcggctgggccatcgtggacgaccagagcaagctcatctccgtcaaggggaagtacggctacggggtgcggctgtacgacgagggccagaccgccgcggagcgccggagcttccgcacgacccggcgccggctgaagcgccggaagtggcgcctcggcctgctgcgggagatcttcgagccctacatcaccccgatcgactccaccttcttcctccgccagaagcagagcaacctgtcccccaaggaccagcggaagctgtacccccagacgagcctcttcaacgaccgccccgacgccgacttctaccagcagtacccgaccatctaccacctccggtaccagctgatgaccgagaagcgccagttcgacatccgggagatctacctcgccatgcaccacatcgtgaagtaccgcgggcacttcctgaacgaggcccccgtcgcctccttcaagagctccgagatcaacctggcggagcacttcgaccagctcaacaccatcttcgccgacctgttccgggagagcggcttccagctggagacggacgagctcgtggccgtgaaggccctgctgatggacaaccagcagtccgcgagcaaccgccagcggaaggccctccccaagctgtacaccccctccgccgacaagagcatcgagaagcagcgcaaggccatcgccaccgagatcctgaaggcgatcctcgggctgaaggccaagttcaacgtcgtgaccggcatcgaggccgaggacgtgaaggcctgggccctgacgttcaacgcggagaacttcgacgaggagctcgccaagctggagtccagcctggacgacaacgggcacgaggtcatcggcatcctccaggagctgtactccggcatcctgctcgccgggatcgtgccggagaaccagagcctgagccaggccatgatcaccaagtacgaggagcaccaggcccacctgaagatgctcaaggcggtgcgcgacgacctggccaccgccgaccagcagaagctgaagaaggcctacgaccagtacatcgacggccaggagaacaccaaggcctactccaaggaggcgttctacgacgacgtcacgaaggccctcaaggactacagcgagcagcccctggtgtccgagatccagaagctgatcgagctcgaccagttcatgcccaagcagcggaccaaggacaacggggccatcccccaccagctgcaccagcaggagctggaccgcatcatcgagaaccagcagcagtactacccgtggctcgccgagctgaaccccaaccccaagcggcagaccgtggcgaagtacaagctggacgagctcgtcgccttccgcgtgccctactacgtgggcccgctgatcaccgccgagcagcagcagcagagctccaacgccaagttcgcctggatgatccggaagacggagggccgcatcaccccctggaacttcgacgacaaggtcgaccggcaggcgagcgccaacgagttcatcaagcgcatgaccaccacggacacctacctgctggccgaggacgtgctccccaagcagtccctgatctaccagcggttcgaggtgctgaacgagctcaacgggctgaagatcgacgaccagcccatcaccaacgagctgaagcaggccatcttcaacgacctcttcatgcagaagaccagcgtctccgtgaagaacatccaggactacctggtgagcgagaagcgctacgcctcccggccggcgatcacgggcctgagcgacgagaagaagttcaactcccgcctcagcacctaccacgacctgaaggtcatcgtgggggacgccgtcgacgacgtggacaagcaggccgacctggagaagtgcatcgagtggtccaccatcttcgaggacggcaagatctacagcgccaagctcaacgagatcacctggctgacggagcagcagcgggggcagctggccaccaagcgctaccggggctggggccgcctctccgcgaagctgctgacccagatcgtgaacgccaacgggcagcggatcatggacctcctgtgggacaccacggacaacttcatgcgcatcgtccacttcgaggacttcgacaagctgatcaccgaggccaaccagatggtgctcgccgagaacgacgtgcaggacgtcatcaacgacctgtacaccagcccccagaacaagaaggcgctgcggcagatcctcctggtggtgaacgacatccagaaggccatgaagggccaggcccccgagcgcatcctgatcgagttcgcccgcggggcccagaaggacaagtccctcaccgtccggcgcaagcggaagctggacgagatgtacagccagatcagcgacgcggtgctggccgacgagtccgtgcgccaggagctcaagagctccaaccaggacgacctggtcaaggagaaggtgtacctgtacttcatgcagggcgggcgggacctctacaccggcaacgccctgaacatcgaccgcctgagcgactaccacgtggaccacatcatcccccaggcctacatcaaggacgactccctcgacaacaaggccctggtcagctcccggatgaacgagatcaaggcggaccgcgtgccgctccaggtggtccagaagcagttcggcaagaacatggccagcgagtgggggtacatgcaccgggccggcctgatctcccgcaagaagtacgacaacctgatgttcaaccccgagaacctgaacaagtaccagatcaaccggttcatcagccgccagctcgtggagacgcagcaggtcatcaagctggtggccaacctgctctccaaccagtacgagggggacaacgtgaagatcatcaccgtcaagagcaagctgacccagaccatccggtccgagttcgacttccccaagaaccgcgaggtgaacaactaccaccacgccttcgacgcgtacctgacggccttcgtgggcatgtacctcctgaagcggtaccccaagctgagctcctacttcacctacggggagtacctcaagggcaaccagcaggacaagtggagctccttcaacttcctgaacgacctgaagcgcgccaagctcgaggacaagaccaacaaggagatcttctggcacaaggagagcggcctggcctacctgaacaagatctaccagttcaagaagatcctcgtgacccgggaggtccacgagaacagcggggcgctgttcaaccagacgctgtacgccgccaaggacgacaaggcctccggccagggcgggaagcagctcatcccggccaagcaggcgcgccccaccgccctgtacggcgggtacagcggcaagaccgtggcctacatgtgcatcgtgcggatcaagaacaagaagggggacctgtacaaggtctgcggcgtggagacctcctggctcgcccagctgaagcagctgaaggacgaggacagccagaaggccttcctcaagcagaagatcagcccccagttcacgaaggcgaagaagcagaaggggaccatcgtgaaggtcgtggaggacttcgaggtgatcgccccgcacatcctgatcaaccagcgcctgttcgacaacggccaggagctcaccctgggcagcgccacctacaagcacaacgagcaggagctgatcctcgacaagacggccgtcaagctgctgaacggggagctccccctggcccagtccgaggagctggcggagctcgtgtacgacgagatcctggaccaggtgatgcactacttccccctgtacgacaccaaccagttccgggccaagctcctggccggcaagaccgccttcatgcagctgccctggaagtccaacccggacgacaacaagaccgtccagatcacgcagcccatcgtgctcaagaagatcctgcaggggctgcacgccgacgcgggccgcgtgtccctcaaggagctggggatgaccaccgacttcggcatgctgcagaaggccaccggcatcacgttcacccccgacacccagatcatctaccagagccccaccgggctgttcgagcgccgggtcgccctgcgcgacctgtga

SEQ ID NO: 1946 - RNA, 4107 nt, synthetic construct
  misc_feature 1..4107: note = Cas9 variant
  source 1..4107: mol_type = other RNA
atggacaagaagtacagcatcggcctggacatcgggaccaactccgtgggctgggccgtcatcaccgacgactacaaggtgcccagcaagaagttcaaggtgctggggaacacggaccgccactccatcaagaagaacctgatcggcgccctgctgttcgacagcggggagaccgcggaggccacccggctgaagcgcaccgcccggcgccggtacacgcgccggaagaaccgcatctgctacctgcaggagatcttctccaacgagatggccaaggtcgacgacagcttcttccaccggctcgaggagtccttcctggtggaggaggacaagaagcacgagcgccacccgatcttcggcaacatcgtggacgaggtcgcctaccacgagaagtaccccaccatctaccacctccggaagaagctcgtggacagcaccgacaaggcggacctgcgcctgatctacctcgccctggcccacatgatcaagttccggggccacttcctgatcgagggggacctcaaccccgacaactccgacgtggacaagctgttcatccagctggtccagacctacaaccagctgttcgaggagaaccccatcaacgccagcggcgtggacgcgaaggccatcctgtccgcccgcctgagcaagtcccggcgcctcgagaacctgatcgcccagctgccgggggagaagaagaacggcctcttcgggaacctgatcgccctgagcctcggcctgacgcccaacttcaagtccaacttcgacctggcggaggacgccaagctccagctgagcaaggacacctacgacgacgacctggacaacctcctggcccagatcggcgaccagtacgccgacctgttcctcgccgcgaagaacctgtccgacgccatcctgctcagcgacatcctgcgggtgaacaccgagatcaccaaggccccgctgtccgccagcatgatcaagcgctacgacgagcaccaccaggacctcacgctgctgaaggccctcgtccggcagcagctgcccgagaagtacaaggagatcttcttcgaccagagcaagaacgggtacgcgggctacatcgacgggggcgcctcccaggaggagttctacaagttcatcaagccgatcctggagaagatggacggcaccgaggagctcctggtgaagctgaaccgcgaggacctgctccggaagcagcgcaccttcgacaacgggagcatcccccaccagatccacctgggcgagctgcacgccatcctccgccggcaggaggacttctaccccttcctgaaggacaaccgcgagaagatcgagaagatcctgaccttccggatcccctactacgtggggccgctcgcccgcggcaactcccggttcgcctggatgacgcgcaagagcgaggagaccatcaccccctggaacttcgaggaggtcgtggacaagggggcgtccgcccagagcttcatcgagcggatgaccaacttcgacaagaacctgcccaacgagaaggtgctgcccaagcactccctcctgtacgagtacttcacggtctacaacgagctgaccaaggtgaagtacgtgaccgagggcatgcgcaagccggccttcctcagcggcgagcagaagaaggccatcgtcgacctgctgttcaagaccaaccggaaggtgacggtgaagcagctcaaggaggactacttcaagaagatcgagtgcttcgactccgtcgagatcagcggggtggaggaccgcttcaacgcgtccctgggcacctaccacgacctgctcaagatcatcaaggacaaggacttcctggacaacgaggagaacgaggacatcctggaggacatcgtcctcaccctgaccctgttcgaggaccgggagatgatcgaggagcgcctcaagacgtacgcccacctgttcgacgacaaggtgatgaagcagctgaagcggcgccggtacaccgggtggggccgcctcagccggaagctgatcaacgggatccgcgacaagcagtccggcaagaccatcctggacttcctcaagagcgacggcttcgccaaccggaacttcatgcagctgatccacgacgactccctgaccttcaaggaggacatccagaaggcccaggtgagcgggcagggcgactccctccacgagcacatcgccaacctggcggggagccccgccatcaagaagggcatcctgcagacggtcaaggtggtggacgagctcgtcaaggtgatggggcgccacaagcccgagaacatcgtgatcgagatggcccgcgagaaccagaccacccagaagggccagaagaactcccgggagcgcatgaagcggatcgaggagggcatcaaggagctggggagccagatcctgaaggagcaccccgtcgagaacacccagctccagaacgagaagctgtacctgtactacctccagaacggccgcgacatgtacgtggaccaggagctggacatcaaccggctgagcgactacgacgtggaccacatcgtcccgcagtccttcctcaaggacgacagcatcgacaacaaggtgctgacgcgctccgacaagaaccggggcaagagcgacaacgtgccctccgaggaggtcgtgaagaagatgaagaactactggcgccagctgctcaacgccaagctgatcacccagcggaagttcgacaacctgaccaaggccgagcgcgggggcctcagcgagctggacaaggcggggttcatcaagcggcagctggtggagacccgccagatcaccaagcacgtcgcccagatcctcgactcccggatgaacacgaagtacgacgagaacgacaagctgatccgcgaggtgaaggtgatcaccctcaagagcaagctcgtctccgacttccggaaggacttccagttctacaaggtgcgcgagatcaacaactaccaccacgcccacgacgcctacctgaacgccgtggtcggcaccgcgctgatcaagaagtaccccaagctcgagagcgagttcgtgtacggggactacaaggtgtacgacgtccggaagatgatcgccaagtccgagcaggagatcggcaaggccaccgccaagtacttcttctacagcaacatcatgaacttcttcaagacggagatcaccctggcgaacggggagatccgcaagcggcccctgatcgagaccaacggcgagaccggcgagatcgtgtgggacaaggggcgcgacttcgccacggtgcggaaggtcctctccatgccccaggtgaacatcgtgaagaagaccgaggtccagaccggcgggttcagcaaggagtccatcctgcccaagcgcaacagcgacaagctgatcgcccgcaagaaggactgggaccccaagaagtacggcgggttcgactcccccaccgtggcctacagcgtgctcgtcgtggccaaggtggagaagggcaagagcaagaagctgaagtccgtcaaggagctgctcggcatcacgatcatggagcggagctccttcgagaagaacccgatcgacttcctggaggcgaaggggtacaaggaggtgaagaaggacctgatcatcaagctccccaagtacagcctgttcgagctggagaacggccgcaagcggatgctcgcctccgccggggagctgcagaagggcaacgagctggccctccccagcaagtacgtgaacttcctgtacctggcctcccactacgagaagctcaaggggagcccggaggacaacgagcagaagcagctgttcgtcgagcagcacaagcactacctggacgagatcatcgagcagatctccgagttcagcaagcgcgtgatcctcgcggacgccaacctggacaaggtgctgtccgcctacaacaagcaccgggacaagcccatccgcgagcaggccgagaacatcatccacctcttcaccctgaccaacctgggcgcccccgcggccttcaagtacttcgacaccacgatcgaccggaagcgctacaccagcaccaaggaggtcctcgacgccaccctgatccaccagtccatcacgggcctgtacgagacccggatcgacctcagccagctcgggggcgactga

SEQ ID NO: 1947 - RNA, 4107 nt, synthetic construct
  misc_feature 1..4107: note = Cas9 variant
  source 1..4107: mol_type = other RNA
atggacaagaagtacagcatcggcctggacatcgggaccaactccgtgggctgggccgtcatcaccgacgactacaaggtgcccagcaagaagctcaaggggctgggcaacacggaccgccacgggatcaagaagaacctgatcggcgccctcctgttcgactccggcgagaccgcggaggccacccggctgaagcgcaccgcccggcgccggtacacgcgccggaagaaccgcatctgctacctccaggagatcttcagcaacgagatggccaaggtggacgactccttcttccaccggctggaggagagcttcctggtcgaggaggacaagaagcacgagcgccacccgatcttcgggaacatcgtggacgaggtggcctaccacgagaagtaccccaccatctaccacctccggaagaagctggcggactccaccgacaaggtcgacctgcgcctcatctacctggccctggcccacatgatcaagttccggggccacttcctcatcgagggggacctgaaccccgacaacagcgacgtggacaagctgttcatccagctcgtgcagacctacaaccagctgttcgaggagaaccccatcaacgcctcccgcgtcgacgcgaaggccatcctgagcgcccggctctccaagagccgccggctggagaacctgatcgcccagctcccgggcgagaagaagaacgggctgttcggcaacctgatcgccctctccctgggcctgacgcccaacttcaagagcaacttcgacctcgcggaggacgccaagctgcagctgtccaaggacacctacgacgacgacctcgacaacctgctggcccagatcggggaccagtacgccgacctcttcctggccgcgaagaacctgagcgacgccaccctcctgtccgacatcctgcgcgtgaacagcgagatcaccaaggcgcccctctccgccagcatgatcaagcggtacgacgagcaccaccaggacctgacgctgctcaaggccctggtgcgccagcagctgcccgagaagtacaaggagatcttcttcgaccagagcaagaacggctacgccgggtacatcgacggcggcgcctcccaggaggagttctacaagttcatcaagccgatcctcgagaagatggacgggaccgaggagctgctggccaagctgaaccgggaggacctcctgcgcaagcagcgcaccttcgacaacggcagcatcccctaccagatccacctgggggagctccacgccatcctgcggcgccaggaggacttctaccccttcctgaaggacaaccgggagaagatcgagaagatcctcaccttccgcatcccctactacgtcggcccgctggcccgggggaactcccgcttcgcgtggatgacgcgcaagagcgaggagaccatcaccccctggaacttcgaggaggtggtggacaagggcgcctccgcccagagcttcatcgagcggatgaccaacttcgacaagaacctgcccaacgagaaggtcctccccaagcactccctgctgtacgagtacttcacggtgtacaacgagctcaccaaggtgaagtacgtcaccgagggcatgcggaagccggccttcctgagcggggagcagaagaaggcgatcgtggacctgctgttcaagaccaaccgcaaggtgacggtcaagcagctgaaggaggactacttcaagaagatcgagtgcttcgactccgtggagatcagcggcgtggaggaccggttcaacgcctccctggggacctaccacgacctcctgaagatcatcaaggacaaggacttcctggacaacgaggagaacgaggacatcctcgaggacatcgtcctgaccctgaccctcttcgaggaccgcgagatgatcgaggagcggctgaagacgtacgcccacctgttcgacgacaaggtgatgaagcagctcaagcgccggcgctacaccggctgggggcggctgagccgcaagctgatcaacggcatccgggacaagcagtccggcaagaccatcctcgacttcctcaagagcgacgggttcgccaaccgcaacttcatgcagctgatccacgacgactccctcaccttcaaggaggacatccagaaggcccaggtcagcggccagggggactccctgcacgagcacatcgcgaacctggccggcagccccgccatcaagaaggggatcctccagacggtgaaggtggtcgacgagctggtgaaggtgatgggccgccacaagcccgagaacatcgtcatcgagatggcccgggagaaccagaccacccagaagggccagaagaactcccgcgagcggatgaagcgcatcgaggaggggatcaaggagctgggcagcgacatcctcaaggagtaccccgtggagaacacccagctgcagaacgagaagctgtacctctactacctgcagaacgggcgggacatgtacgtggaccaggagctggacatcaaccgcctcagcgactacgacgtcgaccacatcgtgccgcagtccttcctgaaggacgacagcatcgacaacaaggtgctgacgcggtccgacaagaaccgcggcaagagcgacaacgtcccctccgaggaggtggtgaagaagatgaagaactactggcggcagctcctgaacgccaagctgatcacccagcgcaagttcgacaacctcaccaaggcggagcggggcgggctgagcgagctggacaaggtcggcttcatcaagcgccagctcgtggagacccggcagatcaccaagcacgtggcccagatcctggactcccgcatgaacacgaagtacgacgagaacgacaagctgatccgggaggtccgcgtgatcaccctcaagagcaagctggtgtccgacttccggaaggacttccagttctacaaggtccgcgagatcaacaactaccaccacgcccacgacgcctacctgaacgccgtggtggggaccgcgctcatcaagaagtaccccaagctggagagcgagttcgtctacggcgactacaaggtgtacgacgtgcggaagatgatcgccaagtccgagcaggagatcgggaaggccaccgccaagtacttcttctacagcaacatcatgaacttcttcaagacggagatcaccctggcgaacggcgagatccgcaagcggcccctcatcgagaccaacggcgagaccggggagatcgtctgggacaagggccgcgacttcgccacggtgcgcaaggtgctgtccatgccgcaggtcaacatcgtgaagaagaccgaggtgcagaccgggggcttcagcaaggagtccatcctgcccaagcggaacagcgacaagctcatcgcccgcaagaaggactgggaccccaagaagtacgggggcttcgactcccccaccgtcgcctacagcgtgctggtggtcgccaaggtggagaagggcaagagcaagaagctgaagtccgtgaaggagctcctggggatcacgatcatggagcggagctccttcgagaaggacccgatcgacttcctggaggcgaagggctacaaggaggtccgcaaggacctcatcatcaagctgcccaagtacagcctgttcgagctcgagaacgggcggaagcgcatgctggcctccgccggcgagctgcagaaggggaacgagctcgccctgcccagcaagtacgtgaacttcctgtacctcgcctcccactacgagaagctgaagggcagcccggaggacaacgagcagaagcagctgttcgtggagcagcacaagcactacctcgacgagatcatcgagcagatctccgagttcagcaagcgggtcatcctggcggacgccaacctggacaaggtgctctccgcctacaacaagcaccgcgacaagcccatccgggagcaggccgagaacatcatccacctgttcaccctgaccaacctcggcgcccccgcggccttcaagtacttcgacaccacgatcgaccgcaagcggtacaccagcaccaaggaggtgctggacgccaccctgatccaccagtccatcacggggctctacgagacccgcatcgacctgagccagctgggcggggactga

SEQ ID NO: 1948 - RNA, 4107 nt, synthetic construct
  misc_feature 1..4107: note = Cas9 variant
  source 1..4107: mol_type = other RNA
atggacaagaagtacagcatcggcctggacatcgggaccaactccgtgggctgggccgtcatcaccgacgactacaaggtgcccagcaagaagttcaaggtgctcgggaacacggaccgccactccatcaagaagaacctgatcggcgccctcctcttcgacagcggggagaccgcggaggccacccggctgaagcgcaccgcccggcgccggtacacgcgccggaagaaccgcatctgctacctgcaggagatcttctccaacgagatggccaaggtcgacgacagcttcttccaccggctcgaggagtccttcctggtggaggaggacaagaagcacgagcgccacccgatcttcggcaacatcgtggacgaggtcgcctaccacgagaagtaccccaccatctaccacctccggaagaagctcgcggacagcaccgacaaggccgacctgcgcctgatctacctcgccctggcccacatgatcaagttccggggccacttcctgatcgagggggacctcaaccccgacaactccgacgtggacaagctgttcatccagctggtgcagacctacaaccagctgttcgaggagaaccccatcaacgcgagccgcgtcgacgccaaggccatcctgtccgcccggctgagcaagtcccgccggctcgagaacctgatcgcccagctgccgggcgagaagcgcaacgggctgttcggcaacctgatcgcgctgagcctcgggctgacgcccaacttcaagtccaacttcgacctggccgaggacgccaagctccagctgagcaaggacacctacgacgacgacctggacaacctcctggcccagatcggcgaccagtacgccgacctgttcctcgcggccaagaacctgtccgacgccatcctgctcagcgacatcctgcgggtgaactccgagatcaccaaggccccgctgagcgccagcatgatcaagcgctacgacgagcaccaccaggacctcaccctgctgaaggcgctcgtgcggcagcagctgcccgagaagtacaaggagatcttcttcgaccagtccaagaacggctacgccgggtacatcgacggcggggccagccaggaggagttctacaagttcatcaagccgatcctggagaagatggacggcacggaggagctcctggccaagctgaaccgcgaggacctgctccgcaagcagcggaccttcgacaacggctccatcccccaccagatccacctgggggagctgcacgccatcctccgccggcaggaggacttctaccccttcctgaaggacaaccgcgagaagatcgagaagatcctgaccttccggatcccctactacgtcggcccgctcgcgcgcgggaacagccggttcgcctggatgacccgcaagtccgaggagacgatcaccccctggaacttcgaggaggtggtggacaagggcgccagcgcccagtccttcatcgagcggatgaccaacttcgacaagaacctgcccaacgagaaggtcctgcccaagcacagcctcctgtacgagtacttcaccgtgtacaacgagctgacgaaggtgaagtacgtcaccgaggggatgcgcaagccggagttcctctccggcgagcagaagaaggcgatcgtggacctgctgttcaagaccaaccggaaggtgaccgtcaagcagctcaaggaggactacttcaagaagatcgagtgcttcgacagcgtggagatctccggcgtggaggaccgcttcaacgccagcctggggacgtaccacgacctgctcaagatcatcaaggacaaggacttcctggacaacgaggagaacgaggacatcctggaggacatcgtcctcaccctgaccctgttcgaggaccgggagatgatcgaggagcgcctcaagacctacgcccacctgttcgacgacaaggtgatgaagcagctgaagcggcgccggtacacgggctgggggcgcctctcccggaagctgatcaacggcatccgcgacaagcagagcgggaagaccatcctggacttcctcaagtccgacggcttcgccaaccgcaacttcatgcagctgatccacgacgacagcctgaccttcaaggaggacatccagaaggcccaggtctccggccagggggacagcctccacgagcacatcgcgaacctggccggctcccccgccatcaagaaggggatcctgcagaccgtgaaggtggtcgacgagctcgtgaaggtgatgggccggcacaagcccgagaacatcgtcatcgagatggcccgcgagaaccagacgacccagaaggggcagaagaacagccgggagcgcatgaagcggatcgaggagggcatcaaggagctgggcagcgacatcctgaaggagtaccccgtggagaacacccagctccagaacgagaagctgtacctgtactacctccagaacgggcgcgacatgtacgtggaccaggagctggacatcaaccggctgtccgactacgacgtcgaccacatcgtgccgcagagcttcatcaaggacgactccatcgacaacaaggtgctcacccgcagcgacaagaaccggggcaagtccgacaacgtccccagcgaggaggtggtgaagaagatgaagaactactggaagcagctgctgaacgccaagctcatcacgcagcgcaagttcgacaacctgaccaaggcggagcgcgggggcctgtccgagctcgacaaggccggcttcatcaagcggcagctggtcgagacccggcagatcaccaagcacgtggcccagatcctggacagccgcatgaacaccaagtacgacgagaacgacaagctcatccgggaggtgaaggtcatcacgctgaagtccaagctggtgagcgacttccgcaaggacttccagttctacaaggtgcgggagatcaacaactaccaccacgcccacgacgcctacctcaacgcggtcgtggggaccgccctgatcaagaagtaccccaagctggagtccgagttcgtgtacggcgactacaaggtctacgacgtgcgcaagatgatcgccaagagcgagcaggagatcgggaaggccaccgcgaagtacttcttctactccaacatcatgaacttcttcaagaccgagatcacgctcgccaacggcgagatccggaagcgccccctgatcgagaccaacggggagaccggcgagatcgtgtgggacaagggccgggacttcgccaccgtccgcaaggtgctgagcatgccccaggtgaacatcgtcaagaagacggaggtgcagaccgggggcttctccaaggagagcatcctccccaagcgcaactccgacaagctgatcgcccggaagaaggactgggaccccaagaagtacgggggcttcgacagccccaccgtggcctacagcgtcctggtggtggcgaaggtcgagaaggggaagtccaagaagctcaagagcgtgaaggagctgctgggcatcaccatcatggagcgctccagcttcgagaagaacccgatcgacttcctcgaggccaagggctacaaggaggtgcggaaggacctgatcatcaagctgcccaagtactccctcttcgagctggagaacgggcgcaagcggatgctggccagcgccggcgagctccagaaggggaacgagctggccctgccctccaagtacgtcaacttcctctacctggcgagccactacgagaagctgaagggctccccggaggacaacgagcagaagcagctgttcgtggagcagcacaagcactacctggacgagatcatcgagcagatcagcgagttctccaagcgcgtgatcctggccgacgccaacctcgacaaggtcctgagcgcctacaacaagcaccgggacaagcccatccgcgagcaggccgagaacatcatccacctgttcacgctcaccaacttcggggcgcccgccgccttcatctacttcgacaccaccatcggccggaaccgctacaagtccatcaaggaggtgctggacgccacgctgatccaccagagcatcaccggcctctacgagacccggatcgacctgtcccagctcgggggcgactga

SEQ ID NO: 1949 - RNA, 4107 nt, synthetic construct
  misc_feature 1..4107: note = Cas9 variant
  source 1..4107: mol_type = other RNA
atgaagtacgagagcgaggagtactacatcggcctggacatggggacctccagcgtgggctgggccgtcaccgacccccactaccacctcatccgcaagaaggggaaggacctgtggggcgcccggctgttcgagaaggcgaacacggcccaggagcgccggaccaaccgcatcaaccggcgccggaaccagcgccggaagcagcgcatcgccttcatccgggaggccttccgcaaggaggtggagaaggtggacgtcaacttcttccggcgcctcgacgagtcccagctgtacctggaggacaagagcatcaaggagccgtacctcctgttcaacgacctgaactacaccgacaaggacttctaccaccagtaccccaccgtgttccacctcatcacggacctgctgacctccgaccggaagttcgacatccgcgagatctacatcgccgtgagctccctctacaaccaccgggggaacttcctgaacaagagcctgggcaacgagacccaggacgaggacctcgtcttcaagaacctggacgaggcgttctccgcctgcggcatgaactggaacaccaaggccgagaacatcgaggtggtgaagcagatcctgtgcgaccgcagcctcaacaagaaggagaagcaggaccagctggcccactgcctggagatcaacaagaagacggagaaggagaagatcgagttcctcaagctgctgaccgggggcaaggcggactccaagaagatgttcccccagtaccactacgagcgggacgagaagctcagcttcgccttcgccgacgagaacggggacgagaactgggaggagaccctgaacgccatcgaggagcgcctgacctccgacgagtacggcctcatcctggccctcaagagcgtctacgactggtccatcctcgcggacctgatgaagaacgagaagacgggggagacctacccctacctgagcatggcccggaaggactcctacgagaagcacaaggccgacctccgcctgctcaagagcgtgatcaagcgcctcatcccgaacgagtacaaccacttcttccggcagtacgacggcaagggcaagacctacaccaactacatcgggtccgtgcagtaccacgagaagcgccaccggttcaagcacatcacgaccaaggagttctacgacggcctgaagaagctgctcaagccctacagcgaggacgaggagatcaagcagatcctgcaggacatcgagagcgagaccttcctgcccaagcagatcaccaacatgaacggggtcatccccaaccaggtgcacgccaaggagctcaaggtgatcctggagaaggcctcccagcactacgacttcctgaacgagacgaacgagagcggcctcaccgtcaaggagcagatcatgcagatgttcaccttccagatcccgtactacgtgggccccctggcgaacctgaacgggaagggcaacgggtgggccgtgcgctacgtcggcaaggagcggaccaaggtgtacccctggaacatggacgaggtgatcgacgagaaggagacggccgaccagttcatcaagcgcatgatctccacgtgcacctacctcggggacgagtacgtcctgcccaagagctccatcctgtacgagaagttcgccgtgctgaacgagctcaacagcctgaagatcaacggccagccggtgtccgtcgacctgaagcagaagatctaccgggacctcttcaccaagggcaagcgcgtgacccagaaggggctgctgctctacctgaagcgggagggcgtcatcagcaagtccgaggagaccatcctgagcgggttcgacatcgacttcaagaacaccctctccagctaccgcaagttctgcgaggtgttcgccaccaacgagctgaacgacgagcagatccggatggcggaggacatcatcgagtggctgacggtgttcggcgactccaagaagttcgtccgcgagaagatccacgggaactacccccagatcaccgccaaccagctcaagcggatcctgagcttcaacttcaaggactggggcaagctgtccaagcagttcctcgagctggagggcgaggaccgcgagaccggcaagagctgctccctgatccaggccctctgggacaccaacaacaacctgaaccagctgctcagctcccggttcacgtacaaggagaacctggagaagaagcgcaagaagatcgagatggacctgttcgagttcacccacgaggacctcgacgacctgtacatcagcgcccccgtgaagcggatgatctggcaggccctgaagatcatgaaggacatcgtgatcgtcatgaaggagagccccaccaagctgttcatcgagatgacccgcaacaacgagaacgagaagacccggacggtgtcccgcaagaacaagctggtggacctgtacaagaagatcaagggggagagccgcgactggatcaaggagctcgagcggtacgaggagaaggacttccgctccaagaagctgtacctgtactacacccagatgggcaagagcgcgtactccggggagccgatcgacatggacaagctgttcgacaagaacgtctacgacatcgaccacatctaccccaagagcaaggtgaaggacgactccctgctgaacaactgcgtgctcgtcaagcggaaggagaacatggacaaggggaacaacttccccatcgaccccgacatccagaccaagcaggagcacctgtggaagttctggctggagaagggcctcatcacccaggagaagttcaaccgcctgacgcggaagaagccgttcaccaacgacgagctggccgacttcgtgaaccgccagctcgtggagaccggccaggccaccaagacgatcgccgacctgttcaagatgaccttccccaacagcgacatcgtctacgtgaaggcggggaacgtgaccgacttccggcagtacatcgaggtctacaagtgccgcgaggtgaacaacctgcaccacgcctacgacgcctacctcaacgtggtcgtgggcaacgtgtacgacaccaagttcacgaagaaccccatgaactacatcaaggagcagcggaaggagaactccaacgagcgctaccacatggacaagatcttcgagttccccgtcatccggaacgggaaggaggcctggatcaccaagaaggacgagagcatcaacatcgtgcgcaagaccctggcccggaagaccccgctggtgacgaagcgcaacttcgaggcgaacggcaccatcgccaaggccaccatctaccccaagggcaacgtcaaggaccaggggtacctcccccggaagacctccatccccgccctgcgcgacatgaagaagtacggcggggtgacgagcatccagatcgcctacttcttcctggtggagcacgaggtcaagaagaagcggatccgcaccatcgagtgcgtgccgatctaccggaaggaggagctcaagaccaaggagcagctggagcgctactgccgggaggagctgaagctcatcaacccctccatccgcctggagaagatcaagccctacagcctgctcaagatgaacggcaacttcttctacatcaccgggaagacgaacgaccgcttctccctggcgaacgccatggagctgtacgtggacaaggtcagcgagaaccacatccgggacctcgtgaagtacaagaactgcggctacttcaacgtggacgacaaggaggcccgcaagcggaacgagcgcctgtacaccatcctgaccaagaagcacctcaccgtcttcaagggctccccgaagcccatgggggagaagctgcagcagtaccagcagctgttcctcgagctggaggtgagcaagcaggtctacgtgctgctccagatcctgcagctgacggccaccaacgtgaagaccaaggccgacctcaccgcgatcggcgggaaggccaacgagggcacgatggacatcagcaagaacctggagaacgtgatcaagaaccagatcaagaaggggctggtccccgagctcatgctgatcaaccagtcccccaccggcctgttcgagagcgagatcgacctcctgaccatctga

SEQ ID NO: 1950 - RNA, 4107 nt, synthetic construct
  misc_feature 1..4107: note = Cas9 variant
  source 1..4107: mol_type = other RNA
atgagccgcccctacaacatcggcctggacatcgggacctccagcatcggctggtccgtggtcgacgaccagagcaagctcgtgtccgtgcgggggaagtacggctacggggtccgcctgtacgacgagggccagaccgccgccgagcggcgcagcttccggacgacccgccggcgcctgaagcggcgcaagtggcggctcggcctgctgcgcgagatcttcgagccgtacatcacccccgtggacgacaccttcttcctccggaagaagcagtccaacctgagccccaaggaccagcgcaagctgtacccccagacgtccctcttcaacgaccggaccgaccgcgcgttctacgacgactacccgaccatctaccacctccggtacaagctgatgaccgagaagcgccagttcgacatccgggagatctacctggccatgcaccacatcgtgaagtaccgcgggcacttcctgaacgaggcccccgtcagctccttcaagagctccgagatcaacctggtggcccacttcgaccggctcaacacgatcttcgccgacctgttcagcgagtccggcttccagctggagaccgacaagctcgcggaggtgaaggccctgctgctcgacaaccaccagagcgcctccaaccgccagcgccaggccctgctgctcatctacacccccagcaccaacaaggcggtcgagaagcagaacaaggccatcgccacggagctgctgaaggccatcctcgggctgaaggccaagttcaacgtgctgaccggcatcgaggcggaggacgtgaagacctggaccctcacgttcaacgccgagaacttcgacgaggagatggtcaagctggagtccagcctggacgacaacgcccaccagatcatcgagagcctccaggagctgtactccggggtgctgctcgccggcatcgtgcccgagaaccagagcctgtcccaggccatgatcaccaagtacgacgaccaccagaagcacctgaagatgctcaaggcggtccgggaggccctggccccggaggaccgccagcggctgaagcaggcctacgaccagtacgtggacggccaggagaacaccaaggcctacagcaaggaggacttctacggggacatcaccaaggcgctcaagaacaaccccgaccaccccatcgtgtccgagatcaagaagctgatcgagctggaccagttcatgcccaagcagcgcacgaaggacaacggcgccatcccgcaccagctccaccagcaggagctggaccggatcatcgagaaccagcagcagtactacccctggctggccgagctcaaccccaacagcaagcgccagaccgtcgccaagtacaagctggacgagctggtggccttccgggtgccctactacgtcgggccgctgatcaccgcggagcagcagcagcagtccagcgacgccaagttcgcctggatgatccgcaaggccgagggccagatcaccccctggaacttcgacgacaaggtggaccggcaggcgtccgccaacgagttcatcaagcgcatgacgaccaccgacacctacctcctggccgaggacgtgctgcccaagcagagcctcatctaccagcggttcgaggtcctgaacgagctgaacggcctcaagatcgacgaccagcccatcacgaccgagctgaagcaggccatcttcaccgacctgttcatgcagaagacctccgtgacggtcaagaacatccaggactacctcgtgagcgagaagcgctacgcctcccggccggcgatcaccgggctgagcgacgagaacaagttcaactcccgcctgagcacctaccacgacctcaagaccatcgtgggcgacgccgtcgacgacgtggacaagcaggccgacctggagaagtgcatcgagtggtccacgatcttcgaggacgggaagatctacagcgccaagctgaacgagatcgactggctcaccgaccagcagcgggtgcagctggccgcgaagcgctaccggggctgggggcgcctgtccgccaagctcctgacccagatcgtcaacgccaacggccagcggatcatggacctgctctgggacaccaccgacaacttcatgcgcatcgtgcacagcgaggacttcgacaagctgatcacggaggccaaccagatgatgctggccgagaacgacgtgcaggacgtcatcaacgacctctacaccagcccccagaacaagaaggcgctgcgccagatcctgctcgtggtgaacgacatccagaaggccatgaagggccaggcccccgagcggatcctgatcgagttcgcccgcgaggacgaggtcaacccccggctgtccgtgcagcgcaagcgccaggtggagcaggtctaccagaacatcagcaacgagctcctgaacaacaccgagatccggaacgagctgaaggacctctccaacagcgcgctgtccaacacccggctgttcctctacttcatgcagggcgggcgcgacatgtacacgggggacagcctgaacatcgaccggctgtccacctacgacatcgaccacatcctcccgcagagcttcatcaaggacaactccctggacaaccgcgtgctggtgagccagcggatgaaccgctccaaggccgaccaggtccccaccgacttcaccagcgtggagctcggccagaagatgcagatccagtgggagcagatgctgcgggccgggctgatcacgaagaagaagtacgacaacctcaccctgaaccccgaccacatctccaagtacgccatgaagggcttcatcaaccgccagctggtggagacccggcaggtcatcaagctcgccaccaacctgctgatggagcagtacggcgaggacaacatcgagctcatcacggtgaagtccgggctgacccaccagatgcgcaccgagttcgacttccccaagaaccggaacctgaacaaccaccaccacgcgttcgacgcctacctcaccgccttcgtgggcctgtacctgctcaagcgctacccgaagctgaagccctacttcgtctacggggagtaccagaaggcctcccagcaggacaagtggcggaacttcaacttcctgaacggcctcaagaaggacgagctggtggacgagaacacggaggccgtgatctggaacaaggagagcgggctggcgtacctcaacaagatctaccagttcaagaagatcctggtcacccgcgaggtgcacgagaactccggcgccctgttcaaccagaccctctacgccgccaaggacgacaaggccagcggccagggcgggaagcagctgatccccgcgaagcaggaccggccgaccgccctgtacgggggctacagcggcaagacggtggcctacatgtgcatcgtccgcatcaagaacaagaagggggacctctacaaggtgtgcggcgtggagacctcctggctggcccagctgaagcagctcaccgacgaggacagcaagaaggcgttcctgaagcagaagatcagcccccagttcaccaaggtcaagaagcagaaggggacgatcgtgaaggtggtcgaggacttcgaggtgatcgcgccccacatcctgatcaaccagcgcttcttcgacaacggccaggagctcaccctggggagcgccacctacaagcacaacgagcaggagctgatcctcgacaagaccgccgtgaagctgctgaacggcgccctccccctgacgcagtccgaggagctggccgagcaggtctacgacgagatcctcgaccaggtgatgcactacttcccgctgtacgacaccaaccagttccgggccaagctgagcgccggcaaggccgccttcatgaagctcccctggaagtcccagtgggacgggaacaagatggtgcaggtcggccagcaggtcatcctggaccgcgtgctgatcgggctccacgcgaacgccgccgtgagcgacctgggcgtgctgaagatctccacgcccctcgggaagatgcagcagcccagcggcatctccctgagcccggacacccagatcatctaccagtcccccaccggcctgttcgagcggcgcgtggccctgcgggacctctga

SEQ ID NO: 1951 - RNA, 4107 nt, synthetic construct
  misc_feature 1..4107: note = Cas9 variant
  source 1..4107: mol_type = other RNA
atgagccgcccctacaacatcggcctggacatcgggacctccagcatcggctggtccgtggtcgacgaccagagcaagctcgtgtccgtgcgggggaagtacggctacggggtccgcctgtacgacgagggccagaccgccgccgagcggcgcagcttccggacgacccgccggcgcctgaagcggcgcaagtggcggctcggcctgctgcgcgagatcttcgagccgtacatcacccccgtggacgacaccttcttcctccggcagaagcagtccaacctgagccccaaggaccagcgcaagctgtacccccagacgtccctcttcaacgaccggaccgaccgcgcgttctacgacgactacccgaccatctaccacctccggtacaagctgatgaccgagaagcgccagttcgacatccgggagatctacctggccatgcaccacatcgtgaagtaccgcgggcacttcctgaacgaggcccccgtcagctccttcaagagctccgagatcaacctggtggcccacttcgaccggctcaacacgatcttcgccgacctgttcagcgagtccggcttccagctggagaccgacaagctcgcggaggtgaaggccctgctgctcgacaaccagcagagcgcctccaaccgccagcgccaggccctgagcctgatctacaccccctccaccaacaaggcggtcgagaagcagaacaaggccatcgccacggagctcctgaaggccatcctggggctcaaggccaagttcaacgtgctgacccggatcgaggcggaggacgtgaaggcctggaccctgaccttcaacgccgagaacttcgacgaggagatggtcaagctcgagagcagcctggacgacaacgcccaccagatcatcgagtccctgcaggagctctacagcggcatcctgctggccgggatcgtgcccgagaaccagtccctcagccaggcgatgatcatgaagtacgacgaccaccagaagcacctgaagatgctgaaggccgtgcgcgaggccctcgccccggaggaccggcagcgcctgaagcaggcctacgaccagtacgtcgacggccaggagaacacgaaggcgtactccaaggaggacttctacggcgacatcaccaaggccctgaagaacaaccccgaccaccccatcgtgagcgagatcaagaagctcatcgagctggaccagttcatgcccaagcagcggaccaaggacaacggggccatcccgcaccagctgcaccagcaggagctcgaccgcatcatcgagaaccagcagcagtactacccctggctggccgagctgaaccccaactccaagcggcagaccgtggccaagtacaagctcgacgagctggtcgcgttccgcgtgccctactacgtgggcccgctgatcacggccgagcagcagcggcagagctccgacgccaagttcgcctggctgatccgcaaggcggaggggcggatcaccccctggaacttcgacgacaaggtcgaccgccaggccagcgccaacgagttcatcaagcggatgaccaccacggacacctacctcctggccgaggacgtgctgcccaagcagtccctcatctaccagcgcttcgaggtgctgaacgagctgaacggcctcaagatcgacgaccagcccatcaccaccgagctgaagcaggccatcttcacggacctgttcatgcagaagaccagcgtctccgtgaagaacatccaggactacctcgtcagcgagaagcggtacgcgtcccgcccggccatcaccggcctgagcgacgagaacaagttcaactcccggctgagcacctaccacgacctcaaggccatcgtgggggacgccgtggaggacgtcgacaagcaggtcgacctggagaagtgcgtggagtggtccacgatcttcgaggacggcaagatctacagcgccaagctgaacgagatcgactggctcaccgaccagcagcgcgtgcagctggcggccaagcggtaccgcgggtggggccgcctgagcgccaagctcctgacccagatcgtgaacgccaacgggcagcggatcatggacctgctctgggacaccacggacaacttcatgcgcatcgtgcactccgaggacttcgacaagctgatcaccgaggccaaccagatgatgctggcggagaacgacgtccaggacgtgatcaacgacctctacaccagcccccagaacaagaaggccctgcggcagatcctgctcgtggtcaacgacatccagaaggccatgaagggccaggcccccgagcgcatcctgatcgagttcgcgcgggaggacgaggtgaacccccgcctgtccgtgcagcggaagcgccaggtcgagcaggtctaccagaacatcagcaacgagctcctgaacaacaccgagatccggaacgagctgaaggacctctccaacagcgccctgtccaacacccgcctgttcctctacttcatgcagggcgggcgggacatgtacacgggcgacagcctgaacatcgaccgcctgtccacctacgacatcgaccacatcctcccgcagagcttcatcaaggacaactccctggacaaccgggtgctggtgagccagaagatgaaccgctccaaggccgaccaggtgcccaccgacttcaccagcgtggagctcgggaagaagatgcagctgcagtgggagcagatgctgcgggccggcctcatcacgaagaagaagtacgacaacctgaccctgaaccccgaccacatctccaagtacgccatgaaggggttcatcaaccgccagctcgtcgagacccgccaggtgatcaagctggcgaccaacctgctcatggagcagtacggcgaggacaacatcgagctgatcacggtgaagtccggcctgacccaccagatgcggaccgagttcgacttccccaagaaccggaacctcaacaaccaccaccacgccttcgacgcctacctgaccgccttcgtcgggctgtacctcctgaagcgctacccgaagctgaagccctacttcgtgtacggcgagtaccagaaggcctcccagcaggacaagtggcggaacttcaacttcctcaacgggctgaagaaggacgagctggtggacgagaacacggaggcggtcatctgggacaaggagagcggcctcgcctacctgaacaagatctaccagttcaagaagatcctggtgacccgcgaggtgcacgagaacagcggggccctcttcaaccagaccctgtacgccgccaaggacgacaaggcgtccggccagggcgggaagcagctgatccccgccaagcaggaccgcccgaccgccctctacggcgggtacagcggcaagacggtcgcctacatgtgcatcgtgcggatcaagaacaagaagggcgacctgtacaaggtgtgcggggtcgagacctcctggctggcgcagctcaagcagctgaccgacgaggacagccagaaggccttcctgaagcagaagatcagcccccagttcaccaaggtgaagaagcagaagggcacgatcgtgaaggtcgtggaggacttcaaggtgatcgcgccccacatcctcatcaaccagcgcttcttcgacaacgggcaggagctgaccctgggcagcgccacctacaagcacaacgagcaggagctcatcctggacaagaccgccgtcaagctgctcaacggggccctgcccctgacgcagtccgaggagctcgccgagcaggtctacgacgagatcctggaccaggtgatgcactacttcccgctgtacgacaccaaccagttccgggccaagctcagcgccggcaaggccgcgttcatgaagctgccctggaagtccatctgggacggcaacaagatgacccagatcgggcagcagatcatcctggaccgcatcctcatcggcctgcacgccaacgccgccgtgagcgacctgggggtgctcaagatctccacgcccctgggcaagatgcagcagcccagcgggatctccctgagcccggacacccagatcatctaccagtcccccaccggcctgttcgagcggcgcgtggccctccgggacctgtga

SEQ ID NO: 1952 - RNA, 4107 nt, synthetic construct
  misc_feature 1..4107: note = Cas9 variant
  source 1..4107: mol_type = other RNA
atggtggagaagaagtcctacagcatcggcctggacatcgggaccaacagcgtcggctgggccgtgatcaccgacgactacaaggtgcccgccaagaagatgaaggtcctcgggaacacgtcccgccagagcatcaagaagaacatgatcggcgcgctgctgttcgacgagggcgggccggccgcctccacccgggtgaagcgcaccacccggcgccggtacacgcgccggaagaaccgcctctgctacctgcgggacatcttcgagagcgagatgcacaccatcgacaagcacttcttcctgcgcctcgaggactccttcctgcacaagagcgacaagcggtacgaggcccaccccatcttcggcaccctgcaggaggagaaggcctaccacgacaactaccccaccatctaccacctccgcaaggcgctggccgacaacacggagaaggccgacctgcggctcatctacctggccctggcgcacatcatcaagttccgcgggcacttcctcatcgagggcgccctgtccgccaacaacaccgacgtgcagcagctggtccacgccctcgtggacgcctacaacatcatgttcgaggaggaccagctggacatcgaggcgatcgacgtgaaggccatcctgaccgagaagatcagcaagacccggcgcctcgagaacctgatctccaacatccccgggcagaagaagaacggcctgttcgggaacctcatcgccctgagcctgggcctcacgccgaacttcaagtcccacttcaacctgcccgaggacgccaagctgcagctcgccaaggacacctacgacgaggagctgaacaacctgctcacccagatcggcgacgagtacgcggacctgttcctgagcgccaagaacctctccgacgccatcctgctgagcgacatcctcaccgtcaacggggacggcacgcaggcgcccctgtccgccagcctgatcaagcggtacgaggagcaccgccaggacctcgccctgctgaagcagatgttcaaggagcagctccccgacctgtaccgggacgtgttcaccgacgagaacaaggacgggtacgccggctacatctccggcaagaccagccaggaggccttctacaagtacatcaagccgatcctggagaccctcgacggggccgaggacttcctgacgaagatcaaccgcgaggacttcctgcggaagcagcgcaccttcgacaacggcagcatcccccaccagatccacctgggggagctccaggccatcctggagcgccagcaggcgtactaccccttcctgaaggacaaccaggagaagatcgagaagatcctcaccttccggatcccctactacatcggcccgctggcccgcgggaactcccggttcgcctggctgacccgcacgagcgaccagaagatcaccccctggaacttcgacgagatggtggaccaggaggcctccgcgcaggccttcatcgagcggatgaccaacttcgacgagtacctcccccaggagaaggtcctgcccaagcacagcctgacctacgagtacttcacggtgtacaacgagctcaccaaggtgaagtacgtcaccgagggcatgaccaagccggagttcctgtccgccggccagaaggagcagatcgtggagctcctgttcaagaagtaccgcaaggtgacggtcaagcagctgaaggaggacttcttcagcaagatcgagtgcttcgacaccgtggacatctccggggtggaggacaagttcaacgccagcctgggcacctaccacgacctcctgaagatcatcaaggacaaggccttcctggacaactccgagaacgagaacatcatcgaggacatcatcctcaccctgacgctgttcgaggacaaggagatgatcgcgaaccggctcgccgtctacgaggacctgttcgaccagaacgtgctgaagcagctcaagcgccggcactacaccgggtggggccgcctgagcaagcagctgatcaacgggatgcgggacaagcacaccggcaagaccatcctcgacttcctgaaggccgacggcttcatcaaccgcaacttcatgcagctgatcaacgacgacaacctctccttcaaggaggagatcaagaaggcccaggagggcgggctgaaggacagcatcaacgaccagatccgggacctggccgggtcccccgcgatcaagaagggcatcctccagaccatcaacatcgtggacgagatcgtcaagatcatggggaaggcgccccagcacatcgtggtcgagatggcccgcgacgtgcagaagacggacatcggcgtgaagcagagccgggagcgcatgaagcgggtccaggaggtgctgaagaagctgggctcccagctcctgaaggagcaccccgtggagaacttccagctgcagaacgagcgcctctacctgtactacctgcagaacgggaaggacatgtacaccggcgaggagctcagcatctccaacctgagccactacgacatcgaccacatcatcccgcggtccttcatcaaggacgacagcatcgacaacaaggtcctgacccgcagcgagcacaaccgcgggaagaccgacaacgtgccctccatcgaggtggtcaagcggatgaagccctactggcagaagctcctggacacgaaggtgatcagccagcgcaagttcgacaacctgaccaaggccgagcggggcggcctccaggagtccgacaaggccaacttcatccagcgccagctggtggagacccggcagatcaccaagcacgtcgcccagatcctggacagccgcttcaacacggagcgggacgagaaggaccgccccatccggcgcgtgaaggtgatcaccctcaagtccaagttcgtcagcgacttccggcaggacttcgggttctacaagctgcgcgagatcaacgactaccaccacgcccacgacgcctacctgaacgccgtggtgggcaccgcgctcctgaagatgtacccgaagctggcctccgagttcgtctacggggactaccagaagtacgacctcaagcggatggtgggcaagagcgggaaggcctccggccacgccaccgccaagtacttcttctacagcaacctgatgaacttcttcaagtccgaggtgaagctggcgaacggcaacatcatcaagcgcagccccatcgaggtcaacgaggagacgggggagatcgtgtgggacaagaccaaggacttcggcaccgtgcggaaggtcctctccgcgccccaggtgaacatcgtgaagaagaccgagatccagaccgggggcttcagcaacgagacgatcctgtccaagggcaagagctccaagctgatcccccgcaagaacaagtggcgggacaccaccaagtacgggggcttcaacacgccgaccgtcgcctacagcgtgctcgtggtcgccaaggtggagaaggggaaggccaagaagctgaagcccgtgaaggagctggtcggcatcaccatcatggagcgcaccaagttcgaggccaaccccatcgccttcctcgagagcaaggggtaccacgacatccaggagcacctgatgatcacgctgccgaagtactccctcttcgagctggagaacggccggcgccggctgctcgccagcgccaccgagctgcagaaggggaacgagatggtgctgccccagcacctcgtgaccttcctgtaccgcgtctccaagcgcgacaagggcacccagagcgagaacatggagtacatctccaaccacaaggagaagttcatcgagatcttccactacatcatccggtacgccgagaagaacgtgatcaagcccaaggtgatcgagcgcctgaacgacacgttcaaccagaagttcaacgacagcgacctcaccgagctgtccatcagcttcctgaacctcttcaagttcacctccttcggcgcgcccgagaagttcaccttcctgaacagcgagatcaagcaggacgacgtccggtaccgctccacgaaggagtgcctgaacagcaccctcatccaccagtccgtgaccgggctgtacgagacccggatcgacctgagccagttcggcggggactga

SEQ ID NO: 1953 - RNA, 4107 nt, synthetic construct
  misc_feature 1..4107: note = Cas9 variant
  source 1..4107: mol_type = other RNA
atggacaagaagtacagcatcggcctggacatcgggaccaactccgtgggctgggccgtcatcaccgacgactacaaggtgcccagcaagaagttcaaggtgctcgggaacacggaccgccactccatcaagaagaacctgatcggcgccctgctgttcgacagcggggagaccgcggaggccacccggctgaagcgcaccgcccggcgccggtacacgcgccggaagaaccgcatctgctacctgcaggagatcttctccaacgagatcgccaaggtcgacgacagcttcttccaccggctcgaggagtccttcctggtggaggaggacaagaagcacgagcgccacccgatcttcggcaacatcgtggacgaggtcgcctaccacgagaagtaccccaccatctaccacctccggaagaagctcgcggacagcaccgacaaggccgacctgcgcctgatctacctcgccctggcccacatgatcaagttccggggccacttcctgatcgagggggacctcaaccccgacaactccgacgtggacaagctgttcatccagctggtgcagacctacaaccagctgttcgaggagaaccccatcaacgcgagccgcgtcgacgccaaggccatcctgtccgcccggctgagcaagtcccgccggctcgagaacctgatcgcccagctgccgggcgagaagcgcaacggcctcttcgggaacctgatcgcgctgagcctcgggctgacgcccaacttcaagtccaacttcgacctggccgaggacgccaagctccagctgagcaaggacacctacgacgacgacctggacaacctcctggcccagatcggcgaccagtacgccgacctgttcctcgcggccaagaacctgtccgacgccatcctgctcagcgacatcctgcgggtgaacaccgagatcaccaaggccccgctgtccgccagcatgatcaagcgctacgacgagcaccaccaggacctcacgctgctgaaggcgctcgtgcggcagcagctgcccgagaagtacaaggagatcttcttcgaccagagcaagaacggctacgccgggtacatcgacggcggggcctcccaggaggagttctacaagttcatcaagccgatcctggagaagatggacggcaccgaggagctcctggccaagctgaaccgcgaggacctgctccgcaagcagcggaccttcgacaacggcagcatcccccaccagatccacctgggggagctgcacgccatcctccgccggcaggaggacttctaccccttcctgaaggacaaccgcgagaagatcgagaagatcctgaccttccggatcccctactacgtcggcccgctcgcgcgcgggaactcccggttcgcctggatgacgcgcaagagcgaggagaccatcaccccctggaacttcgaggaggtggtggacaagggcgcctccgcccagagcttcatcgagcggatgaccaacttcgacaagaacctgcccaacgagaaggtcctgcccaagcactccctcctgtacgagtacttcacggtgtacaacgagctgaccaaggtgaagtacgtcaccgaggggatgcgcaagccggcgttcctcagcggcgagcagaagaaggccatcgtggacctgctgttcaagaccaaccggaaggtgacggtcaagcagctcaaggaggactacttcaagaagatcgagtgcttcgactccgtggagatcagcggcgtggaggaccgcttcaacgcctccctggggacctaccacgacctgctcaagatcatcaaggacaaggacttcctggacaacgaggagaacgaggacatcctggaggacatcgtcctcaccctgaccctgttcgaggaccgggagatgatcgaggagcgcctcaagacgtacgcccacctgttcgacgacaaggtgatgaagcagctgaagcggcgccggtacaccggctgggggcgcctcagccggaagctgatcaacggcatccgcgacaagcagtccgggaagaccatcctggacttcctcaagagcgacggcttcgccaaccgcaacttcatgcagctgatccacgacgactccctgaccttcaaggaggacctccagaaggcgcaggtcagcggccagggggactccctgcacgagcacatcgccaacctggccggcagccccgccatcaagaaggggatcctccagacggtgaaggtggtcgacgagctggtgaaggtgatgggccggcacaagcccgagaacatcgtcatcgagatggcccgcgagaaccagaccacccagaaggggcagaagaactcccgggagcgcatgaagcggatcgaggagggcatcaaggagctgggcagcgacatcctcaaggagtaccccgtggagaccacgcagctgcagaacgagaagctgtacctctactacctgcagaacgggcgcgacatgtacgtggaccaggagctggacatcaaccggctcagcgactacgacgtcgaccacatcgtgccgcagtccttcctgaaggacgacagcatcgacaacaaggtgctgacccgctccgacaagaaccggggcaagagcgacaacgtcccctccgaggaggtggtgaagaagatgaagaactactggaagcagctcctgaacgcgaagctgatcacccagcgcaagttcgacaacctcaccaaggccgagcgcgggggcctgagcgagctggacaaggccggcttcatcaagcggcagctcgtcgagacccggcagatcacgaagcacgtggcccagatcctggactcccgcatgaacaccaagtacgacgagaacgacaagctgatccgggaggtgcgcgtcatcaccctcaagagcaagctggtgtccgacttccggaaggacttccagttctacaaggtgcgcgagatcaacaactaccaccacgcccacgacgcgtacctgaacgccgtcgtggggaccgccctcatcaagaagtaccccaagctggagagcgagttcgtgtacggcgactacaaggtctacgacatccggaagatgatcgccaagtccgagcaggagatcgggaaggcgacggccaagtacttcttctacagcaacatcatgaacttcttcaagaccgagatcaccctggccaacggcgagatccgcaagcggcccctcatcgagaccaacggggagacgggcgagatcgtgtgggacaagggccgcgacttcgccaccgtgcgcaaggtcctgtccatgccccaggtgaacatcgtgaagaagaccgaggtccagaccgggggcttcagcaaggagtccatcctgcccaagcggaacagcgacaagctcatcgcccgcaagaaggactgggaccccaagaagtacgggggcttcgactcccccacggtggcgtacagcgtgctggtcgtggccaaggtggagaagggcaagagcaagaagctgaagtccgtcaaggagctcgtggggatcaccatcatggagcggagctccttcgagaaggacccggtggacttcctggaggccaagggctacaaggaggtccgcaaggacctgatcatcaagctccccaagtacagcctgttcgagctggagaacgggcggaagcgcatgctcgcctccgccggcgagctgcagaaggggaacgagctggcgctccccagcaagtacgtgaacttcctgtacctggcctcccactacgagaagctcaagggcagcccggaggacaacgagcagaagcagctgttcgtggagcagcacaagcactacctggacgagatcatcgagcagatctccgagttcagcaagcgggtcatcctcgccgacgccaacctggacaaggtgctgtccgcctacaacaagcaccgcgacaagcccatccgggagcaggcggagaacatcatccacctcttcaccctgaccaacctgggggcccccgccgccttcaagtgcttcgacacgaccatcggccgcaaccggtacaagagcatcaaggaggtgctcgacgcgaccctgatccaccagtccatcaccggcctgtacgagacgcgcatcgacctcagccagctcgggggcgactga

SEQ ID NO: 1954 - RNA, 4107 nt, synthetic construct
  misc_feature 1..4107: note = Cas9 variant
  source 1..4107: mol_type = other RNA
atggacaagaagtacagcatcggcctggacatcgggacctccagcatcggcttcgtgggggtcgacgagaacggctggcccctcaacatcaaggggaagcgcgccatcggcgcccacctgttccgggagggcgaggcggccgccgagacccgcgggttccggacgacccgccggcgctacaaccggcgcaagtggcggctgcgcctcctgcgggagatcttcgacgagccgatctcccgcgtggaccccaccttcttcgcccggatgaaggagagctccgtgagccccaaggaccccaactacgacggcctggccaaggagatcctcatcccgcgcgacaaggacgggaagatcctgtaccccaccatctaccacctccggcacgcgctgatgtacgaggaccaccagttcgacatccgcgagatctacctggccatccaccacatcgtcaagtaccggggccacttcctgctcgacggggccgccaagaacttcgagtccagcaacctggacctgaagtccgacatccacgagatcaacgcgatcctcgtgggcatcttcggcaacgagcaggtccagttcaacgaccagtacgtggagaagctgaaggaggtgctgctcgacagcacgcagtcccgcagcgaccggcagaaggccgccgccaagctgctgctccccaccaacgacctggacaaggacaccaccaagatcctgaagacggtgtccaccgagatcaccaaggccatcaccgggctcaaggcgaagttcttcgtcatcacgggcaacgacatcgccaaggaccagcagaaggactggaccttcagcatcgacaccctggacgagaagatgtccgtgatcgagcccagcttctccgagaagaacttcagcctgatcaccatcctccagaagctgtactccagcgtgacgctggccgggatcgtcccgaacggcctcagcctgtccgaggccatgatccagaagtacgaccgccacgccagcgacctggtgctcctgaagaagtactgggacaccaagcccaaggtgctgaagcaccagctccagaacacctacgcggagtacatcgagatccaccaggtcgtggacgagttctactccgacctgagcaagctgatcaagaacgacgacgacaccctcgcccaggagatcaagtccaagatcacgatcggcaacttcctgcccaagcagcggaccaccgagaacggggtgatcccctaccagctgcagcagcgcgagctcgacaccatcatcaagaaccagcaggagtactacccgtggctggccgaggagaaccccgtcgccgaccaccagatcgccttcccctacaagctggacgagctcgtgggcttccgcatcccctactacgtggggccgatgatcgcgaaggaggacacgagcaactccaagaacagcaagttcgcctggatgatccggaagcagtccggcgaggtcaccccctggaacttcgacgagaagatcgaccgcaccgccagcgccaccgccttcatcgaccggatgacgaccaccgacacctacctgatcggggaggacgtgctgcccaagcagtccctcatctaccagcgcttcgaggtgctgaacgagctgaacaagatcagcatcgacggccagcccatcacgcggaagcagaagcagtccgtctacacccacgtgttcgagaagaagaagaccgtccaggtgaaggacgtgcagaagttcctggtcagctccggcgaggtgatgagcctcccgaagatcgggggcctggcgaacgagaagcagttcaactccagcctgtccaccctctacgactacaacaagatcatccccgacgccctggaggaccgcaacaaggtggacgacatcgagaagatcatcctgtggagcacgatcttcgaggacaacagcatcttcgtcgagaagctcgactccatcgactggctgaccagctcccagcggaagcgcctggcccagaagcggtaccgcgggtggggccggctcagcctgcgcctgctcaccaccttcaagaacaaggacgggtactccatcctggacgagctgtggaacagcaaccacaacttcatggagatccaggcccagtccgacttcagcgagcagatcgcgaccgccaacaacaacaacctctcccaggtgctgcccgccaagtgggagcccggccggaagaacctggccagcctcgacgagttcatctccaacctgtacacgagcccgcagaacaagaaggccctgcgcaaggcgatccgggtggtccaggacatgatgaccgccgccggccacatgcccgagaagatcttcatcgaggtggcccgcgacacctccaacagccaccagcagaccatcgcccggcagcgccagctccagcagctgtaccagtccgaggacaaggaggtgatcgacagctccgtccggagcgagctggacgacatcctcaagaaccgcgcgaacatcaaggaccagctgttcctgtacttccagcagggcgggcgcgacctctacacggggaaggccatcaacatcgacaagctgagcctgtaccacatcgaccacatcctcccccagtccctggtgaaggacgacagcctggacaaccgggtgctcgtctcccagaagaccaacgaggacaagggcgtgaccttcgtgagcgacaagtacatgaacaacatgctgcccacctggaagcgctggcacgagatggggctgatctccgcccggaagctcaagaacctgacgatgcgcccggacgagatcgacaagtacgcccccggcttcatccagcggcagctggtcgagacccgccaggtgaccaagctcgtgatcgagctgctggacgccctcctgggcaacagccagaccgagatcatcacgatcaaggcgtccctgagccaccagttccggcagcagttcgacctcgtcaagatccgcgaggtgaacgacaaccaccacgccttcgacgccttcctggccgcgcggatcgggacctacctgtacaagcgctaccccaagctccggccgtacttcgtgtacggccagtacatgcagaaccacaagaacctgaagtccatcaacctgatcaagaccctcgacagcgacaaggccatcgtcgacgaggggaccggcgagatcctgtgggacaagaagtccgacctggccaagatgatcaagatctacaactaccagcgcctcctgatcacgcacgagagccggacctccttcggcgccatgtacaagcagaagatcctgaaggccaccgacgcgaagcagaacgggggcgggttcaagctcgtgcccaccaagcgcaaccggcccgtggacatctacggcgggtacacgggccagaccgccgcctacctgaccatcgtccgcgtgtacagcaagaagacctccgagctgcgggtgctccccatctacacgaacaaggtccagcagatcgagaaggccatgacccagggcgacaaggccaccatgctggcgttcaagaaggtgatcgccccgcagctggggaaggagaacaagaagacccacgagatcaagatccccgagttcgacgtggtcatccccaaggtgctcctggaccagctggtgatcgacgacatcgccggcagcccccaccgcttccggctcgggacggacacctactaccacaactcccagcagctgttcctgccgctcagcatgcagcgccagctgatggaccgggagtccgacgacaaggtctacctggacatcttcaacgacgtgctcaagcaggtcgacagctacttcaacctgtacgacgtgaacggcttccgcgccgccctgcagaagtccaagaaggcgttcgagcagctccccatcaacgacttccccaaggacgtgcccgacaacaagaagaagaaggggaagcgcagcatcctgaaggagatcttcatcggcctgcacgccaacgccaccctcggcaacctgaagcagatggggatcaagaccgacttcggcaagctgcagaagtccaacgggctccggatcacggagaactgcaagatcatccaccagagcccgaccggcctgttcgagcgcatcgtgcccatcaagtga

SEQ ID NO: 1955 - RNA, 4107 nt, synthetic construct
  misc_feature 1..4107: note = Cas9 variant
  source 1..4107: mol_type = other RNA
atggacaagaagtacagcatcggcctggacatcgggaccaactccgtgggctgggccgtcatcaccgacgactacaaggtgcccagcaagaagttcaaggtgctcgggaacacggaccgccactccatcaagaagaacctgatcggcgccctgctgttcgacagcggggagatcgcggaggccacccggctgaagcgcaccgcccggcgccggtacacccgccggaagaaccgcatctgctacctgcaggagatcttctccaacgagatggccaaggtcgacgacagcttcttccaccggctcgaggagtccttcctggtggaggaggacaagaagcacgagcgccacccgatcttcggcaacatcgtggacgaggtcgcctaccacgagaagtaccccacgatctaccacctccggaagaagctcgtggacagcaccgacaaggcggacctgcgcctgatctacctcgccctggcccacatgatcaagttccggggccacttcctgatcgagggggacctcaaccccgacaactccgacgtggacaagctgttcatccagctggtccagacctacaaccagctgttcgaggagaaccccatcaacgccagcggcgtggacgcgaaggccatcctgtccgcccgcctgagcaagtcccggcgcctcgagaacctgatcgcccagctgccgggggagaagaagaacggcctcttcgggaacctgatcgccctgagcctcggcctgacccccaacttcaagtccaacttcgacctggcggaggacgccaagctccagctgagcaaggacacgtacgacgacgacctggacaacctcctggcccagatcggcgaccagtacgccgacctgttcctcgccgcgaagaacctgtccgacgccatcctgctcagcgacatcctgcggctgaactccgagatcaccaaggcgcccctcagcgccagcatgatcaagcgctacgacgagcaccaccaggacctgaccctgctcaaggccctggtgcggcagcagctgcccgagaagtacaaggagatcttcttcgaccagtccaagaacgggtacgccggctacatcgacgggggcgccagccaggaggagttctacaagttcatcaagccgatcctcgagaagatggacggcaccgaggagctgctggccaagctgaaccgcgaggacctcctgcggaagcagcgcacgttcgacaacgggtccatcccccaccagatccacctgggcgagctccacgccatcctgcgccggcaggaggacttctaccccttcctgaaggacaaccgcgagaagatcgagaagatcctcaccttccggatcccctactacgtcgggccgctggcccgcggcaacagccggttcgcgtggatgacccgcaagtccgaggagaccatcacgccctggaacttcgaggaggtggtggacaagggggccagcgcccagtccttcatcgagcggatgaccaacttcgacaagaacctgcccaacgagaaggtcctccccaagcacagcctgctgtacgagtacttcaccgtgtacaacgagctcaccaaggtgaagtacgtcacggagggcatgcgcaagccggccttcctgtccggcgagcagaagaaggcgatcgtggacctcctcttcaagaccaaccggaaggtgaccgtcaagcagctgaaggaggactacttcaagaagatcgagtgcttcgacagcgtggagatctccggggtggaggaccgcttcaacgccagcctgggcacctaccacgacctcctgaagatcatcaaggacaaggacttcctggacaacgaggagaacgaggacatcctcgaggacatcgtcctgacgctgaccctcttcgaggaccgggagatgatcgaggagcgcctgaagacctacgcccacctgttcgacgacaaggtgatgaagcagctcaagcggcgccggtacaccgtctgggggcgcctgtcccggaagctgatcaacggcatccgcgacaagcagagcgggaagacgatcctcgacttcctgaagtccgacggcttcgccaaccggaacttcatgcagctgatccacgacgacagcctcaccttcaaggaggacatccagaaggcccaggtgtccggccagggggacagcctgcacgagcacatcgcgaacctggccggctcccccgccatcaagaaggggatcctccagaccgtgaaggtcgtggacgagctggtgaaggtcatgggccgccacaagcccgagaacatcgtgatcgagatggcccgcgagaaccagaccacgcagaaggggcagaagaacagccgggagcgcatgaagcggatcgaggagggcatcaaggagctgggcagccagatcctcaaggagcaccccgtggagaacacccagctgcagaacgagaagctgtacctctactacctgcagaacgggcgcgacatgtacgtcgaccaggagctggacatcaaccggctctccgactacgacgtggaccacatcgtgccgcagagcttcatcaaggacgactccatcgacaacaaggtcctgacccgcagcgacaagaaccggggcaagtccgacaacgtgcccagcgaggaggtggtcaagaagatgaagaactactggcgccagctgctcaacgccaagctgatcacccagcggaagttcgacaacctgacgaaggcggagcgcgggggcctctccgagctggacaaggccggcttcatcaagcggcagctggtggagacccgccagatcaccaagcacgtggcccagatcctcgacagccggatgaacaccaagtacgacgagaacgacaagctgatccgcgaggtcaaggtgatcaccctgaagtccaagctcgtgagcgacttccggaaggacttccagttctacaaggtccgcgagatcaacaactaccaccacgcccacgacgcctacctgaacgcggtggtggggacggccctgatcaagaagtaccccaagctcgagtccgagttcgtctacggcgactacaaggtgtacgacgtgcggaagatgctggccaagagcgagcaggagatcgggaaggccaccgcgaagtacttcttctactccaacatcatgaacttcttcaagaccgagatcaccctggccaacggcgagatccgcaagcggcccctcatcgagacgaacggggagaccggcgagatcgtctgggacaagggccgcgacttcgccaccgtgcggaaggtgctgagcatgccgcaggtcaacatcgtgaagaagaccgaggtgcagaccgggggcttctccaaggagagcatcctgcccaagcgcaactccgacaagctcatcgcccgcaagaaggactgggaccccaagaagtacgggggcttcgacagccccacggtcgcctacagcgtgctggtggtcgcgaaggtggagaaggggaagtccaagaagctcaagagcgtgaaggagctgctgggcatcaccatcatggagcggtccagcttcgagaagaacccgatcgacttcctggaggccaagggctacaaggaggtccgcaaggacctcatcatcaagctgcccaagtactccctgttcgagctcgagaacgggcggaagcgcatgctggccagcgccggcgagctgcagaaggggaacgagctcgccctgccctccaagtacgtgaacttcctgtacctcgcgagccactacgagaagctgaagggctccccggaggacaacgagcagaagcagctgttcgtggagcagcacaagcactacctcgacgagatcatcgagcagatcagcgagttctccaagcgggtcatcctggccgacgccaacctggacaaggtgctcagcgcctacaacaagcaccgcgacaagcccatccgggagcaggccgagaacatcatccacctgttcaccctgacgaacctcggggcgcccaccgccttcaagtacttcgacaccaccatcgaccgcaagcggtacacgtccaccaaggaggtgctggacgccaccttcatccaccagagcatcaccggcctgtacgagacgcgcatcgacctctcccagctgggcggggactga

SEQ ID NO: 1956 - RNA, 4107 nt, synthetic construct
  misc_feature 1..4107: note = Cas9 variant
  source 1..4107: mol_type = other RNA
atggacaagaagtacagcatcggcctggacatcgggaccaactccgtgggctgggccgtcatcaccgacgactacaaggtgcccagcaagaagttcaaggtgctcgggaacacggaccgccactccatcaagaagaacctgatcggcgccctgctgttcgacagcggggagaccgcggaggccacccggctgaagcgcaccgcccggcgccggtacacgcgccggaagaaccgcatctgctacctgcaggagatcttctccaacgagatggccaaggtcgacgacagcttcttccaccggctcgaggagtccttcctggtggaggaggacaagaagcacgagcgccacccgatcttcggcaacatcgtggacgaggtcgcctaccacgagaagtaccccaccatctaccacctccggaagaagctcgtggacagcaccgacaaggcggacctgcgcctgatctacctcgccctggcccacatgatcaagttccggggccacttcctgatcgagggggacctcaaccccgacaactccgacgtggacaagctgttcatccagctggtccagacctacaaccagctgttcgaggagaaccccatcaacgccagcggcgtggacgcgaaggccatcctgtccgcccgcctgagcaagtcccggcgcctcgagaacctgatcgcccagctgccgggggagaagaagaacggcctcttcgggaacctgatcgccctgagcctcggcctgacgcccaacttcaagtccaacttcgacctggcggaggacgccaagctccagctgagcaaggacacctacgacgacgacctggacaacctcctggcccagatcggcgaccagtacgccgacctgttcctcgccgcgaagaacctgtccgacgccatcctgctcagcgacatcctgcggctgaactccgagatcaccaaggccccgctcagcgccagcatgatcaagcgctacgacgagcaccaccaggacctgaccctgctcaaggccctggtgcggcagcagctgcccgagaagtacaaggagatcttcttcgaccagtccaagaacgggtacgcgggctacatcgacgggggcgccagccaggaggagttctacaagttcatcaagccgatcctcgagaagatggacggcacggaggagctgctggccaagctgaaccgcgaggacctcctgcggaagcagcgcaccttcgacaacgggtccatcccccaccagatccacctgggcgagctccacgccatcctgcgccggcaggaggacttctaccccttcctgaaggacaaccgcgagaagatcgagaagatcctcaccttccggatcccctactacgtcgggccgctggcccgcggcaacagccggttcgcgtggatgacccgcaagtccgaggagacgatcaccccctggaacttcgaggaggtggtggacaagggggccagcgcccagtccttcatcgagcggatgaccaacttcgacaagaacctgcccaacgagaaggtcctccccaagcacagcctgctgtacgagtacttcaccgtgtacaacgagctcacgaaggtgaagtacgtcaccgagggcatgcgcaagccggccttcctgtccggcgagcagaagaaggcgatcgtggacctcctcttcaagaccaaccggaaggtgaccgtcaagcagctgaaggaggactacttcaagaagatcgagtgcttcgacagcgtggagatctccggggtggaggaccgcttcaacgccagcctgggcacgtaccacgacctcctgaagatcatcaaggacaaggacttcctggacaacgaggagaacgaggacatcctcgaggacatcgtcctgaccctgaccctcttcgaggaccgggagatgatcgaggagcgcctgaagacctacgcccacctgttcgacgacaaggtgatgaagcagctcaagcggcgccggtacacggggtggggccgcctgtcccggaagctgatcaacgggatccgcgacaagcagagcggcaagaccatcctcgacttcctgaagtccgacggcttcgccaaccggaacttcatgcagctgatccacgacgacagcctcaccttcaaggaggacatccagaaggcccaggtctccgggcagggcgacagcctgcacgagcacatcgcgaacctggccgggtcccccgccatcaagaagggcatcctccagaccgtgaaggtggtcgacgagctggtgaaggtgatggggcgccacaagcccgagaacatcgtcatcgagatggcccgcgagaaccagacgacccagaagggccagaagaacagccgggagcgcatgaagcggatcgaggagggcatcaaggagctggggagccagatcctcaaggagcaccccgtggagaacacccagctgcagaacgagaagctgtacctctactacctgcagaacggccgcgacatgtacgtggaccaggagctggacatcaaccggctctccgactacgacgtcgaccacatcgtgccgcagagcttcatcaaggacgactccatcgacaacaaggtgctgacccgcagcgacaagaaccgggggaagtccaacaacgtccccagcgaggaggtggtgaagaagatgaagaactactggcgccagctgctcaacgccaagctgatcacgcagcggaagttcgacaacctgaccaaggcggagcgcggcggcctctccgagctggacaaggccgggttcatcaagcggcagctggtcgagacccgccagatcaccaagcacgtggcccagatcctcgacagccggatgaacaccaagtacgacgagaacgacaagctgatccgcgaggtgaaggtcatcacgctgaagtccaagctcgtgagcgacttccggaaggacttccagttctacaaggtgcgcgagatcaacaactaccaccacgcccacgacgcctacctgaacgcggtcgtgggcaccgccctgatcaagaagtaccccaagctcgagtccgagttcgtgtacggggactacaaggtctacgacgtgcggaagatgatcgccaagagcgagcaggagatcggcaaggccaccgcgaagtacttcttctactccaacatcatgaacttcttcaagaccgagatcacgctggccaacggggagatccgcaagcggcccctgatcgagaccaacggcgagaccggcgagatcgtgtgggacaaggggcgcgacttcgccaccgtccggaaggtgctcagcatgccccaggtgaacatcgtcaagaagacggaggtgcagaccggcgggttctccaaggagagcatcctgcccaagcgcaactccgacaagctgatcgcccgcaagaaggactgggaccccaagaagtacggcgggttcgacagccccaccgtggcctacagcgtcctcgtggtggcgaaggtcgagaagggcaagtccaagaagctcaagagcgtgaaggagctgctgggcatcaccatcatggagcggtccagcttcgagaagaacccgatcgacttcctggaggccaaggggtacaaggaggtgcgcaaggacctgatcgtcaagctccccaagtactccctgttcgagctggagaacggccggaagcgcatgctcgccagcgccggggagctgcagaagggcaacgagctggccctcccctccaagtacgtgaacttcctgtacctggcgagccactacgagaagctcaaggggtccccggaggacaacgagcagaagcagctgttcgtggagcagcacaagcactacctggacgagatcatcgagcagatcagcgagttctccaagcgggtcatcctcgccgacgccaacctggacaaggtgctgagcgcctacaacaagcaccgcgacaagcccatccgggagcaggccgagaacatcatccacctcttcacgctgaccaacctgggcgcgcccgccgccttcaagtacttcgacaccaccatcgaccgcaagcggtacacgtccaccaaggaggtgctcgacgccaccttcatccaccagagcatcaccggcctgtacgagacgcgcatcgacctgtcccagctcgggggcgactga

SEQ ID NO: 1957 - RNA, 4107 nt, synthetic construct
  misc_feature 1..4107: note = Cas9 variant
  source 1..4107: mol_type = other RNA
atgagccgcccctacaacatcggcctggacatcgggacctccagcatcggctggtccgtggtcgacgaccagagcaagctcgtgtccgtgcgggggaagtacggctacggggtccgcctgtacgacgagggccagaccgccgccgagcggcgcagcttccggacgacccgccggcgcctgaagcggcgcaagtggcggctcggcctgctgcgcgagatcttcgagccgtacatcacccccatcgacgacaccttcttcctccggcagaagcagtccaacctgagccccaaggaccagcgcaagctgtacacgcagacctccctcttcaacgaccggaccgaccgcgcgttctacgacgactaccccaccatctaccacctccggtaccgcctgatgacggagaagcggcagttcgacatccgcgagatctacctggccatgcaccacatcgtgaagtaccgggggcacttcctgaacgaggccccggtgagctccttcaagagctccgagatcaacctggtcgcccacttcgaccgcctcaacaccatcttcgccgacctgttcagcgagtccggcttccagctggagaccgacaagctcgcggaggtgaaggccctgctgctcgacaaccagcagagcgcctccaaccgccagcggcaggccctgagcctgatctacaccccctccacgaacaaggcggtggagaagcagaacaaggccatcgccaccgagctcctgaaggccatcctggggctcaaggccaagttcaacgtcctgaccggcatcgaggcggaggacgtgaaggcctggaccctgacgttcaacgccgagaacttcgacgaggagatggtgaagctcgagagcagcctggacgacaacgcccaccagatcatcgagtccctgcaggagctctacagcggggtcctgctggccggcatcgtgcccgagaaccagtccctcagccaggcgatgatcaccaagtacgacgaccaccagaagcacctgaagatgctgaaggccgtgcgcgaggccctcgcccccggcgaccggcagcgcctgaagcaggcctacgaccagtacgtcgacgggcaggagaacaccaaggcgtactccaaggaggacttctacggcgacatcaccaaggccctgaagaacaacccggaccaccccatcgtgagcgagatcaagaagctcatcgagctggaccagttcatgcccaagcagcggacgaaggacaacggggccatcccccaccagctgcaccagcaggagctcgaccgcatcatcgagaaccagcagcagtactacccgtggctggccgagctgaaccccaactccaagcggcagaccgtggccaagtacaagctcgacgagctggtcgcgttccgcgtgccctactacgtgggccccctgatcaccgccgagcagcagcggcagagctccgacgccaagttcgcctggctgatccgcaaggcggagggccggatcaccccgtggaacttcgacgacaaggtcgaccgccaggccagcgccaacgagttcatcaagcggatgacgaccaccgacacctacctcctggccgaggacgtgctgcccaagcagtccctcatctaccagcgcttcgaggtgctgaacgagctgaacgggctcaagatcgacgaccagcccatcacgaccgagctgaagcaggccatcttcaccgacctgttcatgcagaagatcagcgtcaccgtgaagaacatccaggactacctcgtctccgagaagcggtacgcgagccgccccgccatcacgggcctgtccgacgagaacaagttcaacagccggctgtccacctaccacgacctcaagatgatcgtgggggacgccgtggacgacgtcgacaagcaggccgacctggagaagtgcatcgagtggagcaccatcttcgaggacggcaagatctactccgccaagctgaacgagatcgactggctcaccgaccagcagcgcgtgcagctggcggccaagcggtaccgcgggtggggccgcctgagcgccaagctcctgacgcagatcgtgaacgccaacggccagcggatcatggacctgctctgggacaccaccgacaacttcatgcgcatcgtccacagcgaggacttcgacaagctgatcaccgaggccaaccagatgatgctggcggagaacgacgtgcaggacgtgatcaacgacctctacacctccccgcagaacaagaaggccctgcggcagatcctgctcgtcgtgaacgacatccagaaggccatgaaggggcaggcccccgagcgcatcctgatcgagttcgcgcgggaggacgaggtgaacagccgcctgtccgtccagcggaagcgccaggtggagcaggtctaccagaacatcagcaacgagctcctgaacaacacggagatccggaacgagctgaaggacctctccaacagcgccctgtccaacacccgcctgttcctctacttcatgcagggcgggcgggacatgtacaccggcgacagcctgaacatcgaccgcctgtccacctacgacatcgaccacatcctcccccagagcttcatcaaggacaactccctggacaaccgggtgctggtgagccagaagatgaaccgctccaaggccgaccaggtgcccacggacttcaccagcgtcgagctcgggcagaagatgcagatccagtgggagcagatgctgcgggccggcctgatcaccaagaagaagtacgacaacctcaccctgaacccggaccacatctccaagtacgccatgaagggcttcatcaaccgccagctggtggagacgcgccaggtgatcaagctcgcgaccaacctgctgatggagcagtacggggaggacaacatcgagctcatcaccgtcaagagcggcctgacccaccagatgcggacggagttcgacttccccaagaaccggaacctgaacaaccaccaccacgccttcgacgcctacctcaccgccttcgtggggctgtacctgctcaagcgctaccccaagctgaagccctacttcgtgtacggcgagtaccagaaggcctcccagcaggacaagtggcggaacttcaacttcctgaacgggctcaagaaggacgagctggtcgacgagaacaccgaggcggtgatctgggacaaggagagcggcctggcctacctcaacaagatctaccagttcaagaagatcctggtgacccgcggcgtccacgagaacagcggggccctgttcaaccagacgctctacgccgccaaggacgacaaggcgtccggccagggcgggaagcagctgatcccggccaagcaggaccgcagcaccgccctgtacggcgggtactccggcaagaccgtggcctacatgtgcatcgtgcggatcaagaacaagaagggggacctctacaaggtctgcggcgtggagaccagctggctggcgcagctgaagcagctcacggacgaggactcccagaaggccttcctggagcagaagatcagcccccagttcaccaaggtgaagaagcagaaggggaacatcatcgaggccgtcgaggagttcgaggtgatcgcgccccacatcctgatcaaccagcgcttcttcgacaacggccaggagctcaccctgggctccgccacctacaagcacaacgagcaggagctgatcctcgacaagacggccgtgaagctgctgaacggggccctcccgctgacccagagcgaggagctggccgagcaggtctacgacgagatcctcgaccaggtgatgcactacttccccctgtacgacaccaaccagttccgggccaagctgtccaccggcaaggccgcgttcatgaagctcccctggaagtcccagtgggacgggaacaagatggtgcaggtcggccagcaggtcatcctggaccgcatcctgatcgggctccacgccaacgccgccatgagcgacctgaaggtgctgaagatgacgacccccttcggcatgatccagcagagcaccggcatcaccctctccgccgacacgcagatcatctaccagagcccgaccgggctgttcgagcggcgcgtggcgctgcgggacctgtga

SEQ ID NO: 1958 - RNA, 4107 nt, synthetic construct
  misc_feature 1..4107: note = Cas9 variant
  source 1..4107: mol_type = other RNA
atggacaagaagtacagcatcggcctggacatcgggaccaactccgtgggctgggccgtcatcaccgacgactacaaggtgcccagcaagaagttcaaggtgctcgggaacacggaccgccactccatcaagaagaacctgatcggcgccctgctgttcgacagcggggagaccgcggaggccacccggctgaagcgcaccgcccggcgccggtacacgcgccggaagaaccgcatctgctacctgcaggagatcttctccaacgagatggccaaggtcgacgacagcttcttccaccggctcgaggagtccttcctggtggaggaggacaagaagcacgagcgccacccgatcttcggcaacatcgtggacgaggtcgcctaccacgagaagtaccccaccatctaccacctccggaagaagctcgtggacagcaccgacaaggcggacctgcgcctgatctacctcgccctggcccacatgatcaagttccggggccacttcctgatcgagggggacctcaaccccgacaactccgacgtggacaagctgttcatccagctggtccagacctacaaccagctgttcgaggagaaccccatcaacgccagcggcgtggacgcgaaggccatcctgtccgcccgcctgagcaagtcccggcgcctcgagaacctgatcgcccagctgccgggggagaagaagaacggcctcttcgggaacctgatcgccctgagcctcggcctgacgcccaacttcaagtccaacttcgacctggcggaggacgccaagctccagctgagcaaggacacctacgacgacgacctggacaacctcctggcccagatcggcgaccagtacgccgacctgttcctcgccgcgaagaacctgtccgacgccatcctgctcagcgacatcctgcggctgaactccgagatcaccaaggccccgctcagcgccagcatgatcaagcgctacgacgagcaccaccaggacctgaccctgctcaaggccctggtgcggcagcagctgcccgagaagtacaaggagatcttcttcgaccagtccaagaacgggtacgcgggctacatcgacgggggcgccagccaggaggagttctacaagttcatcaagccgatcctcgagaagatggacggcacggaggagctgctggccaagctgaaccgcgaggacctcctgcggaagcagcgcaccttcgacaacgggtccatcccccaccagatccacctgggcgagctccacgccatcctgcgccggcaggaggacttctaccccttcctgaaggacaaccgcgagaagatcgagaagatcctcaccttccggatcccctactacgtcgggccgctggcccgcggcaacagccggttcgcgtggatgacccgcaagtccgaggagacgatcaccccctggaacttcgaggaggtggtggacaagggggccagcgcccagtccttcatcgagcggatgaccaacttcgacaagaacctgcccaacgagaaggtcctccccaagcacagcctgctgtacgagtacttcaccgtgtacaacgagctcacgaaggtgaagtacgtcaccgagggcatgcgcaagccggccttcctgtccggcgagcagaagaaggcgatcgtggacctgctgttcaagaccaaccggaaggtgaccgtcaagcagctgaaggaggactacttcaagaagatcgagtgcttcgacagcgtggagatctccggggtggaggaccgcttcaacgccagcctgggcacgtaccacgacctcctgaagatcatcaaggacaaggacttcctggacaacgaggagaacgaggacatcctcgaggacatcgtcctgaccctgaccctcttcgaggaccgggagatgatcgaggagcgcctgaagacctacgcccacctgttcgacgacaaggtgatgaagcagctcaagcggcgccggtacacggggtggggccgcctgtcccggaagctgatcaacgggatccgcgacaagcagagcggcaagaccatcctcgacttcctgaagtccgacggcttcgccaaccggaacttcatgcagctgatccacgacgacagcctcaccttcaaggaggacatccagaaggcccaggtctccgggcagggcgacagcctgcacgagcacatcgcgaacctggccgggtcccccgccatcaagaagggcatcctccagaccgtgaaggtggtcgacgagctggtgaaggtgatggggcgccacaagcccgagaacatcgtcatcgagatggcccgcgagaaccagacgacccagaagggccagaagaacagccgggagcgcatgaagcggatcgaggagggcatcaaggagctggggagccagatcctcaaggagcaccccgtggagaacacccagctgcagaacgagaagctgtacctctactacctgcagaacggccgcgacatgtacgtggaccaggagctggacatcaaccggctctccgactacgacgtcgaccacatcgtgccgcagagcttcatcaaggacgactccatcgacaacaaggtgctgacccgcagcgacaagaaccgggggaagtccgacaacgtccccagcgaggaggtggtgaagaagatgaagaactactggcgccagctgctcaacgccaagctgatcacgcagcggaagttcgacaacctgaccaaggcggagcgcggcggcctctccgagctggacaaggccgggttcatcaagcggcagctggtcgagacccgccagatcaccaagcacgtggcccagatcctcgacagccggatgaacaccaagtacgacgagaacgacaagctgatccgcgaggtgaaggtcatcacgctgaagtccaagctcgtgagcgacttccggaaggacttccagttctacaaggtgcgcgagatcaacaactaccaccacgcccacgacgcctacctgaacgcggtcgtgggcaccgccctgatcaagaagtaccccaagctcgagtccgagttcgtgtacggggactacaaggtctacgacgtgcggaagatgatcgccaagagcgagcaggagatcggcaaggccaccgcgaagtacttcttctactccaacatcatgaacttcttcaagaccgagatcacgctggccaacggggagatccgcaagcggcccctgatcgagaccaacggcgagaccggcgagatcgtgtgggacaaggggcgcgacttcgccaccgtccggaaggtgctcagcatgccccaggtgaacatcgtcaagaagacggaggtgcagaccggcgggttctccaaggagagcatcctgcccaagcgcaactccgacaagctgatcgcccgcaagaaggactgggaccccaagaagtacggcgggttcgacagccccaccgtggcctacagcgtcctcgtggtggcgaaggtcgagaagggcaagtccaagaagctcaagagcgtgaaggagctgctcggcctgaccatcatggagcggtccagcttcgagaagaacccgatcgacttcctggaggccaaggggtacaaggaggtgaagaaggacctcatcatcaagctgcccaagtactccctgttcgagctcgagaacggccgcaagcggatgctggccagcgccggggagctgcagaagggcaacgagctcgccctgccctccaagtacgtcaacttcctgtacctcgcgagccactacgagaagctgaaggggtccccggaggacaacgagcagaagcagctgttcgtggagcagcacaagcactacctcgacgagatcatcgagcagatcagcgagttctccaagcgcgtgatcctggccgacgccaacctggacaaggtcctcagcgcctacaacaagcaccgggacaagcccatccgcgagcaggccgagaacatcatccacctgttcacgctgaccaacctcggcgcgcccgccgccttcaagtacttcgacaccaccatcgaccggaagcgctacacgtccaccaaggaggtgctggacgccaccctgatccaccagagcatcaccggcctctacgagacgcggatcgacctgtcccagctcgggggcgactga

SEQ ID NO: 1959 - RNA, 4110 nt, synthetic construct
  misc_feature 1..4110: note = Cas9 variant
  source 1..4110: mol_type = other RNA
atgaagcgcatcctgggcctcgacctggggaccaacagcatcggctgggccctggtgaacgaggccgagaccgtcaacgagaagtccagcatcgtgaagctcggggtgcgggtcaaccccctgacggtggacgagcagaagaacttcgaggcgggcaagtccatcccgaccaacgccgggcgcaccctgaagcggggcatgcgccggaacctccagcgctacaagctgcggcgcgactacctgatccagtgcctcaaggagtacggctggatcaccagcgacacgctgctgtacgagtgcgggaaccggaccaccttcgagacctaccgcctccgggccaaggccgtggacgaggagatcgccctggaggagctgggccgcgtcctcctgatgatcaacaagaagcgggggtacaagtccaaccgcaaggcgaagtcctccgacgagggccagctgatcgacgggatggccatcgccatggacatgtaccacaacggcacgacccccggcgagtacgtgtacagcctcctgtccaaggggaagaagtacatccccgtgttctaccggagcgacctgctcgacgagttcgaccgcatctgggactaccagtgcgcctactaccccgacatcctgacctcccagttcaaggagctgatccggggcaagagctcccaggtcaccagcaagctgttcaagcagcagtacaacctgttcacggcggacaacaaggagaaggacaagcgcctgcaggcctactgccggcgcgccgacgccctcaagaagcggctgccggtggaggaggtggccgcggccctgtgcgacgtcaaccgcgacgtgaacgcctccagcgggtacctcggcaccatctccgaccgcagcaagaagctgttcttcaacaagcagaccgtgggccagtacctgatgctcgagctggacaaggactcccacttcagcgtcaagaacgaggtgttctaccggcaggactacctgaacgagttcgaggccatctgggagaagcaggccgagtaccaccccgagctcacccccgaccgcaagaagatcctgcgggacgtggtcatcttctaccagcgccccctcaagagccagaaggacctcgtggcgtgctgcgagctggagcggcgccggatcgaggtgatgaaggacgggaaggtccgctccgtggagatcggcccgaaggtgtgccccaagagcagccccctgttccaggacttcaagatctggcacgtcctcaacaacctgaaggtgcgggacaaggccacgggggacgagcgcttcctggagctcgacgagaaggagatcctgttcagcgagctggccatcaagtccaagctcagcaagaccgaggccctgaagctgctgtaccagaagcccaagggcctcgacctgaactacgactccgtcgaggggaacaccacccaggccgcgctgttcgaggcctaccagacggtgatcgccatgaccggccacggcgagtacgtgttcagcaagatgtccgccagcgaggtcatgtccgtggtggagggggtcttcggcgggctcggcttcaacaccagcgtgctgcggttcgactccctgctccaggggaaggagctggagaagcaggacagctaccgcctgtggcacctcctgtactcctacgagggcgacaacagcgtgaccggcacggacgggctggtcgccaaggtggcgtccctcctgcggtgcgacgaggagtacgccaaggtggtcgccggcgtgaccttccagccggactacgggagcctgtccgccaaggcgatccgccggatcctcccccacatgcgcgccggcaacgagtacagcctggcctgcgagtacgccgggtacaagcacagccggcgctccctgaccaaggaggagctcgagcagaaggactacaaggaccacctggagctgctcccccggaacagcctgcgcaaccccgtggtcgagaagatcctgaaccagatggtgaacgtggtcaacgccgtggtggacgcgtacggcaagccggacgagatccgcatcgagatggcccgggagctcaagaagtccgccaaggagcgcgaggagatgaccgccgccatcaacaaggcgacgagcgagcacgagcggatcaaggagatcctgaacaaggagttcggcatccagcacgtctcccacaacgacatcgtgcgctacaagctgtactgcgagctcaagaacaacgggtacaagaccctgtacagcgacacctacatcccccaggagaagctgttctccaaggaggtggacatcgagcacatcctcccccaggcccggctgttcgacgacagcttctccaacaagaccctggagtaccgcagcgtcaacatcgagaagtccaaccagacggcctgggactacgtggccgccaagtggggcgaggaggggagcctccggtacaagaagcgcgtggacgacctgctggcggccggcgtcatcggcaagtccaagcacgacaagctcctgatgaagcaggaggacatccccaccgacttcatcaaccgggacctgcgcgacacccagtacatcgcccggaaggcccgcgagatcctcgaggacctggtgccgatggtggtcagcaccacgggggcggtgaccgaccggctgcgcgaggactggcagctcgtggacgtcatgcaggagctgaactgggacaagtacgccatgaagggcctgaccgaggagtggaccgacaaggacgggcggcgcatctcccggatcaaggagtggaccaagcgcaacgaccaccggcaccacgccatggacgccctcacgatcgccttcaccaagcacagcttcatccagtacctgaacaacctgaacgcgcgctccgacaagagcggcagcatctacgccatcgagcagaaggagctctaccgggacaaccacgggaagctgcgcttcatcatgcccttcgagggcttccgctccgaggccaagcggcagctggagaacatcctcgtgagcatcaaggccaagaacaaggtggtcacccgcaacgtgaacaacgcccggcgcggctccgggcggcaggcgaaggtgcagctgacgccccgcggccagctgcacaacgagaccatctacgggagcatccaccggtacgtcaccaagctcgagaaggtgggcgggaacttcgacggcgagcagatcgccaaggtggccaacctgcgctaccgggaggccctgcaggcccgccacgaggcgttcggcggggacgccaagaaggccttcaccggcaagaacgccctcgacaagaaccccctgtacctgaaggacacccggacggaggtcccgctcaaggtgaagaccgtgtccaccgagaccctgtacacgatccgcaaggcggtcgcccccgacctgaacgtggacaaggtgatcgacgccaaggtccggaaggtgctcgaggagcgcctgcaggagtacgggggcgaccccaagaaggccttcgtgaacctggacgagaaccccatctacctcaacaaggccaaggggatcaccatcaagcgggtcgcgatcaccggcgtgaacaacgccatcgccctgcacgacaagaaggacgtcggcgggcacgtgatgctggacgccagcggccgcaagcagccggtggacttcgtcaacaccgggaacaaccaccacgtggccatctaccgggacgcggagggctccctccaggaggtggtcgtgagcttctacgaggccgtggcccgcgtctccctggggctgcccgtgatcgaccgggagtaccgcaaggaggacggctggcagttcctcttcacgatgaagcagaacgagtacttcgtgttccccaacccggagaccggcttcaacccccaggaggtcgacctgaccgacgagaccaactacgccctgatcagccccaacctcttccgcgtgcagaagttcacgatcaaggactacttcttccggcaccacctggagaccaccgtggaggaccgcaaggagctgaaggacatgacctggaagcggtgcgggctcggcgggatcatcggcatcgtcaaggtgcgcgtgaaccacatcggccggatcgtctccgtgggggagtactga

SEQ ID NO: 1960 - RNA, 4110 nt, synthetic construct
  misc_feature 1..4110: note = Cas9 variant
  source 1..4110: mol_type = other RNA
atggccaagacctacaacatcggcctggacatcgggaccaacagcatcggctgggccgtggtcgacgaccagaaccacctcatgtccatcaaggggaagtacggctacggggtgcgcctgtacgacgagggcaagacggcggaggagcggcgcagcttccggaccacccgccggcgcctgaagcggcgcaagtggcggctctccctgctgcgcgagatcttcgagccccagatcaccccgctcgacaacacgttcttcctgcggcagaagcagagctccctgagctccaaggacaaccgcaagctctaccccgagatgagcctgttcaacgaccggaccgacaccgacttctacacccagtaccccacgatctaccacctgtcccgcgacctcatgaccaagaacaagcagttcgacatccgggagatctacctggccatgtaccacatcgtgaagtaccgcggccacttcctgaacgagagccccgtctccagcttcaagtccagcgagatcaagctcgccgagaacttcgagaccctgaaccagatcttcaacgagcggttcaacgagtccatgttccagctggccgtgaacgacttcgacgacctcaaggccctgctgctcaacgaccagcagagcgcgtccaaccgccagaagaaggccctggggatgatctacgtgccgaacgagaacaagagcctggagaagcagaacaaggccatcgccaccgagctcctgaaggcgatcctgggcctcaaggccaagttcaacgtcctgacggggatcgaggtggacgacgccaagccctggaccctgtccttcaacagcgagagcttcgacgaggacatcgacaaggccgccaccaacatcgacgacgactcccgggagatcatcgcgatcctccagggcctgtacagcgggatcctgctcgccggcatcatccccgagaaccagtccctgagcgaggccatggtggagaagtacgaccagcacgccgcccacctgaagcagctcaagtccatctaccccctgctgagcatctccgacaagaaggcgatccagcaggcctacaactactacatcgacggccaggacaacgccaaggcctacagccgcgaggacttctacgccgcgaccacgaaggccctcaagtcctaccaggacaacgagaccatcgccgagatcctgaagctgatcgagctcgagcagttcatgccgaagcagcggaccaaggacaacggggccatcccccaccagctgcaccagcaggagctggagcgcatcatcgagaaccagcagaagtactacccctggctcgccgagctgaaccccaacgagagccgccggaagatcgcgaagtacaagctggacgagctcgtcgccttccgcgtgccgtactacgtgggccccctgatcacctccgagcagcagcagcagagctccaacaagaagttcgcctggatgatccggaaggccgaggggaagatcacgccctggaacttcgacgagaaggtcgaccgccaggcgagcgccaacgagttcatcaagcggatgaccaccaccgacacgtacctgctggccgaggacgtgctccccaagcagtccctggtgtaccagcgcttcgaggtcctgaacgagctcaacggcatcaagatcgacgacgtgccgatcaccgtggagcagaagcagcggatcttcaacgacctgttcatgatgcaggccagcgtctccgtgaagaacatccaggactacctggtgagcaagggctacttcgcctcccgccccgagatcaccgggctcagcgacgagaacaaggtcatcagccggctgtccacctaccacgacctgaaggcgatcctcggcgggatcgtggacgaggccaacaagcaggccgacctggagaagtgcgtggagtggagcacgatcttcgaggacggcaagatcttcgtcgagaagctgaacgagatcgagtggctcaccgacgagcagcgcaagcggctgtccagcaagcgctaccgggggtggggccgcctgtccaacaagctcctgaaccagatcgtgaacgagaacggccagcggatcatggacctgctctgggacaccaccgacaacttcatgcgcatcgtccacagcgaggagttcgacaagctgatctccgccgccaaccagacgctgctcagcaagaacgacgtgcaggacgtgatcaacgacctgtacacctccccgcagaacaagaaggcgctgcggcagatcctcctggtcgtgagcgacatccagaaggccatgaagaaccaggccccctccaagatcctgatcgagttcgcccgcgaggacgaggccaacccgcggctcagcgtgcagcgcaagcgccaggtcgagcaggtctaccagaacatctccaaggacatcctgagcgactccgacgtgaaggcggagctgaaggacctcaccaacaccgccctggccaacacgcggctgttcctctacttcatgcagggcgggcacgacatgtacaccggggagaccctgaacatcgaccgcctgagcgagtacgacatcgaccacatcctcccccaggccttcatcaaggacaactccctggacaaccgggtgctggtgagcgcgaagatgaaccgcagcaagtccgaccaggtgcccctcaacgactacaccgaggagcggttcggcagcaagatgcgcgtccagtgggagcagatgctgcgggccgggctgatcaccaagcgcaagtacgacaacctcacgctgaaccccgaccggatctccaagtacgccatgaagggcttcatcaaccgccagctggtggagacccgccaggtgatcaagctcgtcaccaacctgctgatggaccactacgaggacgacgaggtgcagctcatcaccgtcaagagcggcctgatccaccagatgcgggagatgttcgacttcccgaagaaccggaacctgaacaaccaccaccacgccttcgacgcctacctcacggcgttcgtggggatctacctgctgaagcgctaccccaagctcacccccttcttcgtgtacggctcctaccagaagaacaacaccaacgacaagtggcggaacttcaacttcctgaacgacctgaagaaggaggaggtgatcgacagcgactcccacgaggtcatctggaacaaggcccaggggctcgtggagctggacaagatctaccagttcaagaagatcctggtgacccgcgaggtccacgagaacacgggcgccctctacaaccagaccctgtacagcgccaaggacgacaaggcctccgggcagggcggcaagcagctgatccccgcgaagcaggaccggccgaccgccctctacgggggctacagcgggaagaccgtggcctacatgtgcatcgtgcgcatcaagtccaagaaggaggacacgtacaaggtctgcggcgtgaagaccagctgggtggccgagctggagcggctgtccgacagcaacgagcagctcgcctccctgaaggcgaagctgatgcccaagttcaccaagaacaagaagcagaagggcaagaccatccaggtcacggaggacttcgagatcatcgtgccccgcgtgctcatcaaccagcggttctacgacaacgggcaggagatcaccctgggcagcgccacctacaagcacaacgagcaggagctgatgctcaacaagaaggccgtcaagctgctgaacgggcagctctccctggtggaggccgagaccctggcgccccaggtgtacgacgagatcctcaagcaggtcatgaagtacttccccctgtacgacacgaaccagttccgcaccaagctgaagatgggcaaggagcagttcatcaagctcccctggaagaacaagtgggacgggaacaagctgatccacgtgggccagcagaccgtgctggaccgcatcctcatcggcctgcacgccaacgccgccgtcagcgacctgtccaccctcaaggtgacgacccccttcgggaagctgcagcagccgagcggcatcgccctgagcctcaacaccaagatcatctaccagtcccccaccgggctgttcgagcggcgcgtggcgctgcggggcctctga

SEQ ID NO: 1961 - RNA, 4110 nt, synthetic construct
  misc_feature 1..4110: note = Cas9 variant
  source 1..4110: mol_type = other RNA
atggacaagccctacaacatcggcctggacatcgggagccactccatcggctggaccgtggtcgacgacaacagcaagctcgtgcgcatcaaggggaagctgggctacggggtgcggctgttcgacgagggcaagaccgccgaggagcgccggcagttccgcacgacccggcgccggctcaagcgccggaagtggcgcctgcggctgctccgcgagatcttcgagccgcacatcgcgcccctggacgagaccttcttcctgcggcagaagcagtccaacctcgtccccacccagaagaagctgccccagctgagcctcttcaacgaccgctccgacgccgagttctaccacaagtacccgacgatctaccacctccggaacgccctgatgaccgagaagcgccagttcgacctccgggagatctacctggccatccaccacatcgtgaagtaccgcggccacttcctgaacgccgcccccgcggccagcttcaagtccgggaagttcgacctcgagaacaagttcgaccagctgaacctgctgttcgccagcgcctactccgacctggacttcaccctgcggaccgacaacgtggaccaggtcaaggcgatcctcctgaacgaggacctgagcgcctccacgcgccagcggcaggccctccccctgatctaccagaccagcgccgaccagaaggccgcgaagaagctgaccaagtccctcgccaccgagctgctgaaggccatcctcggcctgaaggccaagttcgacgtgctgacggggatcgagaccgacgacaccaaggcctggcgcctcaccttcaacgcggaggacttcgacgacaagctgaacgagctgaacgtgacggacaacgaggccgccacccagatcatcgagatcctccgcgagctgtacagctccatcctgctcgccgccatcgtccccgagaactacaccctgagccaggcgatgatggccaagtacaacgcccacaagcagcacctgtccctcctgcgccaggtgaagaccacgctgccggccaagaagcagaaggagctccaggccgcgtacgacgactacatcgaccagcacctccccctggacaagttctacgccaagctgaccaaggtgctccccaaggagaaggacaccgacaacccccagatcatccagatcctgaacctgatcgacctcgaccagttcctgccgaagcagcggaccaaggacaacggcgccatcccccaccagctgcaccagcaggagctcgaccagatcatcgacaaccagaaggcctactacccctggctggcgcagctgaaccccaacgagaagcggcagaagatcgccaagtacaagctcgacgagctggtcgccttccgcgtgccgtactacgtggggcccctgatcgaggccaagacgcagcagaagaccagcggcgccaacttcgcgtggatgatccggaaggagcccggcaccaccacgcccatcaccccgtggaacttcgacgagaaggtcaaccgccaggcctccgccaacgagttcatcaagcggatgaccaccacggacacctacctcctgggggaggacgtgctgcccaagcacagcctcctgtaccagcgcttcgaggtgctgaacgagctcaacggcatcaagatcgaccagaagcgggtcaccgtgcgccagaagcaggccatcttcaacgacctgttcctgaagcagcccaacgtgaccgtcaagaagctccagcagtacctgcaggccaagggggagtacgcgagcgcccccatcatcacgggcctgtccgacccgaagaagttcaacagccagctctccacctaccacgagtacaagaagatcttcggcgggctgatcgacgaccccgacaagcaggccgacttcgagaagtgcatcgagtggagcaccatcttcgaggactcccagatcctgaaggacaagctcaaggagatcaactggctgacccccgagcagcggcacaaggtggccaacaagcgctaccagggctgggggcggctgagcaagaagctcctgacccagctggtggactacaacggccagcgcatcatcgacatcctctggaacacgaccgacaacttcatgcagatcgtccactccgaggccttcgacaaggcgatcatcaaggagaaccaggccctgctgacccagtacaacccccaggccgtgatcgacgacctctacaccagcccgcagaacaagaaggccctgcggcagatcctgctcgtcgtgaacgacatccagaaggcgctgaaggggcaggccccctcccgcatcctgatcgagttcgcccgggagggccaggagaacccccgcctcagcacgcagcggaagcagcaggtcgagaacgcctacaaggaggcctccgacgcgctgctgagctccgccgaggtgcgccaggagctcaagggcctggacaacaaggccctggccaacacccgcctcttcctgtacttcatgcagggcgggcgggacatctacaccggcaagagcctgaacatcgacgacctctccaagtacgacatcgaccacatcctgccgcaggccttcatcaaggacaacagcctggacaaccgcgtgctcgtgtccgcgaagatgaaccggagcaagtccgaccaggtccccctgaacgacttcgccgagatccgctacgggaagcagatgcggcagcagtgggagaagatgctgcgcgccgggctcatcacccggaagaagtaccacaacctgacgctgaaccccgagagcatcaacaagtacaccgccaagggcttcatcaaccgccagctcgtggagacccgccaggtgaccaagctggccacgaacctgctcgtcgaccagtacgcggaggacgacgtgcagctgatcaccgtcaagagcaacctgacccaccagatgcgggaggagttcgacttccccaagaaccggaacgtgaacaaccaccaccacgccttcgacgcctacctcaccgccttcgtgggcctgtacctgctcaagcgctacccgaagctggcgccctacttcgtgtacggggactaccagaagggcgcctcccagaacagcaagtggcggaacttcaacttcctggggaacctccaccgcgagaaggtcgtggacaagaacacgggcgagatcatctggcagcgggacgccgggctgggcgagctgaaccgcatctacaacttcaagaagatcctcgtgacccgggccctgcgcgtcaaccggggccccatgttcaagcagaccatctacaaggccgaggaggacaagtccagcgggcgcggctccaagcagctgatccccaccaagaagaaccggccgacggagctctacgggggctacaccaacaaggagaccgcgtacctgtgcctggtgaaggagccccacaagaagggcgacatctaccgcatctgcagcgtgctcaacatgtggctgaccgagctggaccgcatcgccgaccccatcgccaaggcccagaagctcacggagctgctgacgccccagttcaccaccaccaagaagaagcaggggcagaagatcccggtcgtgaagcccttcaaggtggtcatccccaagatcctcatcaaccagcggttcttctcccgcggccaggagctgaccgtggccagccccatgtacatgcacaacgagcaggagctgttcctcaacaagaagaccatcaagctgctgaacgggcagctcgcgaagaacgaggcccacgagctggccccgaagatctaccagcagatcctggaccaggtgaacgactacttccccctgtacgacatgtacaagttccgggacaccctcaacgcctccaaggagatcttcgtcaacctgccctggcaggaccagcgccaggacaagaagatcagccagtccggccagaagtccatcctgaacaagatcctcatcgggctgcacgccaacgcggcccggatcaagctgacggagctcaacttcaagagcgacttcggcctgctgagccagcgctccggcatcgccttcagccccgacgaccagatcatctaccagtccccgaccgggctgttcgagcggcgcgtgaccctgaaggacctgtga

SEQ ID NO: 1962 - RNA, 4110 nt, synthetic construct
  misc_feature 1..4110: note = Cas9 variant
  source 1..4110: mol_type = other RNA
atgaaggtgaacaactaccacatcggcctggacatcgggaccagctccatcggctgggtcgccatgggggaggacggcaagcccctccgcgtgaaggggaagaccgccatcggcgcgcggctgttccgcgagggcaacccggccgccgaccggcgcatgttccggacgacccgccggcgcctgaaccggcgcaagtggcggctcaagctgctggacgagatcttcgacccctacatcacccccgtggacagcaccttcttcgcccgcctcaagcagtccaactggagccccaaggactcccggaaggccttcaaggacagcacgctgttcccggacctgaccgacaagcagtaccacctcgactaccccaccatctaccacctccgccacgcgctgatgacccaggacaagcagttcgacatccggatggtctacctggccctgcaccacatcgtgaagtaccgcgggaacttcctgaactccacgcccgtggacagcttcaaggcctccaaggtcaacttcgacgaccagttcaagaagctcaacgagctgtacaccgccatcaaccccgaggagagcttccagatcaacttcgcgaactccgagaagatcggccagcagttcctggacccgagcatccggaagttcgacaagaagaagcagatctccaagatcgtgcccgtgaccatggacgacaaggccgtcgacaagctcaacgggaagatcgccagcgagatcgtgaacgccatcctgggctacaagtccaagctggacgtggccgtccagtgcgaccccgaggacagcaagccctgggcggtgaagttcgacgacgaggacatcgacgccaagctccagaagatcctgccggagatggacgagaaccagcagtccatcatcgggatcatccaggacctgtacagccaggtgaccctcaaccagatcgtccccaacggcatgtccctgagcgagagcatgatcaagaagtacaacgaccaccacgaccacctgaagctctacaagaagctgatcggccagatctccgacagcaagaagaagacggccctgaagaaggcctacgaccagtacgtggggaacgacggcaaggtgatcgagcaggacgacttctactccagcgtcaagaagaacctcgacgactccgagctgagcaagcagatcatggacctgatcgacgccgacaagttcatgcccaagcagcgcacctcccagaacggggtgatcccccaccagctccaccagcgggagctggacgagatcatcgagcaccagagcaagtactacccgtggctggcggagtccaaccccaacaagcacgacctccacctggccaagtacaagatcgaggagctggtggccttccgcatcccctactacgtcggccccatgatcaccccggaggaccagaagaagtccggcgccgccgtgttcagctggatgaagcggaaggagcccgggcagatcaccccctggaacttcgaccagaaggtggaccgcatggagagcgcgaacaagttcatcaagcgcatgacgaccaaggacacctacctcatcggcgaggacgtcctgcccgacgagtccctgctctacgagaagttcaaggtgctgaacgagctgaacatggtccgggtgaacggggacagcctcaaggtggccgacaagcaggccatctaccaggacctgttcgagaactacaagcacatctccgtcaagaagatgcagaactacatcaaggacaagaccggcctgccgaacaaccccgacatcagcgggctctccgaccccgaccacttcaacaacagcctgggcacgtacaacgacttcaagaagctgttcggcgacaaggtggacgaccccgacctgcaggacgacttcgagaagatcgtggagtggtccaccgtcttcgaggacaagaagatcctccgcgccaagctgaacgagatcagctggctgagcgacaagcagaaggacgacctcgagtccagccggtaccagcgctgggggcggctgtccaagaagctgctcaccggcatcgtgaacgaccagggggagcgcatcatcgacgagctgtggaacaccaacaagaacttcatgcagatccagagcgacgacgacttcgccaagcggatccacgaggcgaacgccgaccagatgaaggccacggacgtggaggacgtcctggccgacgcgtacacctccccgcagaacaagaaggccatccgccaggtggtgaaggtcgtggacgacatccagcgggccatgggcggggtggcccccaagttcatcagcatcgagttcacccgctccgaggaccggaacccccgccggaccatcagccgcgagcggcagctcgaggacacgctgaaggacaccgccaagaccctggtcaagtccatgaacccggacatcctcagcgagctggacaacgcgtccaagagcaagaagggcctgaccgaccgcctctacctgtacttcacgcagctgggccgggacatgtacaccgggaagcccatcaacatcgacgagatctccaactacgacatcgaccacatcctcccccaggccttcatcaaggacgacagcctgtccaaccgcgtgctggtgagcaaggccgtcaacaacggcaagtccgccaacgtgcccctcaagctgttcggggtgaagatggcccacttctggaagcagctggcggaggccggcctcatcaacaagcggaagctgaagaacctgcagaccaacccggacaccatcagcaagttcgccatgcacgggttcatccgccgccagctcgtcgagacgagccaggtgatcaagctggtggccaacatcctgggcgacaagtaccggaacgacgacaccaagatcatcgagatcaccgcccgcatgaaccaccagatgcgggacgagttcgcgttcatcaagaaccgcgagatcaacgactaccaccacgccttcgacgcctacctcaccgccttcctgggccggtacctgtaccaccgctacatcaagctccggccctacttcgtctacggggacttcaagaagttccgcgaggacaaggtgaccatgcggaacttcaacttcctgcacgacctgacggacgacacccaggcgcgcatcgccgacaccgagaccggcgaggtgatctgggaccgggagacgtccatcaagcagctccgcgacgtctaccactacaagttcatgctgatcagccaggaggtgtacaccctgcgcggggccatgttcaaccagaccatctaccccgccgacgaggccggccggaagaagctcatccccaccaaggcggacaaggccgtggacgtctacggcgggtactccggcagcaacgacgcctacatggccatcgtgcggatccacgacaagaagggggacaagtacaaggtggtcggcgtgccgatgcgcgccctggaccggctgaacgcggccaagaacgtgtccgacgccaagtacgaccaggtcctcaaggacgtgctgacgccccagttcaccaagagcaagaagtcccgcaagaccggggagatcagccagaccgtggaggacttcgaggtcgtgctgggcaaggtgatgtaccggcagctcgtcatcgacggcgacaagaagttcatgctggggtccagcacgtaccagtacaacgccaagcagctggtgctctccgacgagagcgtgaagaccctggcctccaagggcaagctggacgaggcgcaggagagcgccgcctacgacaacgtctacgacgagatcctcgacaaggtggaccgctacttcgccctgtacgaccagcggaactaccgcaccaacctgcacgagggggagcagaagttcatcggcctccccctgcacgacaccttcgacgggtccaagaaggtggcgaacggcaagcgcgagacgatcagcgacatcctgaacggcctccacgccaacgccaccatgaccaacctgaaggtcctggggatctccagccccttcggcatgttccagtcccacgggccgatcaacctcaaccccgagaccatcatcctgtgccagagccccacgggcctgttcgagcggcgcatcatcctccgggacctgtga

SEQ ID NO: 1963 - RNA, 4113 nt, synthetic construct
  misc_feature 1..4113: note = Cas9 variant
  source 1..4113: mol_type = other RNA
atgaagaagcgcaactacaacatcgggctggacatcgggaccagctccatcggctggaccatcgtggacgacaacgcccagatcatgcgggccaaggggaagaacggctacggggtccgcatcttcgcggagggcaagacggccgccgaccggcgcggcttccggaccacccgccggcgcctcaagcggcgcaagtggcggctgcgcctgctccaggagttcttcgagccctacatcctgccgatcgacgagaacttcttcatgcggcagaaggagagcaacctggtgccccaggaccccaacaagcacttcaaggggtccatcctcttcaacgaccgcaccgaccaggagttccacgagcagtaccccacgatctaccacctccggtacgccctgatgaccgagcaccgccagttcgacgtgcgggagatctactgggccatccaccacatcgtcaagtaccgcggccacttcctcaacagcaccctggcgtccaagttcaagggcggggagctgcggctcgccgacaagttcgagagcctgaacaagctgttcctccgcgtgcaggccgagaccgggttcgagctgtccgaggacaacgtggacaagatcaagacggtcctgctcgacaacggcaagagccggctggaccgccagcgcgaggtgctgaagatcgtgtacctcacctccgaggacaaggacaccgagaagaagcggaaggccgtcgcgaccgagttcatcaaggccgtgctgggcctgaagacgaagctgttcatcgtgctggccaagaacccgaccgccgagaccgactggaagttcagcttcgacgccgaggacatcgacgacaagctggactccatcagcgagcagctcaccgacgacgaccacgagatcgtcgagctgatctccgagatccacagcatcatcacgctgaccggggtggtgcccgagggcatggggctctccgagagcatgatcgcgaagtacgaccagcaccagctggacctgaagaagctcaagtccctgatgcgcgacctggacgtcaagcaggcccggaagctccaggacgcctacgacgagtacatcgacggcctgaagcccagcgaggaggccttctactccgccgtgagcagcgtgatccagaagatggacgacccccgcgcgaagaagatcaccgccgagatcgagctggaggagttcatgccgaagcagcggaccaaggccaacggccagatcccccaccagctccaccagcaggagctggaccagatcatcgagaaccagaaggagtactacccctggctggccgaggagaaccccaacaagcgcgagcacaacgccgcgccgcacaagctcgacgggctggtcacgttccgggtgccctactacgtgggccccctgatcgaggcctccgtccagcagaagaccagcaactccaacttcgcctggatggagcgcaaggtgaagaacgacaccagccggatcaccccctggaacttcgaggagaaggtggaccgcaacgcctccgccgagaacttcatcaagcggatgacgaccaaggacacctacctcctgaacgaggacgtcctgccgcagcagagcctcctgtaccagcgctacgaggtgctgaacgagctgaacaacgtccgggtgaacgacaagaagctcgagaacaactgcaagcaggacgtgtacaaggacctgttcaagaacaacaccacggtctccatcaagaagttcaaggactacctggtggcgaactgcgagtacgccgacaaccccaagatcgaggggctcgccgacgagagcatcttcctgtccagcctgtccaccgagaacaagttcaaggacatcttcggcgcccagatcgacgaccccaactacttcgaggacttcgagcacatcatcgagtgggcgaccatcttcgaggacaacaagatcctccgcgccaagctggacgagatcagctggctgaacgagtcccagaagaaggagctcgccaagctgcggatgcgcgggtggggccggctgagccgcaagctcatcgccgagatcaccgacgagaacggctcccggatcatcgacctgctgtgggagcacatggacaacttcatggtggtcgtgaaccaggacgtgttcaaggagaagatcgtcgccgagaacaagcaggtcttcaaggagctcaaccccctggacatcatcaacgagcagttcacgagcccgcagaacaagaaggcgctgcgccagatcctcctggtggtggccgacatccagaaggccatgaacggggtgaccccctccaacatcttcatcgagttcgcccgcgaggacgagcggaacccccgccggagcatccagcgcctgcgccaggtggagaacatgtaccgggacatctccgacaccgtcctcgccgaccccgaggtgcggaacgagctgagcaacatcaagaacaccgagctggcgcgcgaccgggtgttcctctacttcctgcagggcgggcgcgacgtctacacgggcgagccgctgaacatcgacaagctcagcgagtacgacatcgaccacatcctgccccaggccttcatcaaggacaactccctggacaaccgggtgctcgtgagcgcctccctgaaccgcagcaagtccgacagcgtccccctggacgacttcacctccgagatgttcgggcggaagatggagcccctctgggagcagatgcagcgcgccggcctgatcagcaagaagaagctggccaacctcaagttcaacccggagaacatcaacaagtacacccggaacggcttcatcaaccgccagctggtggagacccgccaggtgatcaagctggcggccaacatcctcaaggaccactacggggaggagaccgagatcgtcaacgtgaaggccggcctgacgcaccagttccggaaggacttcgacttccccaagaaccggaacgtgaacaactaccaccacgccttcgacgcgtacctgaccgccctcgtcgggacctacctgctgaagaagtaccccaagctcgagtcctacttcgtgtacggcaagttcaagaagggggacggcatcaccaacctgaagaacttcaacttcctgcacggcttcaacaagccggggaagatcatcaacaaggagacgggcgagatcctcttcgaccgcgacaagcagctggggtacatgaacagcatctacgacctgcggaaggtgatcgtcacccacgagctctccacccgccacggcgccatgtacgaccagaccctgtacaaggccagcgacgacaaggactccggccgcgggggcaagcagctgatccggaagaaggacaacctccccacggagatctacgggggctacaccgggagcaccgacgccttcatgtccatcatccgcatgaagaagaaggacaagctgtactacaaggtgatcggcgtgcccacccgggtcgcgcacgaggtgctgcagagcgacggcaagatcaacatcttcacgctcaacaagttcatcgagcagaagctgaccaaggagaaggtgaacaagaagaccggggccatcacccgcatcacggactggttcgagctggtcatcgccaaggtgatgtacggccaggtgatcgacgacgggggccagcccttcatgctcgggtccagcaccctgccgtacaacgtccgggagctgtacctcgccaaggacctggtgaaggtgatcaacaagggcagcacctccaagagctcctacctggacgtctacgacgagctcgtgaagtccctgaacaagtacttccccatgtacgaccgcaacatgttccggcagaagatcaccgacgcccgcgacaagttcgagaagctgcccaagcgggacaaggtgagcaacggcaagctccagcagatcgggcaggtcacgatcatcgaccgcatcctgatcggcctgcacaccaacgcgggggtgagcaacctcaaggacctgggcatcgccacccccttcgggttcatgcagcagggcaacggcatctccctgaccagcacggccaagatcatctaccagtccagcaccggcctcttcgagaagtccaaggccctggacgacctgaacccgctcgcctga

SEQ ID NO: 1964 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcatcaccgacgactacaaggtcccggccaagaagatgcgcgtgctcgggaacacggacaaggagtacatcaagaagaacctgatcggcgccctgctgttcgacgggggcaacaccgcggccgaccggcgcctgaagcggaccgcccgccggcgctacacccggcgccggaaccgcatcctgtacctccaggagatcttcgccgaggagatgtccaaggtggacgacagcttcttccaccggctggaggactccttcctggtcgaggaggacaagcgcggcagcaagtaccccatcttcgccacgatgcaggaggagaagtactaccacgagaagttccccaccatctaccacctccggaaggagctggcggacaagaaggagaaggccgacctgcgcctcatctacctggccctggcccacatcatcaagttccgggggcacttcctcatcgaggacgaccgcttcgacgtgcggaacaccgacatccagaagcagtaccaggcgttcctggagatcttcgacaccacgttcgagaacaacgacctgctctcccagaacgtggacgtcgaggccatcctgaccgacaagatcagcaagtccgccaagaaggaccgcatcctggcccggtaccccaaccagaagtccaccggcatcttcgccgagttcctcaagctgatcgtggggaaccaggcggacttcaagaagcacttcaacctggaggacaagaccccgctccagttcgccaaggacagctacgacgaggacctggagaacctgctcggccagatcggggacgagttcgccgacctgttcagcgccgccaagaagctgtacgactccgtgctcctgagcggcatcctgacggtcaccgacctctccaccaaggcgcccctgagcgcctccatgatccagcgctacgacgagcaccgggaggacctgaagcagctcaagcagttcgtgaaggccagcctgcccgagaagtaccaggagatcttcgccgactccagcaaggacggctacgccgggtacatcgagggcaagaccaaccaggaggcgttctacaagtacctgagcaagctcctgacgaagcaggaggggtccgagtacctgctcgagaagatcaagaacgaggacttcctgcgcaagcagcgcaccttcgacaacggcagcatcccccaccaggtgcacctgaccgagctccgggccatcatccgccggcagtccgagtactacccgttcctgaaggagaacctggaccgcatcgagaagatcctcaccttccggatcccctactacgtcggccccctggcccgcgagaagtccgacttcgcctggatgacgcggaagaccgacgacagcatccgcccctggaacttcgaggacctggtggacaaggagaagtccgccgaggcgttcatccaccggatgaccaacaacgacctgtacctcccggaggagaaggtgctgcccaagcacagcctgatctacgagaagttcaccgtctacaacgagctcacgaaggtgcgcttcctggccgaggggttcaaggacttccagttcctgaaccggaagcagaaggagaccatcttcaacagcctcttcaaggagaagcgcaaggtgaccgagaaggacatcatctccttcctgaacaaggtcgacggctacgaggggatcgccatcaagggcatcgagaagcagttcaacgccagcctgtccacctaccacgacctcaagaagatcctggggaaggacttcctggacaacacggacaacgagctcatcctggaggacatcgtgcagaccctgaccctcttcgaggaccgggagatgatccgcaagcggctggacatctacaaggacttcttcaccgagagccagctgaagaagctctaccgccggcactacacgggctggggccgcctgtccgcgaagctgatcaacgggatccggaacaaggagaaccagaagaccatcctcgactacctgatcgacgacggcagcgccaaccgcaacttcatgcagctgatcaaggacgccgggctctccttcaagcccatcatcgacaaggcccgcaccggcagccactccgacaacctgaaggaggtggtcggggagctggccggcagccccgcgatcaagaagggcatcctccagtccctgaagatcgtggacgagctggtgaaggtcatggggtacgagccggagcagatcgtggtcgagatggcccgggagaaccagaccacggccaagggcctcagccgcctgcggcagcgcctgaccaccctccgggagagcctggccaacctgaagtccaacatcctcgaggagaagaagcccaagtacgtgaaggaccaggtggagaaccaccacctgagcgacgaccgcctgttcctctactacctgcagaacgggaaggacatgtacaccgacgacgagctggacatcgacaacctctcccagtacgacatcgacctgatcatcccccaggccttcatcaaggacgacagcatcgacaaccgggtcctggtgtccagcgcgaagaaccgcggcaagtccgacgacgtgcccagcgtcgagatcgtgaaggactgcaaggtgttctggaagaagctcctggacgccaagctgatgtcccagcggaagtacgacaacctcaccaaggccgagcgcgggggcctgacgagcgacgacaaggcccggttcatccagcgccagctggtcgagacccggcagatcaccaagcacgtggcccgcatcctcgacgagcggttcaacaacgagctggactccaagggccgccggatccgcaaggtgaagatcgtcaccctcaagagcaacctcgtgtccaacttccggaaggagttcgggttctacaagatccgcgaggtgaacaactaccaccacgcgcacgacgcctacctgaacgccgtcgtggccaaggcgatcctgacgaagtacccgcagctcgagcccgagttcgtgtacggcgactaccccaagtacaacagctacaagacccggaagtccgccaccgagaagctgttcttctacagcaacatcatgaacttcttcaagaccaaggtcacgctggccgacgggaccgtggtggtcaaggacgacatcgaggtgaacaacgacaccggcgagatcgtgtgggacaagaagaagcacttcgccaccgtccgcaaggtgctctcctacccccaggtgaacatcgtcaagaagacggagatccagaccggcgggttcagcaaggagagcatcctggcccacggcaactccgacaagctgatcccgcgcaagaccaaggacatctacctcgaccccaagaagtacgggggcttcgacagccccatcgtggcgtactccgtgctggtcgtggccgacatcaagaaggggaaggcccagaagctgaagaccgtgacggagctcctgggcatcaccatcatggagcggagccgcttcgagaagaacccctccgccttcctggagagcaagggctacctcaacatccgggacgacaagctgatgatcctgccgaagtactccctcttcgagctggagaacgggcgccggcgcctgctcgccagcgcggacgagctgcagaagggcaacgagctggccctccccacccagttcatgaagttcctgtacctggcctcccggtacaacgagctcaaggggaagcccgaggagatcgagcagaagcaggagttcgtcgtgcagcacgtgagctacttcgacgacatcctgcagatcatcaacgacttctccaaccgcgtcatcctggccgacgccaacctcgagaagatcaacaagctgtaccaggacaacaaggagaacatcccggtggacgagctggcgaacaacatcatcaacctcttcaccttcacgagcctgggcgcccccgccgccttcaagttcttcgacaagatcgtggaccggaagcgctacacctccaccaaggaggtcctgaacagcaccctcatccaccagtccatcacggggctgtacgagacccggatcgacctgggcaagctcggcgaggactga

SEQ ID NO: 1965 - RNA, 4113 nt, synthetic construct
  misc_feature 1..4113: note = Cas9 variant
  source 1..4113: mol_type = other RNA
atgaccaagaagaactacagcatcggcctggacatcgggaccaactccgtgggctgggccgtcatcacggacgactacaaggtgcccgccaagaagatgaaggtgctcgggaacaccgacaagaagtacatcaagaagaacctgctgggcgcgctcctgttcgacagcggggagaccgccgaggccacccgcctgaagcggacggcccgccggcgctacacccggcgcaagaaccggctccgctacctgcaggagatcttcgccgaggagatgaccaaggtcgacgagtccttcttctaccggctggacgagagcttcctcaccacggacgagaaggacttcgagcgccacccgatcttcggcaacaaggcggaggaggacgcctaccaccagaagttccccaccatctaccacctccggaactacctggccgactccagcgagaaggccgacctccgcctggtgtacctggcgctcgcccacatgatcaagtaccggggccacttcctgatcgaggggaagctgaacgccgagaacaccgacgtgcagaagctgttcaccgacttcgtcggcgtgtacgaccgcacgttcgacgactcccacctgagcgagatcaccgtggacgtcgcctccaccctgaccgagaagatcagcaagtcccggcgcctcgagaacctgatcaagtactaccccacggagaagaagaacaccctgttcgggaacctcatcgccctggcgctgggcctccagcccaacttcaagatgaacttcaagctgagcgaggacgccaagctgcagttctccaaggacacctacgaggaggacctcgaggagctgctggggaagatcggcgacgactacgccgacctcttcaccagcgccaagaacctgtacgacgccatcctgctctccggcatcctgacggtggacgacaacagcaccaaggcgccgctgtccgccagcatgatcaagcggtacgtggagcaccacgaggacctcgagaagctgaaggagttcatcaaggccaacaagtccgagctgtaccacgacatcttcaaggacaagaacaagaacgggtacgccggctacatcgagaacggggtcaagcaggacgagttctacaagtacctcaagaacaccctgagcaagatcgacggcagcgactacttcctggacaagatcgagcgcgaggacttcctccggaagcagcgcaccttcgacaacggctccatcccccaccagatccacctccaggagatgcacgccatcctgcggcgccagggggactactaccccttcctcaaggagaagcaggaccgcatcgagaagatcctgacgttccggatcccctactacgtgggcccgctggtgcgcaaggacagccggttcgcgtgggccgagtaccgctccgacgagaagatcaccccctggaacttcgacaaggtcatcgacaaggagaagtccgccgagaagttcatcacccggatgaccctgaacgacctctacctgcccgaggagaaggtgctgcccaagcacagccacgtgtacgagacgtacgccgtctacaacgagctcaccaagatcaagtacgtgaacgagcaggggaaggagagcttcttcgactccaacatgaagcaggagatcttcgaccacgtgttcaaggagaaccgcaaggtcaccaaggagaagctgctgaactacctcaacaaggagttcccggagtaccggatcaaggacctgatcggcctggacaaggagaacaagagcttcaacgcctccctcgggacctaccacgacctgaagaagatcctggacaaggcgttcctcgacgacaaggtgaacgaggaggtgatcgaggacatcatcaagacgctgaccctgttcgaggacaaggacatgatccacgagcgcctccagaagtacagcgacatcttcaccgccaaccagctgaagaagctggagcggcgccactacaccggctggggccggctctcctacaagctgatcaacgggatccgcaacaaggagaacaacaagacgatcctggactacctcatcgacgacggcagcgccaaccggaacttcatgcagctgatcaacgacgacaccctgcccttcaagcagatcatccagaagtcccaggtcgtgggggacgtcgacgacatcgaggccgtggtgcacgacctccccggcagccccgcgatcaagaaggggatcctgcagtccgtcaagatcgtggacgagctggtgaaggtcatgggcgacaacccggacaacatcgtgatcgagatggcccgcgagaaccagaccaccaaccggggccgcagccagtcccagcagcggctcaagaagctgcagagctccctgaaggagctcgggagcaacatcctgaacgaggagaagcccagctacatcgaggacaaggtggagaactcccacctccagaacgaccagctgttcctgtactacatccagaacggcaaggacatgtacaccggggacgagctggacatcgaccacctgagcgactacgacatcgaccacatcatcccccaggccttcatcaaggacgactccatcgacaaccgcgtcctgacgagctccgccaagaaccggggcaagagcgacgacgtgccctccctggacatcgtgcgcgcccgcaaggcggagtgggtccggctctacaagagcgggctgatctccaagcgcaagttcgacaacctgaccaaggccgagcggggcggcctcaccgaggccgacaaggccgggttcatcaagcgccagctggtggagacccggcagatcacgaagcacgtggcccagatcctggacgcgcgcttcaacaccgagcacgacgagaacgacaaggtcatccgggacgtgaaggtgatcaccctcaagagcaacctggtctcccagttccgcaaggacttcgagttctacaaggtgcgggagatcaacgactaccaccacgcccacgacgcctacctgaacgccgtggtcggcaccgccctcctgaagaagtacccgaagctggcgagcgagttcgtgtacggggagtacaagaagtacgacatccgcaagttcatcacgaactccagcgacaaggccaccgccaagtacttcttctactccaacctcatgaacttcttcaagaccaaggtgaagtacgccgacggcaccgtcttcgagcggcccatcatcgagacgaacgcggacggcgagatcgcctggaacaagcagatcgacttcgagaaggtgcgcaaggtgctgagctacccccaggtcaacatcgtgaagaaggtggagacccagaccgggggcttctccaaggagagcatcctgcccaagggggacagcgacaagctcatcccgcggaagaccaagaaggtctactgggacacgaagaagtacggcgggttcgactcccccaccgtggcctacagcgtgttcgtcgtggccgacgtggagaagggcaaggccaagaagctgaagaccgtcaaggagctggtgggcatctccatcatggagcgcagcttcttcgaggagaaccccgtggagttcctcgagaacaaggggtaccacaacatccgggaggacaagctgatcaagctgcccaagtactccctcttcgagttcgagggcgggcgccggcgcctgctggcgagcgcctccgagctccagaagggcaacgagatggtcctgccggggtacctggtggagctcctgtaccacgcccaccgggccgacaacttcaacagcaccgagtacctgaactacgtgtccgagcacaagaaggagttcgagaaggtcctcagctgcgtggaggacttcgccaacctgtacgtggacgtcgagaagaacctgtccaagatccgcgcggtggccgacagcatggacaacttctccatcgaggagatcagcaactccttcatcaacctcctgacgctgaccgccctcggcgcccccgccgacttcaacttcctgggcgagaagatcccccggaagcgctacaccagcaccaaggagtgcctgacggcgaccctcatccaccagtccatcaccgggctgtacgagacccgcatcgacctgagcaagctcggcgaggagtga

SEQ ID NO: 1966 - RNA, 4113 nt, synthetic construct
  misc_feature 1..4113: note = Cas9 variant
  source 1..4113: mol_type = other RNA
atgaagaacgccaacaaggtgaccggcaagtactacctggggttcgacatcggcaccaacagcgtcgggtgggccgtgacggacgagaactacaacctctgcaagttcaagaagaagtccatgtggggcatccgcctgttcgaggacgcgaagaccgccgaggagcggcgcgggcagcgggccagccgccggcgcctgcagcggcgcaagcagcggatcgacctcctgcaggagatcttcgccgaggagatcaacaaggtggacgagaccttcttcatccgcctgaacgagtcccggctccacctggacgacaagaccgtcagcgagaagcaccccctgttcatcggctccgagtacagcgagaaggagtactaccgcgagtacccgacgatcttccacctccggaaggagctgatggagtccagcgagccccacgacatccgcctggtgtacctcgccatccaccacatcctgaagaaccggggccacttcctgatcgacggggagctctccaaggcgaacagcttcgacgccgccttctaccagatgaaggaggtgctgtgcaacgagctggacctcgagatcgacggcgagaacaccaccgaggtcgagcgcaccctgcgggaccgcaacatctccaagagcgacaaggtgaagctgctcgccgcgctgctggccatgaaccagaacgagacggagtccaaggagaccaagaagaagatcgagaacatctgcaagctcctggccgggaacaagggcgacatcagcaagatcttcgggcagacccccgagggcgtggagaagacctccttcagcttcggcgaggccgactacgacgagtccatccggcccaacctggaggagagcatcccggaccagtgcttcgtcatcgactccatcaaggccctctacgactggaacgtgctggcggacatcctgaacgggcagacgtacctcagctgcgccaaggtgaaccagtacgagacccacaagaacaacctgaaggagctgaagctcctggtcaaccgctactgcagccgggaggagtacaagcgcttcttcaagtccgccgtggagaaggccaactacagcaactacatcggctccgccaagcaggggaacaagatcatcgacgtgaagcgctgcgcggaggaggacttctacaaggagctgaagatcctcctgagcaagatcgagcccgaggaggccgaccgggagctgtacgagcgcatcaagcgggaggccgaggagggctccctcctgcccctgcagcgcaacaaggacaacagcgtcgtgcccaaccagatgcacaaggccgagctcgccctgatcctggagaacgcgggctcctacctcgggttcctgaacgagaaggacgaggacggcctgagcccggccgagaagatcatcgagctgttctccttccggatcccctactacgtggggcccctgagcgaccgccacaaggaccggggctccaacgcctggatcgtccgcaaggccgaggggcggatcctgccctggaacttcgacgagaaggtggaccgcgagaagtccaacgaggccttcatcgagcggatgaccaacaagtgcacctacctgctcggcaaggacgtggtcgcgaagaacagcctgatctacagccacttcatggtgctgaacgagctcaacaacctgtccgtgtgcggcaacaagatcagcgtccaggtgaagcaggacatctaccgcgagctgttccagcggcacacgaaggtctccaagaagatgctcctgcagtactgccgcgagaagatgatgaacaaggacctggaggaggaggacctcagcgggttcgacggcgacttcaaggccaagctgtccagctacctggacttcgagaagaaggtgttcggggccaagatggaggaggaccggatccgcaagatcaccgaggacatcatccggtggaagaccatctacggcgacgacgggaagatgctccaggccgtggtcgagaaggagtacccgggcgagctggacagcgaccagctgaaggcggtgaagcagttccgctactccggctgggggaacttcagcgaggagttcctcaacggcatcgtggggaccgagaagcccacgggccagatgttcaccatcatcgaggccctgtggcagaccaactgcaacctgatgcagctcctgtccaagaacttcaccttcatggaggagatcgagaagcacaaccgggagctggccgggcagatcacggacatcagctacgacaagctcgtcaaggacctgtacatctcccccgccaacaagcgcgccgtgtggcagaccgtgcgcatcgcggaggaggtcaagaagatcatgggctgcgagcccgccaagatcttcgtggagatggcccggggcggggagaaggagaagaagcgcaccatcagccggaagaagaagctgctcgagctgtacgccgcctgcaagaaggacgcgcgcgactggaaccgggagatcgaggaccgcgacgagcgggagttcaactccgacaagctgtacctctactacacccagatgggccgctgcatgtacagcggggagcggatcgacctgcacgagctgatgtccgccaacagcaagtgggacatcgaccacatctacccgcagtccaaggtgaaggacgacagcctcgacaaccgcgtcctgtccctgaagaagatcaacaacgagaagggcaacaagcccctcagccgggacatccagcagtcccagcagaagtggtggacggagctgctgcagctcgagttcatcaccaagaagaagtacgaccgcctgatgcaccggggcgagctgagcgaggaggagctctccgggttcatcaaccgccagctggtggagacccggcagagcaccaaggccgccgccgagctgctcggccgcatgtacaacaacagcaaggtggtctacgtgaaggcgcccctggtgtcccagttccggaaggacgacctgaacatcctcaagagccgcctggccaacgactaccaccacgccaaggacgcctacctgaacatcgcggtcgggaacgtgtacaacgagaagttcacggacaaccccctccggtggatcgagaagcacgccggcgagaactactccatcaaccgcgtgttcgactacgacatcgtcgccggggacggcgccccggtgtgggccgcgcccctgcgggacgagaagaacaagctgcgcaagaacgaggtgggcgagaagtacgggggcaccatcgacgtcatccgcaagaccgtgaagcggaacgacgtgctctacaccgagcacacgtactgcgggaagggcgagctgttcaacgccaccatcgccaagaaggacgggggcgccgagatccccctgaaggccggcctccagaccgggaagtacggcgggtacaagagccccaacacctcctacttcgcggccatcgagttcgacggcaagaagggggagcgcgtcaagaacatcatggaggtgccggtgtacatcgccaacatcctgctgcacgacatcgacgcctacatccggtactgcgagaccgtcaagggcctcaagaacgtgaagatcctgcgcccctgcatcaagaagaacgccctgatcagcgtggacggctaccccatgcggatccgcggggcgaacgagaagaacatcctcctgaagaacaacctgcagcccatcttcggccggcacgaggagacggtccgccggatcgagaagtacgtggagaagaaccaggagttcgaggtggacgagaagttcgacgggctcaacgaggccaacctgaccgacctgtacgacgacatcaccgagaagctctgcggcccgtacgtcgagcgcccctccaaccagggggagtacctgatggagaaccgggagaagttcctgaacatcagcctcaaggagaaggccaagctgctggcccagatgatcaagctcgtgcgctgcgacaccgagacgaaggcggacctgcggtccatcggcgccagcaagaacgccggcgtgatctccgtcaacaagaacaccctcgggggcaagcgcctcatcctgatcaaccagagcgtgaccgggctgttcgagaaccggatcgagctctga

SEQ ID NO: 1967 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcatcaccgacgactacaaggtcccggccaagaagatgcgcgtgctcgggaacacggacaaggagtacatcaagaagaacctgatcggcgccctgctgttcgacgggggcaacaccgcggccgaccggcgcctgaagcggaccgcccgccggcgctacacccggcgccggaaccgcatcctgtacctccaggagatcttcgccgaggagatgtccaaggtggacgacagcttcttccaccggctggaggactccttcctggtcgaggaggacaagcgcggcagcaagtaccccatcttcgccacgatgcaggaggagaagtactaccacgagaagttccccaccatctaccacctccggaaggagctggcggacaagaaggagaaggccgacctgcgcctcatctacctggccctggcccacatcatcaagttccgggggcacttcctcatcgaggacgaccgcttcgacgtgcggaacaccgacatccagaagcagtaccaggcgttcctggagatcttcgacaccacgttcgagaacaacgacctgctctcccagaacgtggacgtcgaggccatcctgaccgacaagatcagcaagtccgccaagaaggaccgcatcctggcccggtaccccaaccagaagtccaccggcatcttcgccgagttcctcaagctgatcgtggggaaccaggcggacttcaagaagcacttcaacctggaggacaagaccccgctccagttcgccaaggacagctacgacgaggacctggagaacctgctcggccagatcggggacgagttcgccgacctgttcagcgccgccaagaagctgtacgactccgtgctcctgagcggcatcctgacggtcaccgacctctccaccaaggcgcccctgagcgcctccatgatccagcgctacgacgagcaccgggaggacctgaagcagctcaagcagttcgtgaaggccagcctgcccgagaagtaccaggagatcttcgccgactccagcaaggacggctacgccgggtacatcgagggcaagaccaaccaggaggcgttctacaagtacctgagcaagctcctgacgaagcaggaggggtccgagtacctgctcgagaagatcaagaacgaggacttcctgcgcaagcagcgcaccttcgacaacggcagcatcccccaccaggtgcacctgaccgagctccgggccatcatccgccggcagtccgagtactacccgttcctgaaggagaacctggaccgcatcgagaagatcctcaccttccggatcccctactacgtcggccccctggcccgcgagaagtccgacttcgcctggatgacgcggaagaccgacgacagcatccgcccctggaacttcgaggacctggtggacaaggagaagtccgccgaggcgttcatccaccggatgaccaacaacgacctgtacctcccggaggagaaggtgctgcccaagcacagcctgatctacgagaagttcaccgtctacaacgagctcacgaaggtgcgcttcctggccgaggggttcaaggacttccagttcctgaaccggaagcagaaggagaccatcttcaacagcctcttcaaggagaagcgcaaggtgaccgagaaggacatcatctccttcctgaacaaggtcgacggctacgaggggatcgccatcaagggcatcgagaagcagttcaacgccagcctgtccacctaccacgacctcaagaagatcctggggaaggacttcctggacaacacggacaacgagctcatcctggaggacatcgtgcagaccctgaccctcttcgaggaccgggagatgatccgcaagcggctggacatctacaaggacttcttcaccgagagccagctgaagaagctctaccgccggcactacacgggctggggccgcctgtccgcgaagctgatcaacgggatccggaacaaggagaaccagaagaccatcctcgactacctgatcgacgacggcagcgccaaccgcaacttcatgcagctgatcaaggacgccgggctctccttcaagcccatcatcgacaaggcccgcaccggcagccactccgacaacctgaaggaggtggtcggggagctggccggcagccccgcgatcaagaagggcatcctccagtccctgaagatcgtggacgagctggtgaaggtcatggggtacgagccggagcagatcgtggtcgagatggcccgggagaaccagaccacggccaagggcctcagccgcagccggcagcgcctgaccaccctgcgggagtccctcgccaacctcaagagcaacatcctggaggagaagaagcccaagtacgtgaaggaccaggtggagaaccaccacctctccgacgaccgcctgttcctgtactacctccagaacgggaaggacatgtacaccgacgacgagctggacatcgacaacctgagccagtacgacatcgaccacatcatcccccaggccttcatcaaggacgactccatcgacaaccgggtcctcgtgagctccgcgaagaaccgcggcaagagcgacgacgtgccctccgtcgagatcgtgaaggactgcaaggtgttctggaagaagctgctggacgccaagctcatgagccagcggaagtacgacaacctgaccaaggccgagcgcgggggcctgacgtccgacgacaaggcccggttcatccagcgccagctcgtcgagacccggcagatcaccaagcacgtggcccgcatcctggacgagcggttcaacaacgagctggacagcaagggccgccggatccgcaaggtgaagatcgtcaccctcaagtccaacctggtgagcaacttccggaaggagttcgggttctacaagatccgcgaggtgaacaactaccaccacgcgcacgacgcctacctgaacgccgtcgtggccaaggcgatcctcacgaagtacccgcagctggagcccgagttcgtgtacggcgactaccccaagtacaactcctacaagacccgcaagagcgccaccgagaagctgttcttctactccaacatcatgaacttcttcaagaccaaggtcacgctcgccgacgggaccgtggtggtcaaggacgacatcgaggtgaacaacgacaccggcgagatcgtgtgggacaagaagaagcacttcgccaccgtccggaaggtgctgagctacccccaggtgaacatcgtcaagaagacggagatccagaccggcgggttcagcaaggagtccatcctggcccacggcaacagcgacaagctcatcccgcgcaagaccaaggacatctacctggaccccaagaagtacgggggcttcgactcccccatcgtggcgtacagcgtgctggtcgtggccgacatcaagaaggggaaggcccagaagctcaagaccgtgacggagctgctgggcatcaccatcatggagcggtcccgcttcgagaagaaccccagcgccttcctcgagtccaagggctacctgaacatccgggacgacaagctgatgatcctcccgaagtacagcctgttcgagctggagaacgggcgccggcgcctcctggcctccgcgggcgagctgcagaaggggaacgagctcgccctgcccacccagttcatgaagttcctgtacctcgccagccggtacaacgagctgaagggcaagcccgaggagatcgagcagaagcaggagttcgtcgtgcagcacgtgtcctacttcgacgacatcctgcagatcatcaacgacttcagcaaccgcgtcatcctcgccgacgccaacctggagaagatcaacaagctgtaccaggacaacaaggagaacatcccggtggacgagctcgcgaacaacatcatcaacctgttcaccttcacgtccctgggggcccccgccgccttcaagttcttcgacaagatcgtggaccggaagcgctacaccagcaccaaggaggtcctcaactccaccctgatccaccagagcatcacgggcctgtacgagacccggatcgacctcggcaagctgggggaggactga

SEQ ID NO: 1968 - RNA, 4113 nt, synthetic construct
  misc_feature 1..4113: note = Cas9 variant
  source 1..4113: mol_type = other RNA
atgaccaagatcaaggacgactacatcgtgggcctggacatcgggaccgacagctgcggctgggtcgccatgaactccaacaacgacatcctcaagctgcaggggaagacggccatcggcagccgcctgttcgagggcgggaagtccgcggccgagcggcgcctcttccggaccacccaccgccggatcaagcgccggcgctggcggctgaagctgctcgaggagttcttcgacccctacatggccgaggtggacccgtacttcttcgcccgcctgaaggagagcggcctgagccccctcgacaagcggaagaccgtgagctccatcgtcttccccacgagcgccgaggacaagaagttctacgacgactaccccaccatctaccacctccgctacaagctgatgaccgaggacgagaagttcgacctccgggaggtgtacctggcgatccaccacatcatcaagtaccgcgggaacttcctgtacaacacctccgtgaaggacttcaaggccagcaagatcgacgtcaagtccagcatcgagaagctcaacgagctgtacgagaacctgggcctcgacctgaacgtggagttcaacatctccaacacggccgagatcgagaaggtgctgaaggacaagcagatcttcaagcgggacaaggtcaagaagatcgccgagctgttcgcgatcaagaccgacaacaaggagcagagcaagcgcatcaaggacatctccaagcaggtcgccaacgccgtgctggggtacaagacccggttcgacaccatcgccctgaaggagatcagcaaggacgagctctccgactggaacttcaagctgagcgacatcgacgccgactccaagttcgaggcgctgatgggcaacctcgacgagaacgagcaggccatcctgctgacgatcaaggagctgttcaacgaggtgaccctcaacgggatcgtggaggacggcaacaccctgagcgagagcatgatcaacaagtacaacgaccaccgcgacgacctcaagctgctgaaggaggtgatcgagaaccacatcgaccggaagaaggccaaggagctcgccctggcctacgacctgtacgtcaacaaccgccacggccggctcctgcaggcgaagaagaagctggggaagatcaagccgcgctccaaggaggacttctacaaggtggtgaacaagaacctcgacgacagccgcgcctccaaggagatcaagaagaagatcgagctggacagcttcatgcccaagcagcggaccaacgccaacggcgtcatcccctaccagctgcagcagctcgagctggacaagatcatcgagaaccagtccaagtactaccccttcctgaaggagatcaacccggtgagctcccacctcaaggaggccccctacaagctggacgagctgatccgcttccgggtgccctactacgtcgggcccctgatcagcccgaacgagtccacgaaggacatccagaccaagaagaaccagaacttcgcctggatgatccgcaaggaggagggccggatcaccccctggaacttcgaccagaaggtggaccgcatcgagagcgcgaacaagttcatcaagcggatgaccacgaaggacacctacctcttcggcgaggacgtgctgcccgccaactccctgctctaccagaagttcaccgtcctgaacgagctgaacaacatccgcatcaacgggaagcggatcagcgtggacctcaagcaggagatctacgagaacctgttcaagaagcacaccacggtcaccgtgaagaagctggagaactacctcaaggagaaccacaacctggtgaaggtcgagatcaagggcctggccgacgagaagaagttcaactccgggctcaccacctacaaccgcttcaagaacctgaacatcttcgacaaccagatcgacgacctgaagtaccggaacgacttcgagaagatcatcgagtggagcacgatcttcgaggacaagtccatctacaaggagaagctccgcagcatcgactggctgaacgagaagcagatcaacgccctgtccaacatccggctccagggctgggggcgcctgagcaagaagctgctcgcccagctgcacgaccacaacggccagaccatcatcgagcagctgtgggactcccagaacaacttcatgcagatcgtgacccaggcggacttcaaggacgccatcgccaaggccaaccagaacctcctggtggcgaccagcgtcgaggacatcctgaacaacgcctacacgagccccgccaacaagaaggccatccgccaggtgatcaaggtggtcgacgacatcgtgaaggccgcgtccggcaaggtgccgaagcagatcgccatcgagttcacccgggacgccgacgagaaccccaagcggagccagacccgcgggtccaagctccagaaggtctacaaggacctgagcaccgagctggcctccaagacgatcgccgaggagctcaacgaggcgatcaaggacaagaagctggtgcaggacaagtactacctgtacttcatgcagctcggccgggacgcctacaccggggagcccatcaacatcgacgagatccagaagtacgacatcgaccacatcctgccccagagcttcatcaaggacgacgccctggacaaccgcgtgctcgtctcccgcgccgtgaacaacggcaagagcgacaacgtgccggtcaagctgttcgggaacgagatggccgcgaacctgggcatgaccatccggaagatgtgggaggagtggaagaacatcggcctcatctccaagaccaagtacaacaacctgctgaccgaccccgaccacatcaacaagtacaagagcgccgggttcatccgccggcagctcgtggagacgtcccagatcatcaagctggtgagcaccatcctgcagtcccgctaccccaacaccgagatcatcaccgtcaaggccaagtacaaccactacctccgggagaagttcgacctgtacaagagccgcgaggtgaacgactaccaccacgccatcgacgcgtacctgtccgccatctgcggcaacctcctgtaccagaactaccccaacctgcggccgttcttcgtgtacgggcagtacaagaagttcagctccgaccccgacaaggagaaggagatcttcaacaagacgcgcaagttcagcttcatcagccagatcctcaagaacaagtccgagaacagcaaggagatcgccgagaagctgaagcgggcctaccagttcaagtacatgctggtctcccgcgagaccgagaccaaggaccaggagatgttcaagatgaccgtgttcccccgggagacgcccggcaacctcatcccgaagaagaaggggatggcccccgagatctacggcggctacaccaagaacagcgacgcgtacatggtgatcgtcaagatcgacaagaagaaggagaccgagtaccgcatcctggggatccccacccgggagctggtgaacctcaagaaggccgagaaggaggaccactacgagtcctacctgaaggagatcctggccccgcgcatcctctacaacaagaacggcaagcgggacaagaagatcacgagcttcgagatcgtgaagtccaagatcccctacaagcaggtcatccaggacggggacaagaagttcatgctgggcagctccacctacgtgtacaacgccaagcagctgaccctcagcaccgagtccatgaaggccatcacgaacaacttcgacaaggacagcgacgagaacgacgcgctgatcaaggcctacgacgagatcctggacaaggtggacaagtacctccccctgttcgacatcaacgccttccgcaagaagctgcactccggccgggagaagttcgtcgagctcagcctggaggacaagaaggacatcatcctgaaggtgctcatcgggctgcacgacaaccccgccacctccgacctgaagaccctcggcttcagctccaccgagctggggaagatgcagaagaacagcggcatcgtgctgtccgggaacgccaagctcatctaccagagcccgacgggcctgttcaagaagtccgtcaagatctccgacctgtga

SEQ ID NO: 1969 - RNA, 4113 nt, synthetic construct
  misc_feature 1..4113: note = Cas9 variant
  source 1..4113: mol_type = other RNA
atgaccaagatcaaggacgactacatcgtgggcctggacatcgggaccgacagctgcggctgggtcgccatgaactccgacaacgacatcctcaagctgcaggggaagacggccatcggcagccacctgttcgaggcggggaagtccgccgccgaccgccgcctcttccggaccacccaccggcgcatcaagcggcgccggtggcgcctgaagctgctcgaggagttcttcgacccctacatggccaaggtggacccgtacttcttcgcccggctgaaggagagcggcctgagccccctcgacaagcgcaagaacgtgttctccatcgtcttccccaccgcggccgaggacaagaagttctacgacgactaccccacgatctaccacctccggtacaagctgatgaccgaggacgagaagttcgacctccgcgaggtgtacctggccatccaccacatcatcaagtaccggggcaacttcctgtacaacacctccgtgaaggacttcaaggccagcaagatcgacgtcaagtccagcatcgagaagctcaacgagctgtacgagaacctggggctcgacctgaacgtggagttcaacatctccaacaccgcggagatcgagaaggtgctgaaggacaagcagatcttcaagcgcgacaaggtcaagaagatcgccgagctgttcgccatcaagacggacaacaaggagcagagcaagcggatcaaggacatctccaagcaggtcgccaacgccgtgctgggctacaagacccgcttcgacaccatcgcgctgaaggaggtgagcaaggacgagctctccgactggaacttcaagctgagcgacatcgacgccgactccaagttcgaggccctgatggggaacctcgacgagaacgagcaggccatcctgctgaccatcaaggagctgttcaacgccgtgacgctcaacggcatcgtggaggacgggaacaccctgagcgagtccatgatcaacaagtacaacgaccaccgggacgacctcaagctgctgaaggaggtcatcgagaaccacatcgaccgcaagaaggcggtgaagctcgccctggcctacgacctgtacgtgaacaaccggcacggccagctcatccaggccaagaagaagctgggcaagatcaagccggggagcaaggaggacttctacaaggtcgtgaacaagaacctggacgacagccaggcctccaaggagatcaagaagaagatcgagctcgacagcttcatgcccaagcagcgcaccaacgcgaacggcgtgatcccctaccagctgcaccagctggagctcgacaagatcatcgagaaccagtccaagtactaccccttcctgaaggagatcaacccggtcagctcccacctgaaggaggccccctacaagctcgacgagctgatccggttccgcgtgccctactacgtggggcccctgatcagcccgaacgagtccaccaaggacatccagacgaagaagaaccagaacttcgcctggatgatccgcaaggaggagggccggatcaccccctggaacttcgaccagaaggtcgaccgcatcgagagcgccaacaagttcatcaagcggatgaccaccaaggacacgtacctgttcggcgagaacgtgctccccgccaactccctgctgtaccagaagttcaccgtcctcaacgagctgaacaacatccgcatcaacgggaagcggatcagcgtggacctgaagcaggagatctacgagaacctcttcaagaagcacaccaccgtgacggtcaagaagctggagaactacctgaagcagaaccacaacctcgtgaaggtggagatcaagggcctggcggacgagaagaagttcaactccgggctgaccacctacaaccgcttcaagaacctcaacatcttcgacaaccagatcgacgacctgaagtaccggaaggacttcgagaagatcatcgagtggagcaccatcttcgaggacaagtccatctacaaggagaagctgcgcagcatcgactggctcaacgagaagcagatcaacgccctgtccaacatccggctgcagggctgggggcgcctcagcaagaagctgctggcccagctccacgaccacaacggccagacgatcatcgagcagctgtgggactcccagaacaacttcatgcagatcgtcacccaggccgacttcaaggacgcgatcgccaaggccaaccagaacctgctcgtggccaccagcgtggaggacatcctgaacgacgcctacacctcccccgcgaacaagaaggccatccggcaggtcatcaaggtggtggacgacatcgtcaaggccgccagcggcaaggtgccgaagcagatcgccatcgagttcacgcgcgacgcggacgacaaccccaagcggagccagacccgcgggtccaagctgcagaaggtgtacaaggacctcagcaccgagctggcctccaaggccatcgccgaggagctgaacgaggccatcaaggacaagaagctcgtccaggacaagtactacctgtacttcatgcagctgggccgggacgcgtacaccggggagcccatcaacatcgacgagatccagaagtacgacatcgaccacatcctcccccagagcttcatcaaggacgacgccctggacaaccgcgtgctggtgtccaaggccgtcaacaacgacaagagcgacaacgtgccggtgaagctgttcggcaacgagatggccgggaacctcggcatcacgatccggaagatgtgggaggagtggaagaacatcggcctgatctccaagaccaagtacaacaacctcctgaccgaccccgaccacatcaacaagtacgagagcgcggggttcatccgccggcagctggtcgagacctcccagatcatcaagctcgtgagcaccatcctgcagtcccgctaccccaacacggagatcatcaccgtgaaggccaagtacaaccactacctgcgcgagaagttcgacctctacaagagccgggaggtcaacgactaccaccacgccatcgacgcctacctgtccgccatctgcggcaacctgctctaccagaactaccccaacctgcgcccgttcttcgtgtacgggcagtacaagaagttcagctccgaccccgacaaggagaaggagatcttcaacaagacccggaagttcagcttcatctcccagatcctgaagaacaagagcgagaacagcaaggagatcgcggagaagctcaagcgcgcctaccagttcaagtacatgctggtgtcccgggagaccgagacgaaggaccaggagatgttcaagatgaccgtcttcccccgcgagacccccggcaacctgatcccgaagaagaaggggatggccaccgagatctacggcggctacacgaagaacagcgacgcctacatggtgatcgtgaagatcgacaagaagaaggagaccgagtaccggatcctcgggatccccacccgcgagctggtcaacctgaagaaggccgagaaggaggaccactacgagtcctacctcaaggagatcctggcgccccggatcctgtacaacaagaacggcaagcgcgacaagaagatcaccagcttcgagatcgtgaagtccaagatcccgtacaagcaggtcatccaggacggggacaagaagttcatgctcggcagctccacgtacgtgtacaacgccaagcagctgaccctgagcaccgagtccatgaaggccatcaccaacaacttcgacaaggacagcgacgagaacgacgccctcatcaaggcctacgacgagatcctggacaaggtggacaagtacctgcccctcttcgacatcaacgcgttccggaagaagctgcactccggccgcgagaagttcgtggagctgagcctcgaggacaagaaggacatcatcctgaaggtcctgatcgggctccacgacaaccccgccacgtccgacctgaagaccctgggcttcagctccaccgagctcgggaagatgcagaagaacagcggcatcgtgctgtccgggaacgccaagctgatctaccagagccccaccggcctcttcaagaagtccgtgaagatcagcgacctgtga

SEQ ID NO: 1970 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcatcaccgacgactacaaggtcccggccaagaagatgcgcgtgctcgggaacacggacaaggagtacatcaagaagaacctgatcggcgccctgctgttcgacgggggcaacaccgcggccgaccggcgcctgaagcggaccgcccgccggcgctacacccggcgccggaaccgcatcctgtacctccaggagatcttcgccgaggagatgtccaaggtggacgacagcttcttccaccggctggaggactccttcctggtcgaggaggacaagcgcggcagcaagtaccccatcttcgccacgatgcaggaggagaagtactaccacgagaagttccccaccatctaccacctccggaaggagctggcggacaagaaggagaaggccgacctgcgcctcatctacctggccctggcccacatcatcaagttccgggggcacttcctcatcgaggacgaccgcttcgacgtgcggaacaccgacatccagaagcagtaccaggcgttcctggagatcttcgacaccacgttcgagaacaacgacctgctctcccagaacgtggacgtcgaggccatcctgaccgacaagatcagcaagtccgccaagaaggaccgcatcctggcccggtaccccaaccagaagtccaccggcatcttcgccgagttcctcaagctgatcgtggggaaccaggcggacttcaagaagcacttcaacctggaggacaagaccccgctccagttcgccaaggacagctacgacgaggacctggagaacctgctcggccagatcggggacgagttcgccgacctgttcagcgccgccaagaagctgtacgactccgtgctcctgagcggcatcctgacggtcaccgacctctccaccaaggcgcccctgagcgcctccatgatccagcgctacgacgagcaccgggaggacctgaagcagctcaagcagttcgtgaaggccagcctgcccgagaagtaccaggagatcttcgccgactccagcaaggacggctacgccgggtacatcgagggcaagaccaaccaggaggcgttctacaagtacctgagcaagctcctgacgaagcaggaggggtccgagtacctgctcgagaagatcaagaacgaggacttcctgcgcaagcagcgcaccttcgacaacggcagcatcccccaccaggtgcacctgaccgagctccgggccatcatccgccggcagtccgagtactacccgttcctgaaggagaacctggaccgcatcgagaagatcctcaccttccggatcccctactacgtcggccccctggcccgcgagaagtccgacttcgcctggatgacgcggaagaccgacgacagcatccgcccctggaacttcgaggacctggtggacaaggagaagtccgccgaggcgttcatccaccggatgaccaacaacgacctgtacctcccggaggagaaggtgctgcccaagcacagcctgatctacgagaagttcaccgtctacaacgagctcacgaaggtgcgcttcctggccgaggggttcaaggacttccagttcctgaaccggaagcagaaggagaccatcttcaacagcctcttcaaggagaagcgcaaggtgaccgagaaggacatcatctccttcctgaacaaggtcgacggctacgaggggatcgccatcaagggcatcgagaagcagttcaacgccagcctgtccacctaccacgacctcaagaagatcctggggaaggacttcctggacaacacggacaacgagctcatcctggaggacatcgtgcagaccctgaccctcttcgaggaccgggagatgatccgcaagcggctggacatctacaaggacttcttcaccgagagccagctgaagaagctctaccgccggcactacacgggctggggccgcctgtccgcgaagctgatcaacgggatccggaacaaggagaaccagaagaccatcctcgactacctgatcgacgacggcagcgccaaccgcaacttcatgcagctgatcaaggacgccgggctctccttcaagcccatcatcgacaaggcccgcaccggcagccactccgacaacctgaaggaggtggtcggggagctggccggcagccccgcgatcaagaagggcatcctccagtccctgaagatcgtggacgagctggtgaaggtcatggggtacgagccggagcagatcgtggtcgagatggcccgggagaaccagaccacggccaagggcctcagccgcagccggcagcgcctgaccaccctgcgggagtccctcgccaacctcaagagcaacatcctggaggagaagaagcccaagtacgtgaaggaccaggtggagaaccaccacctctccgacgaccgcctgttcctgtactacctccagaacgggaaggacatgtacaccgacgacgagctggacatcgacaacctgagccagtacgacatcgaccacatcatcccccaggccttcatcaaggacgactccatcgacaaccgggtcctcgtgagctccgcgaagaaccgcggcaagagcgacgacgtgccctccgtcgagatcgtgaaggactgcaaggtgttctggaagaagctgctggacgccaagctcatgagccagcggaagtacgacaacctgaccaaggccgagcgcgggggcctgacgtccgacgacaaggcccggttcatccagcgccagctcgtcgagacccggcagatcaccaagcacgtggcccgcatcctggacgagcggttcaacaacgagctggacagcaagggccgccggatccgcaaggtgaagatcgtcaccctcaagtccaacctggtgagcaacttccggaaggagttcgggttctacaagatccgcgaggtgaacaactaccaccacgcgcacgacgcctacctgaacgccgtcgtggccaaggcgatcctcacgaagtacccgcagctggagcccgagttcgtgtacggcgactaccccaagtacaactcctacaagacccgcaagagcgccaccgagaagctgttcttctactccaacatcatgaacttcttcaagaccaaggtcacgctcgccgacgggaccgtggtggtcaaggacgacatcgaggtgaacaacgacaccggcgagatcgtgtgggacaagaagaagcacttcgccaccgtccggaaggtgctgagctacccccaggtgaacatcgtcaagaagacggagatccagaccggcgggttcagcaaggagtccatcctggcccacggcaacagcgacaagctcatcccgcgcaagaccaaggacatctacctggaccccaagaagtacgggggcttcgactcccccaaggtggcgtacagcgtgctggtcgtggccgacatcaagaaggggaaggcccagaagctcaagaccgtgacggagctgctgggcatcaccatcatggagcggtcccgcttcgagaagaaccccagcgccttcctcgagtccaagggctacctgaacatccgggacgacaagctgatgatcctcccgaagtacagcctgttcgagctggagaacgggcgccggcgcctcctggcctccgcgggcgagctgcagaaggggaacgagctcgccctgcccacccagttcatgaagttcctgtacctcgccagccggtacaacgagctgaagggcaagcccgaggagatcgagcagaagcaggagttcgtcgtgcagcacgtgtcctacttcgacgacatcctgcagatcatcaacgacttcagcaaccgcgtcatcctcgccgacgccaacctggagaagatcaacaagctgtaccaggacaacaaggagaacatcccggtggacgagctcgcgaacaacatcatcaacctgttcaccttcacgtccctgggggcccccgccgccttcaagttcttcgacaagatcgtggaccggaagcgctacaccagcaccaaggaggtcctcaactccaccctgatccacaagagcatcacgggcctgtacgagacccggatcgacctcggcaagctgggggaggactga

SEQ ID NO: 1971 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcatcaccgacgactacaaggtcccggccaagaagatgcgcgtgctcgggaacacggacaaggagtacatcaagaagaacctgatcggcgccctgctgttcgacgggggcaacaccgcggccgaccggcgcctgaagcggaccgcccgccggcgctacacccggcgccggaaccgcatcctgtacctccaggagatcttcgccgaggagatgtccaaggtggacgacagcttcttccaccggctggaggactccttcctggtcgaggaggacaagcgcggcagcaagtaccccatcttcgccacgctccaggaggagaaggactaccacgagaagttctccaccatctaccacctccggaaggagctggcggacaagaaggagaaggccgacctccgcctgatctacatcgccctggcccacatcatcaagttccgggggcacttcctcatcgaggacgacagcttcgacgtgcgcaacaccgacatctccaagcagtaccaggacttcctggagatcttcaacaccacgttcgagaacaacgacctgctcagccagaacgtggacgtcgaggcgatcctgaccgacaagatctccaagagcgccaagaaggaccggatcctggcccagtaccccaaccagaagtccaccggcatcttcgccgagttcctcaagctgatcgtggggaaccaggccgacttcaagaagtacttcaacctggaggacaagacgcccctccagttcgcgaaggacagctacgacgaggacctggagaacctgctcggccagatcggggacgagttcgccgacctgttctccgccgccaagaagctgtacgacagcgtgctcctgtccggcatcctgacggtcatcgacctcagcaccaaggccccgctgtccgcgagcatgatccagcgctacgacgagcaccgggaggacctgaagcagctcaagcagttcgtgaaggccagcctgcccgagaagtaccaggagatcttcgccgactccagcaaggacggctacgccgggtacatcgagggcaagaccaaccaggaggccttctacaagtacctgtccaagctcctgaccaagcaggaggacagcgagaacttcctggagaagatcaagaacgaggacttcctccgcaagcagcggacgttcgacaacgggtccatcccccaccaggtgcacctgaccgagctgaaggcgatcatccgccgccagagcgagtactaccccttcctcaaggagaaccaggaccggatcgagaagatcctgaccttccgcatcccgtactacatcggccccctggcccgggagaagtccgacttcgcctggatgacccgcaagacggacgacagcatccggccctggaacttcgaggacctcgtcgacaaggagaagtccgccgaggccttcatccaccgcatgaccaacaacgacttctacctgcccgaggagaaggtgctgccgaagcacagcctgatctacgagaagttcaccgtgtacaacgagctcaccaaggtccggtacaagaacgagcagggcgagacgtacttcttcgactccaacatcaagcaggagatcttcgacggggtgttcaaggagcaccgcaaggtgagcaagaagaagctgctggacttcctcgcgaaggagtacgaggagttccggatcgtcgacgtgatcggcctggacaaggagaacaaggccttcaacgcctccctggggacctaccacgacctcgagaagatcctggacaaggacttcctggacaaccccgacaacgagagcatcctcgaggacatcgtgcagaccctgaccctgttcgaggaccgcgagatgatcaagaagcggctcgagaactacaaggacctgttcacggagtcccagctgaagaagctctaccgccggcactacaccggctgggggcgcctgagcgccaagctgatcaacggcatccgggacaaggagtcccagaagaccatcctcgactacctgatcgacgacggccgcagcaaccggaacttcatgcagctgatcaacgacgacgggctctccttcaagagcatcatcagcaaggcgcaggccggctcccacagcgacaacctgaaggaggtcgtgggggagctggccggctcccccgccatcaagaaggggatcctccagagcctgaagatcgtggacgagctggtcaaggtgatgggctacgagcccgagcagatcgtcgtggagatggcccgcgagaaccagaccacgaaccagggccggcgcaactcccgccagcggtacaagctcctggacgacggggtgaagaacctggcgagcgacctcaacggcaacatcctgaaggagtacccgaccgacaaccaggccctgcagaacgagcgcctcttcctgtactacctgcagaacgggcgggacatgtacaccggcgaggccctcgacatcgacaacctgtcccagtacgacatcgaccacatcatcccccaggccttcatcaaggacgacagcatcgacaaccgcgtcctggtgtccagcgccaagaaccgggggaagtccgacgacgtgcccagcctcgagatcgtcaaggactgcaaggtgttctggaagaagctgctggacgcgaagctcatgtcccagcgcaagtacgacaacctgaccaaggccgagcggggcggcctgacgagcgacgacaaggcccgcttcatccagcggcagctcgtggagacccgccagatcaccaagcacgtcgcccggatcctggacgagcgcttcaacaacgagctggactccaaggggcggcgcatccggaaggtgaagatcgtgaccctcaagagcaacctggtctccaacttccgcaaggagttcggcttctacaagatccgggaggtgaacaactaccaccacgcccacgacgcgtacctgaacgccgtggtcgccaaggccatcctcaccaagtacccccagctggagccggagttcgtgtacggggactaccccaagtacaacagctacaagacgcgcaagagcgcgaccgagaagctgttcttctactccaacatcatgaacttcttcaagaccaaggtgaccctcgccgacggcacggtcgtggtgaaggacgacatcgaggtcaacaacgacaccggcgagatcgtgtgggacaagaagaagcacttcgccaccgtgcggaaggtcctgagctacccccagaacaacatcgtgaagaagaccgagatccagaccgggggcttctccaaggagagcatcctggcccacgggaactccgacaagctcatcccccgcaagaccaaggacatctacctggacccgaagaagtacggcgggttcgacagccccatcgtggcctactccgtcctggtggtggcggacatcaagaagggcaaggcccagaagctcaagaccgtcaccgagctgctgggcatcacgatcatggagcggagccgcttcgagaagaacccctccgccttcctcgagagcaaggggtacctgaacatccgcgccgacaagctgatcatcctccccaagtactccctgttcgagctggagaacggccggcgccggctcctggccagcgcgggggagctgcagaagggcaacgagctcgccctgccgacccagttcatgaagttcctgtacctcgcctcccgctacaacgagagcaaggggaagcccgaggagatcgagaagaagcaggagttcgtgaaccagcacgtgtcctacttcgacgacatcctgcagctgatcaacgacttcagcaagcgggtcatcctcgccgacgccaacctggagaagatcaacaagctgtaccaggacaacaaggagaacatctccgtggacgagctcgcgaacaacatcatcaacctgttcaccttcaccagcctgggcgcccccgccgccttcaagttcttcgacaagatcgtggaccgcaagcggtacacgtccaccaaggaggtcctcaacagcaccctgatccaccagagcatcaccggcctgtacgagacgcgcatcgacctcgggaagctgggcgaggactga

SEQ ID NO: 1972 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcatcaccgacgactacaaggtcccggccaagaagatgcgcgtgctcgggaacacggacaaggagtacatcaagaagaacctgatcggcgccctgctgttcgacgggggcaacaccgcggccgaccggcgcctgaagcggaccgcccgccggcgctacacccggcgccggaaccgcatcctgtacctccaggagatcttcgccgaggagatgtccaaggtggacgacagcttcttccaccggctggaggactccttcctggtcgaggaggacaagcgcggcagcaagtaccccatcttcgccacgctccaggaggagaaggactaccacgagaagttctccaccatctaccacctccggaaggagctggcggacaagaaggagaaggccgacctccgcctgatctacatcgccctggcccacatcatcaagttccgggggcacttcctcatcgaggacgacagcttcgacgtgcgcaacaccgacatctccaagcagtaccaggacttcctggagatcttcaacaccacgttcgagaacaacgacctgctcagccagaacgtggacgtcgaggcgatcctgaccgacaagatctccaagagcgccaagaaggaccggatcctggcccagtaccccaaccagaagtccaccggcatcttcgccgagttcctcaagctgatcgtggggaaccaggccgacttcaagaagtacttcaacctggaggacaagacgcccctccagttcgcgaaggacagctacgacgaggacctggagaacctgctcggccagatcggggacgagttcgccgacctgttctccgccgccaagaagctgtacgacagcgtgctcctgtccggcatcctgacggtcatcgacctcagcaccaaggccccgctgtccgcgagcatgatccagcgctacgacgagcaccgggaggacctgaagcagctcaagcagttcgtgaaggccagcctgcccgagaagtaccaggagatcttcgccgactccagcaaggacggctacgccgggtacatcgagggcaagaccaaccaggaggccttctacaagtacctgtccaagctcctgaccaagcaggaggacagcgagaacttcctggagaagatcaagaacgaggacttcctccgcaagcagcggacgttcgacaacgggtccatcccccaccaggtgcacctgaccgagctgaaggcgatcatccgccgccagagcgagtactaccccttcctcaaggagaaccaggaccggatcgagaagatcctgaccttccgcatcccgtactacatcggccccctggcccgggagaagtccgacttcgcctggatgacccgcaagacggacgacagcatccggccctggaacttcgaggacctcgtcgacaaggagaagtccgccgaggccttcatccaccgcatgaccaacaacgacttctacctgcccgaggagaaggtgctgccgaagcacagcctgatctacgagaagttcaccgtgtacaacgagctcaccaaggtccggtacaagaacgagcagggcgagacgtacttcttcgactccaacatcaagcaggagatcttcgacggggtgttcaaggagcaccgcaaggtgagcaagaagaagctgctggacttcctcgcgaaggagtacgaggagttccggatcgtcgacgtgatcggcctggacaaggagaacaaggccttcaacgcctccctggggacctaccacgacctcgagaagatcctggacaaggacttcctggacaaccccgacaacgagagcatcctcgaggacatcgtgcagaccctgaccctgttcgaggaccgcgagatgatcaagaagcggctcgagaactacaaggacctgttcacggagtcccagctgaagaagctctaccgccggcactacaccggctgggggcgcctgagcgccaagctgatcaacggcatccgggacaaggagtcccagaagaccatcctcgactacctgatcgacgacggccgcagcaaccggaacttcatgcagctgatcaacgacgacgggctctccttcaagagcatcatcagcaaggcgcaggccggctcccacagcgacaacctgaaggaggtcgtgggggagctggccggctcccccgccatcaagaaggggatcctccagagcctgaagatcgtggacgagctggtcaaggtgatgggctacgagcccgagcagatcgtcgtggagatggcccgcgagaaccagaccacgaaccagggccggcgcaactcccgccagcggtacaagctcctggacgacggggtgaagaacctggcgagcgacctcaacggcaacatcctgaaggagtacccgaccgacaaccaggccctgcagaacgagcgcctcttcctgtactacctgcagaacgggcgggacatgtacaccggcgaggccctcgacatcgacaacctgtcccagtacgacatcgaccacatcatcccccaggccttcatcaaggacgacagcatcgacaaccgcgtcctggtgtccagcgccaagaaccgggggaagtccgacgacgtgcccagcctcgagatcgtcaaggactgcaaggtgttctggaagaagctgctggacgcgaagctcatgtcccagcgcaagtacgacaacctgaccaaggccgagcggggcggcctgacgagcgacgacaaggcccgcttcatccagcggcagctcgtggagacccgccagatcaccaagcacgtcgcccggatcctggacgagcgcttcaacaacgagctggactccaaggggcggcgcatccggaaggtgaagatcgtgaccctcaagagcaacctggtctccaacttccgcaaggagttcggcttctacaagatccgggaggtgaacaactaccaccacgcccacgacgcgtacctgaacgccgtggtcgccaaggccatcctcaccaagtacccccagctggagccggagttcgtgtacggggactaccccaagtacaacagctacaagacgcgcaagagcgcgaccgagaagctgttcttctactccaacatcatgaacttcttcaagaccaaggtgaccctcgccgacggcacggtcgtggtgaaggacgacatcgaggtcaacaacgacaccggcgagatcgtgtgggacaagaagaagcacttcgccaccgtgcggaaggtcctgagctacccccagaacaacatcgtgaagaagaccgagatccagaccgggggcttctccaaggagagcatcctggcccacgggaactccgacaagctcatcccccgcaagaccaaggacatctacctggacccgaagaagtacggcgggttcgacagccccatcgtggcctactccgtcctggtggtggcggacatcaagaagggcaaggcccagaagctcaagaccgtcaccgagctgctgggcatcacgatcatggagcggagccgcttcgagaagaacccctccgccttcctcgagagcaaggggtacctgaacatccgcgacgacaagctgatgatcctccccaagtactccctgttcgagctggagaacggccggcgccggctcctggccagcgccggggagctgcagaagggcaacgagctcgcgctgccgacccagttcatgaagttcctgtacctcgcctcccgctacaacgagagcaaggggaagcccgaggagatcgagaagaagcaggagttcgtgaaccagcacgtgtcctacttcgacgacatcctgcagctgatcaacgacttcagcaagcgggtcatcctcgccgacgccaacctggagaagatcaacaagctgtaccaggacaacaaggagaacatctccgtggacgagctcgccaacaacatcatcaacctgttcaccttcaccagcctgggcgcgcccgccgccttcaagttcttcgacaagatcgtggaccgcaagcggtacacgtccaccaaggaggtcctcaacagcaccctgatccaccagagcatcaccggcctgtacgagacgcgcatcgacctcgggaagctgggcgaggactga

SEQ ID NO: 1973 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcatcaccgacgactacaaggtcccggccaagaagatgcgcgtgctcgggaacacggacaaggagtacatcaagaagaacctgatcggcgccctcctcttcgacgggggcaacaccgcggccgaccggcgcctgaagcggaccgcccgccggcgctacacccggcgccggaaccgcatcctgtacctccaggagatcttcgccgaggagatgtccaaggtggacgacagcttcttccaccggctggaggactccttcctggtcgaggaggacaagcgcggcagcaagtaccccatcttcgccacgatgcaggaggagaagtactaccacgagaagttccccaccatctaccacctccggaaggagctggcggacaagaaggagaaggccgacctgcgcctcatctacctggccctggcccacatcatcaagttccgggggcacttcctcatcgaggacgaccgcttcgacgtgcggaacaccgacatccagaagcagtaccaggcgttcctggagatcttcgacaccacgttcgagaacaacgacctgctctcccagaacgtggacgtcgaggccatcctgaccgacaagatcagcaagtccgccaagaaggaccgcatcctggcccggtaccccaaccagaagtccaccggcatcttcgccgagttcctcaagctgatcgtggggaaccaggcggacttcaagaagcacttcaacctggaggacaagaccccgctccagttcgccaaggacagctacgacgaggacctggagaacctgctcggccagatcggggacgagttcgccgacctgttcagcgccgccaagaagctgtacgactccgtgctcctgagcggcatcctgacggtcaccgacctctccaccaaggcgcccctgagcgcctccatgatccagcgctacgacgagcaccgggaggacctgaagcagctcaagcagttcgtgaaggccagcctgcccgagaagtaccaggagatcttcgccgactccagcaaggacggctacgccgggtacatcgagggcaagaccaaccaggaggcgttctacaagtacctgagcaagctcctgacgaagcaggaggggtccgagtacctgctcgagaagatcaagaacgaggacttcctgcgcaagcagcgcaccttcgacaacggcagcatcccccaccaggtgcacctgaccgagctccgggccatcatccgccggcagtccgagtactacccgctgctgaaggagaacctcgaccgcatcgagaagatcctgaccttccggatcccctactacgtcggccccctggcccgcgagaagtccgacttcgcctggatgacgcggaagaccgacgacagcatccgcccctggaacttcgaggacctggtggacaaggagaagtccgccgaggcgttcatccaccggatgaccaacaacgacctctacctgccggaggagaaggtgctgcccaagcacagcctcatctacgagaagttcaccgtctacaacgagctgacgaaggtgcgcttcctggccgaggggttcaaggacttccagttcctcaaccggaagcagaaggagaccatcttcaacagcctgttcaaggagaagcgcaaggtgaccgagaaggacatcatctccttcctgaacaaggtcgacggctacgaggggatcgccatcaagggcatcgagaagcagttcaacgccagcctctccacctaccacgacctgaagaagatcctggggaaggacttcctcgacaacacggacaacgagctgatcctggaggacatcgtgcagaccctcaccctgttcgaggaccgggagatgatccgcaagcggctggacatctacaaggacttcttcaccgagagccagctcaagaagctgtaccgccggcactacacgggctggggccgcctgtccgcgaagctcatcaacgggatccggaacaaggagaaccagaagaccatcctggactacctgatcgacgacggcagcgccaaccgcaacttcatgcagctcatcaaggacgccgggctgtccttcaagcccatcatcgacaaggcccgcaccggcagccactccgacaacctgaaggaggtggtcggggagctcgccggcagccccgcgatcaagaagggcatcctgcagtccctgaagatcgtggacgagctcgtgaaggtcatggggtacgagccggagcagatcgtggtcgagatggcccgggagaaccagaccacggccaagggcctgagccgcagccggcagcgcctgaccaccctccgggagtccctggccaacctcaagagcaacatcctggaggagaagaagcccaagtacgtgaaggaccaggtggagaaccaccacctgtccgacgaccgcctgttcctctactacctgcagaacgggaaggacatgtacaccgacgacgagctggacatcgacaacctcagccagtacgacatcgaccacatcatcccccaggccttcatcaaggacgactccatcgacaaccgggtcctggtgagctccgcgaagaaccgcggcaagagcgacgacgtgccctccgtcgagatcgtgaaggactgcaaggtgttctggaagaagctgctcgacgccaagctgatgagccagcggaagtacgacaacctgaccaaggccgagcgcgggggcctcacgtccgacgacaaggcccggttcatccagcgccagctggtcgagacccggcagatcaccaagcacgtggcccgcatcctggacgagcggttcaacaacgagctcgacagcaagggccgccggatccgcaaggtgaagatcgtcaccctgaagtccaacctggtgagcaacttccggaaggagttcgggttctacaagatccgcgaggtgaacaactaccaccacgcgcacgacgcctacctcaacgccgtcgtggccaaggcgatcctgacgaagtacccgcagctggagcccgagttcgtgtacggcgactaccccaagtacaactcctacaagacccgcaagagcgccaccgagaagctgttcttctactccaacatcatgaacttcttcaagaccaaggtcacgctggccgacgggaccgtggtggtcaaggacgacatcgaggtgaacaacgacaccggcgagatcgtgtgggacaagaagaagcacttcgccaccgtccggaaggtgctgagctacccccaggtgaacatcgtcaagaagacggagatccagaccggcgggttcagcaaggagtccatcctcgcccacggcaacagcgacaagctgatcccgcgcaagaccaaggacatctacctggaccccaagaagtacgggggcttcgactcccccatcgtggcgtacagcgtgctcgtcgtggccgacatcaagaaggggaaggcccagaagctgaagaccgtgacggagctgctcggcatcaccatcatggagcggtcccgcttcgagaagaaccccagcgccttcctggagtccaagggctacctggacatccgggacgacaagctcatgatcctgccgaagtacagcctgttcgagctcgagaacgggcgccggcgcctgctggcctccgcgggcgagctccagaaggggaacgagctggccctgcccacccagttcatgaagttcctctacctggccagccggtacaacgagctgaagggcaagcccgaggagatcgagcagaagcaggagttcgtcgtgcagcacgtgtcctacttcgacgacatcctccagatcatcaacgacttcagcaaccgcgtcatcctggccgacgccaacctggagaagatcaacaagctctaccaggacaacaaggagaacatcccggtggacgagctggcgaacaacatcatcaacctgttcaccttcacgtccctcggggcccccgccgccttcaagttcttcgacaagatcgtggaccggaagcgctacaccagcaccaaggaggtcctgaactccaccctgatccaccagagcatcacgggcctctacgagacccggatcgacctgggcaagctgggggaggactga

SEQ ID NO: 1974 - RNA, 4113 nt, synthetic construct
  misc_feature 1..4113: note = Cas9 variant
  source 1..4113: mol_type = other RNA
atgaagaagccctacagcatcggcctggacatcgggaccaactccgtgggctgggccgtcgtgaccgacgactacaaggtgccggccaagaagatgcgcgtcttcggggacacggaccggagccacatcaagaagaacctcctgggcaccctcctcttcgacgacgggaacaccgcggagtcccgccggctgaagcgcaccgcccggcgccggtacacgcgccggcgcaaccggatcctgtacctccaggagatcttcaccgagagcatgaacgagatcgacgagtccttcttccaccgcctggacgacagcttcctggtgcccgaggacaagcggggctccaagtaccccatcttcgccaccctccaggaggagaaggagtaccacaagcagttccccaccatctaccacctccgcaagcagctggccgacagcaaggagaagtccgacgtgcggctcatctacctggccctggcgcacatgatcaagtaccgcggccacttcctctacgaggagacgttcgacatcaagaacaacgacatccagaagatcttcaacgagttcatcaacatctacgacaacaccttcgaggggagctccctgagcggccagaacgcccaggtcgaggccatcttcaccgacaagatctccaagagcgccaagcgggagcgcgtgctgaagctgttcccggacgagaagtccaccgggctgttcagcgagttcctgaagctcatcgtgggcaaccaggcggacttcaagaagcacttcgacctggaggagaaggccccgctgcagttctccaaggacacgtacgacgaggagctcgagaacctgctggggcagatcggcgacgacttcgccgacctcttcctgatcgccaagaagctgtacgacgccatcctcctgagcggcatcctgaccgtcaccgacccctccaccaaggcgcccctcagcgccagcatgatcgagcggtacgagaaccaccagaaggacctggccgccctgaagcagttcatcaagaacaacctcccggagaagtacgtggaggtgttctccgaccagagcaaggacgggtacgccggctacatcgacgggaagacgacccaggaggcgttctacaagtacatcaagaacctgctgtccaagttcgagggcgccgactacttcctcgacaagatcgagcgcgaggacttcctgcggaagcagcgcaccttcgacaacggcagcatcccccaccagatccacctccaggagatgaacgccatcctgcgccggcagggggagcactaccccttcctgaaggagaaccgcgagaagatcgagaagatcctgaccttccggatcccctactacgtcggcccgctcgcccgcgacaaccgggacttctcctggctgacgcgcaacagcgacgagcccatccggccctggaacttcgaggaggtggtggacaaggcccgctccgcggaggacttcatccaccggatgaccaactacgacctgtacctccccgaggagaaggtcctgccgaagcacagcctgctgtacgagaccttcgccgtgtacaacgagctcaccaaggtgaagttcatcgccgaggggctgcgcgactaccagttcctggactccggccagaagaagcagatcgtcaaccagctgttcaaggagaagcggaaggtgacggagaaggacatcatccactacctgcacaacgtggacgggtacgacggcatcgagctgaagggcatcgagaagcagttcaacgccaacctcagcacctaccacgacctgctgaagatcaccaaggacaaggagttcatggacgaccccaagaacgaggagatcctcgagaacatcgtccacaccctgacgatcttcgaggaccgcgagatgatcaagcagcggctggcccagtacgacaccctcttcgacgagaaggtgatcaaggcgctgacccgccggcactacaccgggtggggcaagctgtccgccaagctcatcaacgggatccgcgacaagcagagcggcaagacgatcctggactacctgatcgacgacgacaagatcaaccggaacttcatgcagctcatcaacgacgacgggctgtccttcaaggagatcatccagaaggcccaggtggtcggcaagaccgacgacgtgaagcaggtcgtgcaggagctgcccggcagccccgccatcaagaaggggatcctccagtccatcaagatcgtggacgagctggtcaaggtgatgggctacgcgctggagagcatcgtgatcgagatggcccgcgagaaccagaccaccgcccgggggaagaagaactcccagcagcgctacaagcgcatcgaggacgccctcaagaacctggccccgggcctggacagcaacatcctcaaggagaaccccacggacaacatccagctgaagaacgaccggctgttcctctactacctgcagaacgggaaggacatgtacaccggcaagcccctggacatcaaccagctctccagctacgacatcgaccacatcatcccccaggcgttcatcaaggacgacagcatcgacaaccgcgtcctgacctccagcaaggacaaccggggcaagtccgacaacgtgccgagcctggaggtggtccagaagcgcaaggccttctggcagcagctcctggactccaagctgatcagcgagcggaagttcaacaacctcaccaaggccgagcgcgggggcctggacgagcgggacaaggtggggttcatccgccggcagctggtggagacccagcagatcacgaagaacgtcgcccagatcctcgacgcccgcttcaacaccgaggtgaaggagaagaaccagaagatccggaccgtgaagatcatcaccctgaagtccaacctggtcagcaacttccgcaaggagttcggcctctacaaggtgcgggagatcaacaactaccaccacgcgcacgacgcctacctgaacgccgtggtcgccaaggccatcctgaagaagtaccccaagctcgagcccgagttcgtgtacggcgactaccagaagtacgacctgaagaagtacatctcccgcttcaagcccagcaaggagatcgagaaggcgacggagaagtacttcttctactccaacctgctcaacttcttcaaggaggaggtgctgtacgccgacgggaccatccggaagcgcgagaacatcgagtacagcaaggacaccggcgagatcgcctgggacaaggagaaggacttcgccaccatcaagaaggtcctgtcctacccccaggtgaacatcgtgaagaagcgggaggtccagaccgggggcttcagcaaggagtccatcctccccaaggggaacagcgacaagctgatcccccgcaagacgaaggacatcctgtgggacaccaccaagtacggcggcttcgactccccggtgatcgcgtacagcatcctcctgatcgccgacatcgagaaggggaaggccaagaagctgaagacggtgaagaccctcgtcggcatcaccatcatggagaaggccgccttcgaggagaaccccatcaccttcctggagaacaaggggtaccacaacgtgcggaaggagaacatcctgtgcctccccaagtacagcctgttcgagctggagaacggccgccggcgcctcctggcgtccgccaaggagctgcagaaggggaacgagatcgtgctccccgtctgcctgacgaccctgctctaccacagcaagaacctgcacaagctggacgagccggagcacctcgagtacatccagaagcaccgcaacgagttcaaggacctgctgaacctcgtgtccgagttcagccagaagtacatcctggccgaggccaacctggagaagatcaaggacctctacgccgacaacgagcaggcggacatcgagatcctggccaactccttcatcaacctgctcaccttcaccgccctgggcgcccccgccgcgttcaagttcttcggcaaggacgtggaccggaagcgctacacgaccgtcagcgagatcctgaacgccaccctcatccaccagtccatcaccgggctgtacgagacgcggatcgacctgagcaagctcggcgaggagtga

SEQ ID NO: 1975 - RNA, 4113 nt, synthetic construct
  misc_feature 1..4113: note = Cas9 variant
  source 1..4113: mol_type = other RNA
atgaagaagccctacagcatcggcctggacatcgggaccaactccgtgggctgggccgtcatcaccgacgactacaaggtgccggccaagaagatgaaggtgctcgggaacacggacaagaactacatcaagaagaacctgctgggcgcgctcctgttcgacagcgggaacaccgccgaggaccgccggctgaagcgcaccgcccggcgccggtacacccgccggcgcaaccggctcctgtacctgcaggacatcttctccgacgagatgaacaaggtcgacgagagcttcttccaccgcctcgaggactccttcctggtgagcgaggacaagcggggcgaccaccaccccatcttcggcaacgtggtcgacgaggtgaagtaccacgagcagttccccacgatctaccacctccgcaagtacctcgccgacacccccgagaaggccgacctgcggctggtgtacctcgcgctggcccacatgatcaagttccgcgggcacttcctgatcgacgacccgaagctcgacgtcaagaacaccgactcccaggagctgttcagccagttcctgaccgcctacgacgtgacgcaggaggactcccacctcgccgacgtgaagatcaacatcagcgacatcatcaccgagaagatgaacaagtcccggaaggtcgaggcgctgctgttccacttccccagccagaagaagaactccttcttcggcaacctcgtgagcctggtgttcgggctgctccccaacttcaagaccaacttcaacctggccgaggacgccaagctgcagctctccaaggacagctacgacgaggacctggagaacctgctcggccagatcggggacgagtacaccgacgtcttcgtggccgcccgcaagctgtacgactccatcctgctcagcggcatcctgacggtgaacgacctgtccaccaaggcgatcctcagcgccagcatggtccggcgctacgaggagcacaacaaggacctggccaagctgaaggccttcgtgaaggccaacttcacccacgacgtgttcaaggaggtcttctccgacgcgagcaagaacggctacgccgggtacatcgagggcaagacctcccaggaggacttctacaagtacgtgaagaacctcatcgggaaggtggacggcagcgccgacttcatcgagaagatcgaccgggaggacttcctgcgcaagcagcggacgttcgacaacggctccatcccccaccaggtccacctggccgagatgaaggccatcctccgccgccagggggagtactacccgttcctgaaggagcacgcggagaagatccagcagatcctgaccttccggatcccctactacgtgggccccctcgaccgccacgggcacagcgacttcgcctgggcctccttcaacagcgaggagaaggtcaccccctggaacttcgaggagatcatcgacaagaacaagtccgcccaggccttcatcgagcggatgaccaaccaggacctgtacctgccgaacgagaaggtgctgcccaagcacagccccctctacgagaagtacacggtgtacaacgagctgaccaagatcaagtacgtcaccgagaccggcacggcgaagttcttcgacgccaacctgaagcaggagatcttcgacgggctgttcaagaaggagcgcaaggtgaccaagcggaagctgctgaccttcctcgagaagaacttcgacgagttccgcatcgtggacatccagggcctggacaaggagaccgagacgttcaacgcctcctacggcatctaccaggacctgctcaagatcatcaaggacaaggccttcatggacgacagcgagaacgcggacatcctggaggacatcgtcctgaccctcaccctgttcgaggaccgggagatgatcaagcagcgcctggccaagtacgccgacctcttcgacaagaaggtgatcgacaacctggcccggcgccggtacaccgggtggggccgcctgtccgccaagctcctgaacgggatccgggacaagcgcagccggaagacgatcatggactacctggtggacgacggccgctccaaccggaacctcatgcagctgatcaccgacgacaacctgaccttcaaggacgagatcgcgaaggcccagtacagcgacaactccgacgacctccaccaggtcgtgcaggacctggccgggagccccgccatcaagaagggcatcctgcagtccgtgaagatcgtcgacgagctcgtgaaggtgatgggctacgagccggagcagatcgtcgtggagatggcccgcgagaaccagaccacggcgaaggggcggcgcaacagccagcagcgctacaagcggctggaggaggccatcaagaacctggaccgcgacctcaactacaagatcctgaaggagcaccccaccgacaaccaggccctgcagaacgaccgcctcttcctgtactacctgcagaacggccgggacatgtacaccggggagagcctcgacatcaaccggctgtccgactacgacatcgaccacatcatcccccaggccttcatcaaggacaacagcatcgacaaccgcgtgctggtctccagcgccaagaaccggggcaagtccgacgacgtgcccagcgaggacgtggtcaaccgcatgcggccgttctggaacaagctcctgaactgcgggctgatctcccagcgcaagtacagcaacctcaccaagaaggagctgacccccaacgacaaggcgggcttcatcaagcggcagctggtggagacgcgccagatcaccaagcacgtggcccggatcctcgacgagcacttcaacaaggagttcgacgaggacaagaagcgcatccggaaggtcaaggtggtgaccctgaagtccaacctggtcagcaacttccgcaaggagttcgagctctacaaggtgcgggagatcaacgactaccaccacgcccacgacgcctacctgaacgcggtggtcgccaaggccctgctcatgaagtaccccaagctggagcccgagttcgtgtacggcgagtacccgaagtacaactcctaccgcgagcggaagaccgccacgcagcgcatgttcttctacagcaacatcatgaacatgttcaagtccaaggtgaagctggccgacgagcggatcatcgagcgccccatgatcgaggtcaacgacgagaccggggagatcgcgtgggacaagaccaagcacatcgccaccgtgaagaaggtgctcagctacccccagatcaacatcgtcaagaaggtggaggagcagacgggcgggctgaccaacgagaccatctacccccgcggctccttcgacaagctgctcaaccggaagaacaccctggaggccagcaagtacggcgggttcggctccccgacggtggcctactgcgtcctggtggtggccgacagcaagaacgagaacgggaaggtcaagaagctcaagctgggcagcgagctgctcgggatcaccatcctggagaagaacgacttcgagaacaactccctggacttcctcagccgcaagggctaccagggcgtgcaggagaagaagatcatcaagctgcccaagtactccctgttcgagttccaggacgggagccggcgcatgctctccagcgtgatggcgaacgacaacaagcggggcgacctgcagaaggccaacgagatgatcctgcccgcctacctcgtcaagctgctgtaccacgccaagcacatcaactccgtgggggagccggcccacaagaactacatcaacgagcactgcagcgagttccaggacctcctgaactacatccgccagttcgcggacaagttcgtggacgtcgacaagaacctgtccaagatccggagcctctccaagagcatggccgagtactccgtgagcgagatctgctccagcttcgtgaacctgctgaccctcaccgccctgggcgcccccgcggacttcaagttcttcgggacgaccatcccccgcaagcggtacggcagcccccagtccatcctgtccgccaccctcatccaccagagcatcaccggcctgtacgagacgcgcatcgacctgagcaagctcggggaggactga

SEQ ID NO: 1976 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcatcaccgacgactacaaggtcccggccaagaagatgcgcgtgctcgggaacacggacaaggagtacatcaagaagaacctgatcggcgccctcctcttcgacgggggcaacaccgcggccgaccggcgcctgaagcggaccgcccgccggcgctacacccggcgccggaaccgcatcctgtacctccaggagatcttcgccgaggagatgtccaaggtggacgacagcttcttccaccggctggaggactccttcctggtcgaggaggacaagcgcggcagcaagtaccccatcttcgccacgatgcaggaggagaagtactaccacgagaagttccccaccatctaccacctccggaaggagctggcggacaagaaggagaaggccgacctgcgcctcatctacctggccctggcccacatcatcaagttccgggggcacttcctcatcgaggacgaccgcttcgacgtgcggaacaccgacatccagaagcagtaccaggcgttcctggagatcttcgacaccacgttcgagaacaacgacctgctctcccagaacgtggacgtcgaggccatcctgaccgacaagatcagcaagtccgccaagaaggaccgcatcctggcccggtaccccaaccagaagtccaccggcatcttcgccgagttcctcaagctgatcgtggggaaccaggcggacttcaagaagcacttcaacctggaggacaagaccccgctccagttcgccaaggacagctacgacgaggacctggagaacctgctcggccagatcggggacgagttcgccgacctgttcagcgccgccaagaagctgtacgactccgtgctcctgagcggcatcctgacggtcaccgacctctccaccaaggcgcccctgagcgcctccatgatccagcgctacgacgagcaccgggaggacctgaagcagctcaagcagttcgtgaaggccagcctgcccgagaagtaccaggagatcttcgccgactccagcaaggacggctacgccgggtacatcgagggcaagaccaaccaggaggcgttctacaagtacctgagcaagctcctgacgaagcaggaggggtccgagtacctgctcgagaagatcaagaacgaggacttcctgcgcaagcagcgcaccttcgacaacggcagcatcccccaccaggtgcacctgaccgagctccgggccatcatccgccggcagtccgagtactacccgttcctgaaggagaacctggaccgcatcgagaagatcctcaccttccggatcccctactacgtcggccccctggcccgcgagaagtccgacttcgcctggatgacgcggaagaccgacgacagcatccgcccctggaacttcgaggacctggtggacaaggagaagtccgccgaggcgttcatccaccggatgaccaacaacgacctgtacctcccggaggagaaggtgctgcccaagcacagcctgatctacgagaagttcaccgtctacaacgagctcacgaaggtgcgcttcctggccgaggggttcaaggacttccagttcctgaaccggaagcagaaggagaccatcttcaacagcctcttcaaggagaagcgcaaggtgaccgagaaggacatcatctccttcctgaacaaggtcgacggctacgaggggatcgccatcaagggcatcgagaagcagttcaacgccagcctgtccacctaccacgacctcaagaagatcctggggaaggacttcctggacaacacggacaacgagctcatcctggaggacatcgtgcagaccctgaccctcttcgaggaccgggagatgatccgcaagcggctggacatctacaaggacttcttcaccgagagccagctgaagaagctctaccgccggcactacacgggctggggccgcctgtccgcgaagctgatcaacgggatccggaacaaggagaaccagaagaccatcctcgactacctgatcgacgacggcagcgccaaccgcaacttcatgcagctgatcaaggacgccgggctctccttcaagcccatcatcgacaaggcccgcaccggcagccactccgacaacctgaaggaggtggtcggggagctggccggcagccccgcgatcaagaagggcatcctccagtccctgaagatcgtggacgagctggtgaaggtcatggggtacgagccggagcagatcgtggtcgagatggcccgggagaaccagaccacggccaagggcctcagccgcctgcggcagcgcctgaccaccctccgggagagcctggccaacctgaagtccaacatcctcgaggagaagaagcccaagtacgtgaaggaccaggtggagaaccaccacctgagcgacgaccgcctgttcctctactacctgcagaacgggaaggacatgtacaccgacgacgagctggacatcgacaacctctcccagtacgacatcgaccacatcatcccccaggccttcatcaaggacgacagcatcgacaaccgggtcctggtgtccagcgcgaagaaccgcggcaagtccgacgacgtgcccagcgtcgagatcgtgaaggactgcaaggtgttctggaagaagctgctcgacgccaagctgatgtcccagcggaagtacgacaacctgaccaaggccgagcgcgggggcctcacgagcgacgacaaggcccggttcatccagcgccagctggtcgagacccggcagatcaccaagcacgtggcccgcatcctggacgagcggttcaacaacgagctcgactccaagggccgccggatccgcaaggtgaagatcgtcaccctcaagagcaacctggtgtccaacttccggaaggagttcgggttctacaagatccgcgaggtgaacaactaccaccacgcgcacgacgcctacctgaacgccgtcgtggccaaggcgatcctgacgaagtacccgcagctggagcccgagttcgtgtacggcgactaccccaagtacaacagctacaagacccggaagtccgccaccgagaagctgttcttctacagcaacatcatgaacttcttcaagaccaaggtcacgctggccgacgggaccgtggtggtcaaggacgacatcgaggtgaacaacgacaccggcgagatcgtgtgggacaagaagaagcacttcgccaccgtccgcaaggtgctgtcctacccccaggtgaacatcgtcaagaagacggagatccagaccggcgggttcagcaaggagagcatcctcgcccacggcaactccgacaagctgatcccgcgcaagaccaaggacatctacctggaccccaagaagtacgggggcttcgacagccccatcgtggcgtactccgtgctcgtcgtggccgacatcaagaaggggaaggcccagaagctgaagaccgtgacggagctgctcggcatcaccatcatggagcggagccgcttcgagaagaacccctccgccttcctggagagcaagggctacctgaacatccgggacgacaagctcatgatcctgccgaagtactccctgttcgagctcgagaacgggcgccggcgcctgctggccagcgcggacgagctccagaagggcaacgagctggccctgcccacccagttcatgaagttcctctacctggcctcccggtacaacgagctgaaggggaagcccgaggagatcgagcagaagcaggagttcgtcgtgcagcacgtgagctacttcgacgacatcctccagatcatcaacgacttctccaaccgcgtcatcctggccgacgccaacctggagaagatcaacaagctctaccaggacaacaaggagaacatcccggtggacgagctggcgaacaacatcatcaacctgttcaccttcacgagcctcggcgcccccgccgccttcaagttcttcgacaagatcgtggaccggaagcgctacacctccaccaaggaggtcctgaacagcaccctgatccaccagtccatcacggggctctacgagacccggatcgacctgggcaagctgggcgaggactga

SEQ ID NO: 1977 - RNA, 4113 nt, synthetic construct
  misc_feature 1..4113: note = Cas9 variant
  source 1..4113: mol_type = other RNA
atggagaagaacaaggagtacgtgatcggcctggacatcgggaccggcagcgtcgggtggtccgccatcagcaccgacaactaccagctcatccgccagaagggcaagaacctgatcggggtgcggctgttcaactccgccgagacggcggaggagcgccggggctaccgcaccacccggcgccggctcagccgccggcgctggcggatgtccctgctgaacgacatcttccgccccgagctcaacgagatcgacgagaacttcctggcccggctgaagtacagctgggtgtccccgctcgaccagaagaacccccagctgaacgagcagggcaccaacgccagcctgtacggggacatcgaggccgaccaggccttccaccgcgcgtaccccacgatctaccacctccggaagaccctgatggaggacaaccagaagcacgacctgcgcgaggtctacctcgccatccaccacatcgtgaagtaccggggccacttcctgacccccgacttcgacgccaactcccagaccatcgacatcaaggggctgttcaagcagctcggcgacgtgagcgggtccatcgagctgcaggccgaccagacgagcaccgtcatcgcggccttccagtccatcctgctcgacttcaccaagaccccgacggagagcggccgcctggccggccagctgttctccgaccagaacaaggacaagcaggccaagaagcaggtcgaggagctgttcaagctcctgcgcgggggcaaggggagcctcgccgacatgttcctgctgaccgacctcgacaaggtggtgaagaaccagctgaagttcgcgttcgacgacgccgtggacgagaacctgaacctcatctccaacctgatcaacgaggagcagtacgagctgctcctgaacatccagaagctgcggggcaccatcatcctcaagcagatcctgggcgacgacgagaccgtgagcgacgccaaggtccggtcctacgaggagcacgcccaccagctgaaggagctcaaggcccaggtgctgacgaaggacaacaaggagaagttcgaggaggcgtaccagctgatccagaagggggacgccagccgcatcgacggcctcaagaagctgaagaccatcatcaaccaggagcacgaggccctgcgcctcgacaagtacgaggccgacaagctgctgaagctgatcgagctcgaccagctgctgcccgtgcagcggagcaagcgcaacggggagatcccccaccagctccacgagttcgagctgaagaagatcatcgagaagcagggccggtactaccccttcctgcgcgagaccttcgagcgggacgggcaggagttcaacaagatcggccagctcgtcaacttccgcatcccgtactacgtgggccccctggtggacccccggctggccgggatccagtccggcgaccagaccaaccactggatgacgcagaagaaggcggggaagatcaccccctggaactacaccgagctcatcgacatcgacaagagcgccgccgagttcatcaagcgcatgaccggcacggacacctacctggtcggggagccgtccctgcacaaggccagcctcatctaccaggactacaacgtgctgcaggagctgaacaacctccggtacgacggcaagcccctgcccgtggacgccaagcaggagatctactccaacctgcaggtcagcctcaagaacgcgaccaagaacaagatcaactccttcctgatcagcgagggctacctgcaggacggggaggagctcaccggcttcgccgggaaggagctgaagaacaagctgtccagcttccactacttcaagaacatcttcggccccgagcgcatgaacacgctcgggaccgacaacctggagaagatcaccgagctgcagaccgtgttcgaggaccggcacatgctcaagcgccagctgcagaagctgggcttcctcgacgacgacgagtgcgagaagctggccggcaagcacttcacggggtggggcaacctgtccaagaagctcctgaacaccccggccatcatcgaccccgagatcaacgagaacaagatcagcctgatcgacgcgctctacaaggggcagcggaacctgtccttctacgtgaacaacatggacgacaagtaccagttccgcgactggatcgagagcgagaaccagtcccagcaggtcgagatcagcctggacgagaagatcaagaacctcgccggctcccccgccatcaagcggggcatcacccagagcatggccgtgatccaggacatcatccgcgccaacaacgggatctcccccaagcggatctacctggagttcgcgcgcgagagccagaacagctaccagccgaactcccggatcaagcagatcgagaagatctacgaccagaacaagaaggagctgatgaaggtctaccccgacgtgttcaaggacgtgcagggcgtcctcaacaacgtggacgagaacaacagcctgtccgagaaggccttcctgtacttcatgcagctcgggaaggacatgtacaccggcgaggccctggacttcgacaagctgtacacgtacgacatcgaccacatcatcccccaggccatgaccaaggacaacagctgggacaacaaggtgctcgtcaccgccatcaagaaccgcgagaagtccaaccaggtgctggacaacgcgatccaggccaagatgcacaacttctggctgcagctcaagaaggtgaacctgctgagccagcgcaagtacgacaccctcatgaagaccaacttctccaagggggacgagaagaagttcatcgcccggagcctggtcgagacgcgccagatcatcaagaacgtggccgagctgatcaagtccgagttcgaccacgtggaggccatccccatccggcaggagctcaccagcgacatgcgccagctgatggactacaagaagaaccggctggtcaacgactaccaccacgcgcacgacgccctcctgatcgccaccgtgggcgagttcatgcagaagcgcggcttcatgcaggggatgaacccgtcccagaacgtgtaccacggctacacccagtacgtcaagaagtggctgagcatggccaagaaggcgcggtccgccgagaagcccgagcgcatcttccccctccagttcgtggtggggagcatgcggatggccgtccgcgacggccaggtggacaaggtgacgcaccccgccaccggggagatctgctggaccgccgacaacgaggcgtacctgcggaaggtcctgggctacaagaacatcctcgtgacccgcaaggtgaagaacgccggcaagctgtaccagcgggtcacggtgaagccgaaggggtccggcgaggcccccgtgaaccaccagaagtccgacatcaacatctacgggggcgtcacctccgagcaggccgccgagctggtgctcatccgcatcaaggcgaagaacaacgccaagaacatggtgatcaagatccccaccgccatcgccaaccaggtcgccaacaagaccacgacctacgacgcgtacgtgcggagcctgaacatcccgaactacgccgggatcatcctggaccagatccccctcggccagctggtgttcgacgagcgcaccagcttctacctggcctccgccgagatcaagcacaacgcgcggcagctctgggtcaaccagcacatcaacaacgtgctgaccaagaagaacatcaacgacgaggagcgcgacaacatcctgaacctcctgacgaacgagaagaacctggagcggttcaagctcctggagcccgacctgaagcgcgtgaaggccgccaagcagcagtgggccagctgcgacgaccaggagcagatgcagatcctccggatcatcatcaacaagatgcacgacgacgccagcccccagatcccgggcaagatcgaccccttcaagaactacctggacaagcaggggaagggctggcgcgacctgcgcaccaagaaggggatgaagctcagcgacaacgcggagttcgtctaccagtcccccaccggcctgtaccaccggaagatcagcatcaacgagctgctcaagcagaagcagctggagtga

SEQ ID NO: 1978 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcatcaccgacgactacaaggtcccggccaagaagatgcgcgtgctcgggaacacggacaaggagtacatcaagaagaacctgatcggcgccctgctgttcgacgggggcaacaccgcggccgaccggcgcctgaagcggaccgcccgccggcgctacacccggcgccggaaccgcatcctgtacctccaggagatcttcgccgaggagatgtccaaggtggacgacagcttcttccaccggctggaggactccttcctggtcgaggaggacaagcgcggcagcaagtaccccatcttcgccacgatgcaggaggagaagtactaccacgagaagttccccaccatctaccacctccggaaggagctggcggacaagaaggagaaggccgacctgcgcctcatctacctggccctggcccacatcatcaagttccgggggcacttcctcatcgaggacgaccgcttcgacgtgcggaacaccgacatccagaagcagtaccaggcgttcctggagatcttcgacaccacgttcgagaacaacgacctgctctcccagaacgtggacgtcgaggccatcctgaccgacaagatcagcaagtccgccaagaaggaccgcatcctggcccggtaccccaaccagaagtccaccggcatcttcgccgagttcctcaagctgatcgtggggaaccaggcggacttcaagaagcacttcaacctggaggacaagaccccgctccagttcgccaaggacagctacgacgaggacctggagaacctgctcggccagatcggggacgagttcgccgacctgttcagcgccgccaagaagctgtacgactccgtgctcctgagcggcatcctgacggtcaccgacctctccaccaaggcgcccctgagcgcctccatgatccagcgctacgacgagcaccgggaggacctgaagcagctcaagcagttcgtgaaggccagcctgcccgagaagtaccaggagatcttcgccgactccagcaaggacggctacgccgggtacatcgagggcaagaccaaccaggaggcgttctacaagtacctgagcaagctcctgacgaagcaggaggggtccgagtacctgctcgagaagatcaagaacgaggacttcctgcgcaagcagcgcaccttcgacaacggcagcatcccccaccaggtgcacctgaccgagctccgggccatcatccgccggcagtccgagtactacccgttcctgaaggagaacctggaccgcatcgagaagatcctcaccttccggatcccctactacgtcggccccctggcccgcgagaagtccgacttcgcctggatgacgcggaagaccgacgacagcatccgcccctggaacttcgaggacctggtggacaaggagaagtccgccgaggcgttcatccaccggatgaccaacaacgacctgtacctcccggaggagaaggtgctgcccaagcacagcctgatctacgagaagttcaccgtctacaacgagctcacgaaggtgcgcttcctggccgaggggttcaaggacttccagttcctgaaccggaagcagaaggagaccatcttcaacagcctcttcaaggagaagcgcaaggtgaccgagaaggacatcatctccttcctgaacaaggtcgacggctacgaggggatcgccatcaagggcatcgagaagcagttcaacgccagcctgtccacctaccacgacctcaagaagatcctggggaaggacttcctggacaacacggacaacgagctcatcctggaggacatcgtgcagaccctgaccctcttcgaggaccgggagatgatccgcaagcggctggacatctacaaggacttcttcaccgagagccagctgaagaagctctaccgccggcactacacgggctggggccgcctgtccgcgaagctgatcaacgggatccggaacaaggagaaccagaagaccatcctcgactacctgatcgacgacggcagcgccaaccgcaacttcatgcagctgatcaaggacgccgggctctccttcaagcccatcatcgacaaggcccgcaccggcagccacctggacaacctgaaggaggtggtcggggagctcgccggctcccccgcgatcaagaagggcatcctgcagagcctgaagatcgtggacgagctcgtgaaggtcatggggtacgagccggagcagatcgtggtcgagatggcccgggagaaccagaccacggccaagggcctgtcccgcagccggcagcgcctgaccaccctccgggagagcctggccaacctgaagtccaacatcctcgaggagaagaagcccaagtacgtgaaggaccaggtggagaaccaccacctgagcgacgaccgcctgttcctctactacctgcagaacgggaaggacatgtacaccgacgacgagctggacatcgacaacctctcccagtacgacatcgaccacatcatcccccaggccttcatcaaggacgacagcatcgacaaccgggtcctggtgtccagcgcgaagaaccgcggcaagtccgacgacgtgcccagcctggagatcgtcaaggactgcaaggtgttctggaagaagctcctggacgccaagctgatgtcccagcggaagtacgacaacctcaccaaggccgagcgcgggggcctgacgagcgacgacaaggcccggttcatccagcgccagctggtggagacccggcagatcaccaagcacgtcgcccgcatcctcgacgagcggttcaacaacgagctggactccaagggccgccggatccgcaaggtgaagatcgtgaccctcaagagcaacctcgtctccaacttccggaaggagttcgggttctacaagatccgcgaggtgaacaactaccaccacgcgcacgacgcctacctgaacgccgtggtcgccaaggcgatcctgacgaagtacccgcagctcgagcccgagttcgtgtacggcgactaccccaagtacaacagctacaagacccggaagtccgccaccgagaagctgttcttctacagcaacatcatgaacttcttcaagaccaaggtgacgctggccgacgggaccgtcgtggtgaaggacgacatcgaggtcaacaacgacaccggcgagatcgtgtgggacaagaagaagcacttcgccaccgtgcgcaaggtcctctcctacccccaggtgaacatcgtgaagaagacggaggtccagaccggcgggttcagcaaggagagcatcctggcccacggcaactccgacaagctgatcccgcgcaagaccaaggacatctacctcgaccccaagaagtacgggggcttcgacagccccatcgtggcgtactccgtgctggtcgtggccgacatcaagaaggggaaggcccagaagctgaagaccgtgacggagctcctgggcatcaccatcatggagcggagccgcttcgagaagaacccctccgccttcctggagagcaagggctacctcaacatccggaccgacaagctgatcatcctgccgaagtactccctcttcgagctggagaacgggcgccggcgcctgctcgccagcgcgggcgagctgcagaaggggaacgagctggccctccccacccagtacatgaagttcctgtacctggcctcccggtacaacgagctcaagggcaagcccgaggagatcgagcagaagcaggagttcgtcgtgcagcacgtgagctacttcgacgacatcctgcagatcatcaacgacttctccaaccgcgtcatcctggccgacgccaacctcgagaagatcaacaagctgtaccaggacaacaaggagaacatcccggtggacgagctggcgaacaacatcatcaacctcttcacgttcaccagcctgggggcccccgccgccttcaagttcttcgacaagatcgtggaccggaagcgctacacctccaccaaggaggtcctgaacagcacgctcatccaccagtccatcaccggcctgtacgagacccggatcgacctgggcaagctcggggagggctga

SEQ ID NO: 1979 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcatcaccgacgactacaaggtcccggccaagaagatgcgcgtgctcgggaacacggacaaggagtacatcaagaagaacctgatcggcgccctgctgttcgacgggggcaacaccgcggccgaccggcgcctgaagcggaccgcccgccggcgctacacccggcgccggaaccgcatcctgtacctccaggagatcttcgccgaggagatgtccaaggtggacgacagcttcttccaccggctggaggactccttcctggtcgaggaggacaagcgcggcagcaagtaccccatcttcgccacgctccaggaggagaaggactaccacgagaagttctccaccatctaccacctccggaaggagctggcggacaagaaggagaaggccgacctccgcctgatctacatcgccctggcccacatcatcaagttccgggggcacttcctcatcgaggacgacagcttcgacgtgcgcaacaccgacatctccaagcagtaccaggacttcctggagatcttcaacaccacgttcgagaacaacgacctgctcagccagaacgtggacgtcgaggcgatcctgaccgacaagatctccaagagcgccaagaaggaccggatcctggcccagtaccccaaccagaagtccaccggcatcttcgccgagttcctcaagctgatcgtggggaaccaggccgacttcaagaagtacttcaacctggaggacaagacgcccctccagttcgcgaaggacagctacgacgaggacctggagaacctgctcggccagatcggggacgagttcgccgacctgttctccgccgccaagaagctgtacgacagcgtgctcctgtccggcatcctgacggtcatcgacctcagcaccaaggccccgctgtccgcgagcatgatccagcgctacgacgagcaccgggaggacctgaagcagctcaagcagttcgtgaaggccagcctgcccgagaagtaccaggagatcttcgccgactccagcaaggacggctacgccgggtacatcgagggcaagaccaaccaggaggccttctacaagtacctgtccaagctcctgaccaagcaggaggacagcgagaacttcctggagaagatcaagaacgaggacttcctccgcaagcagcggacgttcgacaacgggtccatcccccaccaggtgcacctgaccgagctgaaggcgatcatccgccgccagagcgagtactaccccttcctcaaggagaaccaggaccggatcgagaagatcctgaccttccgcatcccgtactacatcggccccctggcccgggagaagtccgacttcgcctggatgacccgcaagacggacgacagcatccggccctggaacttcgaggacctcgtcgacaaggagaagtccgccgaggccttcatccaccgcatgaccaacaacgacttctacctgcccgaggagaaggtgctgccgaagcacagcctgatctacgagaagttcaccgtgtacaacgagctcaccaaggtccggtacaagaacgagcagggcgagacgtacttcttcgactccaacatcaagcaggagatcttcgacggggtgttcaaggagcaccgcaaggtgagcaagaagaagctgctggacttcctcgcgaaggagtacgaggagttccggatcgtcgacgtgatcggcctggacaaggagaacaaggccttcaacgcctccctggggacctaccacgacctcgagaagatcctggacaaggacttcctggacaaccccgacaacgagagcatcctcgaggacatcgtgcagaccctgaccctgttcgaggaccgcgagatgatcaagaagcggctcgagaactacaaggacctgttcacggagtcccagctgaagaagctctaccgccggcactacaccggctgggggcgcctgagcgccaagctgatcaacggcatccgggacaaggagtcccagaagaccatcctcgactacctgatcgacgacggccgcagcaaccggaacttcatgcagctgatcaacgacgacgggctctccttcaagagcatcatcagcaaggcgcaggccggctcccacagcgacaacctgaaggaggtcgtgggggagctggccggctcccccgccatcaagaaggggatcctccagagcctgaagatcgtggacgagctggtcaaggtgatgggctacgagcccgagcagatcgtcgtggagatggcccgcgagaaccagaccacgaaccagggccggcgcaactcccgccagcggtacaagctcctggacgacggggtgaagaacctggcgagcgacctcaacggcaacatcctgaaggagtacccgaccgacaaccaggccctgcagaacgagcgcctcttcctgtactacctgcagaacgggcgggacatgtacaccggcgaggccctcgacatcgacgacctgtcccagtacgacatcgaccacatcatcccccaggccttcatcaaggacgacagcatcgacaaccgcgtcctggtgtccagcgccaagaaccgggggaagtccgacgacgtgcccagcctcgagatcgtcaaggactgcaaggtgttctggaagaagctgctggacgcgaagctcatgtcccagcgcaagtacgacaacctgaccaaggccgagcggggcggcctgacgagcgacgacaaggcccgcttcatccagcggcagctcgtggagacccgccagatcaccaagcacgtcgcccggatcctggacgagcgcttcaacaacgagctggactccaaggggcggcgcatccggaaggtgaagatcgtgaccctcaagagcaacctggtctccaacttccgcaaggagttcggcttctacaagatccgggaggtgaacaactaccaccacgcccacgacgcgtacctgaacgccgtggtcgccaaggccatcctcaccaagtacccccagctggagccggagttcgtgtacggggactaccccaagtacaacagctacaagacgcgcaagagcgcgaccgagaagctgttcttctactccaacatcatgaacttcttcaagaccaaggtgaccctcgccgacggcacggtcgtggtgaaggacgacatcgaggtcaacaacgacaccggcgagatcgtgtgggacaagaagaagcacttcgccaccgtgcggaaggtcctgagctacccccagaacaacatcgtgaagaagaccgagatccagaccgggggcttctccaaggagagcatcctggcccacgggaactccgacaagctcatcccccgcaagaccaaggacatctacctggacccgaagaagtacggcgggttcgacagccccatcgtggcctactccgtcctggtggtggcggacatcaagaagggcaaggcccagaagctcaagaccgtcaccgagctgctgggcatcacgatcatggagcggagccgcttcgagaagaacccctccgccttcctcgagagcaaggggtacctgaacatccgcgccgacaagctgatcatcctccccaagtactccctgttcgagctggagaacggccggcgccggctcctggccagcgcgggggagctgcagaagggcaacgagctcgccctgccgacccagttcatgaagttcctgtacctcgcctcccgctacaacgagagcaaggggaagcccgaggagatcgagaagaagcaggagttcgtgaaccagcacgtgtcctacttcgacgacatcctgcagctgatcaacgacttcagcaagcgggtcatcctcgccgacgccaacctggagaagatcaacaagctgtaccaggacaacaaggagaacatctccgtggacgagctcgcgaacaacatcatcaacctgttcaccttcaccagcctgggcgcccccgccgccttcaagttcttcgacaagatcgtggaccgcaagcggtacacgtccaccaaggaggtcctcaacagcaccctgatccaccagagcatcaccggcctgtacgagacgcgcatcgacctcgggaagctgggcgaggactga

SEQ ID NO: 1980 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcatcaccgacgactacaaggtcccggccaagaagatgcgcgtgctcgggaacacggacaaggagtacatcaagaagaacctgatcggcgccctgctgttcgacgggggcaacaccgcggccgaccggcgcctgaagcggaccgcccgccggcgctacacccggcgccggaaccgcatcctgtacctccaggagatcttcgccgaggagatgtccaaggtggacgacagcttcttccaccggctggaggactccttcctggtcgaggaggacaagcgcggcagcaagtaccccatcttcgccacgctccaggaggagaaggactaccacgagaagttctccaccatctaccacctccggaaggagctggcggacaagaaggagcgcgccgacctccggctgatctacatcgccctggcccacatcatcaagttccgcgggcacttcctcatcgaggacgacagcttcgacgtgcggaacaccgacatctccaagcagtaccaggacttcctggagatcttcaacaccacgttcgagaacaacgacctgctcagccagaacgtggacgtcgaggcgatcctgaccgacaagatctccaagagcgccaagaaggaccgcatcctggcccagtaccccaaccagaagtccaccggcatcttcgccgagttcctcaagctgatcgtggggaaccaggccgacttcaagaagtacttcaacctggaggacaagacgcccctccagttcgcgaaggacagctacgacgaggacctggagaacctgctcggccagatcggggacgagttcgccgacctgttctccgccgccaagaagctgtacgacagcgtgctcctgtccggcatcctgacggtcatcgacctcagcaccaaggccccgctgtccgcgagcatgatccagcggtacgacgagcaccgcgaggacctgaagcagctcaagcagttcgtgaaggccagcctgcccgagaagtaccaggagatcttcgccgactccagcaaggacggctacgccgggtacatcgagggcaagaccaaccaggaggccttctacaagtacctgtccaagctcctgaccaagcaggaggacagcgagaacttcctggagaagatcaagaacgaggacttcctccggaagcagcgcacgttcgacaacgggtccatcccccaccaggtgcacctgaccgagctgaaggcgatcatccgccggcagagcgagtactaccccttcctcaaggagaaccaggaccgcatcgagaagatcctgaccttccggatcccgtactacatcggccccctggcccgcgagaagtccgacttcgcctggatgacccggaagacggacgacagcatccgcccctggaacttcgaggacctcgtcgacaaggagaagtccgccgaggccttcatccaccggatgaccaacaacgacttctacctgcccgaggagaaggtgctgccgaagcacagcctgatctacgagaagttcaccgtgtacaacgagctcaccaaggtccgctacaagaacgagcagggcgagacgtacttcttcgactccaacatcaagcaggagatcttcgacggggtgttcaaggagcaccggaaggtgagcaagaagaagctgctggacttcctcgcgaaggagtacgaggagttccgcatcgtcgacgtgatcggcctggacaaggagaacaaggccttcaacgcctccctggggacctaccacgacctcgagaagatcctggacaaggacttcctggacaaccccgacaacgagagcatcctcgaggacatcgtgcagaccctgaccctgttcgaggaccgggagatgatcaagaagcgcctcgagaactacaaggacctgttcacggagtcccagctgaagaagctctaccggcgccactacaccggctgggggcggctgagcgccaagctgatcaacggcatccgcgacaaggagtcccagaagaccatcctcgactacctgatcgacgacggccggagcaaccgcaacttcatgcagctgatcaacgacgacgggctctccttcaagagcatcatcagcaaggcgcaggccggctcccacagcgacaacctgaaggaggtcgtgggggagctggccggctcccccgccatcaagaaggggatcctccagagcctgaagatcgtggacgagctggtcaaggtgatgggctacgagcccgagcagatcgtcgtggagatggcccgggagaaccagaccacgaaccagggccgccgcaactcccggcagcgctacaagctcctggacgacggggtgaagaacctggcgagcgacctcaacggcaacatcctgaaggagtacccgaccgacaaccaggccctgcagaacgagcgcctcttcctgtactacctgcagaacgggcgggacatgtacaccggcgaggccctcgacatcgacgacctgtcccagtacgacatcgaccacatcatcccccaggccttcatcaaggacgacagcatcgacaaccgggtcctggtgtccagcgccaagaaccgcgggaagtccgacgacgtgcccagcctcgagatcgtcaaggactgcaaggtgttctggaagaagctgctggacgcgaagctcatgtcccagcggaagtacgacaacctgaccaaggccgagcgcggcggcctgacgagcgacgacaaggcccggttcatccagcgccagctcgtggagacccggcagatcaccaagcacgtcgcccgcatcctggacgagcggttcaacaacgagctggactccaaggggcgccggatccgcaaggtgaagatcgtgaccctcaagagcaacctggtctccaacttccggaaggagttcggcttctacaagatccgcgaggtgaacaactaccaccacgcccacgacgcgtacctgaacgccgtggtcgccaaggccatcctcaccaagtacccccagctggagccggagttcgtgtacggggactaccccaagtacaacagctacaagacgcgcaagagcgcgaccgagaagctgttcttctactccaacatcatgaacttcttcaagaccaaggtgaccctcgccgacggcacggtcgtggtgaaggacgacatcgaggtcaacaacgacaccggcgagatcgtgtgggacaagaagaagcacttcgccaccgtgcggaaggtcctgagctacccccagaacaacatcgtgaagaagaccgagatccagaccgggggcttctccaaggagagcatcctggcccacgggaactccgacaagctcatcccccggaagaccaaggacatctacctggacccgaagaagtacggcgggttcgacagccccatcgtggcctactccgtcctggtggtggcggacatcaagaagggcaaggcccagaagctcaagaccgtcaccgagctgctgggcatcacgatcatggagcgcagccgcttcgagaagaacccctccgccttcctcgagagcaaggggtacctgaacatccgggccgacaagctgatcatcctccccaagtactccctgttcgagctggagaacggccgccggcgcctcctggccagcgcgggggagctgcagaagggcaacgagctcgccctgccgacccagttcatgaagttcctgtacctcgcctcccggtacaacgagagcaaggggaagcccgaggagatcgagaagaagcaggagttcgtgaaccagcacgtgtcctacttcgacgacatcctgcagctgatcaacgacttcagcaagcgcgtcatcctcgccgacgccaacctggagaagatcaacaagctgtaccaggacaacaaggagaacatctccgtggacgagctcgcgaacaacatcatcaacctgttcaccttcaccagcctgggcgcccccgccgccttcaagttcttcgacaagatcgtggaccggaagcgctacacgtccaccaaggaggtcctcaacagcaccctgatccaccagagcatcaccggcctgtacgagacgcggatcgacctcgggaagctgggcgaggactga

SEQ ID NO: 1981 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcatcaccgacgactacaaggtcccggccaagaagatgcgcgtgctcgggaacacggacaaggagtacatcaagaagaacctgatcggcgccctgctgttcgacgggggcaacaccgcgtccgaccggcgcctgaagcggaccgcccgccggcgctacacccggcgccggaaccgcatcctgtacctccaggagatcttcgccgaggagatgagcaaggtggacgactccttcttccaccggctggaggacagcttcctggtcgaggacgacaagcgcggctccaagtaccccatcttcgccacgatgcaggaggagaaggactaccacgagaagttccccaccatctaccacctccggaaggagctggccgacaagaaggagaaggcggacctgcgcctcttctacctggccctggcccacatcatcaagttccgggggcacttcctcatcgaggacgacagcttcgacgtgcgcaacaccgacatccagcggcagtaccaggccttcctggagatcttcgacaccacgttcgagaacaaccacctcctctcccagaacatcgacgtggagggcatcctgaccgacaagatcagcaagtccgcgaagaaggaccgcatcctggcccagtaccccaaccagaagtccaccgggatcttcgccgagttcctcaagctgatcgtcggcaaccaggccgacttcaagaagcacttcaacctggaggacaagaccccgctccagttcgccaaggacagctacgacgaggacctggagaacctgctcgggcagatcggcgacgagttcgcggacctgttcagcgtggccaagaagctgtacgactccgtgctcctgagcggcatcctgacggtcaccgacctctccaccaaggcgcccctgagcgcctccatgatccagcggtacgacgagcaccgcgaggacctgaagcagctcaagcagttcgtgaaggccagcctgcccgagaagtaccaggagatcttcaccgacagctccaaggacgggtacgccggctacatcgaggggaagacgaaccagggcgccttctacaagtacctgagcaagctcctgaccaagcaggagggctccgagtacttcctggagaagatcaagaacgaggacttcctccggaagcagcgcaccttcgacaacgggagcatcccccaccaggtgcacctgaccgagctgaaggccatcatccgccggcagtccgagtactacccgttcctcaaggagaacctggaccgcatcgagaagatcctgacgttccggatcccctactacgtcggccccctcgcccgcgagaagtccgacttcgcctggatgacccggaagaccgacgacagcatccgcccctggaacttcgaggagctggtggacaaggaggcgagcgccgaggccttcatccaccggatgaccaacaacgacctgtacctgccggaggagaaggtgctccccaagcactccctgatctacgagaagttcacggtctacaacgagctgaccaaggtgcgctacaagaacgagcagggggagacctacttcttcgacagcaacatcaagcaggagatcttcgacggcgtgttcaaggagcaccggaaggtctccaagaagaagctcctggacttcctggccaaggagtacgaggagttccgcatcgtggacgtgatcgggctcgacaaggagaacaaggccttcaacgcgagcctgggcacctaccacgacctgaagaagatcctcgacaaggacttcctggacaaccccgacaacgagtccatcctggaggacatcgtccagacgctcaccctgttcgaggaccgggagatgatcaagaagcgcctggagaactacaaggacctcttcaccgagagccagctgaagaagctgtaccggcgccactacaccggctgggggcggctctccgccaagctgatcaacggcatccgcgacaaggagagccagaagacgatcctggactacctcatcgacgacgggaagtccaaccggaacttcatgcagctgatccacgacgacggcctgagcttcaagtccatcatcagcaaggcccaggccgggagccactccgacaacctcaaggaggtggtgggcgagctggcgggcagccccgccatcaagaaggggatcctgcagtccctcaagatcgtcgacgagctggtgaaggtcatgggctacgagccggagcagatcgtggtggagatggcccgcgagaaccagaccaccaaccaggggcggcgcaacagccgccagcggtacaagctgctcgacgacggcgtcaagaacctggcctccgacctgaacgggaacatcctcaaggagtaccccaccgacaaccaggccctgcagaacgagcgcctgttcctctactacctgcagaacggccgggacatgtacacgggcaaggcgctggacatcgacaacctcagccagtacgacatcgaccacatcatcccccaggccttcatcaaggacgactccatcgacaaccgcgtgctggtgagctccgccaagaaccgggggaagtccgacgacgtccccagcctggagatcgtgaaggactgcaaggtgttctggaagaagctcctggacgccaagctgatgagccagcgcaagtacgacaacctcaccaaggccgagcggggcgggctgacctccgacgacaaggcgcgcttcatccagcggcagctggtcgagacccgccagatcaccaagcacgtggcccggatcctcgacgagcgcttcaacaacgagctggacagcaagggccggcgcatccggaaggtgaagatcgtcacgctgaagtccaacctcgtgagcaacttccgcaaggagttcggcttctacaagatccgggaggtgaacaactaccaccacgcccacgacgcctacctgaacgccgtcgtggcgaaggccatcctgaccaagtacccgcagctcgagcccgagttcgtgtacggggactaccccaagtacaactcctacaagacccgcaagagcgccaccgagaagctgttcttctacagcaacatcatgaacttcttcaagacgaaggtcaccctggccgacggcaccgtggtggtcaaggacgacatcgaggtgaacaacgacaccggggagatcgtgtgggacaagaagaagcacttcgcgacggtccggaaggtgctctcctacccccaggtgaacatcgtcaagaagaccgagatccagaccggcgggttcagcaaggagtccatcctggcccacggcaacagcgacaagctgatcccgcgcaagaccaaggacatctacctcgaccccaagaagtacggcgggttcgactcccccatcgtggcctacagcgtgctggtcgtggccgacatcaagaagggcaaggcccagaagctgaagacggtgaccgagctcctggggatcaccatcatggagcggtcccgcttcgagaagaaccccagcgcgttcctggagtccaagggctacctcaacatccgcgacgacaagctgatgatcctgccgaagtacagcctcttcgagctggagaacgggcggcgccggctgctcgcctccgccggcgagctgcagaagggcaacgagctggccctccccacccagttcatgaagttcctgtacctggccagccgctacaacgagctcaaggggaagcccgaggagatcgagcagaagcaggagttcgtcgtgcagcacgtgtcctacttcgacgacatcctgcagatcatcaacgacttcagcaaccgggtcatcctggcggacgccaacctcgagaagatcaacaagctgtaccaggacaacaaggagaacatctccgtggacgagctggccaacaacatcatcaacctcttcacgttcaccagcctgggcgccccggccgcgttcaagttcttcgacaagatcgtggaccgcaagcggtacacctccaccaaggaggtcctgaacagcacgctcatccaccagtccatcaccgggctgtacgagacccgcatcgacctgggcaagctcggggaggactga

SEQ ID NO: 1982 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcatcaccgacgactacaaggtcccggccaagaagatgcgcgtgctcgggaacacggacaaggagtacatcaagaagaacctgatcggcgccctgctgttcgacgggggcaacaccgcggccgaccggcgcctgaagcggaccgcccgccggcgctacacccggcgccggaaccgcatcctgtacctccaggagatcttcgccgaggagatgtccaaggtggacgacagcttcttccaccggctggaggactccttcctggtcgaggaggacaagcgcggcagcaagtaccccatcttcgccacgatgcaggaggagaagtactaccacgagaagttccccaccatctaccacctccggaaggagctggcggacaagaaggagaaggccgacctgcgcctcatctacctggccctggcccacatcatcaagttccgggggcacttcctcatcgaggacgaccgcttcgacgtgcggaacaccgacatccagaagcagtaccaggcgttcctggagatcttcgacaccacgttcgagaacaacgacctgctctcccagaacgtggacgtcgaggccatcctgaccgacaagatcagcaagtccgccaagaaggaccgcatcctggcccggtaccccaaccagaagtccaccggcatcttcgccgagttcctcaagctgatcgtggggaaccaggcggacttcaagaagcacttcaacctggaggacaagaccccgctccagttcgccaaggacagctacgacgaggacctggagaacctgctcggccagatcggggacgagttcgccgacctgttcagcgccgccaagaagctgtacgactccgtgctcctgagcggcatcctgacggtcaccgacctctccaccaaggcgcccctgagcgcctccatgatccagcactacgacgagcaccgcgaggacctgaagcagctcaagcagttcgtgaaggccagcctgcccgagaagtaccaggagatcttcgccgactccagcaaggacggctacgccgggtacatcgagggcaagaccaaccaggaggcgttctacaagtacctgagcaagctcctgacgaagcaggaggggtccgagtacctgctcgagaagatcaagaacgaggacttcctgcggaagcagcgcaccttcgacaacggcagcatcccccaccaggtgcacctgaccgagctccgcgccatcatccggcgccagtccgagtactacccgttcctgaaggagaacctggaccggatcgagaagatcctcaccttccgcatcccctactacgtcggccccctggcccgggagaagtccgacttcgcctggatgacgcgcaagaccgacgacagcatccggccctggaacttcgaggacctggtggacaaggagaagtccgccgaggcgttcatccaccgcatgaccaacaacgacctgtacctcccggaggagaaggtgctgcccaagcacagcctgatctacgagaagttcaccgtctacaacgagctcacgaaggtgcggttcctggccgaggggttcaaggacttccagttcctgaaccgcaagcagaaggagaccatcttcaacagcctcttcaaggagaagcggaaggtgaccgagaaggacatcatctccttcctgaacaaggtcgacggctacgaggggatcgccatcaagggcatcgagaagcagttcaacgccagcctgtccacctaccacgacctcaagaagatcctggggaaggacttcctggacaacacggacaacgagctcatcctggaggacatcgtgcagaccctgaccctcttcgaggaccgcgagatgatccggaagcgcctggacatctacaaggacttcttcaccgagagccagctgaagaagctctaccggcgccactacacgggctggggccggctgtccgcgaagctgatcaacgggatccgcaacaaggagaaccagaagaccatcctcgactacctgatcgacgacggcagcgccaaccggaacttcatgcagctgatcaaggacgccgggctctccttcaagcccatcatcgacaaggcccgcaccggcagccactccgacaacctgaaggaggtggtcggggagctggccggcagccccgcgatcaagaagggcatcctccagtccctgaagatcgtggacgagctggtgaaggtcatggggtacgagccggagcagatcgtggtcgagatggcccgcgagaaccagaccacggccaagggcctcagccggagccgccagcggctgaccaccctgcgcgagtccctcgccaacctcaagagcaacatcctggaggagaagaagcccaagtacgtgaaggaccaggtggagaaccaccacctctccgacgaccggctgttcctgtactacctccagaacgggaaggacatgtacaccgacgacgagctggacatcgacaacctgagccagtacgacatcgaccacatcatcccccaggccttcatcaaggacgactccatcgacaaccgcgtcctcgtgagctccgcgaagaaccggggcaagagcgacgacgtgccctccgtcgagatcgtgaaggactgcaaggtgttctggaagaagctgctggacgccaagctcatgagccagcgcaagtacgacaacctgaccaaggccgagcgcgggggcctgacgtccgacgacaaggcccggttcatccagcggcagctcgtcgagacccgccagatcaccaagcacgtggcccggatcctggacgagcgcttcaacaacgagctggacagcaagggccggcgcatccggaaggtgaagatcgtcaccctcaagtccaacctggtgagcaacttccgcaaggagttcgggttctacaagatccgggaggtgaacaactaccaccacgcgcacgacgcctacctgaacgccgtcgtggccaaggcgatcctcacgaagtacccgcagctggagcccgagttcgtgtacggcgactaccccaagtacaactcctacaagacccgcaagagcgccaccgagaagctgttcttctactccaacatcatgaacttcttcaagaccaaggtcacgctcgccgacgggaccgtggtggtcaaggacgacatcgaggtgaacaacgacaccggcgagatcgtgtgggacaagaagaagcacttcgccaccgtccggaaggtgctgagctacccccaggtgaacatcgtcaagaagacggagatccagaccggcgggttcagcaaggagtccatcctggcccacggcaacagcgacaagctcatcccgcgcaagaccaaggacatctacctggaccccaagaagtacgggggcttcgactcccccatcgtggcgtacagcgtgctggtcgtggccgacatcaagaaggggaaggcccagaagctcaagaccgtgacggagctgctgggcatcaccatcatggagcgctcccggttcgagaagaaccccagcgccttcctcgagtccaagggctacctgaacatccgcgacgacaagctgatgatcctcccgaagtacagcctgttcgagctggagaacgggcggcgccggctcctggcctccgcgggcgagctgcagaaggggaacgagctcgccctgcccacccagttcatgaagttcctgtacctcgccagccgctacaacgagctgaagggcaagcccgaggagatcgagcagaagcaggagttcgtcgtgcagcacgtgtcctacttcgacgacatcctgcagatcatcaacgacttcagcaaccgggtcatcctcgccgacgccaacctggagaagatcaacaagctgtaccaggacaacaaggagaacatcccggtggacgagctcgcgaacaacatcatcaacctgttcaccttcacgtccctgggggcccccgccgccttcaagttcttcgacaagatcgtggaccgcaagcggtacaccagcaccaaggaggtcctcaactccaccctgatccaccagagcatcacgggcctgtacgagacccgcatcgacctcggcaagctgggggaggactga

SEQ ID NO: 1983 - RNA, 4116 nt, synthetic construct
  misc_feature 1..4116: note = Cas9 variant
  source 1..4116: mol_type = other RNA
atgaaggtgaacaactaccacatcggcctggacatcgggaccagctccatcggctgggtcgccatcggggaggacggcaagcccctccgcatcaaggggaagaccgccatcggcgcgcggctgttccaggagggcaacccggccgccgaccgccggatgttccgcacgacccggcgccggctgagccgccggaagtggcgcctcaagctgctggaggagatcttcgacccctacatcacccccgtggactccaccttcttcgcccggctcaagcagagcaacctgtcccccaaggacagccgcaaggagttcaaggggtccatgctgttcccggacctcacggacatgcagtaccacaaggactaccccaccatctaccacctccggcacgccctgatgacccaggacgagaagttcgacatccgcatggtgtacctggcgatccaccacatcgtcaagtaccggggcaacttcctgaacagcacccccgtggactccttcaaggccagcaaggtgaacttcgtcgaccagttcaagaagctgaacgagctctacacggccatcaaccccgaggagtccttccagatcaacctggccaacagcgaggacatcgggcaccagttcctggacccgtccatccgcaagttcgacaagaagaagcagatccccaagatcgtgcccgtgagcgtcgacgacaaggcgaccgacaagatcaacggcaagatcgcctccgagatcatcaacgccatcctcgggtacaagagcaagctggacgtggtggtccagtgcacccccgtggactccaagagctgggccctgaagttcgacgaggaggacatcgacgccaagctccagaagatcctgccggagatggacgagaaccagcagtccatcatcgcgatcctgcagaacctctacagccaggtgaccctgaaccagatcgtccccaacggcatgagcctgtccgagagcatgatcgagaagtacaacgaccaccacgaccacctcaagctgtacaagaagatcatcgaccagctggccgaccccaagaagaaggccgccctcaagaaggcctactcccagtacgtgggcgacgacgggaaggtgatcgagcaggcggacttctggagctccgtcaagaagaacctggacgacagcgacctgtccaagcagatcatggacctcatcgacgccgagaagttcatgcccaagcagcggacgagccagaacggcgtgatcccgcaccagctgcaccagcgcgagctggacgagatcatcgagcaccagtccaagtactacccctggctcgccgagatcaaccccaacaagcacgacctgcacctggccaagtacaagatcgaggagctcgtggccttccgggtcccctactacgtggggccgatgatcacccccgacgaccaggccaagagcgcggagaccgtgttctcctggatggagcgcaagggcaaggaggccggccagatcaccccctggaacttcgacgagaaggtcgaccggaacgccagcgccaaccgcttcatcaagcgcatgacgaccaaggacacctacctgatcggggaggacgtgctgcccgacgagtccctcctgtacgagaagttcaaggtcctgaacgagctcaacatggtgcgggtgaacggcaagctgctgaaggtcgcggacaagcaggccatcttccaggacctcttcgagaactacaagcacatcagcgtgaagaagctgcagaactacatcaagtccaagaccgggctgccgagcgaccccgagatctccggcctgagcgaccccgagtacttcaacaactccctcgggacgtacaacgacttcaagaagctgttcggcaacaaggtggacgagcccgacctgcaggacgacttcgagaagatcgtcgagtggagcaccgtgttcgaggacaagcgcatcctccgggagaagctgaacgagatcacctggctgagcgaccagcagaaggacgtgctcgagtccagccgctaccagggctgggggcggctgtccaagaagctgctcaccggcatcgtcaacgaccagggggagcgcatcatcgacgagctgtggaacacgaacaagaacttcatgcagatccagagcgacaacgacttcgccaagcggatccacgaggccaacgcggaccagatgaaggccgtggacgtggaggacgtcctggccgacgcctacacctccccgcagaacaagaaggccatccgccaggtggtgaaggtcgtggacgacatccagaaggcgatgggcggggtggcccccaagtacatcagcatcgagttcacccggtccgaggaccgcaacccccggcgcaccatcagccggcagcgccagctcgagaacacgctgaaggacaccgccaagtccctggccaagagcatcaacccggagctcctgtccgagctggacaacgccgccaagagcaagaagggcctcaccgaccggctgtacctgtacttcacccagctcggcaaggacatctacacggggaagcccatcaacatcgacgagatctccacctacgacatcgaccacatcctgccccaggcgttcgtcaaggacgacagcctgaacaaccgcgtgctcgtgtccaaggccatcaacaacggcaagagcgacaacgtccccgtgcagctgttcggggccaagatgggccacttctggaagcagctggccgaggcggggctcatctccaagcggaagctgaagaacctgcagaccgacccggacaccatcagcaagtacgccatgcacggcttcatccgccggcagctcgtggagacgagccaggtcatcaagctggtggccaacatcctgggcgacaagtaccgcaacgacaacaccaagatcatcgagatcaccgcccgcatgaaccaccagatgcgggacgagttcgggttcatcaagaaccgcgagatcaacgactaccaccacgcgttcgacgcctacctcaccgccttcctgggccggtacctgtaccaccgctacatcaagctccggccctacttcgtgtacggggacttcaagaagttcaaggaggacaaggtcaccatgcgcaacttcaacttcctgcacgacctgacggacgacacccaggagaagatcgccgacgccgagaccggcgaggtgatctgggaccgggagaactccatccagcagctcaaggacgtgtaccactacaagttcatgctgatcagccacgaggtctacaccctgcgcggcgcgatgttcaaccagacggtgtaccccgcctccgacgccgggaagcggaagctcatccccatcaaggccgaccgcccgatcaacgtgtacggcgggtacagcggctccgccgacgcgtacatggccatcgtccggatccacaacaagaagggggacaagtaccgcgtggtgggcgtccccatgcgggcccgcgaccggctggacgccgccaagaaggtgagcgacgcggactgcgaccgcgccctgaaggacgtgctcacgccccagctgaccaagaccaagaagtcccggaagaccggcgagatcacccaggtcgtggaggacttcgagatcgtgctggggaaggtcatgtaccgccagctcatgatcgacggcgacaagaagttcatgctggggagctccacctaccagtacaacgccaagcagctggtgctcagcgaccagtccgtgaagaccctggccagcaagggccggctggaccccctccaggagtccatggactacaacaacgtctacacggagatcctggacaaggtgaaccagtacttcagcctgtacgacatgaacaagttccgccacaagctcaacctggggttctccaagttcatcagcttcccgaaccacaacgtgttcgacggcaacaccaaggcgtccagcggcaagcgggagatcctggaggaggtcctcaacgggctgcacgccaaccccaccttcggcaacctgaaggacatcgggatcaccacgcccttcggccagctccagcagcccaacgggatcctgctgtccgacgaggccaagatccgctaccagagcccgaccggcctcttcgagcgcaccgtgagcctgaaggacctgtga

SEQ ID NO: 1984 - RNA, 4116 nt, synthetic construct
  misc_feature 1..4116: note = Cas9 variant
  source 1..4116: mol_type = other RNA
atggacaagaagtacagcatcggcctggacatcgggaccaactccgtgggctgggccgtcatcaccgacgactacaaggtgcccagcaagaagttcaaggtgctcgggaacacggaccgccactccatcaagaagaacctgatcggcgccctgctgttcgacagcggggagaccgcggaggccacccggctgaagcgcaccgcccggcgccggtacacgcgccggaagaaccgcatccggtacctgcaggagatcttctccagcgagatgtccaaggtcgacgacagcttcttccaccgcctcgaggagtccttcctggtggaggaggacaagaagcacgagcggcacccgatcttcggcaacatcgtggacgaggtcgcctaccacgagaagtaccccaccatctaccacctccgcaagaagctcgccgacagcaccgacaaggcggacctgcggctgatctacctcgccctggcccacatgatcaagttccgcggccacttcctgatcgagggggacctcaaccccgacaactccgacatggacaagctgttcatccagctggtgcagacctacaaccagctgttcgaggagaaccccatcaacgccagccgggtggacgcgaaggccatcctgtccgcccgcctgagcaagtcccggcgcctcgagaacctgatcgcccagctgccgggcgagaagcggaacggcctcttcgggaacctgatcgccctgagcctcgggctgacgcccaacttcaagtccaacttcgacctggcggaggacgccaagctccagctgagcaaggacacctacgacgacgacctggacaacctcctggcccagatcggcgaccagtacgccgacctgttcctcgccgcgaagaacctgtccgacgccatcctgctcagcgacatcctgcgcgtcaacagcgagatcaccaaggcgcccctgtccgccagcatgatcaagcggtacgacgagcaccaccaggacctcaccctgctgaaggccctcgtgcgccagcagctgcccgagaagtacaaggagatcttcttcgaccagtccaagaacggctacgcggggtacatcgacggcggggccagccaggaggagttctacaagttcatcaagccgatcctggagaagatggacggcacggaggagctcctggccaagctgaaccgcgaggacctgctccggaagcagcgcaccttcgacaacggctccatcccccaccagatccacctgggggagctgcacgccatcctccggcgccaggaggacttctaccccttcctgaaggacaaccgggagaagatcgagaagatcctgaccttccgcatcccctactacgtgggcccgctcgcccgggggaacagccgcttcgcgtggatgacccggaagtccgaggagacgatcaccccctggaacttcgaggaggtcgtggacaagggcgccagcgcccagtccttcatcgagcgcatgaccaacttcgacaagaacctgcccaacgagaaggtgctgcccaagcacagcctcctgtacgagtacttcaccgtctacaacgagctgacgaaggtgaagtacgtgaccgaggggatgcggaagccggagttcctctccggcaagcagaaggaggccatcgtcgacctgctgttcaagaccaaccgcaaggtgaccgtgaagcagctcaaggaggactacttcaagaagatcgagtgcttcgacagcgtcgagatctccggcgtggaggaccggttcaacgcgagcctggggacgtaccacgacctgctcaagatcatcaaggacaaggacttcctggacaacgaggagaacgaggacatcctggaggacatcgtgctcaccctgaccctgttcgaggacaaggagatgatcgaggagcgcctcaagaagtacgccaacctgttcgacgacaaggtcatgaagcagctgaagcggcgccactacaccggctgggggcggctctcccgcaagctgatcaacggcatccgggacaagcagagcgggaagacgatcctggacttcctcaagtccgacggcttcgccaaccgcaacttcatgcagctgatcaacgacgacagcctgaccttcaaggaggccatccagaaggcccaggtgtccggccaggggcacagcctccacgagcagatcgcgaacctggccggcagccccgccatcaagaaggggatcctgcagtccgtcaaggtggtggacgagctcgtcaaggtgatgggccacaagcccgagaacatcgtgatcgagatggcccgcgagaaccagaccacccagaaggggcagaagaacagccgggagcgcatgaagcggatcgaggagggcatcaaggagctgggctcccagatcctgaaggagcaccccgtcgagaacacgcagctccagaacgagaagctgtacctgtactacctccagaacgggcgcgacatgtacgtggaccaggagctggacatcaaccggctgagcgactacgacgtggaccacatcgtcccgcagtccttcatcaaggacgacagcatcgacaacaaggtgctcacccgctccgacaagaaccggggcaagagcgacaacgtgccctccgaggaggtcgtgaagaagatgaagaactactggcgccagctgctgaacgccaagctcatcacccagcggaagttcgacaacctgaccaaggcggagcgcgggggcctgagcgagctcgacaaggccggcttcatcaagcggcagctggtggagacgcgccagatcaccaagcacgtcgcccagatcctggactcccggatgaacaccaagtacgacgagaacgacaagctcatccgcgaggtgaaggtgatcaccctcaagagcaagctggtctccgacttccggaaggacttccagttctacaaggtgcgcgagatcaacaactaccaccacgcccacgacgcctacctcaacgcggtggtcgggaccgccctgatcaagaagtaccccaagctggagagcgagttcgtgtacggcgactacaaggtgtacgacgtccggaagatgatcgccaagtccgagcaggagatcgggaaggccacggcgaagcgcttcttctacagcaacatcatgaacttcttcaagaccgagatcaccctcgccaacggcgagatccggaagcgccccctgatcgagaccaacgaggagacgggggagatcgtgtgggacaagggccgggacttcgccaccgtgcgcaaggtcctgtccatgccccaggtgaacatcgtgaagaagaccgaggtccagaccggcgccctcacgaacgagagcatctacgcccgcgggagcttcgacaagctgatctcccggaagcaccgcttcgagagctccaagtacggcgggttcggcagcccgaccgtgacctactccgtgctggtcgtggccaagagcaaggtgcaggacgggaaggtcaagaagatcaagaccggcaaggagctcatcggcatcacgctgctggacaagctcgtgttcgagaagaaccccctgaagttcatcgaggacaaggggtacggcaacgtgcagatcgacaagtgcatcaagctgcccaagtactccctcttcgagttcgagaacgggacccggcgcatgctggccagcgtcatggccaacaacaactcccggggcgacctgcagaaggccaacgagatgttcctcccggccaagctggtgaccctgctctaccacgcgcacaagatcgagagctccaaggagctggagcacgaggcctacatcctggaccactacaacgacctctaccagctgctgagctacatcgagcgcttcgcctccctctacgtggacgtcgagaagaacatcagcaaggtgaaggagctgttctccaacatcgagagctactccatcagcgagatctgctccagcgtgatcaacctgctcaccctgacggccagcggggcccccgcggacttcaagttcctgggcaccaccatcccccggaagcgctacggctccccgcagagcatcctctccagcaccctgatccaccagtccatcacggggctgtacgagacccggatcgacctcagccagctgggcggggactga

SEQ ID NO: 1985 - RNA, 4116 nt, synthetic construct
  misc_feature 1..4116: note = Cas9 variant
  source 1..4116: mol_type = other RNA
atggacaagaagtacagcatcggcctggacatcgggaccaactccgtgggctgggccgtcatcaccgacgactacaaggtgcccagcaagaagttcaaggtgctcgggaacacggaccgccactccatcaagaagaacctgatcggcgccctgctgttcgacagcggggagaccgcggaggccacccggctgaagcgcaccgcccggcgccggtacacgcgccggaagaaccgcatccggtacctgcaggagatcttctccagcgagatgtccaaggtcgacgacagcttcttccaccgcctcgaggagtccttcctggtggaggaggacaagaagcacgagcggcacccgatcttcggcaacatcgtggacgaggtcgcctaccacgagaagtaccccaccatctaccacctccgcaagaagctcgccgacagcaccgacaaggcggacctgcggctgatctacctcgccctggcccacatgatcaagttccgcggccacttcctgatcgagggggacctcaaccccgacaactccgacatggacaagctgttcatccagctggtgcagacctacaaccagctgttcgaggagaaccccatcaacgccagccgggtggacgcgaaggccatcctgtccgcccgcctgagcaagtcccggcgcctcgagaacctgatcgcccagctgccgggcgagaagcggaacggcctcttcgggaacctgatcgccctgagcctcgggctgacgcccaacttcaagtccaacttcgacctggcggaggacgccaagctccagctgagcaaggacacctacgacgacgacctggacaacctcctggcccagatcggcgaccagtacgccgacctgttcctcgccgcgaagaacctgtccgacgccatcctgctcagcgacatcctgcgcgtcaacagcgagatcaccaaggcgcccctgtccgccagcatgatcaagcggtacgacgagcaccaccaggacctcaccctgctgaaggccctcgtgcgccagcagctgcccgagaagtacaaggagatcttcttcgaccagtccaagaacggctacgcggggtacatcgacggcggggccagccaggaggagttctacaagttcatcaagccgatcctggagaagatggacggcacggaggagctcctggccaagctgaaccgcgaggacctgctccggaagcagcgcaccttcgacaacggctccatcccccaccagatccacctgggggagctgcacgccatcctccggcgccaggaggacttctaccccttcctgaaggacaaccgggagaagatcgagaagatcctgaccttccgcatcccctactacgtgggcccgctcgcccgggggaacagccgcttcgcgtggatgacccggaagtccgaggagacgatcaccccctggaacttcgaggaggtcgtggacaagggcgccagcgcccagtccttcatcgagcgcatgaccaacttcgacaagaacctgcccaacgagaaggtgctgcccaagcacagcctcctgtacgagtacttcaccgtctacaacgagctgacgaaggtgaagtacgtgaccgaggggatgcggaagccggagttcctctccggcaagcagaaggaggccatcgtcgacctgctgttcaagaccaaccgcaaggtgaccgtgaagcagctcaaggaggactacttcaagaagatcgagtgcttcgacagcgtcgagatctccggcgtggaggaccggttcaacgcgagcctggggacgtaccacgacctgctcaagatcatcaaggacaaggacttcctggacaacgaggagaacgaggacatcctggaggacatcgtgctcaccctgaccctgttcgaggacaaggagatgatcgaggagcgcctcaagacctacgcccacctgttcgacgacaaggtcatgaagcagctgaagcggcgccactacacgggctgggggcggctctcccgcaagctgatcaacggcatccgggacaagcagagcgggaagaccatcctggacttcctcaagtccgacggcttcgccaaccgcaacttcatccagctgatccacgacgacagcctgaccttcaaggaggccatccagaaggcccaggtgtccggccaggggcacagcctccacgagcagatcgcgaacctggccggcagccccgccatcaagaaggggatcctgcagtccgtcaaggtggtggacgagctcgtcaaggtgatgggccacaagcccgagaacatcgtgatcgagatggcccgcgagaaccagaccacgcagaaggggcagaagaacagccgggagcgcatgaagcggatcgaggagggcatcaaggagctgggctcccagatcctgaaggagcaccccgtcgagaacacccagctccagaacgagaagctgtacctgtactacctccagaacgggcgcgacatgtacgtggaccaggagctggacatcaaccggctgagcgactacgacgtggaccacatcgtcccgcagtccttcatcaaggacgacagcatcgacaacaaggtgctcacccgctccgacaagaaccggggcaagagcgacgacgtgccctccgaggaggtcgtgaagaagatgaagaactactggcgccagctgctgaacgccaagctcatcacccagcggaagttcgacaacctgacgaaggcggagcgcgggggcctgagcgagctcgacaaggccggcttcatcaagcggcagctggtggagacccgccagatcaccaagcacgtcgcccagatcctggactcccggatgaacaccaagtacgacgagaacgacaagctcatccgcgaggtgaaggtgatcaccctcaagagcaagctggtctccgacttccggaaggacttccagttctacaaggtgcgcgagatcaacaactaccaccacgcccacgacgcctacctcaacgcggtggtcgggacggccctgatcaagaagtaccccaagctggagagcgagttcgtgtacggcgactacaaggtgtacgacgtccggaagatgatcgccaagtccgagcaggagatcgggaaggccaccgcgaagcgcttcttctacagcaacatcatgaacttcttcaagaccgagatcaccctcgccaacggcgagatccggaagcgccccctgatcgagacgaacgaggagaccggggagatcgtgtggaacaagggccgggacttcgccaccgtgcgcaaggtcctgtccatgccccaggtgaacatcgtgaagaagaccgaggtccagacgggcgccctcaccaacgagagcatctacgcccgcgggagcttcgacaagctgatctcccggaagcaccgcttcgagagctccaagtacggcgggttcggcagcccgaccgtgacctactccgtgctggtcgtggccaagagcaaggtgcaggacgggaaggtcaagaagatcaagacgggcaaggagctcatcggcatcaccctgctggacaagctcgtgttcgagaagaaccccctgaagttcatcgaggacaaggggtacggcaacgtgcagatcgacaagtgcatcaagctgcccaagtactccctcttcgagttcgagaacgggacccggcgcatgctggccagcgtcatggccaacaacaactcccggggcgacctgcagaaggccaacgagatgttcctcccggccaagctggtgaccctgctctaccacgcgcacaagatcgagagctccaaggagctggagcacgaggcctacatcctggaccactacaacgacctctaccagctgctgagctacatcgagcgcttcgcctccctctacgtggacgtcgagaagaacatcagcaaggtgaaggagctgttctccaacatcgagagctactccatcagcgagatctgctccagcgtgatcaacctgctcacgctgaccgccagcggggcccccgcggacttcaagttcctgggcaccaccatcccccggaagcgctacggctccccgcagagcatcctctccagcacgctgatccaccagtccatcaccgggctgtacgagacccggatcgacctcagccagctgggcggggactga

SEQ ID NO: 1986 - RNA, 4116 nt, synthetic construct
  misc_feature 1..4116: note = Cas9 variant
  source 1..4116: mol_type = other RNA
atgaacaacaacaactacagcatcggcctggacatcgggaccaactccgtgggctgggccgtcatcaccgacgactacaaggtgcccagcaagaagatgcgcgtgctcgggaacacggacaagcggttcatcaagaagaacctgatcggcgccctgctgttcgacgaggggaccaccgcggaggaccgccggctgaagcgcaccgcccggcgccggtacacgcgccggaagaaccgcctgcggtacctccaggagatcttcgccgaggagatgtccaaggtcgacagctccttcttccaccgcctggacgacagcttcctggtgccggaggacaagtccggcagcaagtaccccatcttcgccaccctcgccgaggagaaggagtaccacaagaagttccccaccatctaccacctccggaagcacctggcggactccaaggagaaggccgacctccgcctgatctacctggccctcgcccacatcaccaagtaccggggccacttcctgtacgaggaggcgttcgacatcaagaacaacgacatccagaagatcttcaacgagttcatcaacatctacgacaacacgttcgaggggagctccctgagcggccagaacgcccaggtggaggccatcttcaccgggaagatctccaagagcgtcaagcgcgagcacgtgctcaagctgttccccgacgagaagtccaccggcctgttcagcgagttcctcaagctgatcgtggggaaccaggccgacttcaagaagcacttcgacctggaggagaaggcctccctccagttcagcaaggacacctacgacgaggacctggagaacctgctcggccagatcggcgacgacttcgcggacctgttcctggtcgccaagaagctctacgacgccatcctgctgtccgggatcctcacggtgaccgacccgagcaccaaggcgcccctgagcgcctccatgatcgagcggtacgagaaccaccaggaggacctggccgccctcaagcagttcatcaagaacaacctgcccgagaagtacgccgaggtgttcagcgaccagtccaaggacggctacgccgggtacatcgacggcaagaccacgcaggaggccttctacaagtacatcaagaacctgctcagcaagttcgagggcgcggactacttcctggacaagatcgagcgcgaggacttcctgcggaagcagcgcaccttcgacaacgggtccatcccccaccagatccacctccaggagatgaacgccatcctgcggcgccagggcgagcactacccgctgctcaaggagaacaaggagaagatcgagaagatcctgaccttccgcatcccctactacgtcgggcccctggcccggggcaaccgcgacttcgcctggctcacccggaacagcgaccaggccatccgcccctggaacttcgaggagatcgtggacaaggcgtccagcgccgagtccttcatcaacaagatgacgaactacgacctgtacctgccggaggagaaggtgctgcccaagcacagcctcctgtacgagaccttcgccgtctacaacgagctgaccaaggtgaagttcatcgccgaggggctccgggactaccagttcttcgactccggccagaagaagcagatcgtgaaccagctgttcaaggagaagcgcaaggtcaccgagaaggacatcatccactacctgcacaacgtggacggctacgacgggatcgagctcaagggcatcgagaagcagttcaacgcgagcctgtccacgtaccacgacctgctcaagatcatcaaggacaaggagttcatggacaaccacaagaaccaggagatcctggagaacatcgtgcacaccctgaccatcttcgaggaccgggagatgatcaagcagcgcctcgcccagtacgacagcatcttcgacgagaaggtcatcaaggccctgacccggcgccactacacggggtggggcaagctgtccgccaagctcatcaacgggatctgcgacaagaagaccggcaagaccatcctggactacctgatcgacgacggctacaacaaccggaacttcatgcagctcatcaacgacgacgggctgagcttcaaggagatcatccagaaggcccaggtggtgggcaagaccgacgacctgacgcaggtcgtgcgcgagctctccgggagccccgcgatcaagaagggcatcctgcagtccatcaagatcgtcgacgagctggtgaagatcatggggtacgcccccgagagcatcgtgatcgagatggcccgggagaaccagaccaccgccaagggcaagaagaacagccagcagcgctacaagcggatcgaggacgccctcaagaacctggcgccgggcctggactccaccatcagcaaggagaaccccacggacaacatccagctccagaacgaccgcctgttcctgtactacctccagaacgggaaggacatgtacaccggcgaggccctggacatcaaccagctgtccagctacgacatcgaccacatcatcccccaggccttcatcaaggacgactccctcgacaaccgggtcctgaccagctccaaggacaaccgcggcaagagcgacaacgtgccctccctggaggtggtcaagaagcggaaggccttctggcagcagctcctggacagcaagctgatctccgagcgcaagttcaacaacctcaccaaggccgagcgcgggggcctggacgagcgggacaaggtggggttcatcaagcgccagctggtggagacccggcagatcacgaagcacgtcgcgcgcatcctcgacgcccggttcaacaccgaggtgagcgagaagaaccagaagatccgctccgtgaagatcatcaccctcaagagcaacctggtctccaacttccggaaggagttcaagctgtacaaggtgcgcgagatcaacgactaccaccacgcccacgacgcctacctgaacgcggtggtcgccaaggccatcctgaagaagtacccgaagctcgagcccgagttcgtgtacggcgactaccagaagtacgacctgaagcggtacatcagcaagtccaaggaccccaaggaggtggagaaggccaccgagaagtacttcttctacagcaacctgctcaacttcttcaaggaggaggtccactacgccgacgggacgatcgtgaagcgcgagaacatcgagtacagcaaggacaccggcgagatcgcgtggaacaaggagaaggacttcgtgaccatcaagaaggtcctgtcctacccccaggtgaacatcgtgaagaagcgggaggtccagaccgggggcttcagcaaggagtccatcctgccgaagggcaacagcgacaagctcatcccccgcaagacgaaggacatcctgtgggacaccaccaagtacgggggcttcgactcccccgtgatcgcctacagcatcctgctcatcgccgacatcgagaaggggaaggccaagaagctgaagaccgtgaagacgctggtcggcatcaccatcatggagaaggccgcgttcgagaagaaccccatcaccttcctcgagaacaaggggtaccacaacgtgcggaaggagaacatcctgtgcctgccgaagtactccctcttcgagctggagaacggccgccggcgcctgctcgccagcgccaaggagctgcagaagggcaacgagatcgtgctgcccgtctacctcaccacgctgctgtaccactccaagaacgtgcacaagctcgacgagcccgagcacctggagtacatccagaagcaccggtacgagttcaaggacctgctcaacctggtgagcgagttctcccagaagtacgtcctggccgaggccaacctcgagaagatcaagagcctgtacgtggacaacgagcaggcggacatcgagatcctggccaactccttcatcaacctcctgaccttcaccgccctgggggccccggcggccttcaagttcttcggcaaggacgtggaccgcaagcggtacaccacggtcagcgagatcctcaacgccaccctgatccaccagtccatcaccgggctgtacgagacccgcatcgacctcagcaagctgggcgaggactga

SEQ ID NO: 1987 - RNA, 4116 nt, synthetic construct
  misc_feature 1..4116: note = Cas9 variant
  source 1..4116: mol_type = other RNA
atgaccgagaagaactacagcatcggcctggacatcgggaccaactccgtgggctgggccgtcatcacggacgactacaaggtgcccgccaagaagatgaaggtgctcgggaacaccgacaagaagtacatcaagaagaacctgctgggcgcgctcctgttcgacaacggggagaccgccgaggccacccgcctgaagcggacggcccgccggcgctacacccggcgcaagaaccggctccgctacctgcaggagatcttcgccgaggagatggcgaaggtcgacgagagcttcttctaccggctggacgagtccttcctcaccaccgacgacaaggacttcgagcgccacccgatcttcggcaacaaggccgacgagatcaagtaccaccaggagttccccacgatctaccacctccggaagcacctggccgacagccacgagaaggccgacctccgcctgatctacctggcgctcgcccacatgatcaagttccggggccacttcctgatcgagggggagctgaacgccgagaacaccgacgtgcagaagctgttcgaggccttcgtggaggtctacgaccgcaccttcgacgactccaacctgagcgagatcaccgtggacgcctccagcatcctgacggagaagttctccaagagccggcgcctcgagaacctgatcaagcactaccccaccgagaagaagaacaccctgttcggcaacctcgtggcgctggccctggggctccagcccaacttcaagacctccttcaagctgagcgaggacgccaagctgcagttctccaaggacacgtacgaggaggacctcgaggagctgatcggcaagatcggggacgagtacgccgacctgttcaccagcgccaagaacctctacgacgcgatcctgctgtccggcatcctcaccgtcgccgacaacaccacgaaggccccgctgagcgcctccatgatcaagcggtacaacgagcaccaggtggacctgaagaagctcaaggagttcatcaagaacaacgccagcgacaagtacgacgagatcttcaacgacaaggacaagaacggctacgcggggtacatcgagaacggcgtgaagcaggacgagttctacaagtacctgaagaccaccctgtccaagatcgacgggagcgactacttcctcgacaagatcgagcgcgaggacttcctgcggaagcagcgcaccttcgacaacggcagcatcccccaccagatccacctccaggagatgcacgccatcctccggcgccagggcgagcactacgccttcctgaaggagaaccaggccaagatcgagaagatcctgacgttccgcatcccctactacgtcgggcccctcgcccggaagaactcccgcttcgcgtgggccgagtaccacagcgacgagaagatcaccccgtggaacttcgacgagatcatcgacaaggagaagtccgccgagaagttcatcacccggatgaccctgaacgacctgtacctgcccgaggagaaggtgctccccaagcacagcctggtgtacgagacgtacaccgtctacaacgagctgaccaaggtgaagtacgtgaacgagcagggcaagtccaacttcttcgacgccaacatgaagcaggagatcttcgagcacgtcttcaaggagaaccgcaaggtgaccaaggacaagttcctcaactacctgaacaaggagttccccgagtaccggatccaggacctgatcgggctcgacaaggagaacaagagcttcaacgcgtccctgggcacgtaccacgacctgaagaagatcctcgacaagagcttcctggacgacaagaccaacgagaccatcatcgaggacatcatccagaccctgacgctgttcgaggaccgcgacatgatccggcagcgcctgcagaagtactccgacatcttcaccccgcagcagctgaagaagctcgagcggcgccactacaccgggtggggccggctgagctacaagctgatcaacggcatccgcaacaaggagaacgggaagtccatcctcgactacctgatcgacgacggctacgccaaccggaacttcatgcagctgatcagcgacgacaccctccccttcaagcagatcatcaaggacgcccagatcatcggggacatcgacgacgtgacctccgtcgtgcgcgagctgcccggcagccccgccatcaagaaggggatcctgcagtccgtgaagatcgtcgacgagctcgtgaaggtcatgggccacaacccggacaacatcgtgatcgagatggcccgggagaaccagacgaccaaccgcggccggaaccagagccagcagcgcctgaagaagctgcaggactccctcaaggagctggggagcaacatcctgaacgaggagaagccctcctacatcgagggcaaggtggagaacaaccacctccaggacgaccggctgttcctgtactacatccagaacgggaaggacatgtacaccggcgacgagctcgacatcgaccacctgagcgactacgacatcgaccacatcatcccccaggcgttcatcaaggacgacagcatcgacaaccgcgtcctgacctccagcgccaagaaccgcgggaagtccgacgacgtgcccagcctcgacatcgtgcacgaccggaaggccgactggatccgcctgtacaagtccggcctgatcagcaagcggaagttcgacaacctcacgaaggccgagcgcggcgggctgaccgagaacgacaaggccggcttcatcaagcggcagctggtcgagacccgccagatcaccaagcacgtggcgcagatcctcgactcccggttcaacacggagcgcgacgagaacgacaaggtgatccggaacgtcaaggtgatcaccctcaagagcaacctggtgtcccagttccgcaaggacttcaagttctacaaggtccgggagatcaacgactaccaccacgcccacgacgcctacctgaacgccgtggtggggaccgccctgctgaagaagtacccgaagctcgcgcccgagttcgtctacggcgagtacaagaagtacgacatccgcaagttcatcaccagctccggcgacaaggccacggccaagtacttcttctacagcaacctgatgaacttcttcaagcgggtgatccgctactccaacgggaaggtggtcgtgcggcccgtgatcgagtgcagcaaggacaccggcgagatcgcctggaacaagcagaccgacttcgagaaggtccgccgggtgctgtcctacccccaggtgaacatcgtcaagaaggtggagacccagaccgggggcttcagcaaggagtccatcctcccgaaggggaacagcgacaagctgatcccccgcaagacgaagaagttccggtgggacacccccaagtacggcggcttcgacagccccaacatcgcgtactccgtgttcgtcatcgccgacgtggagaaggggaaggccaagaagctgaagaccgtgaaggagctcgtcggcatcagcatcatggagcgctccagcttcgaggagaacccggtggtgttcctggagaagaaggggtaccagaacgtccaggaggacaacctgatcaagctccccaagtactccctgttcgagttcgagggcgggcggcgccgcctgctcgccagcgcctccgagctgcagaagggcaacgaggtggtgctgagccggcacctcgtcgagctgctgtaccacgcgcaccgcgtgaactccttcaacaacagcgagcacctcaagtacgtgtccgagcacaagaaggagttcggcgaggtcctgagctgcgtggagaacttcgccaagtcctacgtggacgtcgagaagaacctggggaagatccgggccgtggccgacaagatcgacacgttcagcatcgaggacatctccatcagcttcgtgaacctcctgaccctgaccgccctcggcgcgcccgccgacttcaacttcctgggggagaagatcccgcgcaagcggtacacctccacgaaggagtgcctgaacgccaccctcatccaccagagcatcaccggcctgtacgagacccgcatcgacctgtccaagctcggggaggagtga

SEQ ID NO: 1988 - RNA, 4116 nt, synthetic construct
  misc_feature 1..4116: note = Cas9 variant
  source 1..4116: mol_type = other RNA
atgaacctgcgcaacgtggagagctaccaggtcggcctcgacatcgggaccggctccgtggggtgggccgtgctggacgacaacggcgacctgtgccggttcaaggggaagcccacctggggcagccgcgtcttcccgacggccgagaccgcggccgaggcccgggtgcaccgcggccagcggcgccggtacgaccgccggcgccagcggatcgacctcctgcagcgcttcttcgccgacgaggtggccaaggtcgaccccgagttcttcatccggctgaaccaggcgcgcctccaccccgagaaccgggaccccgcccacgccgactaccgctggccgctgttcaacgggtccaacttcaccgagaaggactactaccggcagttccccaccatctaccacctccgcgcccacctcctcaagagcgacgagcccgcggacatccggctggtgtacctggccctgcacaacatcgtgaagcaccgcggcaacttcctgcaccaggacaacccctccctgagcgcccggaacgccaacgtcggggacgccgtggaggcgctgtgcctggccctcgacgagtggtgcggcgcccacgacgtggagtgcgcctgcgacgaggccgcgctggccgaggccctgggggacgcctccctccgcccgggcgagaagcgcgagcgggccgaggcggccctgggcgtcgagaaggcccacaagaagctggccaaggccgtgagctccgcggtggtcgggtacgccgccgagttcggccacgtgttcttcgccgagagcgaggggtccaagttcgcgctcagcaacgacgagaaggtggaggcctacgtctgccccgacgagggccgcgacctgttcgacgccatgcgggccgtgcactccagctacgtgctgatgggcatcctctccgaggcccagggggagctgctgagcgtctgcaaggtgggcgagtacgagcgctacaagcgggacctcgagacgctgaagtccctggtgcgcgcgtacgggcccgagcggtacgacgagttcttctgcggccccttctacgaggggacccgcgactacgacccgggcaaggcccagggctacaccaagtacaacctcggggccagcaagctgtcccacgaggacttcctgaaggaggtccagaagctcctgaaggacatcggcgcccaggccgacgagcggtacgcggacatcgagcgcgccatcgaggccggggccttcctgcggcgcctcaagaccagcgacaacggcacgatcccctaccagctgcacctggaggagatggacgccatcatcgagcggcaggcggccttctaccccttcctcgcccaggagaaggacaagctcaagagcctggtgtccttccgcatcccctactacgtcgggccgctgacccagaagaacgccgcgcgggacggcaagggcgaggcccgcttcgcctggagctcccggaagcccgggatggaggacgcccgcgtgtacccctggaactgggaggacgtgatcgacaaggaccagagcgccgaggacttcatccggcgcatgaccgggacctgcacgtacctgaagggggagcccgtcctggcgcgctgctccctcgactacgagctgttctgcgtgctgaacgagctggccggcgcccggtggacccaggacggggacaagagctaccgcttcgacgccgccgaccggctcggcatcgtggaggacctgttcaagaagcgcaagcgggtcacctacgaggcggccgagaagtggctggcccgcacccacggcccggagtccggcaagagcgccggcggggcctaccacgtgtccggcggccagggggaggacgcgttcgagagccagctctccagccactacgacttctgcaagatcctgggcgtggacgagctgtccgacgccgacgaggccatggccgaggacatcatcctctggaacacggtcttcgaggaccggagcatcctgaagcgcaagatcaagctggcgtacggggaccggctcggcgacgcccaggtgcgcaagctgtgccagaagcggtacaccgggtggggccgcctgtccggcgagctcctgcgggggctgcgcagcgccaccgacaacggccccaagaccatcatggacatcctcctggagggggaccccaaccacgcccggcgcatgggcgccgcgatgaacctgatggagatcctccacgacgacctgctggagttccaggccaagatcgacgagcacaaccgggagcgcgccctcgccgtcgggggcatgtccgtggacgaggtgacgggcagccccgccctgcggcgcgggatcaaccaggcgctgcgggtggtcgacgagatcgccggcatcgccgggaagccgcccgcccacatctacgtggaggtgacccgcgacgagggcgcccgcaacaaggggcggcgcaccacctcccggtaccgcgcgctcgaggccgccctgagcagcatcaaggcccagtgcgccgacgtctacgcggagctgaaggagcgggacccccgcgccctcgacgacgagcggctgacgctgtacttcatgcagtgcggcaagtgcatgtactccggcgacgccctcgacatcaacaagctgcagacctaccaggtggaccacatcctgccccagagctacgtgaaggacgactccttcgagaacaaggtcctcgtgcgcccggacaccaaccagcggaagggggacaccctgctgctcgacgagcgcctgatcgcccggatgcgcggcttctggcggacgctgcgcgacgcggagctcatcggggagaagaagttcaacaacctgacccggaccagcgtgtccgacgagcagatgaagaagttcgtcagccgccagctggtggagaccggccagatggtgaagcaggtccagcagctcctgcaggcccggtaccccgagtccgaggtgcagcccgtgaaggccggggtcagccaccagctgcgcgtgggctgcgccctcgccaagtcccgggagatcaacgacttccaccacgcgcacgacgcctacctggcctgccaggtgggccgcttcgtccagtaccgccacagcgccgtgtactccgagccggtgaagatggccgcggtcgtgaagcagttcatcaagaagcaggccgaggactaccggcgcacgcgggagctgcccgggagcgacggcttcatcgtgtccagcttcatgacccccgggttcgacgtcaagaccggcgaggtgttccgcgacgcctgggacgccggcgccgagatcgaccggatccgccggtgcttcgactacaaggactgcttcatctcccgcatgcccgaggagacccacggggcgttctgggacgccacgatctacagcccgcgggccgccggcaagaccctctccctgcccctgaagcgcgggctcgacccccggaagtacggcagctacagccgcgagcagttcgcgtacttcttcgtgtacgaggccgtcaagcccaagaagaagcagcgggtgctggagttcgccccggtgcccgtccgcgtggcctccgccctggcgaacgaccccgacgccctcgaggactacgcccgggagctggccgaggccgaggggctggtgttcgagcgcatccggcgccggaaggtctacaagtaccagcagatcatcgtgggcgacagccgcctctacgtgaccggccgggaggaggtccgcaacgcgcgccagctggccttctcccaggacgagaccaagctgatctgccggatcgagcagggggaggagtgcgaggagggcgagctcctggacctgttccgcagcatgcagcggaagtacctcgcctgcgcgccccgcctggcccggctgatgaaggtggccgagatggaggaggggttcatcgccgccaccgcctccggcaagcgcgaggtcctcctgagcctgacgtccatcgcggccgcccaccggaacagcatcgacctcaagccgatcgggcgcaagggctccagcggccagatgaagatcaccttctccaaggagctgagcaccaacgggatcctgttcgtggactccagcgtgaccggcatgttcgagcggcgctgccggctcgggctgtga

SEQ ID NO: 1989 - RNA, 4116 nt, synthetic construct
  misc_feature 1..4116: note = Cas9 variant
  source 1..4116: mol_type = other RNA
atggagaacaagaactacagcatcggcctggacatcgggaccaactccgtgggctggagcgtcatcaccgacgactacaaggtgccctccaagaagatgaaggtgctcgggaacacggacaagcgcttcatcaagaagaacctgatcggcgccctgctgttcgacgaggggaccaccgccgaggcgcggcgcctgaagcggaccgcccgccggcgctacacgcggcgcaagaaccggctgcgctacctccaggagatcttcgccgaggagatgagcaaggtcgactccagcttcttccaccggctggacgactccttcctgatcccggaggacaagcgcggcagcaagtaccccatcttcgccaccctcgccgaggagaaggagtaccacaagcagttccccaccatctaccacctccggaagcagctggcggactccaaggagaagaccgacctccgcctgatctacctggccctcgcccacatgatcaagtaccggggccacttcctgtacgaggacacgttcgacatcaagaacaacgacatccagaagatcttcagcgagttcatctccatctacgacaacaccttcgaggggagctccctgagcggccagaacgcccaggtggaggcgatcttcaccgacaagatctccaagagcgccaagcgcgagcgggtgctcaagctgttccccgacgagaagtccaccgggctgttcagcgagttcctcaagctgatcgtcggcaaccaggccgacttcaagaagcacttcgacctgggggagaaggccccgctccagttctccaaggacacgtacgacgaggacctggagaacctgctcggccagatcggcgacgacttcgccgacctgttcctggtggcgaagaagctctacgacgccatcctgctgagcgggatcctcaccgtgaccgaccccagcaccaaggcgcccctgtccgccagcatgatcgagcgctacgagaaccaccagaaggacctggccgtcctcaagcagttcatcaagaacaacctgcccgagaagtacgacgaggtgttctccgaccagagcaaggacggctacgccgggtacatcgacggcaagacgacccaggaggccttctacaagtacatcaagaacctgctctccaagttcgagggcaccgactacttcctggagaagatcgagcgggaggacttcctgcgcaagcagcggaccttcgacaacgggagcatcccgcaccagatccacctccaggagatgaacgccatcctgcgccgccagggcgagcactaccccttcctgaaggacaacaaggagaagatcgagaagatcctcacgttccggatcccctactacgtggggcccctggcccgcggcaaccgggacttcgcctggctgacccgcaactccgacgaggcgatccggccgtggaacttcgaggagatcgtcgacaaggccagctccgccgaggacttcatcaacaagatgaccaactacgacctctacctgcccgaggagaaggtgctgcccaagcacagcctgctctacgagaccttcgccgtgtacaacgagctgacgaaggtcaagttcatcgccgaggggctgcgcgactaccagttcctcgactccggccagaagaagcagatcgtgacccagctgttcaaggagaagcggaaggtgaccgagaaggacatcatccagttcctgcacaacgtcgacggctacgacgggatcgagctcaagggcatcgagaagcagttcaacgcgagcctgtccacctaccacgacctgctcaagatcatcaaggacaaggagttcatggacgacagcaagaacgaggagatcctggagaacatcgtgcacacgctgaccatcttcgaggaccgcgagatgatcaagcagcggctcgcccagtacgactccctgttcgacgagaaggtgatcaaggccctgatccgccggcactacaccgggtggggcaagctcagcgccaagctgatcgacgggatctgcgacaagcagaccggcaacacgatcctggactacctcatcgacgacggcaagaacaaccgcaacttcatgcagctgatcaacgacgacgggctgtccttcaaggagatcacccagaaggcgcaggtcgtgggcaagaccgacgacgtgaagcaggtcgtgcaggagctccccgggagcccggccatcaagaagggcatcctgcagtccatcaagatcgtcgacgagctggtgaaggtgatggggcacacccccgagagcatcgtcatcgagatggcccgggagaaccagacgaccgcccgcggcaagaagaacagccagcagcggtacaagcgcatcgaggacgccctcaagaacctggcgtccggcctggacagcaacatcctcaaggagcaccccaccaacaacatccagctgcagaacgaccggctgttcctctactacctgcagaacgggcgcgacatgtacaccggcaagcccctggacatcaaccagctctccagctacgacatcgaccacatcgtgccgcaggccttcatcaaggacgactccctggacaaccgggtgctgaccagcctcaaggacaaccgcgggaagtccgacaacgtccccagcatcgaggtggtgcagaagcgcaaggccttctggcagcagctgctggactccaagctcatcagcgagcggaagttcaacaacctgacgaaggccgagcgcggcggcctggacgagcgggacaaggtcgggttcatcaagcgccagctcgtggagacccggcagatcaccaagcacgtggcccagatcctggacgcgcgcttcaacaaggaggtcaacgagaaggacaagaagaaccggaccgtgaagatcatcacgctgaagtccaacctcgtgagcaacttccgcaaggagttccggctgtacaaggtccgcgagatcaacgactaccaccacgcccacgacgcctacctgaacgccgtggtggccaaggcgatcctcaagaagtaccccaagctggagcccgagttcgtctacggcgactaccagaagtacgacctgaagcggtacatctcccgcagccggaacccgaaggaggtggagaaggccaccgagaagtacttcttctactccaacctcctgaacttcttcaaggaggaggtgcactacgccgacgggaccatcgtcaagcgcgagaacatcgagtacagcaaggacaccggcgagatcgcctggaacaaggagaaggacttcgcgacgatcaagaaggtgctgtcctacccccaggtgaacatcgtcaagaagcgggaggtgcagaccgggggcttcagcaaggagagcatcctccccaagggcaactccgacaagctgatcccccgcaagaccaaggacatcctgtgggagaccacgaagtacgggggcttcgacagcccggtgatcgcctactccatcctcctgatcgccgacatcgagaaggggaaggccaagaagctgaagaccgtcaagaccctcgtgggcatcaccatcatggagaaggccgcgttcgaggagaaccccatcacgttcctggagaacaaggggtaccacaacgtgcggaaggagaacatcctgtgcctccccaagtacagcctgttcgagctggagaacggccgccggcgcctcctggcctccgccaaggagctgcagaagggcaacgagatcgtcctcccggtgtacctgaccaccctgctctaccacagcaagaacgtgcacaagctggacgagcccgagcacctggagtacatccagaagcaccggaacgagttcaaggacctcctgaacctggtctccgagttcagccagaagtacgtgctcgccgacgccaacctggagaagatccagaacctgtacgcggacaacgagcaggccgacatcgagatcctcgccaactccttcatcaacctgctgaccttcacggccctcggggcccccgcggccttcaagttcttcggcaaggacatcgaccgcaagcgctacaccaccgtgagcgagatcctgaacgccaccctgatccaccagtccatcacggggctctacgagacccggatcgacctgagcaagctgggcgaggactga

SEQ ID NO: 1990 - RNA, 4116 nt, synthetic construct
  misc_feature 1..4116: note = Cas9 variant
  source 1..4116: mol_type = other RNA
atggacaagaagtacagcatcggcctggacatcgggaccaactccgtgggctgggccgtcatcaccgacgactacaaggtgcccagcaagaagttcaaggtgctcgggaacacggaccgccactccatcaagaagaacctgatcggcgccctcctcttcgacagcggggagaccgcggaggccacccggctgaagcgcaccgcccggcgccggtacacgcgccggaagaaccgcatccggtacctgcaggagatcttctccagcgagatgtccaaggtcgacgacagcttcttccaccgcctcgaggagtccttcctggtggaggaggacaagaagcacgagcggcacccgatcttcggcaacatcgtggacgaggtcgcctaccacgagaagtaccccaccatctaccacctccgcaagaagctcgccgacagcaccgacaaggcggacctgcggctgatctacctcgccctggcccacatgatcaagttccgcggccacttcctgatcgagggggacctcaaccccgacaactccgacatggacaagctgttcatccagctggtgcagacctacaaccagctgttcgaggagaaccccatcaacgccagccgggtggacgcgaaggccatcctgtccgcccgcctgagcaagtcccggcgcctcgagaacctgatcgcccagctgccgggcgagaagcggaacgggctgttcggcaacctgatcgccctgagcctcgggctgacgcccaacttcaagtccaacttcgacctggcggaggacgccaagctccagctgagcaaggacacctacgacgacgacctggacaacctcctggcccagatcggcgaccagtacgccgacctgttcctcgccgcgaagaacctgtccgacgccatcctgctcagcgacatcctgcgcgtcaacagcgagatcaccaaggcgcccctgtccgccagcatgatcaagcggtacgacgagcaccaccaggacctcaccctgctgaaggccctcgtgcgccagcagctgcccgagaagtacaaggagatcttcttcgaccagtccaagaacggctacgcggggtacatcgacggcggggccagccaggaggagttctacaagttcatcaagccgatcctggagaagatggacggcacggaggagctcctggccaagctgaaccgcgaggacctgctccggaagcagcgcaccttcgacaacggctccatcccccaccagatccacctgggggagctgcacgccatcctccggcgccaggaggacttctaccccttcctgaaggacaaccgggagaagatcgagaagatcctgaccttccgcatcccctactacgtgggcccgctcgcccgggggaacagccgcttcgcgtggatgacccggaagtccgaggagacgatcaccccctggaacttcgaggaggtcgtggacaagggcgccagcgcccagtccttcatcgagcgcatgaccaacttcgacaagaacctgcccaacgagaaggtgctgcccaagcacagcctcctgtacgagtacttcaccgtctacaacgagctgacgaaggtgaagtacgtgaccgaggggatgcggaagccggagttcctctccggcaagcagaaggaggccatcgtcgacctgctgttcaagaccaaccgcaaggtgaccgtgaagcagctcaaggaggactacttcaagaagatcgagtgcttcgacagcgtcgagatctccggcgtggaggaccggttcaacgcgagcctggggacgtaccacgacctgctcaagatcatcaaggacaaggacttcctggacaacgaggagaacgaggacatcctggaggacatcgtgctcaccctgaccctgttcgaggacaaggagatgatcgaggagcgcctcaagaagtacgccaacctgttcgacgacaaggtcatgaagcagctgaagcggcgccactacaccggctgggggcggctctcccgcaagctgatcaacggcatccgggacaagcagagcgggaagacgatcctggacttcctcaagtccgacggcttcgccaaccgcaacttcatgcagctgatcaacgacgacagcctgaccttcaaggaggccatccagaaggcccaggtgtccggccaggggcacagcctccacgagcagatcgcgaacctggccggcagccccgccatcaagaaggggatcctgcagtccgtcaaggtggtggacgagctcgtcaaggtgatgggccacaagcccgagaacatcgtgatcgagatggcccgcgagaaccagaccacccagaaggggcagaagaacagccgggagcgcatgaagcggatcgaggagggcatcaaggagctgggctcccagatcctgaaggagcaccccgtcgagaacacgcagctccagaacgagaagctgtacctgtactacctccagaacgggcgcgacatgtacgtggaccaggagctggacatcaaccggctgagcgactacgacgtggaccacatcgtcccgcagtccttcatcaaggacgacagcatcgacaacaagatcctcacccgctccgacaagaaccggggcaagagcgacaacgtgccctccgaggaggtggtcaagaagatgaagaactactggcgccagctgctgaacgccaagctcatcacccagcggaagttcgacaacctgaccaaggcggagcgcgggggcctgagcgagctcgacaaggccggcttcatcaagcggcagctggtggagacgcgccagatcaccaagcacgtggcccagatcctggactcccggatgaacaccaagtacgacgagaacgacaagctcatccgcgaggtcaaggtgatcaccctgaagtccaagctggtgtccgacttccggaaggacttccagttctacaaggtccgcgagatcaacaactaccaccacgcccacgacgcctacctcaacgcggtggtggggaccgccctgatcaagaagtacacgaagctggagagcgagttcgtctacggcgactacaaggtgtacgacgtgcggaagatgatcgccaagtccgagcaggagatcgggaaggccaccgcgaagcgcttcttctacagcaacatcatgaacttcttcaagaccgagatcaccctcgccaacggcgagatccggaagcgccccctgatcgagacgaacgaggagaccggggagatcgtctgggacaagggccgggacttcgccaccgtgcgcaaggtgctgtccatgccccaggtcaacatcgtgaagaagaccgaggtgcagacgggcgccctcaccaacgagagcatctacgcccgcgggagcttcgacaagctgatctcccggaagcaccgcttcgagagctccaagtacggcgggttcggcagcccgaccgtcacctactccgtgctggtggtcgccaagagcaaggtgcaggacgggaaggtgaagaagatcaagacgggcaaggagctcatcggcatgaccctgctggacaagctcgtcttcgagaagaaccccctgaagttcatcgaggacaaggggtacggcaacgtgcagatcgacaagtgcatcaagctgcccaagtactccctcttcgagttcgagaacgggacccggcgcatgctggccagcgtgatggccaacaacaactcccggggcgacctgcagaaggccaacgagatgttcctccccgccaagctggtcaccctgctctaccacgcgcacaagatcgagagctccaaggagctggagcacgaggcctacatcctggaccactacaacgacctctaccagctgctgagctacatcgagcgcttcgcctccctctacgtggacgtggagaagaacatcagcaaggtcaaggagctgttctccaacatcgagagctactccatcagcgagatctgctccagcgtgatcaacctgctcacgctgaccgccagcggggccccggcggacttcaagttcctgggcaccaccatcccccggaagcgctacggcagcccccagagcatcctctccagcacgctgatccaccagtccatcaccgggctgtacgagacccggatcgacctcagccagctgggcggggactga

SEQ ID NO: 1991 - RNA, 4116 nt, synthetic construct
  misc_feature 1..4116: note = Cas9 variant
  source 1..4116: mol_type = other RNA
atggacaagaagtacagcatcggcctggacatcgggaccaactccgtgggctgggccgtcatcaccgacgactacaaggtgcccagcaagaagttcaaggtgctcgggaacacggaccgccactccatcaagaagaacctgatcggcgccctgctgttcgacagcggggagaccgcggaggccacccggctgaagcgcaccgcccggcgccggtacacgcgccggaagaaccgcatccggtacctgcaggagatcttctccagcgagatgtccaaggtcgacgacagcttcttccaccgcctcgaggagtccttcctggtggaggaggacaagaagcacgagcggcacccgatcttcggcaacatcgtggacgaggtcgcctaccacgagaagtaccccaccatctaccacctccgcaagaagctcgccgacagcaccgacaaggcggacctgcggctgatctacctcgccctggcccacatgatcaagttccgcggccacttcctgatcgagggggacctcaaccccgacaactccgacgtggacaagctgttcatccagctggtgcagacctacaaccagctgttcgaggagaaccccatcaacgccagccgggtcgacgcgaaggccatcctgtccgcccgcctgagcaagtcccggcgcctcgagaacctgatcgcccagctgccgggcgagaagcggaacggcctcttcgggaacctgatcgccctgagcctcgggctgacgcccaacttcaagtccaacttcgacctggcggaggacgccaagctccagctgagcaaggacacctacgacgacgacctggacaacctcctggcccagatcggcgaccagtacgccgacctgttcctcgccgcgaagaacctgtccgacgccatcctgctcagcgacatcctgcgcgtgaacagcgagatcaccaaggccccgctgtccgccagcatgatcaagcggtacgacgagcaccaccaggacctcaccctgctgaaggccctcgtgcgccagcagctgcccgagaagtacaaggagatcttcttcgaccagtccaagaacggctacgcggggtacatcgacggcggggccagccaggaggagttctacaagttcatcaagccgatcctggagaagatggacggcacggaggagctcctggccaagctgaaccgcgaggacctgctccggaagcagcgcaccttcgacaacggctccatcccccaccagatccacctgggggagctgcacgccatcctccggcgccaggaggacttctaccccttcctgaaggacaaccgggagaagatcgagaagatcctgaccttccgcatcccctactacgtcggcccgctcgcccgggggaacagccgcttcgcgtggatgacccggaagtccgaggagacgatcaccccctggaacttcgaggaggtggtggacaagggcgccagcgcccagtccttcatcgagcgcatgaccaacttcgacaagaacctgcccaacgagaaggtcctgcccaagcacagcctcctgtacgagtacttcaccgtgtacaacgagctgacgaaggtgaagtacgtcaccgaggggatgcggaagccggccttcctctccggcgagcagaagaaggcgatcgtggacctgctgttcaagaccaaccgcaaggtgaccgtcaagcagctcaaggaggactacttcaagaagatcgagtgcttcgacagcgtggagatctccggcgtggaggaccggttcaacgccagcctggggacgtaccacgacctgctcaagatcatcaaggacaaggacttcctggacaacgaggagaacgaggacatcctggaggacatcgtcctcaccctgaccctgttcgaggacaaggagatgatcgaggagcgcctcaagacctacgcccacctgttcgacgacaaggtgatgaagcagctgaagcggcgccactacacgggctgggggcggctctcccgcaagctgatcaacggcatccgggacaagcagagcgggaagaccatcctggacttcctcaagtccgacggcttcgccaaccgcaacttcatccagctgatccacgacgacagcctgaccttcaaggaggccatccagaaggcgcaggtctccggccaggggcacagcctccacgagcagatcgccaacctggccggcagccccgccatcaagaaggggatcctgcagtccgtgaaggtggtcgacgagctcgtgaaggtgatgggccacaagcccgagaacatcgtcatcgagatggcccgcgagaaccagaccacgcagaaggggcagaagaacagccgggagcgcatgaagcggatcgaggagggcatcaaggagctgggctcccagatcctgaaggagcaccccgtggagaacacccagctccagaacgagaagctgtacctgtactacctccagaacgggcgcgacatgtacgtggaccaggagctggacatcaaccggctgagcgactacgacgtcgaccacatcgtgccgcagtccttcatcaaggacgacagcatcgacaacaaggtgctcacccgctccgacaagaaccggggcaagagcgacaacgtcccctccgaggaggtggtgaagaagatgaagaactactggcgccagctgctgaacgcgaagctcatcacccagcggaagttcgacaacctgacgaaggccgagcgcgggggcctgagcgagctcgacaaggccggcttcatcaagcggcagctggtcgagacccgccagatcaccaagcacgtggcccagatcctggactcccggatgaacaccaagtacgacgagaacgacaagctcatccgcgaggtgaaggtcatcaccctcaagagcaagctggtgtccgacttccggaaggacttccagttctacaaggtgcgcgagatcaacaactaccaccacgcccacgacgcgtacctcaacgccgtcgtggggacggccctgatcaagaagtaccccaagctggagagcgagttcgtgtacggcgactacaaggtctacgacgtgcggaagatgatcgccaagtccgagcaggagatcgggaaggcgaccgccaagcgcttcttctacagcaacatcatgaacttcttcaagaccgagatcaccctcgccaacggcgagatccggaagcgccccctgatcgagacgaacgaggagaccggggagatcgtgtgggacaagggccgggacttcgccaccgtccgcaaggtgctgtccatgccccaggtgaacatcgtcaagaagaccgaggtgcagacgggcgccctcaccaacgagagcatctacgcgcgcgggagcttcgacaagctgatctcccggaagcaccgcttcgagagctccaagtacggcgggttcggcagccccaccgtgacctactccgtcctggtggtggccaagagcaaggtccaggacgggaaggtgaagaagatcaagacgggcaaggagctcatcggcatcaccctgctggacaagctcgtgttcgagaagaaccccctgaagttcatcgaggacaaggggtacggcaacgtccagatcgacaagtgcatcaagctgcccaagtactccctcttcgagttcgagaacgggacccggcgcatgctggccagcgtgatggccaacaacaactcccggggcgacctgcagaaggccaacgagatgttcctcccggcgaagctggtgaccctgctctaccacgcccacaagatcgagagctccaaggagctggagcacgaggcctacatcctggaccactacaacgacctctaccagctgctgagctacatcgagcgcttcgcctccctctacgtcgacgtggagaagaacatcagcaaggtgaaggagctgttctccaacatcgagagctactccatcagcgagatctgctccagcgtcatcaacctgctcacgctgaccgccagcggggcgcccgccgacttcaagttcctgggcaccaccatcccccggaagcgctacggctccccgcagagcatcctctccagcacgctgatccaccagtccatcaccgggctgtacgagacccggatcgacctcagccagctgggcggggactga

SEQ ID NO: 1992 - RNA, 4116 nt, synthetic construct
  misc_feature 1..4116: note = Cas9 variant
  source 1..4116: mol_type = other RNA
atggagaacaagaactacagcatcggcctggacatcgggaccaactccgtgggctggagcgtcatcaccgacgactacaaggtgccctccaagaagatgaaggtgctcgggaacacggacaagcacttcatcaagaagaacctgatcggcgccctgctgttcgacgaggggaccaccgccgaggcgcgccggctgaagcgcaccgcccggcgccggtacacgcgccggaagaaccgcctgcggtacctccaggagatcttcagcgaggagatcggcaaggtcgactccagcttcttccaccgcctggacgactccttcctgatcccggaggacaagcggggcagcaagtaccccatcttcgccaccctcgccgaggagaagaagtaccacaagcagttccccaccatctaccacctccgcaagcagctggccgactccaaggagaagaccgacctccggctgatctacctggcgctcgcccacatgatcaagtaccgcgggcacttcctgtacgaggaggccttcgacatcaagaacaacgacatccagaagatcttcaacgagttcatcagcatctacaacaacacgttcgagggcaactccctgagcgggcagaacgtccaggtggaggccatcttcaccgacaagatctccaagagcgcgaagcgggagcgcgtgctcaagctgttccccgacgagaagtccaccggcctgttcagcgagttcctcaagctgatcgtggggaaccaggccgacttcaagaagcacttcgacctggaggagaaggccccgctccagttctcccgggacacctacgacgaggacctggagaacctgctcggccagatcggcgacgacttcgccgacctgttcctggtggccaagaagctctacgacgcgatcctgctgagcgggatcctcacggtcaccaacccctccaccaaggccccgctgagcgccagcatgatcgagcgctacgagaaccaccagaaggacctggcctccctcaagcagttcatcaagaacaacctgcccgagaagtacgacgaggtgttcagcgaccagtccgaggacggctacgccgggtacatcgacggcaagaccacgcaggagaccttctacaagtacatcaagaacctgctcagcaagttcgagggcgcggactacttcctggacaagatcgagcgggaggacttcctgcgcaagcagcggaccttcgacaacgggtccatcccgcaccagatccacctccaggagatgaacgccatcctgcgccgccagggcgagcactaccccttcctgaaggagaacaaggagaagatcgagaagatcctcaccttccggatcccctactacgtggggcccctggcccgcggcaaccgggacttcgcctggctgacgcgcaacagcgaccaggccatccggccgtggaacttcgaggagatcgtcgacaaggcgtccagcgccgaggacttcatcaacaagatgaccaactacgacctctacctgcccgaggagaaggtgctgcccaagcactccctgctctacgagaccttcgccgtgtacaacgagctgaccaaggtcaagttcatcgccgaggggctgcgcgactaccagttcctcgacagcggccagaagaagcagatcgtgacgcagctgttcaaggagaagcggaaggtgaccgagaaggacatcatccagttcctgcacaacgtcgacggctacgacgggatcgagctcaagggcatcgagaagcagttcaacgcctccctgagcacctaccacgacctgctcaagatcatcaaggacaaggcgttcatggacgacgccaagaacgaggccatcctggagaacatcgtgcacaccctgacgatcttcgaggaccgcgagatgatcaagcagcggctcgcccagtacgactccctgttcgacgagaaggtgatcaaggcgctgacccgccggcactacaccgggtggggcaagctcagcgccaagctgatcaacgggatctccgacaagcagaccggcaacacgatcctggactacctcatcgacgacggcgagatcaaccgcaacttcatgcagctgatcaacgacgacgggctgagcttcaaggagatcatccagaaggcccaggtcgtgggcaagaccaacgacgtgaagcaggtcgtgcaggagctccccgggtccccggccatcaagaagggcatcctgcagagcatcaagatcgtcgacgagctggtgaaggtgatggggcacgcccccgagtccatcgtcatcgagatggcgcgggagaaccagaccaccgcccgcggcaagaagaacagccagcagcggtacaagcgcatcgaggacagcctcaagatcctggcctccggcctgaacagcaagatcctcaaggagcaccccacggacaacatccagctgcagaacgaccggctgttcctctactacctgcagaacgggaaggacatgtacaccggcgaggccctggacatcaaccagctctccagctgcgacatcgaccacatcatcccccaggccttcatcaaggacgactccctggacaaccgcgtgctgaccagctccaaggacaaccggggcaagagcgacaacgtgccgtccctcgaggtcgtggacaagatgaaggtgttctggcagcagctgctggacagcaagctcatctcctaccgcaagttcaacaacctgaccaaggcggagcgcgggggcctgaacgagctcgacaaggtcgggttcatcaagcggcagctggtggagacccgccagatcacgaagcacgtggcccagatcctggacgcccggttcaacaaggaggtcaccgagaaggacaagaagaaccgcaccgtgaagatcatcaccctcaagagcaacctggtgtccaacttccggaaggagttcgagctgtacaaggtccgcgagatcaacgactaccaccacgcccacgacgcctacctcaacgcggtggtggccaaggccatcctgaagaagtaccccaagctggagcccgagttcgtctacggcgactaccagaagtacgacctcaagcggtacatcagccgctccaaggaccccaaggagatcgagaaggccacggagaagtacttcttctacagcaacctgctgaacttcttcaaggaggaggtgcactacgcggacgggaccatcgtgaagcgggagaacatcgagtactccaaggacaccggcgagatcgcctggaacaaggagaaggacttcgccaccatcaagaaggtcctcagcctgccccaggtgaacatcgtgaagaagcgcgaggtccagaccgggggcttcagcaaggagtccatcctgcccaagggcaacagcgacaagctcatcccccggaagacgaaggacatcctgtgggacaccaccaagtacgggggcttcgactcccccgtgatcgcctacagcatcctgctcatcgccgacatcgagaaggggaaggcgaagaagctgaagacggtgaagaccctggtcggcatcaccatcatggagaaggacgccttcgagaagaacccgatcgccttcctcgagaacaaggggtaccacaacgtgtgcaaggagaacatcctgtgcctgcccaagtactccctcttcgagctggagaacggccgccggcgcctgctcgccagcgccaaggagctgcagaagtgcaacgagatcgtgctgcccgtctacctcaccacgctgctgtaccactccaagaacgtgcacaagctcgacgagccgggccacctggagtacatccagaagcaccggaacgagttcaaggacctgctcaacctggtgagcgagttctcccagaagtacgtcctggcggacgccaacctcgagaagatcaagaacctgtacgccgacaacgagcaggccgacatcgagatcctggccaacagcttcatcaacctcctgaccttcaccgcgctgggggcccccgccgccttcaagttcttcggcaaggacgtggaccgcaagcggtacaccacggtgtccgagatcctcaacgcgaccctgatccaccagagcatcaccgggctgtacgagacccgcatcgacctctccaagctgggcgaggactga

SEQ ID NO: 1993 - RNA, 4116 nt, synthetic construct
  misc_feature 1..4116: note = Cas9 variant
  source 1..4116: mol_type = other RNA
atgaaggtgaacaactaccacatcggcctggacatcgggaccagctccatcggctgggtcgccatcggggaggacggcaagcccctccgcatcaaggggaagaccgccatcggcgcgcggctgttccaggagggcaacccggccgccgaccgccggatgttccgcacgacccggcgccggctgagccgccggaagtggcgcctcaagctgctggaggagatcttcgacccctacatcacccccgtggactccaccttcttcgcccggctcaagcagagcaacctgtcccccaaggacagccgcaaggagttcaaggggtccatgctgttcccggacctcacggacatgcagtaccacaaggactaccccaccatctaccacctccggcacgccctgatgacccaggacgagaagttcgacatccgcatggtgtacctggcgatccaccacatcgtcaagtaccggggcaacttcctgaacagcacccccgtggactccttcaaggccagcaaggtgaacttcgtcgaccagttcaagaagctgaacgagctctacacggccatcaaccccgaggagtccttccagatcaacctggccaacagcgaggacatcgggcaccagttcctggacccgtccatccgcaagttcgacaagaagaagcagatccccaagatcgtgcccgtgagcgtcgacgacaaggcgaccgacaagatcaacggcaagatcgcctccgagatcatcaacgccatcctcgggtacaagagcaagctggacgtggtggtccagtgcacccccgtggactccaagagctgggccctgaagttcgacgaggaggacatcgacgccaagctccagaagatcctgccggagatggacgagaaccagcagtccatcatcgcgatcctgcagaacctctacagccaggtgaccctgaaccagatcgtccccaacggcatgagcctgtccgagagcatgatcgagaagtacaacgaccaccacgaccacctcaagctgtacaagaagatcatcgaccagctggccgaccccaagaagaaggccgccctcaagaaggcctactcccagtacgtgggcgacgacgggaaggtgatcgagcaggcggacttctggagctccgtcaagaagaacctggacgacagcgacctgtccaagcagatcatggacctcatcgacgccgagaagttcatgcccaagcagcggacgagccagaacggcgtgatcccgcaccagctgcaccagcgcgagctggacgagatcatcgagcaccagtccaagtactacccctggctcgccgagatcaaccccaacaagcacgacctgcacctggccaagtacaagatcgaggagctcgtggccttccgggtcccctactacgtggggccgatgatcacccccgacgaccaggccaagagcgcggagaccgtgttctcctggatggagcgcaagggcaaggaggccggccagatcaccccctggaacttcgacgagaaggtcgaccggaacgccagcgccaaccgcttcatcaagcgcatgacgaccaaggacacctacctgatcggggaggacgtgctgcccgacgagtccctcctgtacgagaagttcaaggtcctgaacgagctcaacatggtgcgggtgaacggcaagctgctgaaggtcgcggacaagcaggccatcttccaggacctcttcgagaactacaagcacatcagcgtgaagaagctgcagaactacatcaagtccaagaccgggctgccgagcgaccccgagatctccggcctgagcgaccccgagtacttcaacaactccctcgggacgtacaacgacttcaagaagctgttcggcaacaaggtggacgagcccgacctgcaggacgacttcgagaagatcgtcgagtggagcaccgtgttcgaggacaagcgcatcctccgggagaagctgaacgagatcacctggctgagcgaccagcagaaggacgtgctcgagtccagccgctaccagggctgggggcggctgtccaagaagctgctcaccggcatcgtcaacgaccagggggagcgcatcatcgacgagctgtggaacacgaacaagaacttcatgcagatccagagcgacaacgacttcgccaagcggatccacgaggccaacgcggaccagatgaaggccgtggacgtggaggacgtcctggccgacgcctacacctccccgcagaacaagaaggccatccgccaggtggtgaaggtcgtggacgacatccagaaggcgatgggcggggtggcccccaagtacatcagcatcgagttcacccggtccgaggaccgcaacccccggcgcaccatcagccggcagcgccagctcgagaacacgctgaaggacaccgccaagtccctggccaagagcatcaacccggagctcctgtccgagctggacaacgccgccaagagcaagaagggcctcatcgaccggctgtacctgtacttcacccagctcggcaaggacatctacaccgggaagcccatcaacatcgacgagatctccacgtacgacatcgaccacatcctgccccaggcgttcgtcaaggacgacagcctgaacaaccgcgtgctcgtgtccaaggccatcaacaacggcaagagcgacaacgtccccgtgcagctgttcggggccaagatgggccacttctggaagcagctggccgaggcggggctcatctccaagcggaagctgaagaacctgcagaccgacccggacaccatcagcaagtacgccatgcacggcttcatccgccggcagctcgtggagaccagccaggtcatcaagctggtggccaacatcctgggcgacaagtaccgcaacgacgacacgaagatcatcgagatcaccgcccgcatgaaccaccagatgcgggacgagttcgggttcatcaagaaccgcgagatcaacgactaccaccacgcgttcgacgcctacctcaccgccttcctgggccggtacctgtaccaccgctacatcaagctccggccctacttcgtgtacggggacttcaagaagttcaaggaggacaaggtcaccatgcgcaacttcaacttcctgcacgacctgaccgacgacacgcaggagaagatcgccgacgccgagaccggcgaggtgatctgggaccgggagaactccatccagcagctcaaggacgtgtaccactacaagttcatgctgatcagccacgaggtctacaccctgcgcggcgcgatgttcaaccagaccgtgtaccccgcctccgacgccgggaagcggaagctcatccccatcaaggccgaccgcccgatcaacgtgtacggcgggtacagcggctccgccgacgcgtacatggccatcgtccggatccacaacaagaagggggacaagtaccgcgtggtgggcgtccccatgcgggcccgcgaccggctggacgccgccaagaaggtgagcgacgcggactacgaccgcgccctgaaggacgtgctcacgccccagctgaccaagaccaagaagtcccggaagaccggcgagatcacgcaggtcgtggaggacttcgagatcgtgctggggaaggtcatgtaccgccagctcatgatcgacggcgacaagaagttcatgctggggagctccacctaccagtacaacgccaagcagctggtgctcagcgaccagtccgtgaagaccctggccagcaagggccggctggaccccctccaggagtccatggactacaacaacgtctacaccgagatcctggacaaggtgaaccagtacttcagcctgtacgacatgaacaagttccgccacaagctcaacctggggttctccaagttcatcagcttcccgaaccacaacgtgttcgacggcaacacgaaggcgtccagcggcaagcgggagatcctggaggaggtcctcaacgggctgcacgccaaccccaccttcggcaacctgaaggacatcgggatcaccacccccttcggccagctccagcagcccaacgggatcctgctgtccgacgaggccaagatccgctaccagagcccgacgggcctcttcgagcgcaccgtgagcctgaaggacctgtga

SEQ ID NO: 1994 - RNA, 4116 nt, synthetic construct
  misc_feature 1..4116: note = Cas9 variant
  source 1..4116: mol_type = other RNA
atgaaggtgaacaactaccacatcggcctggacatcgggaccagctccatcggctgggtcgccatcgggaaggacggcaagcccctccgcgtgaaggggaagaccgccatcggcgcgcggctgttccaggagggcaacccggccgccgaccgccggatgttccgcacgacccggcgccggctgagccgccggaagtggcgcctcaagctgctggaggagatcttcgacccctacatcacccccgtggactccaccttcttcgcccggctcaagcagagcaacctgtcccccaaggacagccgcaaggagttcaaggggtccatgctgttcccggacctcacggacatgcagtaccacaagaactaccccaccatctaccacctccggcacgccctgatgacccaggacaagaagttcgacatccgcatggtctacctggcgatccaccacatcgtgaagtaccggggcaacttcctgaacagcacccccgtggactccttcaaggccagcaaggtcgacttcgtggaccagttcaagaagctgaacgagctctacgccgccatcaaccccgaggagtccttcaagatcaacctggcgaacagcgaggacatcgggcaccagttcctggacccgtccatccgcaagttcgacaagaagaagcagatccccaagatcgtgcccgtcatgatgaacgacaaggtgacggaccggctcaacggcaagatcgccagcgagatcatccacgccatcctggggtacaaggccaagctggacgtggtcctccagtgcacccccgtggactccaagccgtgggccctgaagttcgacgacgaggacatcgacgcgaagctggagaagatcctccccgagatggacgagaaccagcagagcatcgtggccatcctgcagaacctgtactcccaggtcaccctcaaccagatcgtgcccaacggcatgagcctgtccgagagcatgatcgagaagtacaacgaccaccacgaccacctgaagctctacaagaagctgatcgaccagctggccgaccccaagaagaaggccgtgctcaagaaggcctacagccagtacgtcggcgacgacgggaaggtgatcgagcaggcggagttctggtccagcgtgaagaagaacctggacgactccgagctgagcaagcagatcatggacctcatcgacgccgagaagttcatgccgaagcagcgcacctcccagaacggcgtcatcccccaccagctgcaccagcgggagctggacgagatcatcgagcaccagagcaagtactacccctggctcgtggagatcaaccccaacaagcacgacctgcacctggccaagtacaagatcgagcagctcgtggccttccgcgtcccgtactacgtggggcccatgatcacgcccaaggaccaggccgagtccgcggagaccgtcttcagctggatggagcggaagggcaccgagaccggccagatcacgccctggaacttcgacgagaaggtggaccgcaaggcctccgccaaccgcttcatcaagcggatgaccaccaaggacacctacctgatcggggaggacgtgctgccggacgagagcctcctgtacgagaagttcaaggtcctgaacgagctcaacatggtgcgcgtgaacggcaagctgctgaaggtcgccgacaagcaggccatcttccaggacctgttcgagaactacaagcacgtgtccgtgaagaagctccagaactacatcaaggcgaagacggggctgcccagcgaccccgagatctccggcctgagcgaccccgagcacttcaacaactccctcgggacctacaacgacttcaagaagctgttcggcagcaaggtcgacgagccggacctgcaggacgacttcgagaagatcgtggagtggtccaccgtgttcgaggacaagaagatcctccgggagaagctgaacgagatcacctggctgagcgaccagcagaaggacgtcctcgagtccagccgctaccagggctgggggcggctgagcaagaagctgctcacgggcatcgtgaacgaccagggggagcgcatcatcgacaagctgtggaacaccaacaagaacttcatgcagatccagtccgacgacgacttcgccaagcggatccacgaggccaacgccgaccagatgcaggcggtggacgtcgaggacgtgctggccgacgcctacaccagcccccagaacaagaaggccatccgccaggtggtcaaggtggtggacgacatccagaaggccatgggcggggtcgcgcccaagtacatctccatcgagttcacccggagcgaggaccgcaacccgcggcgcacgatctcccggcagcgccagctcgagaacaccctgaaggacaccgccaagagcctggccaagtccatcaaccccgagctcctgagcgagctggacaacgccgccaagtccaagaagggcctcaccgaccggctgtacctgtacttcacgcagctcggcaaggacatctacaccggggagcccatcaacatcgacgagctgaacaagtacgacatcgaccacatcctgccccaggcgttcatcaaggacaacagcctcgacaaccgcgtgctggtgctgaccgccgtcaacaacggcaagtccgacaacgtgccgctccggatgttcggggccaagatgggccacttctggaagcagctggccgaggccgggctgatcagcaagcgcaagctcaagaacctgcagaccgaccccgacacgatctccaagtacgcgatgcacggcttcatccggcgccagctggtggagaccagccaggtcatcaagctcgtggccaacatcctgggcgacaagtaccgcaacgacgacaccaagatcatcgagatcaccgcccggatgaaccaccagatgcgcgacgagttcgggttcatcaagaaccgggagatcaacgactaccaccacgccttcgacgcgtacctgaccgccttcctcggccgctacctgtaccaccggtacatcaagctgcgcccctacttcgtgtacggggacttcaagaagttccgggaggacaaggtcacgatgcgcaacttcaacttcctccacgacctgaccgacgacacccaggagaagatcgccgacgccgagaccggcgaggtgatctgggaccgggagaactccatccagcagctgaaggacgtgtaccactacaagttcatgctcatcagccacgaggtctacacgctgcgcggcgccatgttcaaccagaccgtgtaccccgcgtccgacgccgggaagcggaagctgatcccggtgaaggccgaccgccccgtcaacgtgtacggcgggtacagcggcagcgccgacgcctacatggcgatcgtgcggatccacaacaagaagggggacaagtaccgcgtcgtgggcgtgcccatgcgggccctcgaccgcctggacgccgccaagaacgtctccgacgccgacttcgaccgggcgctgaaggacgtgctcgcgccccagctgaccaagaccaagaagtcccgcaagacgggcgagatcacccaggtgatcgaggacttcgagatcgtcctggggaaggtgatgtaccggcagctcatgatcgacggcgacaagaagttcatgctggggagcagcacctaccagtacaacgccaagcagctggtgctctccgaccagagcgtcaagaccctggcctccaagggccgcctggacccgctccaggagagcatggactacaacaacgtgtacacggagatcctggacaaggtgaaccagtacttctccctgtacgacatgaacaagttccggcacaagctcaacctggggttcagcaagttcatctccttccccaaccacaacgtcctggacggcaacaccaaggtgagctccggcaagcgcgagatcctccaggagatcctgaacgggctgcacgccaaccccaccttcggcaacctcaaggacgtcgggatcaccacgcccttcggccagctgcagcagccgaacgggatcctgctcagcgacgagaccaagatccgctaccagtcccccaccggcctgttcgagcggaccgtgagcctgaaggacctctga

SEQ ID NO: 1995 - RNA, 4116 nt, synthetic construct
  misc_feature 1..4116: note = Cas9 variant
  source 1..4116: mol_type = other RNA
atggacaagaagtacagcatcggcctggacatcgggaccaactccgtgggctgggccgtcatcaccgacgactacaaggtgcccagcaagaagttcaaggtgctcgggaacacggaccgccactccatcaagaagaacctgatcggcgccctgctgttcgacagcggggagaccgcggaggccacccggctgaagcgcaccgcccggcgccggtacacgcgccggaagaaccgcatctgctacctgcaggagatcttctccaacgagatggccaaggtcgacgacagcttcttccaccggctcgaggagtccttcctggtggaggaggacaagaagcacgagcgccacccgatcttcggcaacatcgtggacgaggtcgcctaccacgagaagtaccccaccatctaccacctccggaagaagctcgcggacagcaccgacaaggccgacctgcgcctgatctacctcgccctggcccacatgatcaagttccggggccacttcctgatcgagggggacctcaaccccgacaactccgacgtggacaagctgttcatccagctggtgcagacctacaaccagctgttcgaggagaaccccatcaacgcgagccgcgtcgacgccaaggccatcctgtccgcccggctgagcaagtcccgccggctcgagaacctgatcgcccagctgccgggcgagaagaagaacggcctcttcgggaacctgatcgcgctgagcctcgggctgacgcccaacttcaagtccaacttcgacctggccgaggacgccaagctccagctgagcaaggacacctacgacgacgacctggacaacctcctggcccagatcggcgaccagtacgccgacctgttcctcgcggccaagaacctgtccgacgccaccctgctcagcgacatcctgcgcgtgaactccgagatcaccaaggccccgctgagcgccagcatgatcaagcggtacgacgagcaccaccaggacctcacgctgctgaaggcgctcgtgcgccagcagctgcccgagaagtacaaggagatcttcttcgaccagtccaagaacggctacgccgggtacatcgacggcggggccagccaggaggagttctacaagttcatcaagccgatcctggagaagatggacggcaccgaggagctcctggccaagctgaaccgggaggacctgctccgcaagcagcgcaccttcgacaacggctccatcccccaccagatccacctgggggagctgcacgccatcctccggcgccaggaggacttctaccccttcctgaaggacaaccgggagaagatcgagaagatcctgaccttccgcatcccctactacgtcggcccgctcgcgcgggggaacagccgcttcgcctggatgacgcggaagtccgaggagaccatcaccccctggaacttcgaggaggtggtggacaagggcgccagcgcccagtccttcatcgagcgcatgaccaacttcgacaagaacctgcccaacgagaaggtcctgcccaagcacagcctcctgtacgagtacttcacggtgtacaacgagctgaccaaggtgaagtacgtcaccgaggggatgcggaagccggcgttcctctccggcgagcagaagaaggccatcgtggacctgctgttcaagaccaaccgcaaggtgacggtcaagcagctcaaggaggactacttcaagaagatcgagtgcttcgacagcgtggagatctccggcgtggaggaccggttcaacgccagcctggggacctaccacgacctgctcaagatcatcaaggacaaggacttcctggacaacgaggagaacgaggacatcctggaggacatcgtcctcaccctgaccctgttcgaggacaaggagatgatcgaggagcgcctcaagacgtacgcccacctgttcgacgacaaggtgatgaagcagctgaagcggcgccactacaccggctgggggcggctctcccgcaagctgatcaacggcatccgggacaagcagagcgggaagaccatcctggacttcctcaagtccgacggcttcgccaaccgcaacttcatccagctgatccacgacgacagcctgaccttcaaggaggcgatccagaaggcccaggtctccggccaggggcacagcctccacgagcagatcgccaacctggccggctcccccgccatcaagaaggggatcctgcagagcgtgaaggtggtcgacgagctcgtgaaggtgatgggccacaagcccgagaacatcgtcatcgagatggcgcgggagaaccagacgacccagaaggggcagaagaacagccgcgagcgcatgaagcggatcgaggagggcatcaaggagctgggctcccagatcctgaaggagcaccccgtggagaacacccagctccagaacgagaagctgtacctgtactacctccagaacgggcgcgacatgtacgtggaccaggagctggacatcaaccggctgagcgactacgacgtcgaccacatcgtgccgcagtccttcatcaaggacgacagcatcgacaacaaggtgctcacccgctccgacaagaaccggggcaagagcgacgacgtcccctccgaggaggtggtgaagaagatgaagaactactggcgccagctgctgaacgccaagctcatcacgcagcggaagttcgacaacctgaccaaggccgagcgcgggggcctgagcgagctcgacaaggccggcttcatcaagcggcagctggtcgagacccgccagatcaccaagcacgtggcccagatcctggactcccggatgaacaccaagtacgacgagaacgacaagctcatccgcgaggtgaaggtcatcacgctcaagagcaagctggtgtccgacttccggaaggacttccagttctacaaggtgcgcgagatcaacaactaccaccacgcgcacgacgcctacctcaacgccgtcgtggggaccgccctgatcaagaagtaccccaagctggagagcgagttcgtgtacggcgactacaaggtctacgacgtgcggaagatgatcgcgaagtccgagcaggagatcgggaaggccaccgccaagcgcttcttctacagcaacatcatgaacttcttcaagaccgagatcacgctcgccaacggcgagatccggaagcgccccctgatcgagaccaacgaggagaccggggagatcgtgtgggacaagggccgggacttcgccaccgtccgcaaggtgctgtccatgccccaggtgaacatcgtcaagaagacggaggtgcagaccggcgcgctcaccaacgagagcatctacgcccgggggtccttcgacaagctgatcagccgcaagcaccgcttcgagagctccaagtacggcgggttcggcagccccaccgtgacgtactccgtcctggtggtggccaagagcaaggtccaggacgggaaggtgaagaagatcaagaccggcaaggagctcatcggcatcaccctgctggacaagctcgtgttcgagaagaaccccctgaagttcatcgaggacaaggggtacggcaacgtccagatcgacaagtgcatcaagctgcccaagtactccctcttcgagttcgagaacgggacccggcgcatgctggccagcgtgatggccaacaacaactcccggggcgacctgcagaaggcgaacgagatgttcctcccggccaagctggtgacgctgctctaccacgcccacaagatcgagagctccaaggagctggagcacgaggcctacatcctggaccactacaacgacctctaccagctgctgagctacatcgagcgcttcgcctccctctacgtcgacgtggagaagaacatcagcaaggtgaaggagctgttctccaacatcgagagctactccatcagcgagatctgctccagcgtcatcaacctgctcaccctgaccgcgtccggggcccccgccgacttcaagttcctgggcaccacgatcccccggaagcgctacggcagcccgcagagcatcctctccagcaccctgatccaccagtccatcaccgggctgtacgagacccggatcgacctcagccagctgggctccgactga

SEQ ID NO: 1996 - RNA, 4119 nt, synthetic construct
  misc_feature 1..4119: note = Cas9 variant
  source 1..4119: mol_type = other RNA
atgaacaacgagtacttcgtgggcttcgacatcgggaccaacagcgtcggcgccgccgtgaccgacgagaagtaccacgtgctgaagttcaaggggaacgcgatgtggacgtccgccgtcttcgagagcgcccagcagtccgccgaccgccggctcaaccgcaccgcccggcgccggctggaccgcagccagcagcggcgcgacctgctccaggagctgatcgcgcccgccatcaccccggtggacccccggttcttcgaccgcatccgggagtccgccctgtgggccgaggacaagaccacgggcagccgcttcacctacttctccgacgaggggtacaccgacaagcagtaccacaaggagtaccccaccatccaccacctcatctgcagcctgatgaacgaccccgcgccgcacgacccccggctggtgtacatcgcctgctcctacatgctcacgcaccgcggccacttcctgaacgaggccgacaaggagaagatcgacgacgtcctggacatccggcgcgtgttcaacgagctctgcagctggttcacctcctacggcatcgaggtgcccttcagctgcttccccgaggagttcgggaacgtcctgaccgccaaccggggcgtgcaggaccgcacccgggccttctacgacctcctcttcgcggggaagaagccgaagccctccgaggacgaccaggtggacatcgacgtcctgatcaagctgatcagcggcgggaagatcgagctctccaagctgttcctgaacgaggagtacagcgagctcgagaacaacaagatccagctgtccgacgccggcttcgacgagaaggagcccgagctgcgcagcgagctcggcgacgacttcgggctggtggccgccgccaagaacatctacgactggtccctgctcacgggcgtgctgggggagtgcaagagcatcagcgaggcgaaggtcaagacctacgagaagcactccgaggacctggccgccctccggcgcgtggtgcgcaagtaccaccccgacaagtacaaggagatcttcaagaagtacgtcgtgggcaactacaccagctactccggcaacgtcaagagcgccgggaagatctccgagaccaagctgaagcggtgcaaccaggccgagttctgcgactacctcaagagcaagctgaaggacgtgaagccggcgcccggcgacgacgagtgcgagcgcgtgctgaaggagatctccaagcacacgttctgcccccgccaggtgaccaccgacaaccgggtcatcccctaccagctgtactacaccgagctcaagaaggtgctggagaacgccaagcggtacatcccgcagctgaacgtcacggacgagtacgggagcgccgccgacaagatcctctccctgatgaccttccgcatcccctactacgtgggccccctggtgaagaagaacgacagctccaacgcctggatcgtccggcgcggggagggccggatcctcccctggaacttcgacgagctggtggacaaggacaagtgcgaggacgagttcatccgccggatgacctgcaagtgcacctacatcgcgggcaagaacgtgctgccgaagaacagcctcctgtactgcaagttcatggtcctgaacgagatcaacaacatcaagatcaacggggagcgcatctccgtgggcgacaagcagaagatctacacggagctgttcgagaagaagcggaaggtgaccgtccgcgacatccggaacctgctgaccagcgaggggcgcctgaaggccggcgacaccttcgggggcatcgacatcacggtgaagtccagcctcaagccccagcacgacctgaagcggctgatggccgccggcgtgatcaccgaggcggacgccgaggagatcatcgagcgcatcacgtgcaccaccgacgtctcccggctccgcacctggctggggaagttcggcctgagcgccgccgacgccaagtacgtgtccgggctcaagtacagcgacttcggccgcctgagccgggagttcctgaccgaggtgaacgacgtcgaccccgcgaccggggaggtgatcaaccccaacatcatcacgatgatgtgggagaacaacatcaacctcatggagctgctgtcccagaagtacagctaccgctcccagatcgagagcatgaaccgggagtactacgccgccaacccgctcaccctggacgagcgcatgtccgagatgtacatccccagcgccgtgcggcgccccgtcaagcggaccatcgagatgatgaaggagtacatgcacatcatgcgcaagcccccgaagcggatcttcatcgagatggcccgcgagctgaccgacctcgacaacaagggcaagcggacctccagccgccggaacacgctgctggagttcttcaagaagtgcccccaggacaccaccgagctccgcgcgcagctggagaagaagtccgacgacgagctgcggagcgagaagctctacctgtacttcgcccagctgggcaagtgcatgtactccggggagagcatcgacatcgagcgcctcggctccaagctgtacgacgtggaccacatcttcccccaggcccgggtgaaggacgacagcatcgagaacaaggtcctggtgctctccgacctgaacggggccaagagcgaccgctacccgatcaacgccgacatccggaacaagatgcactccttctgggacaagctgcacagcatcggcctcatcggcgagaagaagtacgagcgcctgacccggagcacggggttcaccgacgacgagctggcgggcttcatctcccgccagctcgtggagacccgccagagcaccaaggccgtcgccgccctgctggcggaggagttccccgagtccgagatcgtgtacgtgaaggccgggctcgccagccagttccggcacgagttcggcctgctgaagtgccgcgagatcaacgacctccaccacgccaaggacgcctacctgaacatcgtcatggggaacatctaccacgtgaagttcacgaaggaccccatgaacttcgtgaaggagtaccggcgcaaggagcaggtcttcgacctgaagatccagtccatgctcacccacgacgcgatccggaacggcgagaccgcctggatcggcgacgggacctggctggagacggtgaagaagcagatggagaagaacaacatccgctacgtgcggtacagcttccgccggaagggcgccctgttcaacctcatgcccgagcgcaagaacccgtccctgctgccccggaagaacgggaagaacatggtcctccccgccgagaagtacggcgggtacaacaacaccgccgcgagcttcttctccctggtgaagtaccacagcgccaagggctccggcgtggtcatcatccccgtggagctgatccacgcccaccgctacgagcacgacagctccttcgccgaggagtacgccctccgggtgctggcggacatcgtcagcctgaagaagggggacgtgctccagtccgtggagttcccgctgggcagccgcatcctgaaggtcaacaccctcctggacatcgacgggttccgggccaacatcaccggcaaggactccgggggcaagtacctgggcatcagctccgccagcagcctcatcatctcccaggtggacacgacctacatcaagcgcgtgatcagcatcaacgagcggatctccgcctgcgagaagaacaagcagagctacaccatccgccccgagttcgacgtcatcacctccgagcggaacatcgagatctacaacatgctgtgcgagaagatcagctcccgccccttctgcatcaagttcgcgaacacgagcgacaccttcgtgtccgggcgcgagaagttcatcgccctgagcctcaacgagcaggtcaagaccctgaccaacatgctgtccgtgttcaagacgggccgggccagcgggtgcgacctcaccaacatcggcgggtccaagaacaccgccatcgtgaagctgaacgccgtgctgagcaacctcaaggacttcaagtccgtccgcatcatcgaccagagccccaccggcctgtacgagaaggtgtccccgaacctgctcagcctgtga

SEQ ID NO: 1997 - RNA, 4119 nt, synthetic construct
  misc_feature 1..4119: note = Cas9 variant
  source 1..4119: mol_type = other RNA
atgaccaagaagaactacagcatcggcctggacatcgggaccaactccgtgggctgggccgtcatcacggacgactacaagatccccgccaagaagatgaaggtgctcgggaacaccgacaaggagtacatcaagaagaacctgctgggcgcgctcctgttcgacagcggggagaccgccgaggccacccgcctgaagcggacggcccgccggcgctacacccggcgcaagaaccggctccgctacctgcaggagatcttcgccgaggagatcgcgaaggccgacaactccttcttccagcggctggacgagagcttcctcaccgacgacgacaaggacttcgactcccacccgatcttcggcaacaaggccgaggaggacgcctaccaccagaagttcagcaccatctaccacctccgcaagtacctggcggactcccccgagaagtccgacctccggctggtgtacctggccctcgcccacatgatcaagtaccgcggccacttcctgatcgagggggagctgaaggccgagaacacggacgtccagaagctgttcaccgacttcgtggaggtgtacgaccggaccttcgacgacagccacctgagcgaggtcaccgtggacgcctccagcatcctgacggagaagatctccaagagccgccggctcgagaacctgatcgagtcctaccccaaggagaagaagaacaccctgttcggcaacctcatcgcgctgagcctggggctccagcccaacttcaagaccaacttcaagctgtccgaggacgccaagctgcagttcagcaaggacacctacgaggaggacctcgaggaggtgctggagaagatcggcgacgactacgccgacctgttcacgtccgccaagaacctctacgacgccatcctgctgagcgggatcctcaccgtcgacgacagctccaccaaggcgccgctgagcgcctccatgatcaagcgctacgccgagcaccacgaggacctggagaagctcaaggccttcatcaagaccaacaagcccaacctgtaccacgacatcttcaaggacgagacgcagaacggctacgccggctacatcgagaacggggtgaagcaggacgagttctacaagtacctgaagaccatcctcagcaagaccgacggctccgagtacttcctggacaagatcgagcgggaggacttcctgcgcaagcagcggaccttcgacaacgggagcatcccccaccagatccacctccaggagatgcacgcgatcctgcgccggcagggcgactactaccccttcctgaaggagaaccaggaccgcatcgagaagatcctcacgttccgcatcccgtactacgtgggccccctggcccggaagaactcccgcttcgcctgggccgagtaccacagcgacgagaagatcaccccctggaacttcaacaaggtcatcgacaaggagaagtccgccgagaagttcatcacccggatgaccctgaacgacctgtacctccccgaggagaaggtgctgccgaagcacagccacgtgtacgagacgttcgcggtctacaacgagctgaccaagatcaagtacgtgaacgagcaggggaaggaggccttcttcgactccaacatgaagcaggagatcttcgaccacgtgttcaaggagaaccgcaaggtcaccaaggagaagctcctgaactacctggacaaggagttccccgagtaccggatccaggacctcatcggcctggacaaggagaacaagagcttcaacgcctccctggggacctaccacgacctcaagaagatcctggacaagagcttcctggacgacaaggtgaacgaggaggtgatcgaggacatcatcaagacgctcaccctgttcgaggaccgcgagatgatccagcagcggctgcacaagtactccgacatcttcagcacccagcagctcaagaagctggagcgccggcactacaccggctgggggcgcctgtcctacaagctcatcaacggcatccggaacaaggagaacaacaagacgatcctggagtacctgatcgacgacggctacgccaaccgcaacttcatgcagctcatcaacgacgacaccctgcccttcaagcagatcatcaaggacgcgcagatcatcgggaacatcgacgacatcgccgccgtcgtgcacgagctgcccggcagcccggccatcaagaaggggatcctccagtccatcaagatcgtggacgagctggtcaaggtgatgggccacaaccccgacaacatcgtcatcgagatggcccgggagaaccagaccaccaaccgcgggcggagccagagccagcagcgcctgaagaagctccaggactccctgaaggagctgggcagcaacatcctcaacaagaagaagccctcctacgtggaggacaaggtggagaacgtccacctccaggacgaccggctgttcctgtactacatccagaacggcaaggacatctacaccggggaggagctggacatcgaccgcctgagcgactacgacatcgaccacatcatcccccaggcgttcatcaaggacgactccatcgacaaccgggtgctcacgagctccgccaagaaccgcggcaagagcgacgacgtgccgaacctggacatcgtccgcgcccggaaggccgactgggtgcgcctgtacaagtccgggctcatcagcaagcggaagttcgacaacctgaccaagtccgagcgcggcgggctgaccgaggccgacaaggcgggcttcatcaagcggcagctcgtggagacccgccagatcacgaagcacgtcgcccagatcctggacgcccggttcaacaccgagcacgacgaggacgacaaggtgatccgcaacgtgaaggtcatcaccctcaagagcaacctgatctcccagttccggaaggacttcaagttctacaaggtgcgcgagatcaacgactaccaccacgcccacgacgcctacctgaacgcggtggtcggcaccgccctgctccggaagtaccccaagctggcccccgagttcgtgtacggggagtacaagaagtacgacgtgcgcaagctgatcacgagctccagcgacaaggccaccgcgaagtacttcttctactccaacctcatgaacttcttcaagcgggtcgtgcgctacagcaacggccgggtgatcgtccgccccgtgatcgagtacagcaaggacaccggggagatcgtgtggaacaaggagaccgacttccggacgatctgcaaggtcctgtcctacccccaggtgaacatcgtgaagaaggtcgagagccagaccggcggcttctccaaggagagcatcctgccgaagggggactccgacaagctcatcccccgcaagaccaagaaggtgtactgggacaccaagaagtacggcgggttcgacagccccatcatcgcctactccgtgttcgtcgtggccgacgtggagaagggcaaggccaagaagctgaagaaggtcaaggagctggtggggatcagcatcatggagcggccgtccttcgagaagaaccccatcgtgttcctcgagaagaagggctaccgcaacgtccaggaggacacgctgatcaagctgcccaagtacagcctcttcgagttcgagggcgggcggcgccgcctgctggcctccgcgagcgagctccagaagggcaacgaggtggtgctgtccgaccggctggtcgagctcctgtaccacgcccaccgcgtgaacagcttcaactccaccgagcacctgaagtacgtgagcgagcacaagaaggagttcggggaggtcctctcctgcgtggagaacttcgccaacagctacgtggacgtcgagaagaacctggacaagatccgggccgtgatcaacaagatcgacaccttctccatcgaggagatcagcaccagcttcgtgaacctgctcacgctgaccgccctgggcgcgccggccgacttcaacttcctcgggaagaagatcccccgcaagcggtacacctccaccaaggagtgcctgaacgccacgctgatccaccagagcatcaccggcctctacgagacccgcatcgacctgtccaagctgggcgaggacaagtga

SEQ ID NO: 1998 - RNA, 4119 nt, synthetic construct
  misc_feature 1..4119: note = Cas9 variant
  source 1..4119: mol_type = other RNA
atgaccaagaagaactacagcatcggcctggacatcgggaccaactccgtgggctgggccgtcatcacggacgactacaaggtgcccgccaagaagatgaaggtgctcgggaacaccgacaagaagtacatcaagaagaacctgctgggcgcgctcctgttcgacagcggggagaccgccgaggccacccgcctgaagcggacggcccgccggcgctacacccggcgcaagaaccggctccgctacctgcaggagatcttcgccaacgagatcgcgaaggtcgacgagtccttcttccagcggctggacgagagcttcctcaccgacgacgacaagaccttcgactcccacccgatcttcggcaacaaggccgaggaggacgcctaccaccagaagttccccacgatctaccacctccgcaagcacctggccgacagctccgagaaggcggacctgcggctggtgtacctggccctcgcccacatgatcaagttccgcggccacttcctgatcgagggggagctgaacgccgagaacaccgacgtgcagaagatcttcgccgacttcgtcggcgtgtacaaccggaccttcgacgacagccacctctccgagatcaccgtggacgtcgcgagcatcctgacggagaagatctccaagagccgccggctggagaacctcatcaagtactaccccaccgagaagaagaacaccctgttcgggaacctgatcgccctcgccctgggcctgcagcccaacttcaagaccaacttcaagctctccgaggacgccaagctgcagttcagcaaggacacgtacgaggaggacctggaggagctcctggggaagatcggcgacgactacgccgacctgttcacctccgcgaagaacctctacgacgccatcctgctgagcggcatcctcaccgtggacgacaactccaccaaggccccgctgagcgcctccatgatcaagcgctacgtggagcaccacgaggacctggagaagctcaaggagttcatcaaggccaacaagagcgagctgtaccacgacatcttcaaggacaagaacaagaacgggtacgcgggctacatcgagaacggggtcaagcaggacgagttctacaagtacctgaagaacatcctcagcaagatcaagatcgacggctccgactacttcctggacaagatcgagcgggaggacttcctgcgcaagcagcggacgttcgacaacggcagcatcccccaccagatccacctccaggagatgcacgccatcctgcgccggcagggggactactaccccttcctgaaggagaagcaggaccgcatcgagaagatcctcaccttccgcatcccctactacgtgggcccgctggtgcggaaggactcccgcttcgcctgggccgagtaccggagcgacgagaagatcaccccctggaacttcgacaaggtcatcgacaaggagaagtccgccgagaagttcatcacccgcatgacgctgaacgacctgtacctccccgaggagaaggtgctgcccaagcacagccacgtgtacgagacctacgcggtctacaacgagctgaccaagatcaagtacgtgaacgagcaggggaaggagtccttcttcgacagcaacatgaagcaggagatcttcgaccacgtgttcaaggagaaccggaaggtcaccaaggagaagctcctgaactacctgaacaaggagttcccggagtaccgcatcaaggacctcatcggcctggacaaggagaacaagtccttcaacgccagcctggggacgtaccacgacctcaagaagatcctggacaaggccttcctggacgacaaggtgaacgaggaggtgatcgaggacatcatcaagaccctcaccctgttcgaggacaaggacatgatccacgagcggctgcagaagtactccgacatcttcaccgccaaccagctcaagaagctggagcgccggcactacacgggctggggccgcctgagctacaagctcatcaacgggatccggaacaaggagaacaacaagaccatcctggactacctgatcgacgacggctccgcgaaccgcaacttcatgcagctcatcaacgacgacaccctgcccttcaagcagatcatccagaagtcccaggtcgtgggggacgtcgacgacatcgaggccgtggtgcacgacctgcccggcagccccgccatcaagaaggggatcctccagagcgtcaagatcgtggacgagctggtgaaggtcatgggcggcaacccggacaacatcgtgatcgagatggcccgggagaaccagaccacgaaccgcgggcggtcccagagccagcagcgcctgaagaagctccagaactccctgaaggagctgggcagcaacatcctcaacgaggagaagcccagctacatcgaggacaaggtggagaactcccacctccagaacgaccagctgttcctgtactacatccagaacgggaaggacatgtacaccggcgacgagctggacatcgaccacctgagcgactacgacatcgaccacatcatcccccaggccttcatcaaggacgactccatcgacaaccgggtcctcaccagctccgcgaagaaccgcggcaagagcgacgacgtgccctccctggacatcgtgcgggcccgcaaggccgagtgggtccgcctgtacaagagcgggctcatctccaagcggaagttcgacaacctgaccaaggccgagcgcggcgggctgaccgaggccgacaaggcgggcttcatcaagcggcagctcgtggagacgcgccagatcaccaagcacgtggcccagatcctggacgcccggttcaacaccgagcacgacgagaacgacaaggtcatccgcgacgtgaaggtgatcaccctcaagagcaacctggtctcccagttccggaaggacttcgagttctacaaggtgcgcgagatcaacgactaccaccacgcccacgacgcctacctgaacgcggtggtcgggacggccctgctcaagaagtacccgaagctggccagcgagttcgtgtacggcgagtacaagaagtacgacatccggaagttcatcaccaactccagcgacaaggccaccgcgaagtacttcttctactccaacctgatgaacttcttcaagaccaaggtgaagtacgccgacggcacggtcttcgagcgccccatcatcgagaccaacgccgacggggagatcgcctggaacaagcagatcgacttcgagaaggtgcggaaggtgctcagctacccccaggtcaacatcgtgaagaaggtggagacccagaccggcgggttctccaaggagagcatcctgcccaagggcgacagcgacaagctgatcccgcgcaagacgaagaaggtctactgggacaccaagaagtacgggggcttcgactcccccaccgtggcctacagcgtgttcgtcgtggcggacgtggagaagggcaaggccaagaagctcaagaccgtcaaggagctggtggggatctccatcatggagcggagcttcttcgaggagaaccccgtggagttcctggagaacaagggctaccacaacatccgcgaggacaagctcatcaagctgcccaagtactccctgttcgagttcgagggcgggcggcgccggctcctggccagcgcctccgagctgcagaaggggaacgagatggtcctcccgggctacctggtggagctgctctaccacgcccaccgcgcggacaacttcaacagcacggagtacctgaactacgtgtccgagcacaagaaggagttcgagaaggtcctgagctgcgtggaggacttcgccaacctctacgtggacgtcgagaagaacctgtccaagatccgggccgtggccgacagcatggacaacttctccatcgaggagatcagcaactccttcatcaacctgctcaccctgaccgccctgggcgcgcccgccgacttcaacttcctcggggagaagatcccccgcaagcggtacaccagcacgaaggagtgcctgaacgccaccctgatccaccagtccatcaccggcctctacgagacccgcatcgacctgagcaagctgggggaggagtga

SEQ ID NO: 1999 - RNA, 4119 nt, synthetic construct
  misc_feature 1..4119: note = Cas9 variant
  source 1..4119: mol_type = other RNA
atgaacagcgacaagcgcgaggactactacgtgggcctggacatggggaccggctccctcgggggcgccgtcaccgacacgcagtaccacctcctgaaggtgaaggggaaggacttctggttcgtgcgggagtacgagaccgccaagagccagctggaccgccggacccaccgcatcgcgaagcggcgcctgcagcggcacaaggcccgcatcggcctgatccggtcctacttcgccgaggacatcctcaagcacgaccccctgttctacatccgccaggacaacagcaagtactaccacgaggacaaggacgtccggctgaccacgaaggactccatcttcgccgacccgggctacggggacaaggagtacctcgacgacaaggagtaccccaccatcttccacctccgccaggccctgctgcgggaccagatcaaggacgaggagcgctacagccggttcctgtacctggcgatcatcaacatgttcgagcaccgcggccacttcctcctgaacaccgagtccagcgacctgaacgccgacatgatcaaggacgtgggggagctcgtgatgaacgccatctgcggcgtctccgagtacgggagcgtgacctacaaggagatcatcgagatcctggaggacaagaacatctcccggacggccaagaaggaccagatcgcgagcaagatcgacatcaagaagtccgagaaggcccagatggagcgcatcaagtgcctgtgcggcatggaggccgacgcccgggtgatgttcgagatcgaggccgacgagaagatcaagatcgcgttccagcaggccgccttcgaggacgagaaggaggagatcgaggccgtcatcggcgaggaccgctacctcatcatcgagaacatgaagcagctgtacgactacagccagctgcagtccgtgctcaacgggttcgactacctgagcgacgcccgggtgcagatgtacgagaagcacaaggaggacctgcacctcctgaagaaggtctaccgcaagaacctggaccgcgagatctacgaccggatgttccgctccggcgaggaggggagctactgcgcgtactccaacagcaccaacagcgtggactccctcgccgaggccaagaagtaccggcgcaacatgaagaagcggagccagaaggacctgtacgaccgcatcaagaaggacctgaaggaggtgcacgacgccgacgccgacgcgatccggaaggagatggagctcgagcgcttcctgcccaagcagatcaccggcgccaacggcatcatccccaaccaggtccaccggaaggagctgaagaagatcctcgagaacgccgagcaccacctggacttcctgaaggagaaggacgagtccgggtacaccgtgagcgagcgcatcctcatgctgttctccagcaacatcccgtactacgtgggccccgtcgggtccggcagcaagacggggtgggccaagatccaggagtccggccaggtgctgccctggaacatggagcagaagatcgacatcgagcagaccagcgagcggttcatcaccaacctcatccgcgagtgcacctacctgtccggcgagaaggtgctgcccaagcagagcctcctgtacgagtcctactgcgtcctgaacgagatcaacaacctccggatccacgggaagcgcatcgtgccggagctgaagcaggacatctacaaggaggtgttccagggcttccggctggggaagaaggtcacgaagaagaacatctgcacctacctgatcaaccgcggcctcatcaccgaggagagcgaggtgtccgggatcgacaaggagatcaacgcctacctgcccagctacggcaagatgtacggcgtcttcggggagcggctgcgcgaggaggcggtgcaggagatcgccgagaagatcatctactacggcaccatctacggggacgccaagtccatgttccggaagaagctcaaccagtacgtgagcgacggctggatgacggagtaccaggccaagcgcatctccgggtacaagttcaaggactgggcgcgcctgagccggagcatgctgtgcctctccggctgcgacaagagcaccggcgagaagatctccctgatccgcgccatgtgggagtacaacctgaacttcatggagctcatctaccgggaggacttcaccttccagaaggagctggaggagcgccggaaggccctggggaagaccctccaggagttccagttcgaggacctggacgagtactactacagcgcccccgtcaagcgcatgatctggcaggccgtgcaggcgctgaaggagatcacgcagatcatgggccacaaccccaagcggatcttcatcgagatgacccgcaccgaggaggagaagggggagcagggccggaagaactcccgcgagaagcggctcctgaagatgtacgagagcatccgcgacgagcggaactgggccgccgagatcaagaacgccaacgcctccggcaagctgaacagcaagaagctctacctgtactacctgcagatggggcgcgacgtgtacaccggcgagccgatcgacatcgaggacctcttcgacgactcccggtacgacatcgaccacatctacccccgcagcctgacgaacgacaacaacatcgagaacaacctggtcctcgtgtccaagaccatcaaccagaacgagaagaagaacgactaccccgtgcccgagaagatccggcgcaacaagaaggtccggaacctgtggcacaccctgcacaagatggggttcatgaacgacgagaagtacaaccgcctcaccagcacggagcggctgtccgaggaccagctggcgggcttcatcgcccgccagctcgtggagaccgcccagggggccaagggcatcgccgagctgatgaaggcgatgctgccgggcaccgacatcgtgtacgccaaggcccgcaacgtcagcgacttccggaaggagtacaagatgctcaagtcccgcctggtgaacgactaccaccacgcccaggacgcgtacctgaacatcgtggtcgggaacgtgtacttcatgaagttcacccggaaccccatgaacttcgtgaagacggaggcccgccgggacggccgcaactacgactacaacctctacaagatgtacagcaaggacatcatccggaacggggagaaggcctggatcgccacctccgagcagggccccgggaccatccgcctggtcaaggagaccatgggccggaacacccccatcatcacgcgccaggccttcgagcagcggggcgagctgttcaacctccagccggtggggaagtacagcgcgaagaaggacaactacgtgcccctgaagatcaacgacgagaagatgcaggacgtcagcaagtacggcgggtacacctccctgaaccccagctacttcatcttcatcgagcacggccccgagaagaagcgcaagaagtgcttcgaggtgatccactcctactacgccgcccagatcaagaccgagaaggacctcatcgacttcctgctgcagaaggggtacaagaacccgcgggtgatcaacgcccgcatcaagaagaacgccctcatcaagtacaacggctacttcctgtacatcatcggcatggacgcgcggaagaacatcgagttcagcaacgccaccgccatgtgcctgaagaacaagtacatccagtacgtctgcaagctcgagaagatgaacaaggccatcctgctgtccgagaagcagaagacgaacctccactgggacgagaagatcacgtgcgagagcaacctggagctgtaccgcgagctcaccgagaagcacctccactccatctaccagcggcacccccgcagcatcgggaagtgcctggccgacggcgagggggcgttcaagctgctggacatcgaggagcaggtcaagatcatctgcgacatcgtgcagtacacctccttccagcggggcgtgttcagcctgaaggtgctcgggggccccaaggaggtgggccgcatccgcatctccgggaacatgaccgaggccaaggagtgcaagctggtcaactacagcatcaccggcatgtacaagaccgagatggacctgctcaagaagtga

SEQ ID NO: 2000 - RNA, 4122 nt, synthetic construct
  misc_feature 1..4122: note = Cas9 variant
  source 1..4122: mol_type = other RNA
atggagaagacctacagcatcggcctggacatcgggaccaactccgtgggctggagcgtcatcacggacgactacaaggtgcccgccaagaagatgaaggtgctcgggaacaccgacaagaagtacatcaagaagaacctgctgggcgccctcctgttcgactccggggagaccgcggaggtcacccgcctgaagcggacggcccgccggcgctacacccggcgcaagaaccggctccgctacctgcaggagatcttcgccaaggagatggccaaggtggacgagagcttcttccagcggctggaggagtccttcctcaccgacgacgacaagaccttcgacagccacccgatcttcggcaacaaggccgaggaggacgcgtaccaccaggagttccccacgatctaccacctccgcaagcacctggccgactccagcgagaaggccgacctccggctggtgtacctggccctcgcgcacatgatcaagttccgcggccacttcctgatcgagggggagctgaacgccgagaacaccgacatccagaagctgttcaacgacttcgtcgagacctacgacaagatcgccgacgagtcccacctgagcgaggtggacgcctccagcatcctgaccaacaagatctccaagagccggcgcctcgagaacctgatcaagcagtaccccacggagaagaagaacaccctgttcggcaacctcgtggccctggtcctggggctccagcccaacttcaagaccaacttcaagctgtccgaggacgcgaagctgcagttcagcaaggacacctacgacgaggacctcgaggagctgctgggcaagatcggggacgactacgccgacctcttcacggccgccaagaacctgtacgacgccatcctgctctccggcatcctgaccgtggacgacaacagcaccaaggcgccgctgtccgccagcatgatcaagcggtacgaggagcaccacgaggacctcgagaagctgaagaagttcatcaaggtgaacaacttcgacaagtaccacgagatcttcaaggacaagagcaagaacggctacgccgggtacatcgagaacggcgtcaagcaggacatcttctacaagcacctgaagtccatcatcagcgagaagaacgggggccagtacttcctcgacaagatcgagcgcgaggacttcctgcggaagcagcgcaccttcgacaacggctccatcccccaccagatccacctccaggagatgcgggccatcctccgccggcagggggagtactaccccttcctgaaggagaaccaggccaagatcgagaagatcctgacgttccgcatcccctactacgtgggcccgctcgcgcgcaaggacagccggttcgcctgggccaactaccactccgacgagcccatcaccccctggaacttcgacgaggtggtcgacaaggagaagtccgccgagaagttcatcacccgcatgaccctgaacgacctgtacctgcccgaggagaaggtgctcccgaagcacagccacgtgtacgagacgttcaccgtctacaacgagctgaccaagatcaagtacgtgaacgagcagggggagagcttcttcttcgacgccaacatgaagcaggagatcttcgaccacgtgttcaaggagaaccggaaggtcaccaaggcgaagctgctctcctacctgaacaacgagttcgaggagttccgcatcaacgacctgatcggcctcgacaaggacagcaagtccttcaacgccagcctggggacgtaccacgacctgaagaagatcctcgacaagtccttcctggacgacaagaccaacgagcagatcatcgaggacatcgtgctgaccctcaccctgttcgaggaccgggacatgatccacgagcgcctgcagaagtacagcgacttcttcacgtcccagcagctcaagaagctggagcggcgccactacaccggctggggccggctgagctacaagctcatcaacgggatccgcaacaaggagaacaacaagaccatcctggacttcctgatcgacgacggccacgccaaccggaacttcatgcagctcatcaacgacgagtccctgagcttcaagaccatcatccaggaggcccaggtggtcggggacgtggacgacatcgaggcggtcgtgcacgacctgcccggctcccccgccatcaagaaggggatcctccagagcgtgaagatcgtcgacgagctggtgaaggtgatgggcgacaaccccgacaacatcgtcatcgagatggcccgcgagaaccagacgaccaaccgggagcgcagccagtcccagcagcggctgaagaagctccagaacagcctgaaggagctgggctccaacatcctcaacgaggagaagccgagctacatcgaggacaaggtggagaactcccacctccagaacgaccagctgttcctctactacatccagaacgggaaggacatgtacaccggcgacgagctggacatcgaccacctgagcgactacgacatcgaccacatcatcccccaggccttcatcaaggacaactccatcgacaaccgcgtgctcaccagctccgccaagaaccggggcaagagcgacgacgtcccctccctggacatcgtgcgcgcgcggaaggccgagtgggtgcgcctgtacaagagcgggctcatctccaagcgcaagttcgacaacctgaccaaggccgagcgcgggggcctgacggaggccgacaaggccggcttcatcaagcggcagctcgtcgagacccggcagatcaccaagcacgtggcgcagatcctggacgcccgcttcaacaccaagcgggacgagaacgacaaggtgatccgcgacgtcaaggtgatcacgctcaagagcaacctggtgtcccagttccggaaggagttcaagttctacaaggtccgcgagatcaacgactaccaccacgcccacgacgcctacctgaacgccgtggtggggaccgcgctgctcaagaagtaccccaagctgaccccggagttcgtctacggcgagtacaagaagtacgacgtgcggaagctgatcgccaagagctccgacgactacagcgagatggggaaggccaccgccaagtacttcttctacagcaacctcatgaacttcttcaagacggaggtgaagtacgcggacggccgcgtcttcgagcggcccgacatcgagaccaacgccgacggcgaggtggtgtggaacaagcagaaggacttcgacatcgtccgcaaggtgctgtcctacccccaggtgaacatcgtcaagaaggtggaggagcagaccgtggggcagaacggcgggctgttcgacaacaacatcctcgccaagcccgagaaggacgacaagaagaagctgttcccgatcaagaagtccctgagcaccacgagctacggcgggtacgcccgggccaccatcgcgtactccatcctcatcgtcagcgagttcggcaagaacaaggagctgaagctgctcggcctgcccctgctcgacaaggtgaagtacgagaagaaccccatcgcctacctgaactccatcgggatcatcaacgtcaagagcatcttcaagctgcccaagtactgcctcttcgagttccaggagaagaacaccaactaccgccggtacatggtgtccaaccaggagctgaagcgcgccaaccagctgttcctgacctgcaaggagacggagctggtgtacaagtacatcaagagcgacaacgacaacacccacctggtgggcaacgagaagaccatcctctccatctggaacaagctggtcatcttcatggagcggaccaagctgatcgacaagaagctgttcgccagcctgaagcagctgaaggacgaggtggacctcatcaacatcctggacatgacggccaagtccctggacttcaccaagatcagcgcggggcagaagaagatcaccatctccgacagcctctccctgccgatcaagcgctggcagttcagctccgacgagaagatgctgaagcagctcaagaccgccacgctgatccaccagagcgtgaccggcctgtacgagacccggatcgacctcagcaagctgggggaggagtga

SEQ ID NO: 2001 - RNA, 4122 nt, synthetic construct
  misc_feature 1..4122: note = Cas9 variant
  source 1..4122: mol_type = other RNA
atggagaagacctacagcatcggcctggacatcgggaccaactccgtgggctggagcgtcatcacggacgactacaaggtgcccgccaagaagatgaaggtgctcgggaacaccgacaagaagtacatcaagaagaacctgctgggcgccctcctgttcgactccggggagaccgcggaggtcacccgcctgaagcggacggcccgccggcgctacacccggcgcaagaaccggctccgctacctgcaggagatcttcgccaaggagatggccaaggtggacgagagcttcttccagcggctggaggagtccttcctcaccgacgacgacaagaccttcgacagccacccgatcttcggcaacaaggccgaggaggacgcgtaccaccaggagttccccacgatctaccacctccgcaagcacctggccgactccagcgagaaggccgacctccggctggtgtacctggccctcgcgcacatgatcaagttccgcggccacttcctgatcgagggggagctgaacgccgagaacaccgacatccagaagctgttcaacgacttcgtcgagacctacgacaagatcgccgacgagtcccacctgagcgaggtggacgcctccagcatcctgaccaacaagatctccaagagccggcgcctcgagaacctgatcaagcagtaccccacggagaagaagaacaccctgttcggcaacctcgtggccctggtcctggggctccagcccaacttcaagaccaacttcaagctgtccgaggacgcgaagctgcagttcagcaaggacacctacgacgaggacctcgaggagctgctgggcaagatcggggacgactacgccgacctcttcacggccgccaagaacctgtacgacgccatcctgctctccggcatcctgaccgtggacgacaacagcaccaaggcgccgctgtccgccagcatgatcaagcggtacgaggagcaccacgaggacctcgagaagctgaagaagttcatcaaggtgaacaacttcgacaagtaccacgagatcttcaaggacaagagcaagaacggctacgccgggtacatcgagaacggcgtcaagcaggacatcttctacaagcacctgaagtccatcatcagcgagaagaacgggggccagtacttcctcgacaagatcgagcgcgaggacttcctgcggaagcagcgcaccttcgacaacggctccatcccccaccagatccacctccaggagatgcgggccatcctccgccggcagggggagtactaccccttcctgaaggagaaccagagcaagatcgagaagatcctgacgttccgcatcccctactacgtgggcccgctcgcccgcaagaactcccggttcgcgtgggccaagtaccacagcgacgagcccatcaccccctggaacttcgacgaggtggtcgacaaggagaagtccgccgagaagttcatcacccgcatgaccctgaacgacctgtacctgcccgaggagaaggtgctcccgaagcacagccacgtgtacgagacgtacgccgtctacaacgagctgaccaagatcaagtacgtgaacgagcaggggaaggagtccttcttcgacagcaacatgaagcaggagatcttcgaccacgtgttcaaggagaaccggaaggtcaccaaggagaagctgctcaactacctgaacaaggagttccccgagtaccgcatcaaggacctgatcggcctcgacaaggagaacaagtccttcaacgccagcctggggacctaccacgacctgaagaagatcctcgacaagtccttcctggacgacaaggtgaacgaggaggtgatcgaggacatcatcaagacgctgaccctcttcgaggacaaggacatgatccacgagcggctgcagaagtacagcgacatcttcaccgcgaaccagctgaagaagctcgagcgccggcactacaccggctggggccgcctgtcctacaagctgatcaacgggatccggaacaaggagaacaacaagacgatcctcgactacctgatcgacgacggcagcgccaaccgcaacttcatgcagctgatcaacgacgacaccctccccttcaagcagatcatccagaagtcccaggtcgtgggggacgtcgacgacatcgaggccgtggtgcacgacctgcccggcagcccggccatcaagaaggggatcctgcagtccgtcaagatcgtggacgagctcgtgaaggtcatgggcggcaaccccgacaacatcgtgatcgagatggcgcgggagaaccagaccaccaaccgcgggcggagccagagccagcagcgcctgaagaagctgcagtccagcctcaaggagctgggctccaacatcatcaacgaggagaagcccagctacatcgaggacaaggtggagaactcccacctccagaacgaccagctgttcctgtactacatccagaacgggaaggacatgtacacgggcgacgagctggacatcgaccacctcagcgactacgacatcgaccacatcatcccccaggccttcatcaaggacgactccatcgacaaccgggtcctgaccagctccgccaagaaccgcggcaagagcgacgacgtgccgtccctggacatcgtgcgggcccgcaaggccgagtgggtccggctctacaagagcgggctgatctccaagcgcaagttcgacaacctgaccaaggcggagcgcggcgggctcaccgaggccgacaaggccggcttcatcaagcggcagctggtggagacccgccagatcacgaagcacgtggcccagatcctggacgcccggttcaacaccgagcacgacgagaacgacaaggtcatccgcgacgtgaaggtgatcaccctcaagagcaacctggtctcccagttccggaaggacttcgagttctacaaggtgcgcgagatcaacgactaccaccacgcgcacgacgcctacctgaacgccgtggtcgggaccgccctcctgaagaagtaccccaagctggcccccgagttcgtgtacggcgagtacaagaagtacgacgtgcggaagctcatcgccaagagctccgacgaccacagcgagatgggcaaggcgacggccaagtacttcttctacagcaacctgatgaacttcttcaagaccaaggtcaagtacgccgacgggtccgtgtacgagcgccccatcatcgagaccaacgcggacggcgaggtggtctggaacaagcagaaggacttcgagatcatccggaaggtgctgagctacccccaggtgaacatcgtcaagaaggtggaggagcagaccgtggggcagaacggcggcctcttcgacaacaacatcctggccaagccggagaaggacgacaagaagaagctgttccccatcaagaagtccctcagcacgacctcctacgggggctacgcccgcgccaccatcgcctacagcatcctgatcgtctccgagttcgggaagaacaaggagctgaagctcctgggcctgcccctcctggacaaggtgaagtacgagaagaacccgatcgcgtacctgaacagcatcgggatcatcaacgtgaagtccatcttcaagctccccaagtactgcctgttcgagttccaggagaagaacaccaactaccggcgctacatggtcagcaaccaggagctgaagcgggccaaccagctgttcctgacgtgcaaggagaccgagctggtgtacaagtacatcaagtccgacaacgacaacacccacctcgtgggcaacgagaagaccatcctgagcatctggaacaagctggtcatcttcatggagcgcacgaagctcatcgacaagaagctgttcgcctccctgaagcagctcaaggacgaggtgaacctgatcaacatcctggacatcgccagcaagtccatcgacttcaccaagatcagcgccgggcagaagaagatcgtgctcaacgactccctgagcctgcccatcaagcggtggcagttcaagtccgacgagaagatgctcaagcagctgaacgacgcgaccctgatccaccagagcatcaccggcctctacgagacgcgcatcgacctgagcaagctgggcgaggagtga

SEQ ID NO: 2002 - RNA, 4122 nt, synthetic construct
  misc_feature 1..4122: note = Cas9 variant
  source 1..4122: mol_type = other RNA
atgaacctgcgccgggcccgcgactacagcatcggcctcgacctggggaccggctccgtggggtgggccgtcaccgacgcggagggcaacctgtacagcttcaaggggcggcccgccatgggctcccgcacgttcccgaacgccgagcccgccagcgtggcccggatcccccgcggccagcggcgccggtacgagcgccggcgccagcggatcaagctcctgcagcagttcttcatgtccgacatggagcgcgtggaccccgacttcttcacccggctgaaccagagcaccctcctggcggaggacaaggacgagcgcatcgcctcctgcgcctggccgatcttcaacagctccgacttcaccgagaaggactactacaagaagttccccacgatctaccacctccgggccttcctgtgcgagagcgacgagaagggggacctgcgcctggtctacctcgcgctgcacaacatcgtgaagcaccggggcaacttcctgtaccaggacaaccccgccctctccgccagcgacgcctccgtggacgaggccgtccgccagctggtggacgcgctggccgagtggtgccagaacaaggagatcgagctcagctgcgacgccgggcggatcatcgaggtgttcggcgacgcctccctgcgccgcaccgacaagcgggaccagctgaaggggctcctgggcctgcccgccgacctcgcgaagaccatgggcaaggagctggccagcgccgtcctggggtacgccgccaacttctccaagatcttcctcatcagcgacgcggagcacaagttctccctgggcaacgacgagaaggtggaggagttcgagaccatctgcccgaacgagtgcacgagcctgttcagcgccctccgcaccgcctactccgcctacctgctgagcgggatcctccgggacgccaacggcaagaccctgtccttctgcaagaagaaggagtacgaccgctaccacgacgacctggcgctcctgaaggccctggtgcgggagtacgcccccgagagctaccagtccttcttcggcggggagcgcctcgtcgtgaacggccggatgaccaagcgctacgaccccacgaaggccaaggggtacaccaagtacgacctggtgcacagcgcgggctcctacgacgagctggccaaggacgtcaagaagctcctggggagcctggccgccgacgactcccggtaccagcgcatgatgcaggccttcgacgaggagcggttcctccgccggctgaagaccagcgacaacggctccatcccctaccagctgcacctcgaggagctgcgcgcgatcatcgcccggcagggcgagttctacccgttcctgaaggaggagagcaagaagatcgagtccctggtgagcttccgcatcccctactacgtggggcccctcaccacgaagaacgccgccgtcgacgtgcacggcaacaagcggttcgcctggtccgagcgcaagcccgggatggagagcgcgaaggtgcggccgtggaactgggacgacgtcatcgaccgcggcaagtccgccgagaacttcatcgtgcgcatgaccgggacctgcacctacctgcagaacgagaaggtgctgcccaagtgcagcctcctgtacgaggagttctgcgtcctgaacgagctcaacggcgcccactggtccgccgacggcgaccacgagtgccccttcgacacgagcgaccggcgcgggatcgtgcaggacctgttctgcggcaagcggcgcgtcagctacaagcaggtcgaggactggctgcggcagcacgggtcccgccgggcccgcgtgagcggcgggcagggcgcgtccggcttcgagagcaagatgtccagctacatcttcttctccaaggacgtgctccacgtggaccggatcgaccccgccgacttcccgatgatcgaggagatcatcctgtggaacaccctgttcgaggaccgcgacatcctcaaggagcggatcgaggaggcctacggggaccgcctgaacgccgagcagatcaagaccatctgcaagaagcggttcaccggctgggggcgcctgagccggcgcctcctgacgggcatcaaggcgcagaccgaccagggcgacctgtccatcatggacatcctccgggagggggaccccaacaacgaccaccgcggcaaggccatggtgttcatggggatcctgcacagcgaggacctgggcttccagaagaagatcgaccagatcaaccaggagaaggtctccgccgggaaggtgagcctcgaggacctgcccggctcccccgccctgcggcgcagcatcaaccaggccatgcgggtggtcgacgagatcgtgtccatcgcgaagtgcccgcccagccacatctacctcgaggtgacccgcgacgaggacggcgcccgcaaggggcggcgctccacccggcgctacgacgccatcaaggccgccctggagaagttcaaggaggagagccccacgtggttcgaccaggacgtcttcggcgagttccggcgcagccgggcggaggacctggacgagcgcctctccctgtacttcatgcagggcggcaagagcctgtactccgccacgcccctcaagctggagctgctccacaccaaccagtaccaggtggaccacatcatcccgcagagctacatcaaggacgactccttcgagaacaaggccctggtgctggccggggagaaccagcgcaagagcgacgccctcctgatcgactccagcatccggaccgcgatggccccctactggcgggccctgcaccaggccgggctcatgggcgacaagaagttcaactccctgatgtgcagctccatcagcgacaagcgcgtccgggggttcatcgcgcgccagctggtggagacctcccagatcgtgaagctcgccggcatgatgctgcagagcaactaccccgaggccgacgtccagccggtgaaggcctccctggggcacgacctccgggtgcaggccggcttcatcaagtgccgcgaggtcaacgacttccaccacgcgcacgacgccctgatcgcctgcgaggtggggcggtacatcaaccagtgccaccccggcatctacgacaaccccatcggctacgcccgcgccgtgcgggagctggtccgcaagcagaacgaggagatgcgcaagtacgggcggctccccggcagcgcggggttcatcgtgggcgggttcatgcgcacccacgtggacgtcgacaccggcgaggtggtgtgggacgccgaggaggagctgtcccggatccgcgcctacctggactacagcaacgtcttcgtgacccggatgtccgaggagacgagcggcgccctctggaacgccaccatctacagcccgcactacgggaagaccgcgcccaccctgcacatcaagcagggcctggacgtgcagcgctacgggggctactccagcgccaccttcgcctacttcacgctctacgtcgccgagaagggcaagaagcggaaggccgagctgctggggatccccatctccgtggcgcgcaagatcgagggcgagcccagcaagctcgacgccttcgtggcccaggacgccgaggcgaagaagctgaagcacccgctgatcatccgggcccgcatcctcaagtacgcccggttcgagatggaggggaaccagttctacttcgccgcccaggacgcggtctactccgcccgccagctggtgctgaagggcgacctctacagcgtggccgccaaggcctgcgacaagcacctgaacgactcctgcatcagcaacgaggacctgatccggctctacgacgagctggtccacaagggggacctgctctgcaacaagttcggcaacgtgaccgacgtgctgcgcgcgggccgggagcgctacgccgggctgtccatcagcgagaagcggcagctcgtctgcaacgtgctggcctactaccgctccgccaccgcccgggtggacatcagcctggtcggcgggcccaagcacgcgggcaacctcgggatcgccttcgtgctgaacaaccccgaggccatcgtgttcgtcgaccagtccgtgaccggcatgttcgagaagcgcacgcgggtggagctgtga

SEQ ID NO: 2003 - RNA, 4122 nt, synthetic construct
  misc_feature 1..4122: note = Cas9 variant
  source 1..4122: mol_type = other RNA
atgaagaagatcctgggcctcgacctggggaccaacagcatcggctgggccctggtgaacgaggccgacaacgagcgcgagaagtccagcatcatcaagatcggggtccgggtgaaccccctcaccgtggacgagcagcagaacttcgagaagggcaagtccatcacgaccaacgcggaccgcaccctgaagcggagcatgcgccggaacctgcagcgcttcaagctccggaaggagaacctgatcgagatcctgaagaagcagaagttcatcaacgacgagaccatcctctccgagaacgggaacaagagcacgttcgagacctacaacctgcgcgccaagtccgccaccgaggagatcaccctggagcagttcgcccgggtcctcctgatgatcaacaagaagcgcggctacaagagctcccggaaggccaagagccaggacgagggccagctgatcgacgggatggagatcgcgaagaagctctacaacgacaacctgacgccgggccagttcgtgttccagatcctgaaggaggggaagaagtacatccccgacttctaccgctccgacctccaggccgagttcgacaagatctggagcttccagaagcagttcaaccccgacatcctgaccgaggagttcaacaagcagatcatcggcaaggggaaggtgaacaccaccaagatcttcctggccaagtacggcatctacacgatcgacaacaagggcgccgacaagaagtcccaggcgtacaactggcgggtcgaggccctcaccaaccagctgaccaaggaggagctggccttcgtgatcagcgacctcaacgggatcatctccaacagctccggctacctggggagcatctccgaccgcagcaaggagctgtacttcaacaagcagaccgtgggccagtacctcatcgcccagctgaaggagaacccccacacgcagctgaagaaccaggtcttctaccggcaggactacctcgacgagttcaacaccatctgggagacccaggccaagttccacaaggagctgaccaacgagctgaaggaggagatccgcgacatcatcatcttctaccagcggaagctcaagagccagaagggcctgatctccttctgcgagttcgagagcaagcagatcgagatcaacatcgacgggaagaagaagctgaagacggtgggctccaaggtgtgccccaagagcagccccctcttccaggtcttcaagatctggcagatcctgaacaacatccaggtgatcgagaagtccaccgggaagtccaagttcctggagcaggacgagaaggagatcctcttcaaggagctgaacttcaaggacaagatcagcaagaccgacgcgctgaagatcctctacaagaactacaaggagctggacttcaacttcaaggagaacatcgagggcaaccgcacccaggccacgttcctgaaggccttccagtccatcatcgagctcagcgggcacgaggtgtccgacttcagcaagatcaagaccgacgagatcctggagatcgtcacccccatcttcgagggcttcggcttcaacaccaacctgctccagttcaactccaacctgaaggggaaggacttcgagaagcaggccgtgtaccagctgtggcacctcctctacagcttcgagggcgacaactccaacacggggaacgagaagctgatccagaagatcagcgagctgtacggcttcgagcgggagtacgccatcatcatcgcgaacatctccttccagcccgactacgggagcctctccaccaaggccatccgcaagatcctgccgcacctgaaggagggcatcgagttcagcctcgcctgcgagtacgccggctaccggcacagcaagaactccctgaccaaggaggagaagaacaagaagatcctgaaggacaagatcgacatcctccccaagaacagcctgcgcaaccccgtggtcgagaagatcctgaaccagatgatcaacgtggtgaacgccaccatcgagacgtacgggaagcccgacgagatccgcatcgagctcgcgcgggagctgaagaagtccgccaaggagcgcgaggacctgaccaacgccatcaacaagagcaccctcgaccacgagaagtacaaggccctgctgcagaaggagttcggcctctccaacgtcagccggaacgacatcatccgctacaagctgtacctggagctcgagcacaacgggttccacaccctgtactccaacacgtacatcgagccgaacaagctgttcagcaaggagttcgacatcgagcacatcatcccccagtcccggctgttcgacgacagcttctccaacaagaccatcgagagccgctccgccaacatcgagaagggcaacgagaccgcgttcgactacgtgagcaacaagaacggggaggtgggcctgaaggactacctgaagaacatcgaggacctcttcaacaacggcaagatctccaagaccaagtacaacaagctgaagatgaagggggacgagatccccagcgacttcatcgcccgggacctgcgcgacacccagtacatctccaagaaggccaagagcatcctcgaggacctggtcaaggacgtggtcagcacgggcgggtccatcaccgaccggctgcgcgaggactggcagctcatcgacatcatgaaggagctgaactgggacaagtacgacaagctgggcctcaccgaggtgatcgagaacaacgacggccacaagatcaaccggatcaaggactggaccaagcgcaacgaccaccggcaccacgccatggacgcgctgacgatcgccttcaccaagcgcagctacatccagtacctgaacaacctcaacgcccggtccgacaagagcgggtccatctacggcatcgagcagaaggagctgtaccgcgacaagaacaacaagctgcggttcaagcccccgatccccctcgacgacttccgcgccgaggccaagaagcagctggagaacaccctggtgagcatcaaggcgaagaacaaggtcgccaccatcaacatcaacaacacgaagaagcagggcggggagaacaagaagaagcagctcaccccgcgggggcagctgcacctggagaccatctacggctccatccagcagtacgtgaccaaggaggagaaggtgggcgccaacttcaacaaggagctcatcgagaaggtcgccaacaagaagtgccgcgaggccctgctgaagcgcctcatcgagttcgacaacgaccccaagaaggcgttcacgcggaagaacagcctgaacaagaacccgctgtacatcgacaccatcaagacctacaaggtgcccgagaaggtgaagaccgtcacgaccgagaccatctacaccatccgcaaggacatcaaccccgacctcaagatcgacaaggtggtggacaagaagatcaagaacatcctggagctgcggctcaaggagttcaacggggacgccaagaaggccttctccaacctggacgagaagcccatctggctgaacaaggagaagggcatcagcatcaagcgcgtcacgatcaccgggatctccaacgccatcgccctccacgacaagaaggacaaggagggcaacttcatcctggacaaccaggggaagaagcaggcggtggacttcgtgaacaccggcaacaaccaccacgtcgccatctacaaggacgagaagggcaacctgcaggagaacgtgatcaccttctacgaggccgtggagcgggtcaaccaggggatcccgatcatcgacaagacgtacaagcagaacgagggctggcagttcctcttcagcatgaagcagaacgagtacttcgtgttccccaacgagaagaccgggttcaactccaacgagatcgacctgctgaaccccgagaactaccacctcatcagccccaacctgttccgcgtgcagaagatcgccaccaaggactacttcttccggcaccacctggagaccaacgtcgagaacatcacgaccaccaaggacctcacctggaagcgcctgggcatcaacgggatcatcaacatcctgaaggtgcggatcaaccacatcggccagatcgtgtccgtcggcgagtactga

SEQ ID NO: 2004 - RNA, 4122 nt, synthetic construct
  misc_feature 1..4122: note = Cas9 variant
  source 1..4122: mol_type = other RNA
atgaccaagaagaactacagcatcggcctggacatcgggaccaactccgtgggctgggccgtcatcacggacgactacaaggtgcccgccaagaagatgaaggtgctcgggaacaccgacaagaagtacatcaagaagaacctgctgggcgcgctcctgttcgacagcggggagaccgccgaggccacccgcctgaagcggacggcccgccggcgctacacccggcgcaagaaccggctccgctacctgcaggagatcttcgccgaggagatgaccaaggtcgacgagtccttcttccagcggctggacgagagcttcctccgctgggacgacgacaacaagaagctgggccggtacccgatcttcggcaacaaggcggacgtggtgaagtaccaccaggagttccccaccatctaccacctccgcaagcacctcgccgactccagcgagaaggccgacctgcggctggtctacctcgccctggcgcacatgatcaagttccgcgggcacttcctgatcgagggcgagctcaacgccgagaacacggacgtgcagaagatcttcgccgacttcgtgggggtctacgaccggaccttcgacgactcccacctgagcgagatcaccgtggacgccgcctccatcctgaccgagaagatcagcaagtcccgccggctcgagaacctgatcaagtactaccccacggagaagaagaacaccctgttcggcaacctcatcgcgctggccctggggctccagcccaacttcaagatgaacttcaagctgagcgaggacgccaagctgcagttctccaaggacagctacgaggaggacctcggcgagctgctgggcaagatcggggacgactacgccgacctcttcacctccgccaagaacctgtacgacgcgatcctgctcagcggcatcctgatcgtggacgacaactccaccaaggccccgctgagcgcctccatgatcaagcgctacgtcgagcaccaggaggacctcgagaagctgaaggagttcatcaaggccaacaagagcgagctgtaccacgacatcttcaaggacaagaacaagaacgggtacgccggctacatcgagaacggcgtgaagcaggacgagttctacaagtacctcaagaacacgctgagcaagatcgcggggtccgactacttcctggacaagatcgagcgggaggacttcctccgcaagcagcggaccttcgacaacggcagcatcccccaccagatccacctccaggagatgcacgccatcctgcgccgccagggggactactaccccttcctgaaggagaaccaggaccggatcgagaagatcctgaccttccgcatcccctactacgtgggcccgctggcccggaaggactcccgcttcagctgggccgagtaccactccgacgagaagatcaccccctggaacttcgacaaggtcatcgacaaggagaagtccgccgagaagttcatcacgcggatgaccctgaacgacctctacctgcccgaggagaaggtgctgcccaagcacagccacgtgtacgagacctacgcggtctacaacgagctcaccaagatcaagtacgtgaacgagcaggggaaggacagcttcttcgactccaacatgaagcaggagatcttcgaccacgtgttcaaggagaaccgcaaggtcacgaaggagaagctgctgaactacctcaacaaggagttcccggagtaccggatcaaggacctgatcggcctggacaaggagaacaagagcttcaacgcctccctcggcacctaccacgacctgaagaagatcctggacaaggccttcctcgacgacaaggtgaacgaggaggtgatcgaggacatcatcaagaccctgaccctgttcgaggacaaggacatgatccacgagcgcctccagaagtacagcgacatcttcacggccgaccagctgaagaagctggagcggcgccactacaccgggtggggccggctctcctacaagctgatcaacgggatccgcaacaaggagaacaacaagaccatcctggactacctcatcgacgacggcagcgcgaaccggaacttcatgcagctgatcaacgacgacaccctgcccttcaagcagatcatccagaagtcccaggtcgtgggggacgtcgacgacatcgaggccgtggtgcacgacctccccggcagccccgccatcaagaagggcatcctgcagtccgtcaagatcgtggacgagctggtgaaggtcatgggggacaacccggacaacatcgtgatcgagatggcccgcgagaaccagacgaccaaccggggccgcagccagtcccagcagcggctcaagaagctgcagaacagcctgaaggagctcgggagcaacatcctgaacgaggagaagccctcctacatcgaggacaaggtggagaacagccacctccagaacgaccagctgttcctgtactacatccagaacggcaaggacatgtacaccggggacgagctggacatcgaccacctgtccgactacgacatcgaccacatcatcccccaggccttcatcaaggacgacagcatcgacaaccgcgtcctgacctccagcgcgaagaaccggggcaagtccgacgacgtgcccagcctggacatcgtgcgcgcccgcaaggccgagtgggtccggctctacaagtccggcctgatcagcaagcgcaagttcgacaacctgacgaaggccgagcgcgggggcctcaccgaggccgacaaggcggggttcatcaagcggcagctggtggagacccggcagatcaccaagcacgtggcccagatcctggacgcccgcttcaacaccgagtccgacgagaacgacaaggtcatccgggacgtgaaggtgatcacgctcaagagcaacctggtctcccagttccgcaaggacttcgagttctacaaggtgcgggagatcaacgactaccaccacgcccacgacgcctacctgaacgcggtggtcggcaccgccctcctgaagaagtacccgaagctggccagcgagttcgtgtacggcgagtacaagaagtacgacatccgcaagttcatcaccaactccagcgacaaggccaccgcgaagtacttcttctactccaacctcatgaacttcttcaagcgggtgatccgctacagcaacgggaaggtcatcgtgcggcccgtggtcgagtacagcaaggacacggaggacatcgcctgggacaagaagtccaacttccgcaccatctgcaaggtgctgagctacccccaggtgaacatcgtcaagaaggtggagacccagaccggcgggttctccaaggagagcatcctgcccaagggcgactccgacaagctcatcccgcggaagacgaagaaggcctactgggacaccaagaagtacgggggcttcgacagccccaccgtggcctactccgtcttcgtggtggccgacgtcgagaagggcaaggcgaagaagctgaagaccgtgaaggagctggtggggatcagcatcatggagcgctccttcttcgaggagaaccccgtcgagttcctcgagaacaagggctaccacaacatccgggaggacaagctgatcaagctgcccaagtacagcctcttcgagttcgagggcgggaagcgccggctgctggcctccgccagcgagctccagaaggggaacgagatggtgatcccgggccacctggtgaagctgctctaccacgcccagcgcatcaactccttcaacagcacgaagtacctggactacgtctccgcccacaagaaggagttcgagaaggtgctgagctgcgtggaggacttcgcgaacctctacgtcgacgtggagaagaacctgtccaagatccgggccgtggccgacagcatggacaacttctccatcgaggagatcagcaacagcttcatcaacctgctcaccctgaccgccctgggcgcccccgcggacttcaacttcctcggggagaagatcccccgcaagcgctacacctccacgaaggagtgcctgaacgccaccctgatccaccagagcatcaccggcctctacgagacccggatcgacctgtccaagatcggggaggagtga

SEQ ID NO: 2005 - RNA, 4122 nt, synthetic construct
  misc_feature 1..4122: note = Cas9 variant
  source 1..4122: mol_type = other RNA
atggagaacaagaactacagcatcggcctggacatcgggaccaactccgtgggctgggccgtcatcaccgacgactacaaggtgcccagcaagaagatgaaggtgctcgggaacacggacaagcgcttcatcaagaagaacctgatcggcgccctgctgttcgacgaggggaccaccgcggaggcccggcgcctgaagcggaccgcccgccggcgctacacgcggcgcaagaaccggctgcgctacctccaggagatcttcgccgaggagatgtccaaggtcgacagctccttcttccaccggctggacgacagcttcctgatcccggaggacaagaagggctccaagtaccccatcttcgccaccctcatcgaggagaaggagtaccacaagcagttccccaccatctaccacctccgcaagcagctggcggacagcaaggagaagaccgacctccggctgatctacctggccctcgcccacatgatcaagtaccgcggccacttcctgtacgaggacacgttcgacatcaagaacaacgacatccagaagatcttcaacgagttcatctccatctacaacaacaccttcgaggggaacagcctgtccggccagaacgtccaggtggaggccatcttcaccgacaagatcagcaagtccgcgaagcgggagcgcgtgctcaagctgttccccgacgagaagtccaccgggctgttcagcgagttcctcaagctgatcgtgggcaaccaggccgacttcaagaagcacttcgacctggaggagaaggccccgctccagttcagccgggacacgtacgacgaggacctggagaacctgctcgggcagatcggcgacgacttcgccgacctgttcgtggccgcgaagaagctgtacgacgccatcctcctgtccggcatcctgaccgtcaccgaccccagcaccaaggcgcccctctccgccagcatgatcgagcgctacgagaaccaccagaaggacctggccacgctgaagcagttcatcaagaccaacctccccgagaagtacgacgaggtgttcagcgaccagtccaaggacgggtacgcgggctacatcgacgggaagaccacccaggagagcttctacaagtacatcaagaacctgctgtccaagttcgagggcgccgactacttcctcgagaagatcgagcgggaggacttcctgcgcaagcagcggacgttcgacaacggcagcatcccgcaccagatccacctccaggagatgaacgccatcctgcgccgccagggggagcactaccccttcctgaaggagaacaaggagaagatcgagaagatcctgaccttccggatcccctactacgtgggccccctcgcccgcgggaaccgggacttcgcctggctgacccgcaactccgaccaggcgatccggccgtggaacttcgaggagatcgtcgacaaggccagctccgccgagagcttcatcaacaagatgaccaactacgacctgtacctccccgaggagaaggtgctgcccaagcactccctgctgtacgagacgttcgccgtgtacaacgagctcaccaaggtcaagttcatcgccgagggcctgcgcgactaccagttcctggacagccggcagaagaaggacatcttctacaccctcttcaaggcggaggacaagcgcaaggtgaccgagaaggacatcatccagtacctgcacacggtggacgggtacgacggcatcgagctgaagggcatcgagaagcagttcaacgcctccctcagcacctaccacgacctgctgaagatcatcaaggacaaggagttcatggacgaccccaacaacgaggagatcctcgagaacatcgtccacaccctgaccatcttcgaggaccgggagatgatcaagcagcgcctggcccagtacgactccctcttcgacgagaaggtgatcaaggccctgacgcggcgccactacaccgggtggggcaagctgagctccaagctcatcaacgggatccgggacaagcagaccggcaagaccatcctggactacctgatggacgacgggtacaacaaccgcaacttcatgcagctcatcaacgacgacgagctgagcttcaaggagatcatcaagaaggcccaggtggtcggcaagacggacgacgtgaagcaggtcgtgcaggagctgccgggctcccccgccatcaagaaggggatcctccagagcatcaagctggtggacgagctggtcaaggtgatgggccacgagcccgagtccatcgtgatcgagatggcccgggagaaccagaccaccgcccgcgggaagaagaacagccagcagcggtacaagcgcatcgaggacagcctcaagatcctggcctccggcctgaacgcgaagatcctcaaggagcaccccaccgacaacatccagctgcagaacgaccggctgttcctctactacctgcagaacgggcgcgacatgtacaccggcaagccgctggacatcaaccagctcagctcctacgacatcgaccacatcgtcccccaggccttcatcaaggacgacagcctggacaaccgcgtgctgacgtccctcaaggacaaccggggcaagagcgacaacgtgccctccctggaggtcgtggagaagatgaagaccttctggcagcagctgctcgacagcaagctgatctcctaccgcaagttcaacaacctgaccaaggccgagcgcgggggcctcgacgagcgggacaaggtggggttcatcaagcggcagctggtcgagacccgccagatcacgaagcacgtggcccagatcctggacgcccggtacaacaccgaggtgaacgagaaggacaagaagaaccgcaccgtcaagatcatcaccctcaagagcaacctggtgtccaacttccggaaggagttccgcctgtacaagatccgggagatcaacgactaccaccacgcgcacgacgcctacctcaacgccgtggtcgccaaggccatcctgaagaagtaccccaagctggagccggagttcgtgtacggcgactaccagaagtacgacctcaagcgctacatcagccggtccaaggaccccaaggagatcgagaaggcgacggagaagtacttcttctacagcaacctgctgaacttcttcaaggaggaggtgcactacgccgacggcaccatcgtcaagcgcgagaacatcgagtactccaaggacaccggggagatcgcctggaacaaggagaaggacttcgccaccatcaagaaggtgctcagcctgccccaggtgaacatcgtcaagaagcgggaggtgcagacgggcgggttctccaaggagagcatcctgcccaagggcaacagcgacaagctcatcccgcgcaagaccaaggacatcctgtgggacaccaccaagtacgggggcttcgactcccccgtgatcgcgtacagcatcctgctcatcgccgacatcgagaagggcaaggccaagcggctgaagacggtcaagaccctggtggggatcaccatcatggagaaggccaccttcgagaagtcccccatcgccttcctcgagaacaagggctaccacaacgtgcgcaaggagaacatcctgtgcctgccgaagtacagcctcttcgagctgaagaacgggcggcgccggatgctggcgtccgccaaggagctccagaagggcaacgagatcgtcctgcccgtgcacctgacgaccctcctgtaccacgccaagaacatccaccgcctggacgagcccgagcacctcgagtacatccagaagcaccgcaacgagttcaaggggctgctgaacctcgtgagcgagttctcccagaagtacgtcctggccgacgccaacctggagaagatcaagaacctctacgcggacaacgagcaggccgacatcgagatcctggccaacagcttcatcaacctgctcaccttcaccgccctgggcgcccccgcggccttcaagttcttcggcaaggacgtggaccggaagcgctacacgaccgtgtccgagatcctgaacgccaccctcatccaccagagcatcaccgggctgtacgagacgcggatcgacctgtccaagctcggcgaggactga

SEQ ID NO: 2006 - RNA, 4125 nt, synthetic construct
  misc_feature 1..4125: note = Cas9 variant
  source 1..4125: mol_type = other RNA
atggagaccaagttcacctactacctgggcctcgacatggggacggacagcctgggctgggccgtgaccgactccagctaccacatcctgcgcgccaaggggaaggacctctggggcgtccggctgttcccctccgcggagaccagcgtggagcgccggacctaccgcgtgaaccggcgccggcgccagcgggaggtcgcccgcatcggggccctgaaggagctgttcgccgacgagatcgagaaggtggacccgggcttcttcgtgcggctggacgagtccaagttccacatggaggaccgcagcgagaacaacaagcagaagtacggcctgttcgccgacaagctgttctccgacgcggggtactacaagaagtaccccacgatcttccacctccggaaggagctcctcgagagcgaggagccccacgacgtccgcctggtgtacctggccctcctgaacatgttcaagcaccggggccacttcctgaactccagcctccagatcgagggggagaactccaacatcgccgagagctaccagatgttcgtggacaccctgaccgacgaggacctggacttccccgagcaggtctccggcgagcgcctccaggagatcttccggagctccgacagccgcaagaagaaggtggagaacctgctggccgagatgaacctctccaagaagcagaagcgggagatccagttcgtgaacctgatctgcgggctgaagggcaagctcagcgagctgttcccggacaaggagtacgacgaggagcagaagaagatcgcgttctccttccaggacagcgactacgaggacaaggagaacaccatccaggagctgctcgacgagagcgagatgaacatgatctacgccgtcaaggccgtgcacgactccggcgtgctgagcgggatcatgaacggcgagcgctacctgtccgtcgcccgggtggccagctacgagaagcacaagaaggacctccagatcctgaaggacatcctgaagaagtacgacacgaaggagtacttcgagatgttccgcaacgagtccgccaagagcgagtcctacagcgcgtacgtggggtccgtcaagtaccacggcaccttccgccggggcctcagcgggggcaagcaggaggacctgtacaagcacatcaagaaggtgctggggaagttcccccaggacgacgagggcgtgacctacatcctcgaggagatcgagaccgagtccttcctgcccaagcagctgacggccagcaacggggtcatccccaaccaggtgcacgcccgcgagatgctcgccatcctgaagcacgcggagctgtacctcccgttcctgcaggagaaggacgacaccggcctgtccgtgagcgagaagatcctcaagctgttcatgttccagatcccctactacgtcggccccctggggcaggagtacaaggacaagaagggctacaacgtgtgggccgagcggaaggcctccgggaagatctacccctggaacttcgaggacaagatcgacgtcaagaagtccgccgagaagttcatcggccgcatggtgcggcgctgcacctacctgagcggggagcaggccctcccgaagcagagcctgctgtacgagaagttccaggtgctcaacgagctgaacaacctgcggatccgcggcgagaagatccccgtctccctcaagcaggagatctaccacgacctgttcggcgacgggaagaaggtgagcatgacccggctgacgaactacctcctgcagaacggcgtgatcagcggggaggagaaggactcctgcatcagcggcatcgacgggggcttccacaactccctgagctccgtcggcaagttcaagggggtgttcggcgacaccgtgcacaccgacgagcaccgcaagatgatcgaggacatcatcttctgggggaccgtcttcggcgacggcaagaagctcctgaaggagaaggtggaggaggtgtacgggaaccagctgacggaggcgcagaagaagcggatcttcggcttcaagttcagctcctgggggcgcctcagcaaggccttcctgaccatggagggcgcctccaaggacgacggggagatcaagggcctgatccaggccatgtgggacaccaactgcaacctcatggagctgctgagcgaccggttcacctacaaggacaagctcaacgagatggtcacgaccgccgagaagcccctgtgcgagtggaagatcgaggacctggacgagatgtacctctccgcgcccgtgaagcgcatggtgtggcagaccatccgggtcgtggacgaggtgcagcagatcatcggctgcccgcccaagcgcatcttcgtcgagatgacccggagcgacggggagaagggcaagcgcacggtgtcccggcagaagaagctggtggacctgtacaaggccctcgggaaggagggcaagacctggagcgaggagctgtccgacacccccgagagccagttccgcatcaagaagctgtacctctactacctgcagatggggaagtgcatgtacaccggcgaggccatcgagctggagcagctcatgaacgacaacctgtacgacatcgaccacatctacccccgccacttcatcaaggacgacaacatctccaacaacctggtcctcgtgaagaaggagaagaacgcccacaagagcgacagcttcccgatcgagcccgagatccggaacaagatgatgcccttctggaagtccctgcgcaagaagggcttcctgacggaggagaagtacaaccggctcacccgcatgagcgcgttcaccgacgaggagaaggccgccttcatcgggcggcagctggtggagacctcccagggcacgaaggccatcacccagatcttcgagcaggccttcgcgaacagcgagatcgtcttctccaaggccagcgtggtgtccgccttccgccagaagttcgactgctacaaggtccggtgcgtgaacaactaccaccacgcccacgacgcctacctgaacatcgtggcggggaacacctaccgcgtcaagttcaccagcaaccccctcaacttcatcaaggaggccaagaagaacccgaactcccgggagaaccgctacaacatggacaagatcttcgagtgggacgtgacccggaacggcgagacggcctgggtggcccagaccaaggagcaccccgggaccatccagctggtcaagaagtacctgaacaagaacagccccctcatcaccaagatggtgtacgagaagcacggcggcatcacgcagaaggccaccatctggtccgcgaagaaggccgagagcgggaacaccgacgcctacatccccgtgaagatgaacgacccgcgcctggccgacgtcaccaagtacggcggggtgacgaccatcgcggtggccggctacaccctgctcgagtacaaggccgggggcaagaccgtccggtccctggaggccctgcccatctacctcggcgggagcaagaagctgacggaggagcagatggtggagtacttctccaacgtgctgcagcaggagaacaaggagaaggtcgtgagcgacgtgatcatccgcaagaagatgatcccctccggcagcctcatcaagtacaacgggttctactactacctggccggcaagaccggcgaccggatcatcctgatctccgcggtccagctctgcctgccgatggacaccatgctgtacatcaagaagatcgagaaggcctgcagcaccgggaacttcgaggagaaggacaagaacggcaagcaggtcctcagcaagcagcagaacgagttcgtgtacgagctgatcatccagaagtaccagcagtccatcttcaagaagaaggtgggggccatcggcgacacgatcatcgagaagcgcgagaagttcgccgagatcagcctggaggagcagtgcaaggtgctcatgcagatcttcctgaacttccagtccgggatcggcgtggagctgaagatcatcgagggcgggaagaagtccggcgtcacctacctcaacaagaaggtgatgaacgtccaggagctgaagctgatcgaccagagcgtgaccggggtgttcagccgggagatcgacctcctgaccatctga

SEQ ID NO: 2007 - RNA, 4125 nt, synthetic construct
  misc_feature 1..4125: note = Cas9 variant
  source 1..4125: mol_type = other RNA
atgaagaagcgctacagctactccatcggcctggacatcgggaccaacagcgtgggctgggccgtcatcaacgaggactacaaggtgcccgccaagaagatgaccgtgttcgggaacacggaccggaagaccatcaagaagaacctcctgggcaccgtcctgttcgactccggggagaccgcgcaggcccgccggctcaagcgcacgaaccggcgccggtacacccgccggcgctaccggctgtgccagctgcagaacatcttcgccaccgagatggtgaaggtggacgacaccttcttccagcgcctcagcgagtccttcttctactaccaggacaaggccttcgacaagcacccgatcttcggcaacagcaaggaggagcgggcctaccacaagacgtaccccaccatctaccacctccgcaaggacctggcggaccgggaccagaaggccgacctccgcctgatctacctggccctctcccacatcatcaagttccggggccacttcctgatcgaggggaagctgaacagcgagaacaccgacgtccagaagctgttcatcgccctggtgaccgtgtacaacctcctcttcgaggaggagcccatcgcgggcgagacgtgcgacgccaaggccctgctgaccgccaagacctccaagagcaagcgcctcgagtccctgatcagcgagttccccgggcagaagaagaacggcctgttcgggaacctcctggccctggcgctcggcctgcggccgaacttcaagtccaacttcggcctgagcgaggacgccaagctccagatcaccaaggacacgtacgaggaggagctggacaacctgctcgccgagatcggggaccactacgccgacctgttcctggccgcgaagaacctctccgacgccatcctgctgagcgacatcctcaccctgtccgacgagaacacccgcgcgcccctgagcgcctccatgatcaagcggtacgaggagcaccaggaggacctcgccctgctgaagaagctcgtcaaggagcagatgcccgagaagtactgggagatcttcagcaacgccaagaagaacggctacgccgggtacatcgagggcaaggtgagccaggaggacttctaccgctacatcaagcccatcctgtcccgcctgaagggcggggacgagttcctcgccaagatcgaccgggacgacttcctgcgcaagcagcggaccttcgacaacggcagcatcccgcaccagatccacctgaaggagctgcacgccatcctccgccggcaggagaagtactaccccttcctggccgagcagaaggagaagatcgagcagctgctctgcttccgcatcccctactacgtggggcccctggcgaagggcgggaactccagcttcgcctggctgaagcggcgctccgacgagccgatcacgccctggaacttcaaggacgtcgtggacgaggaggccagcgcccaggcgttcatcgagggcatgaccaactacgacacctacctccccgaggagaaggtgctgcccaagcactccccgctgtacgagatgttcaccgtctacaacgagctcacgaaggtgaagtacatcgccgagaacatgaccaagcccctgtacctgagcgccgagcagaaggaggccatcatcgaccacctcttcaagcagacccggaaggtgaccgtcaaggacctgaaggagaagtacttctcccagatcgagggcctggagaacgtggacgtgacgggggtcgagggcgccttcaacgcgagcctcgggacctacaacgacctgctgaagatcatcaaggacaaggccttcctcgacgacgaggccaacgccgagatcctggaggagatcgtgctgatcctcaccctgttccaggacgagaagctgatcgagaagcgcctcgccaagtacgcgaacctgttcgagaagtccgtgctgaagaagctccggaagcgccactaccggggctgggggcgcctgagccggcagctgatcgacggcatgaaggacaaggcctccggcaagaccatcctcgacttcctgaaggccgacgacttcgccaaccgcaacttcatccagctgatcaacgacagctccctcgacttcgagaagctgatcgacgacgcccagaagaaggcgatcaagcgggagagcctgacggaggccgtcgccaacctcgccgggtcccccgcgatcaagaagggcatcctgcagagcctgaaggtggtcgacgagatcgtgaaggtgatggggcacaaccccgacaacatcgtcatcgagatgtcccgcgagaaccagaccaccgcccagggcctcaagaacgcccggcagcgcctgaagaagatcaaggaggtgcacaagaagaccgggagccgcatcctggaggacaacagcgagcggatcacgaacctcaccctgcaggacaaccgcctgtacctctacctgctgcaggacggcaaggacatgtacaccggccaggacctcgacatcaacaacctgtcccagtacgacatcgaccacatcatcccgcagagcttcatcaaggacaactccatcgacaacctggtgctcaccacccagaaggccaaccggggcaagagcgacaacgtcccctccatcgaggtggtgcgcgacatgaaggaccgggtctggcgccggcagctggccaacggggcgatcagccgccagaagttcgaccacctgacgaaggccgagcgcgggggcctcgccgactccgacaaggcccggttcctgcggcgccagctggtggagacccggcagatcaccaagcacgtggcccagctcctggacagccgcttcaactccaagagcaaccagaacaagaagctggcgcggaacgtcaagatcatcaccctcaagtccaagatcgtgagcgacttccgcaaggacttcggcctgtacaagctgcgggaggtgaacaactaccaccacgcccacgacgcctacctcaacgccgtcgtggggacggccctgctgaagaagtaccccaagctcgaggcggagttcgtgtacggcgactacaagcacttcgacctggtcaagctgatctccaagagcgacccctccctcgggaaggccaccgccaaggtgttcttctacagcaacatcatgaacttcttcaaggaggagctgtccctggccgacggcaccctcatgaagcgcccggtgatcgagaccaacacggagaccggggaggtcgtgtgggacaaggtgaaggacttcaagaccatccggaaggtcctgagctacccccaggtgaacatcgtgaagaagaccgagatccagagcggcgcgttctccaaggagagcgtcctgtccaagggcaacagcgacaagctcatcgagcgcaagaaggggtgggaccccaagaagtacggcgggttcgactcccccaacacggcctacagcatcttcgtggtggccaaggtcgccaagcggaaggcccagaagctgaagaccgtgaaggagatcgtgggcatcaccatcatggagcaggcggagtacgagaaggacaacatcgccttcctggagaagaaggggtaccaggacatccaggagaagctcctgatcaagctgccgaagtactccctcttcgagctggagaacggccgccgccggctgctcgccagcgccaacgagttccagaagggcaacgagctggccctgtccgggaagtacatgaagttcctctacctggcgagccgctacgacaagctgtccagcaagatcgagtccgagcagcagaagaagctgttcgtcgagcagcacctccactacttcgacgagatcctggacatcgtggtgaagcacgcgacctgctacatcaaggccgagaacaacctgaagaagatcatcagcctgtacaagaagaaggaggcctactccatcaacgagcaggccctgaacatgctgaacctcttcatcttcacgagcctgggcgccccctccaccttcgtcttcttcgacgagaccatcgaccggaagcgctacaccacgagctccgacgtgctgaacgggatcctcatccagcagagcatcaccggcctgtacgagacccggatcgacctgagccgcttcgggggcgactga

SEQ ID NO: 2008 - RNA, 4125 nt, synthetic construct
  misc_feature 1..4125: note = Cas9 variant
  source 1..4125: mol_type = other RNA
atgaagaagcagaagttcagcgactactacctgggcttcgacatcgggaccaactccgtgggctggtgcgtcaccgacctcgactacaacgtgctgcgcttcaacaagaaggacatgtgggggagccggctgttcgacgaggccaagacggccgcggagcgccgggtgcagcgcaactcccggcgccggctcaagcgccggaagtggcgcctgaacctgctcgaggagatcttcagcgacgagatcatgaagatcgactccaacttcttccggcgcctgaaggagagctccctgtggctcgaggacaagaacagcaaggagaagttcaccctgttcaacgacgacaactacaaggactacgacttctacaagcagtaccccaccatcttccacctccgggacgagctcatcaagaacccggagaagaaggacatccgcctgatctacctggccctccactccatcttcaagagccggggccacttcctgttcgaggggcagaacctgaaggagatcaagaacttcgagaccctctacaacaacctgatctccttcctggaggacaacggcatcaacaagagcatcgacaaggacaacatcgagaagctcgagaagatcatctgcgactccggcaaggggctgaaggacaaggagaaggagttcaagggcatcttcaacagcgacaagcagctggtcgccatcttcaagctctccgtggggagctccgtgagcctgaacgacctgttcgacacggacgagtacaagaaggaggaggtcgagaaggagaagatctccttccgcgagcagatctacgaggacgacaagcccatctactacagcatcctcggcgagaagatcgagctgctggacatcgccaagagcttctacgacttcatggtgctcaacaacatcctgtccgacagcaactacatctccgaggccaaggtgaagctgtacgaggagcacaagaaggacctcaagaacctgaagtacatcatccggaagtacaacaaggagaactacgacaagctgttcaaggacaagaacgagaacaactaccccgcgtacatcgggctcaacaaggagaaggacaagaaggaggtcgtggagaagtcccgcctgaagatcgacgacctgatcaaggtgatcaagggctacctccccaagccggagcggatcgaggagaaggacaagaccatcttcaacgagatcctgaacaagatcgagctgaagaccatcctccccaagcagcgcatcagcgacaacggcaccctgccctaccagatccacgaggtcgagctggagaagatcctcgagaaccagagcaagtactacgacttcctgaactacgaggagaacggggtgtccacgaaggacaagctgctcaagaccttcaagttccggatcccctactacgtgggcccgctgaacagctaccacaaggacaagggcgggaactcctggatcgtccgcaaggaggagggcaagatcctgccctggaacttcgagcagaaggtggacatcgagaagtccgccgaggagttcatcaagcgcatgaccaacaagtgcacctacctgaacggggaggacgtgatccccaaggacagcttcctctacagcgagtacatcatcctgaacgagctgaacaaggtccaggtgaacgacgagttcctcaacgaggagaacaagcggaagatcatcgacgagctgttcaaggagaacaagaaggtgtccgagaagaagttcaaggagtacctgctcgtcaaccagatcgccaaccgcacggtggagctgaagggcatcaaggacagcttcaactccaactacgtgagctacatcaagttcaaggacatcttcggggagaagctgaacctcgacatctacaaggagatctccgagaagtccatcctgtggaagtgcctgtacggcgacgacaagaagatcttcgagaagaagatcaagaacgagtacggggacatcctcaacaaggacgagatcaagaagatcaacagcttcaagttcaacacctggggccggctgagcgagaagctgctcaccggcatcgagttcatcaacctggagaccggggagtgctacagctccgtcatggaggccctgcgccggacgaactacaacctcatggagctgctgagctccaagttcaccctccaggagagcatcgacaacgagaacaaggagatgaacgaggtgtcctaccgcgacctgatcgaggagagctacgtctcccccagcctgaagcgggcgatcctccagaccctgaagatctacgaggagatcaagaagatcaccggccgcgtgccgaagaaggtgttcatcgagatggcccgcgggggcgacgagtccatgaagaacaagaagatccccgcccggcaggagcagctgaagaagctctacgacagctgcgggaacgacatcgccaacttctccatcgacatcaaggagatgaagaacagcctgtccagctacgacaacaactccctgcggcagaagaagctctacctgtactacctgcagttcggcaagtgcatgtacacgggccgcgagatcgacctcgaccggctgctgcagaacaacgacacctacgacatcgaccacatctacccccgcagcaaggtcatcaaggacgactccttcgacaacctcgtgctggtgctgaagaacgagaacgccgagaagtccaacgagtaccccgtcaagaaggagatccaggagaagatgaagtccttctggcggttcctcaaggagaagaacttcatcagcgacgagaagtacaagcgcctgaccgggaaggacgacttcgagctgcggggcttcatggcgcgccagctcgtgaacgtgcggcagaccacgaaggaggtcgggaagatcctgcagcagatcgagccggagatcaagatcgtgtacagcaaggccgagatcgccagcagcttccgcgagatgttcgacttcatcaaggtgcgcgagctgaacgacacccaccacgccaaggacgcctacctcaacatcgtcgcgggcaacgtgtacaacaccaagttcaccgagaagccctaccggtacctgcaggagatcaaggagaactacgacgtgaagaagatctacaactacgacatcaagaacgcctgggacaaggagaactccctggagatcgtcaagaagaacatggagaagaacacggtgaacatcacccgcttcatcaaggaggagaagggggagctgttcaacctgaaccccatcaagaagggcgagaccagcaacgagatcatctccatcaagcccaagctgtacgacggcaaggacaacaagctcaacgagaagtacgggtactacaccagcctgaaggccgcctacttcatctacgtggagcacgagaagaagaacaagaaggtcaagacgttcgagcggatcacccgcatcgactccaccctgatcaagaacgagaagaacctcatcaagtacctggtgagccagaagaagctgctcaacccgaagatcatcaagaagatctacaaggagcagaccctgatcatcgactcctacccctacacgttcaccggcgtggacagcaacaagaaggtcgagctgaagaacaagaagcagctctacctggagaagaagtacgagcagatcctgaagaacgccctcaagttcgtggaggacaaccagggggagaccgaggagaactacaagttcatctacctgaagaagcggaacaacaacgagaagaacgagaccatcgacgcggtgaaggagcgctacaacatcgagttcaacgagatgtacgacaagttcctggagaagctctccagcaaggactacaagaactacatcaacaacaagctgtacaccaacttcctgaactccaaggagaagttcaagaagctcaagctgtgggagaagtccctgatcctccgggagttcctgaagatcttcaacaagaacacgtacggcaagtacgagatcaaggacagccagaccaaggagaagctgttcagcttccccgaggacaccggccgcatccggctcgggcagtccagcctgggcaacaacaaggagctgctcgaggagagcgtcaccgggctgttcgtgaagaagatcaagctgtga

SEQ ID NO: 2009 - RNA, 4128 nt, synthetic construct
  misc_feature 1..4128: note = Cas9 variant
  source 1..4128: mol_type = other RNA
atgagcaacaagccctactccatcggcctggacatcgggaccaacagcgtgggctgggccgtcatcaccgacgactacaaggtgccgtccaagaagatgaaggtgctcgggaacacggacaagcacttcatcaagaagaacctgatcggcgccctgctgttcgacgaggggaccaccgcggaggaccgccggctgaagcgcaccgcccggcgccggtacacgcgccggaagaaccgcctgcggtacctccaggagatcttcttcgaggagatgagcaagctggactccggcttcttccaccgcctggacgacttcttcctcatccccgaggacaagcggggcagcaagtaccccatcttcgccaccctggccgaggagaaggagtaccacaagcagttccccaccatctaccacctccgcaagcagctcgccgactccaaggagaaggcggacctgcggctgatctacctcaccctggcccacatgatcaagtaccgcgggcacttcctgtacgaggagagcttcgacatcaagaacaacgacatccagaagatcttcaacgagttcatctccatctacgacaacacgttcgagggcagctccctcagcgggcagaacgcccagatcgaggccatcttcaccgacaagatctccaagagcgcgaagcgggagcgcgtcctgaagctgttcccggacgagaagtccaccggcctcttcagcgagttcctgaagctgatcgtggggaaccaggccgacttcaagaagcacttcgagctcgaggagaaggcgcccctgcagttccccaaggacacctacgacgaggacctggagaacgtgctcggccagatcggcgacgacttcgccgacctgttcgtcgccgccaagaagctgtacgacgccatcctcctgtccgggatcctgacggtgaccgaccccagcaccaaggccccgctctccgccagcatgatcgagcggtacgagaaccaccagaaggacctggccgcgctgaagcagttcatcaagaccaacctccccgagaagtacgtggaggtcttcagcgaccagtccaaggacggctacgccgggtacatcgacggcaagacgacccaggaggccttctacaagtacatcaagaacctgctgagcaagttcgagggcaccgactacttcctcgacaagatcgagcgcgaggacttcctgcggaagcagcgcaccttcgacaacgggtccatcccccaccagatccacctccaggagatgaacgccatcctccggcgccagggcgagcactaccccttcctgaaggagaacaaggagaagatcgagaagatcctgacgttccgcatcccgtactacgtggggcccctcgcccggggcaaccgcgacttcgcgtggctgacccggaacagcgaccaggccatccgcccctggaacttcgagaagatcgtggacaaggcctccagcgccgaggacttcatcaacaagatgaccaactacgacctgtacctccccgaggagaaggtcctgccgaagcactccctgctgtacgagaccttcgccgtgtacaacgagctcacgaaggtgaagttcatcgcggaggggctgcgggactaccagttcctggacagcggccagaagaagcagatcgtcaaccagctgttcaaggagaagcgcaaggtgaccaagaaggacatcatccactacctgcacaccgtggacggctacgacgggatcgagctgaagggcatcgagaagcagttcaacgcctccctcagcacctaccacgacctgctgaagatcatcaaggacaagaagttcatggacgactccaagaacgaggccatcctcgagaacatcgtccacacgctgaccatcttcgaggaccgggagatgatcaagcagcgcctggcccagtacgacagcctcttcgacgagaaggtgatcaaggcgctgacccggcgccactacaccgggtggggcaagctgtccgccaagctcatcaacgggatctgcgacaagcagacgggcaacaccatcctggactacctgatcgacgacggcgagatcaaccggaacttcatgcagctcatcaacgacgacgggctgagcttcaagaagatcatccagaagtcccaggtggtcggcgagaccgacgacgtgaagcaggtcgtgcgcgagctgcccgggagccccgccatcaagaagggcatcctccagtccatcaagatcgtggacgagctggtcaaggtgatggaccacgcccccgagagcatcgtgatcgagatggcccgggagaaccagaccacggcgcgcgggaagaagaactcccagcagcggtacaagcgcatcgaggacagcctgaagaacctcgccagcggcctggactccaacatcctgaaggagaacccgaccgacaacatccagctcaagaacgaccggctgttcctgtactacctccagaacggcaaggacatgtacaccggggaggccctggacatcaaccagctgagctcctacgacatcgaccacatcatcccccaggccttcatcaaggacgacagcctcgacaaccgcgtcctgacctccagcaaggacaaccggggcaagtccgacaacgtgcccagcctggaggtggtccagaagcgcaaggccttctggcagcagctcctggactccaagctgatcagcgagcgcaagttcaacaacctcaccaaggcggagcgcgggggcctgaacgagcgggacaaggtgggcttcatcaagcggcagctggtggagacgcgccagatcaccaagcacgtcgcccagatcctcgacgcccggtacaacaccgaggtgaacgagaaggacaagaagaaccgcaccgtgaagatcatcacgctgaagtccaacctggtcagcaacttccggaaggagttccgcctctacaaggtgcgggagatcaacgactaccaccacgcccacgacgcctacctgaacgcggtggtcgccaaggccatcctgaagaagtaccccaagctcgagccggagttcgtgtacggggagtaccagaagtacgacctgaagcgctacatctcccggagccgcaaccccaaggaggtggagaaggccaccgagaagtacttcttctactccaacctgctcaacttcttcaaggaggaggtccactacgcggacggcaccatcgtgaagcgggagaacatcgagtacagcaaggacaccggggagatcgcctggaacacggagaaggacttcgccaccatcaagaagatcctgtcctacccccaggtgaacatcgtcaagaagaccgaggagcagaccgtgggccagaacgggggcctgttcgacaacaacatcgtgagcaaggagaaggtcgtggacgccagcaagctcatccccatcaagtccggcctgagcccgaagaagtacgggggctacgcccgccccacgatcgcgtactccgtgctggtcacctacaagcagaacaacaagatcaagaacaccatggtggggatccccgtgctcaccaagctggagttcgagcgggacccgaacctgtacctccgcaacctgggcatcaacaacgtcagccacgtgatcaagctggtgaagtacacggtcctcgagttcaagcacaagtacgggacctaccggcgcttcatcgtgtccaaccaggagctgaagcgggccaaccagatcttcgtgaccaccaagcagatgaagctgatcagccagtacacgaccctcgacaagaacgagcacgactccctgctgaagaacaaccagcagctcatccagagcatctggaaccagttcctggagttcatgctggccaccgacctcgtcaacaagaagcagtacgacgagctgatcctgaccaacaaccagacgatcgaggagtgccgcaacatcatgaaccgggtgatcaccaccctctccttcaccaacatcaacgccggccagaagaagatcatcttcgacgacacgctgagcctgcccatcaagcgctggcagttcaccgactccgacaagatggtgaagaagatcatcgagagcaccctcatccaccagtccatcaccggcctgtacgagacgcgcatcgacctgagcaagctcggggaggactga

SEQ ID NO: 2010 - RNA, 4128 nt, synthetic construct
  misc_feature 1..4128: note = Cas9 variant
  source 1..4128: mol_type = other RNA
atgaaggagtaccacatcggcctggacatcgggaccagctccatcggctgggccgtgaccgacagccagttcaagctcatgcgcatcaaggggaagacggccatcggcgtccggctgttcgaggaggggaagaccgcggccgagcgccggaccttccgcaccacgcggcgccggctgaagcgccggaagtggcgcctccactacctggacgagatcttcgccccccacctgcaggaggtggacgagaacttcctccggcgcctgaagcagtccaacatccacccggaggaccccgccaagaaccaggccttcatcggcaagctgctcttccccgacctgctgaagaagaacgagcggggctaccccaccctcatcaagatgcgcgacgagctgccggtggagcagcgggcgcactaccccgtcaccaacatctacaagctgcgcgaggccatgatcaacgaggaccggcagttcgacctccgcgaggtgtacctggccgtgcaccacatcgtcaagtaccgggggcacttcctgaacaacgccagcgtggacaagttcaaggtgggccgcatcgacttcgacaagtccttcaacgtcctcaacgaggcgtacgaggagctgcagaacggggagggcagcttcaccatcgagccctccaaggtggagaagatcgggcagctgctcctggacacgaagatgcggaagctggaccgccagaaggccgtggccaagctcctggaggtcaaggtggccgacaaggaggagaccaagcgcaacaagcagatcgccaccgcgatgagcaagctggtgctcggctacaaggccgacttcgccaccgtcgccatggtgaacggcaacgagtggaagatcgacctgtccagcgagacgtccgaggacgagatcgagaagttccgggaggagctgagcgacgcccagaacgacatcctcaccgagatcacctccctgttcagccagatcatgctgaacgagatcgtgcccaacgggatgtccatcagcgagtccatgatggaccgctactggacccacgagcggcagctcgcggaggtcaaggagtacctggccacgcagccggccagcgcccgcaaggagttcgaccaggtgtacaacaagtacatcggccaggcccccaaggagaaggggttcgacctggagaagggcctcaagaagatcctgtccaagaaggagaactggaaggagatcgacgagctgctcaaggcgggcgacttcctgcccaagcagcggatcagcgccaacggggtgatcccccaccagatgcaccagcaggagctggaccgcatcatcgagaagcaggccaagtactacccgtggctcgccaccgagaaccccgccaccggcgagcgggaccgccaccaggcgaagtacgagctggaccagctggtcagcttccggatcccctactacgtggggcccctcgtgaccccggaggtccagaaggccacgtccggcgccaagttcgcctgggcgaagcgcaaggaggacggggagatcaccccctggaacctgtgggacaagatcgaccgggccgagagcgccgaggccttcatcaagcgcatgaccgtgaaggacacctacctgctcaacgaggacgtcctgcccgccaactccctgctgtaccagaagtacaacgtgctcaacgagctgaacaacgtgcgggtcaacggccgccggctgagcgtgggcatcaagcaggacatctacacggagctcttcaagaagaagaagaccgtgaaggcgtccgacgtcgccagcctggtgatggccaagacccgcggggtgaacaagccctccgtcgagggcctgagcgacccgaagaagttcaactccaacctcgccacctacctggacctgaagagcatcgtgggggacaaggtggacgacaaccggtaccagatggacctcgagaacatcatcgagtggcgctccgtcttcgaggacggcgagatcttcgccgacaagctgacggaggtggagtggctgaccgacgagcagcggagcgcgctcgtgaagaagcgctacaaggggtggggccgcctgtccaagaagctgctcaccggcatcgtcgacgagaacgggcagcggatcatcgacctgatgtggaacaccgaccagaacttcatgcagatcgtgaaccagcccgtgttcaaggagcagatcgaccagctgaaccagaaggccatcacgaacgacggcatgaccctccgcgagcgggtcgagagcgtgctggacgacgcctacacctccccccagaacaagaaggccatctggcaggtggtccgcgtggtggaggacatcgtcaaggccgtggggaacgcgcccaagagcatctccatcgagttcgcccggaacgagggcaacaagggggagatcacccgcagccggcgcacgcagctgcagaagctcttcgaggaccaggcccacgagctggtgaaggacacctccctgaccgaggagctcgagaaggtcccggacctgagcgaccggtactacttctacttcacccagggcggcaaggacatgtacaccggggaccccatcaacttcgacgagatcagcacgaagtacgacatcgaccacatcctgccccagtccttcgtgaaggacgacagcctcgacaaccgcgtgctgacctcccggaaggagaacaacaagaagagcgaccaggtccccgccaagctgtacgcggccaagatgaagccgtactggaaccagctcctgaagcagggcctgatcacccagcgcaagttcgagaacctcaccatggacgtggaccagacgatcaagtaccggtccctggggttcgtgaagcgccagctggtcgagacccggcaggtgatcaagctcaccgccaacatcctgggcagcatgtaccaggaggccggcaccgacatcatcgagacgcgcgccgggctgaccaagcagctccgggaggagttcgacctgcccaaggtgcgcgaggtcaacgactaccaccacgcggtggacgcctacctgaccaccttcgccggccagtacctcaaccggcgctaccccaagctgcggtccttcttcgtgtacggggagtacatgaagttcaagcacggcagcgacctgaagctccgcaacttcaacttcttccacgagctgatggagggggacaagtcccagggcaaggtcgtggaccagcagacgggcgagctgatcaccacccgcgacgaggtggccgactacttcgactgggtccaggacctcaagctgatgctggtgaccaaggagctcaagcggagcaacgggaagctgttcgacgccacgatccagaacgcgaactacaccaagctgaacgagcgcaagaaggtgttcgtcccgctcaagaaggagctggacaagaccctgtacggctcctacagcgggatccagtccagctacatgaccatcgtgaagaagttcgacaagaagggctccacgtacgccgtgcagcggatccccgtcatgtacagcaagctcctggagctggagaaggagcagtccaagctcaaccgcctggtgcagagcatcgtgaccagcgacccccaggcccccaacaacttcgaggtcctgatgccgtgcgtgctctccgggcagctggtcatcgacaacggccggaagttcaccctgaccagctaccgctaccagtgctccacggcccagctcttcctgcccaagaaggacctgaagtacatccagaacaacttcaaggagctcaagaagacccccgacaagcaggacaagatcttcgagaccatctacgacgacatcctgaagcaggtggacaagtacttcagcctgtacgacatcaacaagttccggtccaagctccacgacggcaaggacaagttcctggccctggagaacttcggggagaaggagagcaaggacaaggtgatcaccaagatcctccgcggcctgcacgcgaacgccgagcggacgtccctgaaggagatcgggctcagcacccccctgggccagttccagtccggggagggcggcatcaccctgagcgacaacaccaagatcatctaccagtccccgacggggctcttcgagcgccacgtctacctgaaggacctgtga

SEQ ID NO: 2011 - RNA, 4128 nt, synthetic construct
  misc_feature 1..4128: note = Cas9 variant
  source 1..4128: mol_type = other RNA
atgcgcaagaaccaggagccctacaacatcggcctggacatcgggaccagctccatcggctggagcatcatgaacgacaacttcgacctcatgcgggtgaaggggaagaagggcatcggggtccgcctgtacaacgagggccagtccgccgccgagcggcgcatgcaccggaccgcgcgccggcgctacggccggcgcaagtggcggctgcgcctcctggaggacttcttcgacgagcacatggccgaggtggacgacacgttcttcgcccggctgaaggacagcaacatctccccgaaggacgacaagaagtaccgcaagagcctcctgttccccaagtccaagggggtgacctaccaggacgacggcgagttctacaagaagtaccccaccatgtaccacctccggtacgccctcatgaccgagcaccgcaagttcgacctgcgggagatctacctggccttccaccacatggtcaagtaccgcgggaacttcctctacgacacgagcgtggactccttcgaggcgaagaacctggacatcaagggcaagttcgacgagatcaacgacctgctcagctcctacaccgacttctacgtggacaacagcaacgccgccctggtcgagtccatcctgctcgagaagaacaccacccggaaggacaagagcaagaagatcgccaagctgctgcacgtggaggacaaggagaaggggaagaacaagaaggcgaaggacctcgccacgcagatctccaacgccgtgctgggcctgaagtgcaacttccacctcatcttcgagctgcagcagaagtacagcttcgacctgtgctccgagaagaccgaggagaacatcgccaagctcagcgaggtcctggacgagaaccagaagatgctgctcatgatcctgaaggaggtgcaggaccaggtgatgctgaacgccttcgtcccctccggcatgagcctcagcgaggcgatgatgcagaagtacgacgactacggggagcagctgaagatctaccacgagctggagcactccgtgagcgacgactccgccgccaagctccgcggcgcctaccgggactacaacgacaacatcatcaagcgcatcgacggggacaacaagaaggacaccttctacaagcgcgtgaagaacatcctgaccaagatcagcaaggagtacgtcgaccaggacgtgctggagtcctgcggcaagctcaagaagctgatcgacgagaacaagctgttcatccggcagcgcacggccgcgaacggcgtgctcccgcaccagctgcaccagatcgagatgcggaagatcatcgacaaccagaaggagtactacccctggctggccgagcccaaccccaacgagaagcgccgggtctacagcaagtacaaggtggaggagctcatcgccttccgcatcccgtactacgtggggcccctggtcgaccccaacaacgccgacaagaacaaggaggcccggttctcctggatggtgcgcaagaaggacggcgagatcaccccctggaacttctacgacaaggtggactgggcggagagcgccaacaacttcatcgagcggatgaagtccaaggacacctacctgctcggggaggacgtcgtgccgaaggagagcatgctgtaccagaagtacgaggtcctgaacgagctgaacaacctccgcatcaacgactccggcctgagcgactccttcgaggacgtgaagctgaagcaggccatctacaacgacctcttcaagaagcagaagatcgtgaagatcaccgacctgcagaactacctggtccagaaccacaagtacctcgtgaagcccaagatcagcgggctggccgacgagaaccggttcctgtccagcctctccacgtacagcgacctgaagaccatcttcggcgacaaggtggacgaccgcacctacttcaacgacttcgagaagatggtcgagtactccaccgtgttcgaggacggccacgactacaaccagaagctggacgagtacacgtggctcaccaaggaggagaagtacaagatcgggaagaagcggtaccgcggctgggggaagctgagcaagaagctgctcaccggcctgcgggacaagaacaaccacaccatcatggacaacctgtgggagacgaaccgcaacttcatgcagatccagaccgccgacgagttcagcaagcagatcgcggaggagaacgagcggcacctcaaggggtccgtgagcgacgccatcaacgacatgtacacctcccccgccaacaagaaggccatccgccaggtcctgcgggtggtggacgacatccagaaggcgatgggctacgcccccagctccatcagcctggagttcgcccgcgaggacggcccgtccgtccgcaccgtgagccgggccaaccgcatgaagtccatctacgagaagtacgccagcgaggtgtccgaggaggtcatgaaggacctcgacggggtgatcaaggacaagaagggcctgaacgaccggctgtacctctacttcgagcagcaggggaaggacatgtacagcggccaccccctggacttcgacaaggtgatctccgggcaggagtacgacatcgaccacatcctgccccaggcggtcatcaaggacgacagcctcgacaaccgcgtgctgacgaccaaggccctgaacaacgacgtgaagtccaagggcgtcccctgccggatgttcaacggcatgcacagcttctggaagaacctctacgacaaggggttcatctcccgccggaagttcaacaacctgaccaccaacccggagaacatcgacaagtacaagatgaagggcttcgtgaaccgccagctggtggagacgcggcagatcatcaagctcgtcgccaacgtgctgaacgacaagtaccagaacgacgacgtggacatcatcgaggtccgcgccgagctgacccacgacgtgcggaagcacttcaagttctacaagaaccgcaacgtgaacgactaccaccacgccttcgacgcgtacctcaccagcttcatcgggcactacctgttcaagaagtaccccaacctgcggcccctcttcgactacaacgacttcatgaaggtcagcgacaacgtgttcaagcagctgcgcggcaacaacttcctgggcgagttcctcaacaagaccggggacatcatctccacggacggcaacttcgtgctgaacaaggaggagatgatcaacaagctgaacaaggcctacgccttcaagaagatcctcgtcaccaaggaggtggggcagcggaccggcgccatgttcaacgagacccgctaccccgccccgaacagccggaaggcggccctgaagtaccgccggatgcccaagcccgactccctgatcagcgtgaaggactacaagaacaccgacatctacgggggctactccggcaagaacgacgcctacatggtcatcgtggacatggggaagcagtacatggtggtcggcgtgcccgtgcgctacacggagaagctcgacaagctgcggatcaagcacagcgagctgtaccgcgacgagctccgcaaggtcctgtcccgggacaagaccctgctcgacagcaaggggaacgtgaagcgcttcgacatcgtgctggaccgggtcctgtacggccagctcatcgaggacgggaacgagctgttcaccctgggctccagcaagtacaagcgcaacttccggcagctgttcctggacaagcagtgcatcgagatcctggactccagcgccaccccgcagcccacggacgaggagctcatctgggtgtacgaccagatcctggacaaggtggacaagtacttcgagctgtacgacatcaaccgccagcgggagaccctccgcaagggccgggcggccttctgctccctgcccaacatcagcatgaagaaggacgacgtcaccaagaagaagatcctgaacgagatcctcgtggccctgcacgccaacgagtccgagagcaactgcgagaagatcgggaagaaggtgttcggccgcctgcaggtccccgggggcatcaagctctccaaggaggccaagctgatctaccagagcccgaccgggctgttcgagcgggtggtctacctcaaggacctgtga

SEQ ID NO: 2012 - RNA, 4128 nt, synthetic construct
  misc_feature 1..4128: note = Cas9 variant
  source 1..4128: mol_type = other RNA
atggagaacaagaagtacagcatcggcctggacatcgggacctccagcatcggcttcgccgtggtcgacgagaacaaccgcgtgatgcgggtgaaggggaagaacgccatcggcgtccgcctcttctccgaggggcagcccgcggccgaccggcgcagcttccggaccacgcgccggcgcctgtcccggcgccggtggcgcctgcggctcctgcgcgagatcttcgagccgtacatcaaccccgtggacgaggccttcttcatgcggctgaaggagagcaacctctcccccaaggacgccaacaagcactacagcggcgacatcctgttcaacaaccagaccgaccaggacttctacgagaagtaccccaccatctaccacctccgccacgccctgatgaccgagcaccggaagttcgacgtgcgcgagatctacctggcgatccaccacatcgtcaagttccggggccacttcctgaacgccgcctccgccagcaacttcacggtggggaagctcaacctggagggcaagttcgacgcgctgaacgagatctaccagcgcgtgctcaccgacgacccgttcgccctgcggaccgacaacctggaccacatcaaggagatcctcatcgacaacaagcgctcccaggccgaccgccagcggaccctgacgggggacgtctaccagagctccgaggagaaggagatcgagaagcgcaacaaggccatcgccaccgagatcctgaaggcggccgtgggcaacaaggccaagctcaacgtgatcaccaacgtcgaggtggacaaggaggccgccaaggactggagcctgaccttcgactccgagacgatcgacgacgagctggcgaaggtggacgggcagatgaccgacgacggccgggagatcatcgagatcctccgcagcctgtactccggcatcaccctggccgccatcgtccccgagaaccacaccctcagccagtccatggtggagaagtacaacagccacaaggcccacctgaagctgctcaaggacctgatcaacaacatgacggacaccaagaaggccaagaacctgcgggcggcctacgacgggtacatcgacggcgtgaaggggaaggtcctcacccgcgacgacttctacaagcagatccagggcaacctggacgacagcgccgaggcccagaagatccaggacgtgatggaccaggacgagttcatgcccaagcagcggaccaaggccaacggctccatcccccaccagctgcagcagcaggagctcgaccagatcgtggagaaccagaaggagtactacccgtggctggcggaggagaaccccaacgagacgcgccgcggggtcgccaagtacaagctggacgagctcgtgaccttccgggtgccctactacgtcggccccatgatcaccgccgaggaccaggagaagcagagcggggcctccttcgcgtggatgaagcggaaggagccgggcaacatcaccccctggaacttcgaccagaaggtggaccgcatggccagcgccaaccagttcatcaagcggatgacgaccaccgacacctacctgctgggggaggacgtcctccccgcccagtccctgctgtaccagcgcttcgaggtgctcaacgagctgaacaagatccggatcgaccgcaagcccatcagcatcgagctgaagcagcagatcttcaacgacctcttcaagaagttcaagaacgtgacgatcaagcacctccaggagtacctggtcgccaccggcggctacgacaagcggccgcgcatcgacgggctggcggacgagaagcggttcaactccggcctgagcgcctaccacgacctgcacgggatcctgggcgccgaggtggtggacgccaacgacaagcaggacgacctcgagaagatcatcgagtggtccaccatcttcgaggacaagaagatctaccgcgccaagctggacgagctgacctggctcacggacagccagaaggagaagctggcgaccaagcgctaccaggggtggggccggctgtccaagaagctcctgagcggcctgcgcaactccgaccaccggagcatcctcgacatcctgtggatcaccaacgagaacttcatgcagatccaggccgaccccgacttcgccgagctggtcaagaacgccaaccaggggatgctcggcaagaacaactcccaggacgtgatcaacgacctgtacaccagcccccagaacaagaaggccatccgccagatcctgctcgtggtccacgacatccagaacgcgatgcacgggcaggcccccgccaagatccacgtggagttcgcccggggcgaggagcgcaacccgcggcgctccatccagcggcagcaccagatcgaggcggcctacgacaaggtgacgagcgacctgctggtcgacgccggggtgcgccaggagctcaaggacgccatcaacgacaagcgggacttcaaggaccgcctgttcctgtacttcatgcagggcggccgggacatctacaacggggagcccatcaacatcgaccgcctctccagctacgacatcgaccacatcctgccccaggccttcgtgaaggacgacagcctgaacaaccgggtcctcaccgacgcggagggcaaccgccggaagtccgacgccgtgcccagcgagctgttcggggccaagatgcgctccacctgggagctgatgcgggagcagggcctcatcagcaaggccaagtaccgcaacctgaccatgaacccggagaacatcaacgcccacaccgagaacggcttcatcaaccggcagctggtggagacgcgccaggtcatcaagctcgcggtgaacatcctggccgacgagtacaccgaggacacccagatcgtgtccgtcaaggccgacctgagccaccagatgcgcgaggacttcgagctcctgaagaaccgggacgtgaacgactaccaccacgccttcgacgcctacctggcggccttcatcgggaactacctcctggagcgctaccccaagctgcagtcctacttcgtgtacggcgacttcaagaagttcagccagaaggacaccaagatgcggcgcttcaacttcatctacgacctcaagcactccgaccagatcgccgacaagaacgggaagaagatctggcacaagacgaacgacctggactacatccggcacctgttcgcctacaagaagatcctcatcagccacgaggtctccgagcgccggggcgcgctgtacaaccagaccgtgtacaaggccagcgacgacaaggcctccgggcagggcagcaagaagctgatccccatcaaggccaacaagcccaccgagatctacggcgggtacaccggcaagacgctcgcctacatggcgatcgtgaaggtcatcaaggggaagaagatcgcctacaaggtggtgggcgtcccgacctccgccctggtgcagctggccgggatcgagcacggcagccaggaggagctcaaccgcctgtacgacgtgctgaagccccagttcacccagctcaagaagaacaacaagaccggcgagatctccgagacggtcagcaagttcgagatcgtgatcccccgggtgaagtaccagcagctggtcgaggacgacgacaagctgttcatgatcgggagcgacacctacccgtacaacgcccagcagctcgtgctgtccgagggcgcgctgaaggtgatcaacaacgtctaccgcaagggggagaacagcgacaagcaggagtcctacaagctcgacgacgtgtacgacgagatcatcatcgccatgaagaagtacttccccctgtacgacaaccggggcttccgcgagaaggtggccgagggcaagagcaccttcgagaacctgcccatctccaacgagttcaagaacgggaagctcaccaagatcggcaagaaggaggtcatcaaccggatgctgcaggggctgcacgccaacgccacgatgaccgacctcaagatcctgggcatcaagagccccttcgggttcatgcagcagccgaccggcatcgcgctgtccgagaacgcccagctcatctaccagagccccaccgacctgttcgagcgccgggtgcagctgaacaagatcaagtga

SEQ ID NO: 2013 - RNA, 4128 nt, synthetic construct
  misc_feature 1..4128: note = Cas9 variant
  source 1..4128: mol_type = other RNA
atgaagaagatcctgggcctcgacctggggaccaccagcatcggctgggccctggtgtacgagtccgagaacacggacgagaagtccagcatcgtccgcctcggggtgcgggtgaaccccctgagcgtcgacgagaagggcaacttcgagaaggggaaggccatcaccaccaacgcggaccgccagcagacccacggcgcccggatcaacctgcagcgctacaagctccggcgcgagaacctgaaggactgcctgcagaagcagggctggatcgggacggaggccctctgcgaggagggcaagacctccaccttcgagacctacatgctgcgggccaaggccgcggaggaggagatcagcctgcacgagctctgccgcgtgctgttcatgatgaacaagaagcgggggtacaagtccaaccgcaaggccaacaacaaggaggacggcaagctgttcgacgggatgacggtggccaagaagctctacgaggagcacctgaccccggccgagtacagcttccagctgctctccagcggcaagaagttcaagcaggagtactaccggtccgacctgaaggaggagttcgaccgcatctggaacgagcagcagaagtactaccccgagatcctgaccgacgacttcaagcagcagctccagggcaagagcaaggggaacacctccaagatcttcctgggcaagtacgggatctacagcgcggacctgaagggcctcgaccggaagctgcagcccctgaagtggcgcgtcgaggccctcaagcagcaggtcgacaaggaggtgctggccttcgtgatctccgacctgaacggccagatcgccagcacgtccgggctcctgggcgccatcagcgaccggtccaaggagctgtacttcaacaagcagaccgtggggcagtacctctggaccagcctgaaggagaccccgcacgtgagcatcaagaacaagccgttctaccgccaggactacctggacgagttcgagaagatctgggagacgcaggcgacctaccacaaggagctcacccccgagctgaagcaggagatccgggacatcatcatcttctaccagcgccccctgaagtccaagaagggcctcatcagcgtctgcgagctggagcagcggaaggtgaaggtgaccatcgacgggaaggagaaggagatctccatcggccccaaggtcgcccccaagagctcccccatgttccaggagttccgcatctggcagaacctgaacaacatcctcctgatcgacaagggcaacaacagcatccaccccctgtacgaggaggagaagaacctcctgtacgaggagctgtccgtgaaggagaagctcagcaaggccgaggccctgaaggtgctgaacaagaactccaagcagtgggacctgaactacaaggagatcgaggggaaccggacgcaggccgtcctctacgactgctacaaccgcatcatcgtgatgaccggccacgaggagtacaacttcaagaagctgaaggcgagcgagatccgctcctacgtgaagaccaccttcacggggctgggcttcaacaccgacatcctcgagttcgacagctccctgaccgggcacgagctggagaagcagcccatgtaccagctctggcacctcctgtacagctacgagtccgacaacagccggaccggcaacgacgccctgctgcgcaagctggagacggccttcggcttcccgaaggagtacgccgccgtcctctccgacgtggtgttcgaggacagctacgggaacctgtccgtcaaggcgatgcggaagatcctgccccacctccaggccggcctgaactacagccaggcctgcgaggaggccgggtacaagcacagccgccggtccctgaccaagaacgagctcgaccagaaggagtacaaggagaagctggagctgctccccaagaacagcctgcacaaccccgtggtcgagaagatcctgaaccagatgatcaacgtgatcaacgccgtgatcgacgagtacggcaagccggacgagatccgcatcgagctcgcgcgggagctgaagatcggggccgccgagcgcgagaacatgacccggtccatcaaccagggcaacgccgagaacaagcgcatccgggagatcctggagaaggagttcgcgctcagctacatctcccgcaacgacatcatcaagtacaagctgtacgaggagctcaagagcaacggcttcaagaccctgtactccgacacgtacatcagcaaggacaagctgttctccaaggacttcgacatcgagcacatcatccccaaggcccggctgttcgacgacagcctctccaacaagaccatcgaggcccgcgacgtcaacatcgccaagagcaacaagaccgccttcgacttcatctccgagaagtacgaccagcaggggatcgaggcgtacaagaagaagctggacatcctgctccaggacggcagcatctccaaggccaagtacaaccggctgctgatgaaggaggccgacatccccagcgggttcatcgaccgcgacctccgggacacccagtacatcgccaagaaggcctacgagatcctgtccgacctggtgcgcaacgtgacgcccaccaccggcgcggtcaccagccggctccgcgaggactggcagctggtggacgtgatgaaggagctgaacttcgagaagtaccagaagctcggcctggtcgaggtgatcgaggaccgcgacgggcggaagatcaagcgcatcaaggactggaccaagcggaacgaccaccgccaccacgccatggacgccctgacgatcgccttcaccaagccgagctacatccagtacctcaacaacctgaacgcccggtccgacaagaacagctccatctacggcatcgagaacaaggagctgcaccgcgaggacaacaagctccggttcaacgcgcccctgcccatcaacgagttccgcgccgaggcccggcgccacctcaagagcatcctggtgtccgtcaaggccaagaacaaggtgatgacccagaacgtgaacgtcatcaagaccaagcacggggtgatcaagaaggtgcagctgacgccccggggcgagctgcacaacgcgaccttctacgggaccaagaagcgcccgatcatcaagatggtcaaggtgggcgccgccctcgacgaggtgaccatcaagaaggtcagctccagcttcatccgggaggccctgctggaccgcctccacgagtacaacggcgacgccaagaaggcgttcacggggcggaactccatcgacaagaaccccatctacatcgacgaggagcacaagaagaccgtgcccgccctggtgaagaccatcgagtgggagatgtaccaccccacccgcaagctgatcagcccggacctcaagatcgacaaggtcatcgacaagggcatccgggagatcctgaagacgcgcctggccaagttcaacggggacgcccagaaggccttctccaacctcgacgagaaccccatctacaaggacgaggcgaagaagatcaccctgaagcgggtgagcctggagggcgtgtccagcgtcatccccctccacaccctgaaggaccgcgaggggaagctggtggtgggcaaggacggcaagccggtcctcggggactacgtgcagacctccaacaaccaccacatcgccttctacatggacgagaacggcaacctgcaggacaacgtggtcagcttcttcgaggccgccgagcggaagtcccagggggtgcccgtgatcgacaagaactacaaccacgacaagggctggaacttcctgttcacgatgaagcagaacgagtacttcgtcttccccaacgaggtgaccgggttcaaccccagcgaggtggacctcatggacgaggccaactactccatcatcagcccgaacctgtaccgcgtccagaagatgagcaaggcgtccggccgcgactactggttccggcaccacctggaggccatgctcaacgacgaccccaagctgcgcaacagcatgttcaagcggatcacctccctgaaggccctcgagggcatcgtgaaggtgcgcatcaactgcatcgggaagatcgtcgccgtgggcgagtacgactga

SEQ ID NO: 2014 - RNA, 4128 nt, synthetic construct
  misc_feature 1..4128: note = Cas9 variant
  source 1..4128: mol_type = other RNA
atgagcaacaagtcctacagcatcggcctggacatcgggaccaactccgtgggctgggccgtcatcaccgacgactacaaggtgcccagcaagaagatgaaggtgctcgggaacacggacaagcacttcatcaagaagaacctgatcggcgccctgctgttcgacgaggggaccaccgcggaggaccgccggctgaagcgcaccgcccggcgccggtacacgcgccggaagaaccgcctgcggtacctccaggagatcttctcccaggagatcagcaaggtcgactccagcttcttccaccgcctggacgacttcttcctggtgccggaggacaagcggggctccaagtaccccatcttcgccaccctcgtggaggagaaggagtaccacaagaagttccccaccatctaccacctccgcaagcacctggccgacagcaaggagaagaccgacctccggctgatctacctggccctcgcgcacatgatcaagtaccgcggccacttcctgtacgaggagtccttcgacatcaagaacaacgacatccagaagatcttcagcgagttcatctccatctacgacaacacgttcgagggcaagagcctgtccgggcagaacgcccaggtcgaggccatcttcaccgacaagatcagcaagtccaccaagcgggagcgcgtgctcaagctgttccccgacgagaagtccaccgggctgttcagcgagttcctcaagctgatcgtgggcaaccaggccgacttcaagaagcacttcgacctggaggagaaggcgccgctccagttcagcaaggacacgtacgacgaggacctggagaacctgctcgggcagatcggcgacgacttcgccgacctgttcctggtcgccaagaagctctacgacgccatcctgctgagcggcatcctcaccgtgaaggacctgtccaccaaggcgcccctgagcgcctccatgatcgagcggtacgagaaccaccagaaggacctcgccgccctgaagcagttcatccagaacaacctgcaggagaagtacgacgaggtgttcagcgaccagtccaaggacgggtacgccggctacatcgacgggaagaccacgcaggaggccttctacaagtacatcaagaacctcctgagcaagttcgagggcgcggactacttcctggacaagatcgagcgcgaggacttcctcaagaagcagcggaccttcgacaacggctccatcccccaccagatccacctccaggagatgaacgccatcatccgccggcagggggagcactaccccttcctgcaggagaacaaggagaagatcgagaagatcctgaccttccgcatcccgtactacgtcggccccctggcccgcgggaacggcgacttcgcctggctgacccggaacagcgaccaggccatccgcccctggaacttcgaggagatcgtggaccaggcgtccagcgccgaggacttcatcaacaagatgacgaactacgacctctacctgcccgaggagaaggtgctgccgaagcactccctgctctacgagaccttcgccgtctacaacgagctgaccaaggtgaagttcatcgccgaggggctgacccggtaccagttcctcgacaagaagcagaagaaggacatcttcgacacgttcttcaaggccgagaacaagcgcaaggtgaccgagaaggacatcatccactacctgcacaacgtcgacggctacgacggcatcgagctgaaggggatcgagaagcagttcaacgcgagcctctccacctaccacgacctgctgaagatcatcaaggacaaggccttcatggacgacagcaagaacgaggagatcctcgagaacatcatccacaccctgacgatcttcgaggaccgggagatgatcaagcagcgcctggcccagtacgactccctcttcgacgagaaggtgatcaaggccctgacccggcgccactacaccggctgggggaagctgagcgcgaagctcatcaacggcatccgggacaagaagtccgggaagaccatcctggactacctgatcgacgacggcgagatcaaccgcaacttcatgcagctcatccacgacgacggcctgagcttcaaggagatcatccagaaggcccaggtgttcgggaagacgaacgacgtcaagcaggtcgtgcaggagctgcccggctcccccgccatcaagaaggggatcctccagagcatcaagatcgtggacgagctggtgaaggtcatgggccacgcccccgagagcatcgtgatcgagatggcccgggagaaccagaccaccgcgcgcgggaagaagaactcccagcagcggtacaagcgcatcgaggacagcctgaagaacctcgcctccggcctggacagcaacatcctgaaggagaacccgaccgacaacatccagctccagaacgaccggctgttcctgtactacctccagaacggccgcgacatgtacacggggaagcccctggagatcaaccagctgtccaactacgacatcgaccacatcatcccccaggccttcatcaaggacgacagcctcgacaaccgggtgctgacctccagcaaggacaaccgcggcaagtccgacaacgtccccagcctggaggtggtggagaagatgaaggccttctggcagcagctcctggactccaagctgatcagcgagcggaagttcaacaacctcaccaaggccgagcgcgagcgcgggggcctgaacgagctggacaaggtcggcttcatcaagcggcagctcgtggagacccgccagatcaccaagcacgtggcgcagttcctggacgcccggttcaacaaggaggtcacggagaaggacaagaagaaccgcaacgtgaagatcatcaccctgaagtccaacctcgtgagcaacttccggaaggagttcgggctgtacaaggtccgcgagatcaacgactaccaccacgcccacgacgcctacctgaacgccgtgctcgcgaaggccatcctgaagaagtacccgaagctggagcccgagttcgtgtacggcgactaccagaagtacgacctccagcggtacatctccaagagccgcgagcccaaggaggtcgagaaggccacccagaagtacttcttctactccaacctgctgaacttcttcaaggaggaggtgcactacgccgacgggaccatcgtgaagcgggagaacatcgagtacagcaaggacacgggcgagatcgcgtggaacaaggagaaggacttcgccaccgtcaagaaggtgctcagcctgccccaggtgaacatcgtcaagaagaccgaggtgcagaccgggggcttctccaaggagagcatcctgccgaagggcaactccgacaagctcatcccccgcaagacgaaggagatcctgtgggacaccaccaagtacgggggcttcgacagccccgtgatcgcctactccatcctgctcatcgccgacatcgagaaggggaaggccaagaagctgaagaccgtcaagacgctggtgggcatcaccatcatggagaaggcgaccttcgagaagaaccccatcaccttcctcgagaacaaggggtaccacaacgtgcggaaggagaacatcctgtgcctgccgaagtacagcctcttcgagctggagtccggccgccggcgcatgctggccagcgccaaggagctccagaagggcaacgagatcgtcctgcccgtgtacctgacgaccctcctgtaccactccaagaacgtgcacaagctggacgagcccgagcacctcgagtacatccagaagcaccggtacgagttcaaggacctgctgaacctcgtcagcgagttctcccagaagtacgtgctggccgacgccaacctggagaagatcaagaacctctacgcggacaacgagcaggccgacatcgagatcctggccaacagcttcatcaacctgctcaccttcaccgccctgggggccccggcggccttcaagttcctgggcaaggacgtggaccgcaagcggtacacgaccgtctccgagatcctcaacgccaccctgatccaccagagcatcaccgggctgtacgagacgcgcatcgacctctccaagctgggcgaggactga

SEQ ID NO: 2015 - RNA, 4128 nt, synthetic construct
  misc_feature 1..4128: note = Cas9 variant
  source 1..4128: mol_type = other RNA
atggagaagaagtacagcatcggcctggacatcgggaccaactccgtgggctgggccgtcatcaccgacgactacaaggtgcccagcaagaagttcaaggtgctcgggaacacgaaccgcaagtccatcaagaagaacctgatgggcgccctgctgttcgacagcggggagaccgcggaggccacccggctgaagcgcaccgcccggcgccggtacacgcgccggaagaaccgcatccggtacctgcaggagatcttcgccaacgagatggccaagctcgacgactccttcttccagcgcctggaggagagcttcctggtcgaggaggacaagaagaacgagcggcacccgatcttcggcaacctcgcggacgaggtggcctaccaccgcaactaccccaccatctaccacctccggaagaagctggccgactcccccgagaaggccgacctccgcctgatctacctggcgctcgcccacatcatcaagttccggggccacttcctgatcgaggggaagctgaacgccgagaacagcgacgtggccaagctgttctaccagctgatccagacctacaaccagctgttcgaggagagccccctcgacgagatcgaggtcgacgccaagggcatcctgtccgcgcgcctgtccaagagcaagcggctcgagaagctgatcgccgtgttcccgaacgagaagaagaacgggctgttcggcaacatcatcgccctcgccctggggctgacccccaacttcaagtccaacttcgacctcacggaggacgccaagctgcagctgagcaaggacacctacgacgacgacctcgacgagctgctgggccagatcggcgaccagtacgcggacctcttctccgccgccaagaacctgagcgacgccatcctgctctccgacatcctgcgcagcaactccgaggtgaccaaggcgcccctgagcgccagcatggtcaagcggtacgacgagcaccaccaggacctcgccctgctgaagaccctcgtgcgccagcagttccccgagaagtacgccgagatcttcaaggacgacacgaagaacgggtacgccggctacgtggggatcggcatcaagcaccggaagcgcaccaccaagctggccacccaggaggagttctacaagttcatcaagccgatcctggagaagatggacggcgcggaggagctcctggccaagctgaaccgcgacgacctgctccggaagcagcgcacgttcgacaacgggtccatcccccaccagatccacctgaaggagctgcacgccatcctccggcgccaggaggagttctaccccttcctgaaggagaaccgggagaagatcgagaagatcctgaccttccgcatcccctactacgtcggcccgctcgcccgggggaacagccgcttcgcgtggctgacccggaagtccgaggaggccatcaccccctggaacttcgaggaggtggtggacaagggcgccagcgcccagtccttcatcgagcgcatgacgaacttcgacgagcagctgcccaacaagaaggtcctccccaagcacagcctgctgtacgagtacttcaccgtgtacaacgagctcaccaaggtgaagtacgtcaccgagcggatgcgcaagccggagttcctgtccggggagcagaagaaggccatcgtggacctcctcttcaagacgaaccggaaggtgaccgtcaagcagctgaaggaggactacttcaagaagatcgagtgcttcgacagcgtggagatcatcggcgtggaggaccgcttcaacgcgtccctgggcacctaccacgacctcctgaagatcatcaaggacaaggacttcctggacaacgaggagaacgaggacatcctcgaggacatcgtcctgaccctgacgctgttcgaggaccgggagatgatcgaggagcgcctgaagacctacgcccacctgttcgacgacaaggtgatgaagcagctcaagcggcgccactacaccgggtggggccggctgagccgcaagatgatcaacgggatccgcgacaagcagtccggcaagaccatcctggacttcctcaagagcgacgggttctccaaccggaacttcatgcagctgatccacgacgacagcctgacgttcaaggaggagatcgagaaggcccaggtctccggccagggcgacagcctccacgagcagatcgccgacctggccgggtcccccgcgatcaagaagggcatcctgcagaccgtgaagatcgtggacgagctcgtcaaggtgatggggcacaagcccgagaacatcgtgatcgagatggcccgcgagaaccagaccaccacgaagggcctgcagcagagccgggagcgcaagaagcggatcgaggaggggatcaaggagctggagtcccagatcctcaaggagaaccccgtcgagaacacccagctgcagaacgagaagctgtacctctactacctgcagaacggccgcgacatgtacgtggaccaggagctggacatcaaccggctcagcgactacgacgtggaccacatcgtcccgcagagcttcatcaaggacgactccatcgacaacaaggtgctgacccgcagcgtggagaaccggggcaagtccgacaacgtccccagcgaggaggtggtgaagaagatgaagaactactggcgccagctgctcaacgccaagctgatcacccagcggaagttcgacaacctgaccaaggccgagcgcgggggcctctccgaggccgacaaggcggggttcatcaagcggcagctggtcgagacgcgccagatcaccaagcacgtggcccggatcctggacagccgcatgaacaccaagcgggacaagaacgacaagcccatccgcgaggtgaaggtcatcaccctcaagtccaagctggtgagcgacttccggaaggacttccagctgtacaaggtgcgcgacatcaacaactaccaccacgcccacgacgcctacctcaacgcggtcgtgggcacggccctgatcaagaagtaccccaagctggagtccgagttcgtgtacggcgactacaaggtctacgacgtgcggaagatgatcgccaagagcgagcaggagatcgggaaggccaccgccaagcgcttcttctactccaacatcatgaacttcttcaagaccgaggtgaagctcgcgaacggcgagatccgcaagcggccgctgatcgagaccaacggggagacgggcgaggtcgtgtggaacaaggagaaggacttcgccaccgtgcgcaaggtcctggccatgccccaggtgaacatcgtgaagaagaccgaggtccagaccgggggcttcagcaaggagtccatcctcagcaagcgggagtccgccaagctgatcccccgcaagaagggctgggacacgcggaagtacgggggcttcgggagccccaccgtggcctactccatcctggtggtcgcgaaggtggagaagggcaaggccaagaagctcaagagcgtgaaggtcctggtggggatcaccatcatggagaagggcagctacgagaaggacccgatcggcttcctggaggccaaggggtacaaggacatcaagaaggagctcatcttcaagctgcccaagtactccctgttcgagctcgagaacggccgccggcgcatgctggccagcgccaccgagctgcagaaggcgaacgagctcgtgctgccccagcacctggtccggctcctgtactacacgcagaacatctccgccaccaccgggagcaacaacctgggctacatcgagcagcaccgcgaggagttcaaggagatcttcgagaagatcatcgacttctccgagaagtacatcctcaagaacaaggtgaacagcaacctgaagtccagcttcgacgagcagttcgccgtgtccgacagcatcctgctctccaacagcttcgtctccctgctgaagtacaccagcttcggggcctccggcggcttcacgttcctcgacctggacgtgaagcaggggcggctgcgctaccagaccgtgaccgaggtcctcgacgcgaccctgatctaccagagcatcacgggcctgtacgagacccggaccgacctctcccagctcgggggcgactga

SEQ ID NO: 2016 - RNA, 4128 nt, synthetic construct
  misc_feature 1..4128: note = Cas9 variant
  source 1..4128: mol_type = other RNA
atgaagaagatcctgggcctcgacctggggaccaccagcatcggctgggccctggtgaacgagtccgagaacaaggacgagcagagctccatcgtccgcctcggggtgcgggtgatccccctgacggtcgacgagaagggcaacttcgagaaggggaaggccatcaccaccaacgcggaccgccagcaggtccacgccgcccggatcaacctgcagcgctacaagctccggcgcgagaacctgcgggactgcctgcagaagcagggctggatcggcagcgagccgatgtgcgaggacgggaagtccagcaccttcgagacgtacaagctccgcgccaaggccgcggtggaggaggtgtccctgcacgagttcgcccgggtgctgttcatgctcaacaagaagcgcggctacaagagcaaccggaaggccaacgacaaggaggaggggaagctgttcgacggcatgaccatcgccaagaagctgtacgaggagcacctcacccccgcggagtactccctgcagctgctcaacaccgggcgcaagttcacgcccgagtactaccggagcgacctgatcgaggagttcgagaagatctggaacgagcagcagaagtactaccccgagatcctgaccgacgagttcaagcagcagctcgagggcaaggccaagtccaacaccagcaagctgttcctgggcaagtacgggatctactccgccgacaccaagggcctcgaccgccggctgcagccgctgaagtggcgcgtggaggccatgaagcagcaggtcgacaaggacgtgctcgccttcgtgatcagcgacctgaaggggcagatcgcgaacacgtccggcctgctcggcgccatcagcgaccggtccaaggagctgtacttcagcaagcagaccatcgggcagtacctgtgggcctccctccaggagaacccccacatcagcatcaagaaccagcccttctaccgccaggactacctggacgagttcgagaagatctgggagacccaggccacctaccacaaggagctgacgagcgagctcaagcaggagatccgggacatcatcatcttctaccagcgccccctgaagtccaagaagaacctgatcgccgtctgcgagctcgagcagcggaaggtgaaggtgaccgtcgacggcaaggagaaggagatcaccatcgggccgaagatcgcgcccaagagctcccccatgttccaggagttccgcatctggcagaacctgaacaacatcctgctcctggaccacgagaccaacagcaagcgccccctgtacgaggaggagcggaacctcctgtacgaggagctgtccgtgaaggagaagctcagcaagacggaggccctgaaggtgctgggcaagaagtccaagcagtgggacctgaactacaaggagctcgaggggaaccgcacccaggccgtcctgtacgactgctacaaccggatcatcgtgatgagcggccacgaggagtgcaacttcaagaagctgaaggcctccgacatccgccactacgtgaagatgatcttcaagaacctcgccttcaacaccgacatcctgtgcttcgacagctccctgaagggccacgagctcgagcggcagccgatgtgccagctgtggcacctcctgtacagctacgagggggacaactcccgcaccggcaacgacgcgctgctgcggaagctcgagacgagcttcgggttccccaaggagtacgccgccgtcctggccgacgtgatcttcgaggactcctacggcaacctgagcgtgaaggccatgcgcaacatcctcccccacctccaggcggggaaggactactcccaggcctgcgaggaggccggctacaagcacagccggcgctccctgaccaaggaggagctgaaccagaaggtctacaaggagaagctggagctgctccccaagaacagcctgcacaacccggtggtcgagaagatcctgaaccagatggtgaacgtgatcaacgccgtcatcgaggagtacggcaagcccgacgagatccggatcgagctcgcgcgcgacctgaagatcggggccgccgagcgggagaacatgacccgcagcatcaaccagggcaacgccgagaacaagcggatccgcgagatcctggagaaggagttcgccctctcctacctgagccggaacgacatcatcaagtacaagctgtacgaggagctcaagtccaacgggttcaagaccctgtacagcgacacgtacatctccaaggacaagctgttcagcaaggacttcgacatcgagcacatcatccccaaggcgcgcctcttcgacgactccctgagcaacaagaccatcgaggcccgggacgtgaacatcgccaagtccaacaagaccgccttcgacttcatcctggagcgctacggcgagcagggggtgaagacctacaagacgaagctcctgcgcctgctcgaggacggcgccatcagcaacaagaagtacaacaacctgctgaagaccgaggcggacatcccctccggcttcatcgaccgggacctccgcaacacccagtacatcgccaagaaggcctacgagatcctgagcgagctggtcaagatcgtgaccccgacgaccgggtccgtgaccaaccggctccgcgaggactggcagctggtcgacgtgatgaaggagctgaacttcgagaagtaccagaagctcggcctggccgacgtgatcgaggaccgggacgggcgcaaggtcaagcggatcaaggactggaccaagcgcaacgaccaccggcaccacgccatggacgcgctgaccatcgccttcacgaagcccagctacatccagtacctcaacaacctgaacgcccgctccgacaagagctccagcatctacggcatcgaggtgaaggagctgcaccgggaggagggcaagttccgcttcaacgcgcccctccccatcaacgagttccgggccgaggccaagcgccacctcaagagcgtgctggtctccatcaaggccaagaagaaggtgatgacccagaacgtgaacaagatcaagaccaagcacgggatcatcaagaaggtccagctgaccccgcggggcgagctgcacaacgccacgtactacgggaccaagaagcgccccctggtgcggatggtgaaggtcggcgccgcgctcgacgaggccaccatcaagcgcgtgtgcagccccgccatccgggccgccctgctgaagcgcctcaacgcgtacaacggggacgccaaggaggccttcaccggccggaactccatcgacaagaaccccatctacctggacatcgagcagacgaagctggtgccggtcctcgtgaagaccatcgagtggggcatgtaccaccccatccgcaagcgcatcacccccgacctgaagatcgacaaggtgatcgacaaggggatccgggagaagctgaaggcccgcctcgccgagttcaacggcgacgcgcagaaggccttcagcaacctggacgagaacccgatctacatggacgaggccaagcggatcaccctgaagcgcgtctccatcgagggggtgctcagcgccatccccctgcacacgctgaaggacaaggcgggcaagcccgtgatcgggtccgacggcaagcccgtcttcggcgactacgtgcagaccagcaacaaccaccacatcgccttctacatcgacgacaaggggaacctccaggacaacccggtgtccttcttcgaggccgccgagcgcaagagccagggcgtccccgtgatcgaccggcggtacaactgcgacaaggggtggcacttcgtgttcaccatgaagcagaacgagtacttcgtcttccccaacgaggccaccggcttcatcccctccgaggtggacctgctggacgaggcgaactactgcatcatcagcccgaacctctaccgcgtgcagaagctgtccaaggccagcgggcgggactactggttccgccaccacctggagacgatgctcaacgacgacctgcggctgaagaactccaccttcaagcgcatccagagcctcaagggcctggaggacatcgtcaaggtgcggatcaactccatcggcaagatcgtggccgtcgggaagtacgactga

SEQ ID NO: 2017 - RNA, 4128 nt, synthetic construct
  misc_feature 1..4128: note = Cas9 variant
  source 1..4128: mol_type = other RNA
atggagaccaagttcacctactacctgggcctcgacatggggacggacagcctgggctgggccgtgaccgactccagctaccacatcctgcgcgccaaggggaaggacctctggggcgtccggctgttccccgcggccgagacctccgtggaccgccggacctaccgcgtgaaccggcgccggcgccagcgggaggtcgcccgcatcggggccctgaaggagctgttcgccgacgagatcgagaaggtggacccgggcttcttcgtgcggctggacgagagcaagttccacatggaggaccgctccgagaacaacaagcagaagtacggcctgttcgcggacaagctgttcagcgacgccgagtactacaagaagtaccccacgatcttccacctccggaaggagctcctcgagtccgaggagccccacgacgtccgcctggtgtacctggccctcctgaacatgttcaagcaccgggggcacttcctgaacagctccctccagatcgagggcgagaacagcaacatcgccgagtcctaccagatgttcgtggacaccctgaaggacgaggagctggacttccccgagcaggtcagcggggagcgcctccaggagatcttccggtccagcgactcccgcaagaagaaggtggagaacctgctggcggagatgaacctcagcaagaagcagaagcgggagatccagttcgtgaacctgatctgcggcctgaaggggaagctctccgagctgttcccggacaaggagtacgacgaggagcagaagaagatcgccttcagcttccaggactccgactacgaggacaaggagaacaccatccaggagctgctcgacgagagcgagatgaacatgatctacgccgtcaaggccgtgcacgacagcggcgtgctgtccggcatcatgaacggggagcgctacctgagcgtcgcccgggtggcgtcctacgagaagcacaagaaggacctccagatcctgaaggacatcctgaagaagtacgacaccaaggagtacttcgagatgttccgcaacgagagcgagaagtccgagaactacagcgcctacgtgggctccgtcaagtaccacgggacgttccgccggggcctcagcggcgggaagcaggaggacctgtacaagcacatcaagaaggtgctgggcaagttcccccaggacgacgagggggtgacctacgtcctcgaggagatcgagaccgagtccttcctgcccaagcagctgaccgccagcaacggcgtgatccccaaccaggtgcacgcccgcgagatgctcgccatcctgaagcacgcggagctgtacctcccgttcctgcaggagaaggacgacacggggctgtccgtcagcgagaagatcctcaagctgttcatgttccagatcccctactacgtgggccccctgggccaggagtacaaggacaagaaggggtacaacgtctgggccgagcggaaggagcccggcaagatctacccgtggaacttcgaggagaagatcgacgtgaagaagtccgccgagaagttcatcgggcgcatggtgcggcgctgcacctacctgagcggcgagcaggccctccccaagcagtccctgctgtacgagaagttccaggtcctcaacgagctgaacaacctgcggatccgcggggagaagatccccgtgagcctcaagcaggagatctaccacgacctgttcggcgacggcaagaaggtgtccatgacccggctgaccaactacctcctgcagaacggggtcatcagctccgaggagaaggacagctgcatcagcggcatcgacgggggcttccacaactccctgagctccgtggggaagttcaagggcgtgttcggcgacacggtccacaccgacgagcaccgcaagatgatcgaggacatcatcttctgggggaccgtgttcggcgacgggaagaagctcctgaaggagaaggtggaggaggtctacggcaaccagctgaccgaggcccagaagaagcggatcttcggcttcaagttcagcgggtggggccgcctctccaaggcgttcctgacgatggagggggccagcaaggacaacggcgagatcaaggggctgatccaggccatgtgggacaccaactgcaacctcatggagctgctgtccgagcggttcacctacaaggacaagctcaacgagatggtgaccacggccgagaagcccctgtgcgagtggaagatcgaggacctggacgagatgtacctcagcgccccggtgaagcgcatggtctggcagaccatccgggtggtggacgaggtccagcagatcatgggctgcccgcccaagcgcatcttcgtggagatgacccggtccgacggcgagaaggggaagcgcaccgtgagccggcagaagaagctggtcgacctgtacaaggcgctcggcaaggaggggaagatctggtccgaggagctgaacaacacgcccgagggccagttccgcatcaagaagctgtacctctactacctgcagatggggaagtgcatgtacaccggcgagagcatcgagctggagcccctcatgaacgacaaccacctgtacgacatcgaccacatctacccccgccacttcatcaaggacgacaacatctccaacaacctggtgctcgtgaagaaggagcggaacgcccacaagagcgactccttccccatcgagcccgagatccgcaacaagatgatgccgttctggaagtccctgcggaagaagggcttcctgaccgaggagaagtacaaccgcctcacccggatgagcgccttcacggacgaggagaaggccgcgttcatcagccgccagctggtcgagaccagccaggggaccaaggccatcacccagatcttcaagcaggccttcgccgactccgagatcgtgttcagcaaggcctccgtggtcagcgcgttccggcagaagttcgactgctacaaggtgcgctgcgtgaacgactaccaccacgcccacgacgcctacctgaacatcgtcgccggcaacacgtaccgggtgaagttcacctccaaccccctcaacttcatcaaggaggccaagaagaaccccaacagccgcgagaaccggtacaacatggacaagaccttcgagtgggacgtgacccgcaacggggagaccgcgtgggtcgcccagtccaacgagaaccccggcacgatccagctggtgaagaagtacctgaacaagaacagcccgctcatcaccaagatggtgtacgagaagcacgggggcatcacccagaaggccaccatctggtccgccaagaaggccgagagcggcaacacggacgcgtacatccccgtcaagatgaacgacccccggctggccgacgtgaccaagtacgggggcgtgaccaccatcgccgtcgccgggtacacgctgctcgagtacaaggcgggcgggaagaccgtgcgctccctggaggccctgccgatctacctcggcggcagcaagaacctgaccgaggagcagatggtggagtacttctccaacatcctgcagcaggagaacaaggagaaggtcgtgagcgacgtgatcatccggaagaagatgatcccctccgggagcctcatcaagtacaacggcttctactactacctggccgggaagaccggcaaccgcatcgtcctgatctccgccgtgcagctctgcctgcccatggacacgatgctgtacatcaagaagatcgagaaggcctgcagcaccggcaacttcgaggagaaggacaagaacgggaagcaggtcctctccaagcagcagaacgagttcgtgtacgagctgatcatcgagaagtaccagcagagcatcttcaagaagaaggtgggcgcgatcggggacaccatcatcgagaagcgggagaagttcgccgagatcagcctggaggagcagtgcaaggtgctcatgcagatcttcctgaacttccagtccggcatcggggtcgacctgaccagcgtggacggctccaacaagagcggcgtcacgtacctcaacaagaagatcatgaacgcccaggagctgaagctgatcgaccagtccgtgaccggggtgttcagccgcgagatcgacctcctgaccatctga

SEQ ID NO: 2018 - RNA, 4128 nt, synthetic construct
  misc_feature 1..4128: note = Cas9 variant
  source 1..4128: mol_type = other RNA
atgagcaacaagtcctacagcatcggcctggacatcgggaccaactccgtgggctgggccgtcatcaccgacgactacaaggtgcccagcaagaagatgaaggtgctcgggaacacggacaagcacttcatcaagaagaacctgatcggcgccctgctgttcgacgaggggaccaccgcggaggaccgccggctgaagcgcaccgcccggcgccggtacacgcgccggaagaaccgcctgcggtacctccaggagatcttctccgaggagatgagcaaggtcgactccagcttcttccaccgcctggacgactccttcctggtgccggaggacaagcggggcagcaagtaccccatcttcgccaccctcgccgaggagaaggagtaccacaagaagttccccaccatctaccacctccgcaagcacctggccgactccaaggagaagaccgacctccggctgatctacctggcgctcgcccacatgatcaagtaccgcggccacttcctgtacgaggagagcttcgacatcaagaacaacgacatccagaagatcttctccgagttcatcagcatctacgacaacacgttcgaggagtccagcctgatcgggcagaacgcccaggtggaggccatcttcaccgacaagatctccaagagcgcgaagcgggagcgcgtcctcaagctgttccccgaccagaagtccaccggcctgttcagcgagttcctcaagctgatcctggggaaccaggccgacttcaagaagcacttcgacctcgaggagaaggccccgctgcagttcagcaaggacacctacgacgaggacctggagaacctcctgggccagatccgggacgacttcgccgacctgttcctcgtggccaagaagctgtacgacgcgatcctgctctccgggatcctgacggtgaaggacctgagcaccaaggcgcccctctccgccagcatgatcgagcactacgagaaccaccagaaggacctggccgccctgaagcagttcatccagaacaacctccaggagaagtacgacgaggtcttctccgaccagagcaaggacggctacgccggctacatcaacgggaagaccacccaggaggccttctacaagtacatcaagaacctgctgtccaagttcgagggcgccgactacttcctcgacaagatcgagcgcgaggacttcctgcggaagcagcgcacgttcgacaacgggagcatcccccaccagatccacctccaggagatgaacgccatcctgcaccggcagggcgagcactaccccttcctgaaggagaacaaggagaagatcgagaagatcctgatcttccgcatcccgtactacgtgggccccctcgcccgcgggaaccgggacttcgcgtggctgacccgcaactccgacgaggccatccggccctggaacttcgaggagatcgtggacaaggccagctccgccgaggacttcatcaacaagatgaccaactacgacctgtacctgcccgaggagaaggtcctcccgaagcacagcctgctgtacgagaccttcgccgtgtacaacgagctcacgaaggtgaagttcatcgcggagggcctgacccgctaccagttcctggacaagaagcagaagaaggacatcttctacaccttcttcaaggccgaggacaagcggaaggtcaccgagaaggacatcatccactacctccacacggtggacgggtacgacggcatcgagctggaggggatcgagaagcagttcaacgcctccctgagcacctaccacgacctcctgaagatcatcaaggacaaggagttcatggacgacgacaagaacgaggccatcctggagaacatcgtgcacaccctcaccatcttcgaggaccgcgagatgatcaagcagcggctggcgcagtacaactccctgttcgacgagaaggtcatcaaggccctcacgcgccggcactacaccggctggggcaagctgagcgccaagctgatcaacgggatccgcgacaagaagtccggcaagaccatcctcgactacctgatcgacgacggggagatcaaccggaacttcatgcagctgatccacgacgacggcctcagcttcaaggagatcatccagaaggcccaggtgttcgggaagaccaacgacgtgaagcaggtcgtgcacgagctgcccggctcccccgccatcaagaagggcatcctgcagagcatcaagatcgtggacgagctcgtcaaggtgatggggcacgcgcccgagagcatcgtcatcgagatggcccgcgagaaccagacgaccgcccggggcaagaagaactcccagcagcgctacaagcggatcgaggacagcctgaagaacctggcctccgggctcgacagcaacatcctgaaggagaacccgaccgacaacgtgcagctgcagaacgaccgcctcttcctgtactacctgcagaacggccgggacatgtacaccgggaagcccctcgagatcaaccagctgtccaactacgacatcgaccacatcatcccccaggccttcatcaaggacgacagcctggacaaccgcgtgctcacgtccagcaaggacaaccggggcaagtccgacaacgtccccagcctggaggtggtggagaagatgaaggcgttctggcagcagctgctcgactccaagctgatcagcgagcgcaagttcaacaacctgaccaaggccgagcgcgagcggggcgggctcaacgagctggacaaggtcggcttcatcaagcgccagctggtggagacccggcagatcaccaagcacgtggcccagatcctcgacacccgcttcaacaaggaggtcacggagaaggacaagaagaaccggaacgtgaagatcatcaccctgaagtccaacctggtgagcaacttccgcaaggagttcgggctctacaaggtccgggagatcaacgactaccaccacgcccacgacgcctacctgaacgcggtggtggccaaggccatcctgaagaagtacccgaagctcgagcccgagttcgtctacggcgagtaccagaagtacgacctgaagcgctacatctcccggagcaaggaccccaaggacatcgagaaggccaccgagaagtacttcttctactccaacctgctcaacttcttcaaggaggaggtgcagtacgcggacggcaccatcgccaagcgcgagaacatcgagtacagcaaggacacgggggagatcgcctggaacaaggagaaggacttcgccaccgtgaagaaggtcctgagcctgccccaggtgaacatcgtgaagaagcgggaggtccagaccggcgggttctccaaggagagcatcctcccgaagggcaactccgacaagctgatcccccgcaagaccaaggacatcctgtgggagacgaccaagtacgggggcttcgacagccccgtgatcgcctactccatcctcctgatcgcggacatcgagaagggcaagagcaaggagctgaagaccgtgaagaccctcgtcgggatcacgatcatggagaaggccaccttcgaggagaaccccatcaccttcctggagaacaagggctaccacaacgtgcggaaggagaacatcctgtgcctcccgaagtactccctgttcgagctggagaacgggcgccggcgcctcctggccagcgccaaggagctgcagaagggcaacgagatcgtgctccccgtctacctgaccacgctgctctaccactccaagaacctgcacaagctggacgagcccgggcacctcgagtacatccagaagcaccggaacgagttcaaggacctgctgaacctcgtgagcgagttctcccagaagtacatcctggccgacgcgaacctggagaagatccagaacctctacgccgacaacgagcaggccgacatcgagatcctggccaacagcttcatcaacctgctcaccttcaccaccctgggcgccccggcggccttcaagttcttcggcaaggacatcgaccgcaagcggtacacgaccgtgtccgagatcctgaacgccaccctcatccaccagagcatcaccgggctgtacgagacgcgcatcgacctgtccaagctcggcgaggactga

SEQ ID NO: 2019 - RNA, 4128 nt, synthetic construct
  misc_feature 1..4128: note = Cas9 variant
  source 1..4128: mol_type = other RNA
atggagaagtcctacagcatcggcctggacatcgggaccaacagcgtgggctgggccgtcatcaccgacgactacaaggtgcccgccaagaagatgaaggtgctcgggaacacggacaagaagtacatcaagaagaacctgctgggcgcgctcctgttcgactccggggagaccgccgaggtcacccgcctgaagcggaccgcccgccggcgctacacgcggcgcaagaaccggctccgctacctgcaggagatcttcgccaaggagatgaccaaggtggacgagagcttcttccagcggctggaggagtccttcctcaccgacgacgacaagaccttcgacagccacccgatcttcggcaacaaggccgaggaggacgcgtaccaccagaagttccccacgatctaccacctccgcaagtacctggccgactcccaggagaaggccgacctccggctggtgtacctggccctcgcgcacatgatcaagtaccgcggccacttcctgatcgagggggagctgaacgccgagaacaccgacgtccagaagctgttcaacgtgttcgtggagacctacgacaagatcgtcgacgagagccacctgtccgagatcgaggtggacgccagctccatcctgaccgagaaggtgagcaagtcccggcgcctcgagaacctgatcaagcagtaccccacggagaagaagaacaccctgttcggcaacctcatcgccctggccctggggctccagcccaacttcaagaccaacttcaagctgagcgaggacgcgaagctgcagttctccaaggacacctacgaggaggacctcgaggagctgctgggcaaggtcggggacgactacgccgacctcttcatcagcgccaagaacctgtacgacgccatcctgctctccggcatcctgacggtggacgacaacagcaccaaggccccgctgtccgcgagcatgatcaagcggtacgtggagcaccacgaggacctcgagaagctgaaggagttcatcaagatcaacaagctgaagctctaccacgacatcttcaaggacaagaccaagaacggctacgccgggtacatcgacaacggcgtcaagcaggacgagttctacaagtacctgaagaccatcctgacgaagatcgacgacagcgactacttcctcgacaagatcgagcgcgacgacttcctgcggaagcagcgcaccttcgacaacgggtccatcccccaccagatccacctccaggagatgcacagcatcctgcggcgccagggcgactactaccccttcctgaaggagaaccaggccaagatcgagaagatcctgaccttccggatcccctactacgtgggcccgctggcccgcaaggactcccgcttcgcctgggcgaactaccacagcgacgagcccatcaccccctggaacttcgacgaggtggtcgacaaggagaagtccgccgagaagttcatcacgcggatgaccctcaacgacctgtacctgcccgaggagaaggtgctcccgaagcacagccacgtgtacgagaccttcaccgtctacaacgagctgacgaagatcaagtacgtgaacgagcagggggagtccttcttcttcgacgccaacatgaagcaggagatcttcgaccacgtgttcaaggagaaccgcaaggtcaccaaggccaagctgctcagctacctgaacaacgagttcgaggagttccggatcaacgacctgatcggcctcgacaaggactccaagagcttcaacgcctccctggggacctaccacgacctgaagaagatcctcgacaagagcttcctggacgacaagaccaacggccagatcatcgaggacatcgtgctgacgctcaccctgttcgaggaccgcgacatgatccacgagcggctgcagaagtactccgacttcttcaccagccagcagctcaagaagctggagcgccggcactacaccgggtggggccgcctgtcctacaagctcatcaacggcatccggaacaaggagaacaacaagacgatcctggacttcctgatcgacgacgggcacgcgaaccgcaacttcatgcagctcatcaacgacgagagcctgtccttcaagaccatcatccaggaggcccaggtcgtgggcgacgtggacgacatcgaggccgtcgtgcacgacctgcccgggagccccgccatcaagaagggcatcctccagtccgtgaagatcgtcgacgagctggtgaaggtgatgggggacaaccccgacaacatcgtcatcgagatggcgcgggagaaccagaccaccggctacggccgcaacaagagcaaccagcggctgaagcgcctccaggacagcctgaaggagttcgggtccgacatcctgagcaagaagaagccgtcctacgtggacagcaaggtggagaactcccacctccagaacgaccggctgttcctgtactacatccagaacggcaaggacatgtacaccggggaggagctcgacatcgaccgcctgagcgactacgacatcgaccacatcatcccccaggccttcatcaaggacaactccatcgacaacaaggtcctgacgagctccgccaagaaccggggcaagagcgacgacgtgccctccatcgagatcgtgcgcaaccggcgcagctactggtacaagctctacaagtccgggctgatcagcaagcgcaagttcgacaacctgaccaaggccgagcggggcggcctcaccgaggccgacaaggcggggttcatcaagcgccagctggtcgagacccggcagatcacgaagcacgtggcccagatcctggacgcccgcttcaacaccaagcgggacgagaacgacaaggtgatccgcgacgtcaaggtgatcaccctcaagtccaacctggtgagccagttccggaaggagttcaagttctacaaggtccgcgagatcaacgactaccaccacgcccacgacgcctacctgaacgcggtggtgggcaccgccctcctgaagaagtaccccaagctgacgccggagttcgtctacggggagtacaagaagtacgacgtgcggaagctcatcgccaagtccagcgacgactacagcgagatgggcaaggccaccgccaagtacttcttctactccaacctgatgaacttcttcaagaccgaggtgaagtacgcggacggccgcgtcttcgagcggcccgacatcgagaccaacgccgacggggaggtggtgtggaacaagcagaaggacttcgacatcgtccgcaaggtgctgagctacccccaggtgaacatcgtcaagaaggtggaggcccagacgggcgggttctccaaggagagcatcctctccaagggcgacagcgacaagctgatcccccggaagaccaagaaggtgtactggaacaccaagaagtacgggggcttcgactccccgaccgtcgcctacagcgtgctggtggtcgcggacatcgagaagggcaaggccaagaagctcaagacggtgaaggagctggtggggatctccatcatggagcgcagcttcttcgaggagaaccccgtctccttcctggagaagaagggctaccacaacgtgcaggaggacaagctcatcaagctgcccaagtacagcctgttcgagttcgagggcgggcggcgccggctcctggcctccgccaccgagctgcagaaggggaacgaggtgatgctccccgcccacctggtcgagctgctctaccacgcgcaccgcatcgacagcttcaactccaccgagcacctgaagtacgtgagcgagcacaagaaggagttcgagaaggtgctgtcctgcgtcgagaacttcagcaacctctacgtggacgtggagaagaacctgtccaaggtccgggccgccgccgagagcatgaccaacttcagcctggaggagatctccgccagcttcatcaacctcctgacgctgaccgcgctcggcgccccggccgacttcaacttcctgggcgagaagatcccccgcaagcggtacacctccaccaaggagtgcctgagcgccacgctcatccaccagtccgtgaccgggctgtacgagacccgcatcgacctgagcaagctcggcgaggagtga

SEQ ID NO: 2020 - RNA, 4128 nt, synthetic construct
  misc_feature 1..4128: note = Cas9 variant
  source 1..4128: mol_type = other RNA
atgaccaagatcaaggacgactacatcgtgggcctggacatcgggaccgacagctgcggctgggtcgccatgaactccaacaacgacatcctcaagctgcaggggaagacggccatcggcagccgcctgttcgagggcgggaagtccgcggccgagcggcgcctcttccggaccacccaccgccggatcaagcgccggcgctggcggctgaagctgctcgaggagttcttcgacccctacatggccgaggtggacccgtacttcttcgcccgcctgaaggagagcggcctgagccccctcgacaagcggaagaccgtgagctccatcgtcttccccacgagcgccgaggacaagaagttctacgacgactaccccaccatctaccacctccgctacaagctgatgaccgaggacgagaagttcgacctccgggaggtgtacctggcgatccaccacatcatcaagtaccgcgggaacttcctgtacaacacctccgtgaaggacttcaaggccagcaagatcgacgtcaagtccagcatcgagaagctcaacgagctgtacgagaacctgggcctcgacctgaacgtggagttcaacatctccaacacggccgagatcgagaaggtgctgaaggacaagcagatcttcaagcgggacaaggtcaagaagatcgccgagctgttcgcgatcaagaccgacaacaaggagcagagcaagcgcatcaaggacatctccaagcaggtcgccaacgccgtgctggggtacaagacccggttcgacaccatcgccctgaaggagatcagcaaggacgagctctccgactggaacttcaagctgagcgacatcgacgccgactccaagttcgaggcgctgatgggcaacctcgacgagaacgagcaggccatcctgctgacgatcaaggagctgttcaacgaggtgaccctcaacgggatcgtggaggacggcaacaccctgagcgagagcatgatcaacaagtacaacgaccaccgcgacgacctcaagctgctgaaggaggtgatcgagaaccacatcgaccggaagaaggccaaggagctcgccctggcctacgacctgtacgtcaacaaccgccacggccagctcctgcaggcgaagaagaagctggggaagatcaagccgcggtccaaggaggacttctacaaggtggtgaacaagaacctcgacgacagccgcgcctccaaggagatcaagaagaagatcgagctggacagcttcatgcccaagcagcgcaccaacgccaacggcgtcatcccctaccagctgcagcagctcgagctggacaagatcatcgagaaccagtccaagtactaccccttcctgaaggagatcaacccggtgagctcccacctcaaggaggccccctacaagctggacgagctgatccggttccgcgtgccctactacgtcgggcccctgatcagcccgaacgagtccacgaaggacatccagaccaagaagaaccagaacttcgcctggatgatccggaaggaggagggccgcatcaccccctggaacttcgaccagaaggtggaccggatcgagagcgcgaacaagttcatcaagcgcatgaccacgaaggacacctacctcttcggcgaggacgtgctgcccgccaactccctgctctaccagaagttcaccgtcctgaacgagctgaacaacatccggatcaacgggaagcgcatcagcgtggacctcaagcaggagatctacgagaacctgttcaagaagcacaccacggtcaccgtgaagaagctggagaactacctcaaggagaaccacaacctggtgaaggtcgagatcaagggcctggccgacgagaagaagttcaactccgggctcaccacctacaaccggttcaagaacctgaacatcttcgacaaccagatcgacgacctgaagtaccgcaacgacttcgagaagatcatcgagtggagcacgatcttcgaggacaagtccatctacaaggagaagctccggagcatcgactggctgaacgagaagcagatcaacgccctgtccaacatccgcctccagggctgggggcggctgagcaagaagctgctcgcccagctgcacgaccacaacggccagaccatcatcgagcagctgtgggactcccagaacaacttcatgcagatcgtgacccaggcggacttcaaggacgccatcgccaaggccaaccagaacctcctggtggcgaccagcgtcgaggacatcctgaacaacgcctacacgagccccgccaacaagaaggccatccgccaggtgatcaaggtggtcgacgacatcgtgaaggccgcgtccggcaaggtgccgaagcagatcgccatcgagttcacccgggacgccgacgagaaccccaagcgcagccagacccgggggtccaagctccagaaggtctacaaggacctgagcaccgagctggcctccaagacgatcgccgaggagctcaacgaggcgatcaaggacaagaagctggtgcaggacaagtactacctgtacttcatgcagctcggccgcgacgcctacaccggggagcccatcaacatcgacgagatccagaagtacgacatcgaccacatcctgccccagagcttcatcaaggacgacgccctggacaaccgggtgctcgtctcccgcgccgtgaacaacggcaagagcgacaacgtgccggtcaagctgttcgggaacgagatggccgcgaacctgggcatgaccatccgcaagatgtgggaggagtggaagaacatcggcctcatctccaagaccaagtacaacaacctgctgaccgaccccgaccacatcaacaagtacaagagcgccgggttcatccggcgccagctcgtggagacgtcccagatcatcaagctggtgagcaccatcctgcagtcccggtaccccaacaccgagatcatcaccgtcaaggccaagtacaaccactacctccgcgagaagttcgacctgtacaagagccgggaggtgaacgactaccaccacgccatcgacgcgtacctgtccgccatctgcggcaacctcctgtaccagaactaccccaacctgcgcccgttcttcgtgtacgggcagtacaagaagttcagctccgaccccgacaaggagaaggccatcttcaacaagacgcggaagttcagcttcatcagccagctcctgaagaacaagtccgagaacagcaaggagatcgccaagaagctgaagcgcgcctaccagttcaagtacatgctcgtctcccgggagaccgagacccgcgaccaggagatgttcaagatgaccgtgtacccccggttcagccacgacacggtgaaggcgccccgcaacctgatcccgaagaagatgggcatgtcccccgacatctacgggggctacaccaacaacagcgacgcctacatggtcatcgtgcggatcgacaagaagaagggcaccgagtacaagatcctggggatccccacccgcgagctcgtgaacctgaagaaggccgagaaggaggaccactacaagtcctacctgaaggagatcctcacgccgcggatcctgtacaacaagaacggcaagcgcgacaagaagatcaccagcttcgagatcgtcaagtccaagatcccctacaagcaggtcatccaggacggggacaagaagttcatgctgggcagctccacctacgtgtacaacgccaagcagctcaccctgagcacggagtccatgaaggccatcaccaacaacttcgacaaggacagcgacgagaacgacgcgctgatcaaggcctacgacgagatcctcgacaaggtggacaagtacctgcccctgttcgacatcaacaagttccgggagaagctccactccggccgcgagaagttcatcaagctgagcctggaggacaagaaggacaccatcctcaaggtgctggaggggctgcacgacaacgccgtgatgaccaagatccccacgatcggcctctccaccccgctggggttcatgcagttccccaacggcgtcatcctgagcgagaacgccaagctcatctaccagtcccccaccgggctgttcaagaagtccgtgaagatcagcgacctgtga

SEQ ID NO: 2021 - RNA, 4131 nt, synthetic construct
  misc_feature 1..4131: note = Cas9 variant
  source 1..4131: mol_type = other RNA
atgagcaacttcgacaaccacaaggactccatctgcaagcacaagggcctgaagaaggggaactactacatcggcctcgacatcgggaccaacagcgtgggctgggccgccaccaacgagcagtacgagctgctgaagttcaagtcccacaagatgtgggggagccgcctcttcgcggaggcccagacggccgtcgacacccggatgaagcgctccgcccggcgccggctgcagcgccggaagttccgcctgatcctcctggagagcctgttctccaaggagatcaacgccgtggacgagaccttcttcatgcggctccacgagagcaactaccacgtggaggacaagaccaacctggtcaagtacacgctgttcatcgacaagaactacaccgacgtggactactacaaggagttccccaccatctaccacctccgccaccacctgatgaccgagggcacgaaggacatccggctgctgttcctggcgatccaccacatcctgaagtaccgcggcaacttcctctacgggaagaaggagttctccgtggacggcgagatgtacagcgtcctgcggtccaccctggaggagctcgggttcggcagctacgtggaggacgagaacgtgctgcagtccatcgccaacctggtcctcgaccgcgggatcgcccggagcgagaaggtgaagcagatcgagccgctgatcgcccagggcaagaagctgtccagcgtggagaagaaccgcctcaaggcgtgggcctacctgatcatgggcctgaaggccaacctcgtcaacctgttcaccgacgaggacgtggaggtggtcctgcccgaggagaaggagttcaagtccatcaacctccacgaggggatctacgaggacgtgcgggacgcctacgaggacgcctggggcgaccgcttcgcgatcgtggaccagtgcaaggtcctgcacgacatcatcgtgatcagctccatcatcaagcccgggcagagcctgagcgaggccaagatcgagtcctacaaccagcacaaggaggacctcgtgctgctcaagagcgtcctcaaggaggacaagaagctgtacgacgacatgttcgtggtggacatcgacaagggcaccaactacgtcaagtacatcaagcagggcgtgaacgggaacacgtccaccacccaggaggccttctacaagtacgtccggaaggtggtgagcgtcctgcccgagaccgagaacacgcgctgcatcgtgcagaagctcgaggagggcaccttcctgccgctgcagcggatctccaagaacggggtggtcccctaccagctccacaaggaggagctggtgcgcatcctggagaaggccaagctcaacttccccttcctgaacgaggtggaggacggcctgaccgtcgccgacaagatcatcagcatcctggagttcaagatcccctactacgtggggccgctcaaccccacccactccatcgagaacggcggcttcgcgtgggtggtccgcaaggaggccggccaggtgctgccctggaacttcgagcagaaggtggacgtccaggccagcgccgtgaagttcatcgagaacctgacgaacaagtgcacctacctcatcgaccaggacgtgctgcccaagtactccctgctctacgccgagttcagcctgctgaacgagctcaacaacatccgggtcaacgacaagccgctgcccgcggacgtgaagcaggccttcatccgcgaccacttcatctccctgcaggacagcaagaccgccaccaagaaggtggtcgccaagtacctcgtggacaacaactacgtgtcccagccgcccatcatcacggggatggaccagcagatcgccaccaagctgaccagccaccgggacatgacccgcatcctgggggagcacttcgactacgcgatggccgaggacatcatccggtacatcacgatcttcggcgagtccaaggacatgctccgccaggtcctgaagaactactacggggaccggctgaccaccgagcagatcaagaagctcggcaagctgacctacacgggctgggggcgcctgagcaagaagttcctctccgacatctggggcatgaagaagaacgacgacgacgccgaggccgggaccatcatcgagcacatgcgggagggccaggagaacctgatgcagctgctcagctccagctacagcttcatcgacgtggtgcaggagtacgtcaccaacgtgctgggggcgaaggagaagaccgccttcgagatgctggaggacctctccctgagccccatggtgaagcgctccgtctggcagacgctgcggatcctcgacgagatcgtgagcatccgcaaggagctgcccaagaagatcttcgtggaggtcgcccggaccaacaaggccgacaagaagcgcacccagtcccggaaggccctgctcgaggagctgtacgagcagatcaaggacgaggacgtgcacgtgctgcagcaggagctcgagagcaaggaggactccgcgctgaacagcaagaagctgtacctctacttcacccagatgggccgctgcatgtactccggccggcgcatcgacatccacgagctgttcaccgacacgtacgacatcgaccacatctacccccggagcctgaccaaggacgactcctggcacaacatcgtcctcgtggagaagcagctgaacgccgagaagaccgaccgcttccccatcctgagcgccatccagtccaagcagaaggggttctggaagctcctgtgggaccgcggcttcatcagcgagaagaagtacgaccggctggtgcgcaccacggacctcaccgacgaggagctgaaccagttcatcaaccggcagatcgtctccaccaaccagagcgtgaaggccgtgaccacgctgctccaccagctgtacccggagaccgaggtcgtgttctccaaggccgagaacatcagcgacttccgccgggactacgggttcgtgaaggtccgcagcatcaaccaccaccaccacgcgaaggacgcctacctgaacatcgtggtgggcaacgtctaccacgagaagttcaccaagaacttcctctccttcgccaagcagaagggcacccaccggacgtacaacctgaccaagatgttcgagtacgagatcaagctgaccgaggagagcaagaaggtgatctgggaccccaacatccacatggacatcgtgaagaagatgatgaagtccaacgacgtccgcgtgacccagcgggccgtcccccagaagggcgggctcagcgacgagacgatctacaagaaggggatcgccaagcgcggcgtgtacctgcccctgaagtccagcgacgagcgggtgcgcgacgtcgagaagtacgggggccggacctccatcaccatcagcgagtacatcatcctcaacatccgcgacacctccgaccaggaccggatcgagatcttcagcctgccgctgtacatcgcgggcaagaaggacatccacaaggccatcgaggaggcctacctctccacgtgcaagaagcccgccagcgtggtggacatccagatcctgtaccgcgggctgtacatcggctccaaggtcaacatcaacgggttcacctactacatgggcgggaagaccggcagcaacgtgtccgtggacagcgcggtcgacgtggtgatggacatcacctccagcgtctacatcaagctcctggagaaggtggccatcaagaagatcgagaactccaagacgttccggatcgagaacatcaagaccagctacaaccacaaggaggtgaccgtcagcaaggagcagaacatcgccctgtaccaggagctcctgaagaagctggacacgcccctcttctccaagatgaagggcaacaagctggaggagttccgcaccgtggggttcgacaccttcatcgccctgagcctcgaggaccaggcctccgtgctgctggaggtcctcaacgtgctgaccaacttcaagaccaagcgggacatcacgaagatcggcatgaccagctcccgcagcaccctggggatcaacatctccaacaccgagcagttcagcgtgatcacgacctccatcaccggcctctacgagcaggagatcaagatcaagtga

SEQ ID NO: 2022 - RNA, 4131 nt, synthetic construct
  misc_feature 1..4131: note = Cas9 variant
  source 1..4131: mol_type = other RNA
atgaccaccaagaaccgcgagaagaacaacaagttccacaaggccagccccctgtacacgctcggcctggacatcgggaccacctccgtgggcttcaccgccatcgacgaggcgcagcggccgatgcgcgccaaggggaagacggtcatcggcgtgcggctgttccaggaggggcagagcgccgtgggccgcaagaacttccggaccacccgccggcgcctcaagcggcgccggcgccggctgaacctgctcaagcagttcttctccgcgcccctgcgcaagatcgaccccaccttcttcaagcggctgaaggccagctccctcagccccgccgacaagcgccggtacctggccccgggcctgttccccaacgggggcgacatcaagttctaccagaagtaccccacgatctaccacctccgcctggccctgatgaccgagaagcggcccttcgacctccgcgaggtctacctggccatccaccacatcgtgaagtaccgggggaacttcctgaacccgctccccgtgtccgcgttccgcggccgcaaccagcggttcgaggaccagttcagcgagctgaaccagctgtacaagtccctcgagggggagagccccttccagttcgacgagaagatcttctccgagctggacaagcagctgctcgtcaacgacggccgcaagatcgaccggcagaagcagctggccaagcgcgtgttcatcaagaccaacgagaagcggatcgacagccaccaccagaagatcgcctccgccttcagcaaggccgtgttcggctacaagttccgccccgacgtcctgctcaactccgacccgaacgagagcatcgacgagttcatcaagttcggggacgaggacttcgacgacaagctggtgatcctgcgggagtccctcaacgcgacccagaaggagatcctggccgtgacgcagcgcatctacagccagatcatcctgaacgagatcgtcccctcccgggagaccctcagcgaggccatggtgagccgctaccagaagcaccactccgacctgcagctgctcaccgaggcctgcaagaagatgaccaaggccaaggcggcccggatccaggccgcctacacggactacatcggcaagggggacggccacaagctggtgcacgaccagttcgtcgccctgatcaagaagaacctcgaccccagcgaggagggccgcgacctggcggagcggctggcccaggacgacttcatgcccctccagcgcaccccgctgaaccgggtgatcccccaccagctgcagcaggaggagctcgaccgcatcatcgagaaccagggggagtactaccccttcctgaagaccctgaaccccaaccggtcccgcgccggcgtggccaactaccagctcgacgagctggtcagcttccggatcccgtactacgtggggcccctgatcaccgccacggaccagctgcacacctccggcgcgaagttcgcctggatgacccgccgcgccgccggggagatcaccccctggaacttcgaccagaaggtggaccggctcgcgagcgccaaccagttcatccgccagaacatgcccaaggacaaccacctcctggaggccgacgtcctgccggccaactccctgacgtaccagcggtacctggtgctcgacgagctgaacgccgtgaaggtcaaccacaagagcctgaccgtgtcccagaagcagcgcatcttcaacgacctcttcaagcggcagcgcaccgtcaccgtgctgaacctgcagaactacctcaagagcatcgagaagctgcccacgctgcccgtgatcaccggcgtctccgacagcgagcggttcaagaccaccctctccacgtacctggacttcaagaacatcttcggcgggaaggtggacgacagctcccagaaggagaagttcgagaagatcatcctgtacgcgaccatcttcgaggaccacgccgtgtacaaggccaagctcgaccagatcgactggctgggccagcagcagaagaccgacctgctcagcaagaactaccaggggtggggccagctgtccgagaagctgctcctggggctgaagaaccaggccggccagagcatcctcgacgagctgtggcagaccaacaagcgcttccgggagatcatgaacgaggcccacttcgcgaagcagatcatggcctccaacgccgccctgctccgcaagaagggcctggacgacgtcctgagcacggccttcctcagcccccagaacaagaaggcgatccggcagaccgtggaggtggtcgacgacatcgtgaaggccatcgggtgcccgccccagaagatctccctgcacttcagcaaggcccccgccgacgcgatccgccacgagcgggacaacgccaacatcatcctgcgcacctaccggaacctcccggccaagatggtggacgaccagctgaaggccgagctgcaggccaccgcggagaagcaccaggtcctctccgacaagctgtacctgtacttcacccagctcggccgcgacctgtacacgggggagatgctgaagatgagcgagctcgagaacgacatgatcgaccacatcatgccccagaccttcgcctacgacgactccgtgaacaaccgggtgctggtcagccagaaccactccagccagctgggcaagacctccggggagaagtccgacgccaagatgatccgcttctggcaggtcctccgggacaacaagctgatcagcgagcagaagtaccagaacctgaccctcgacagcgaccacctgtccaagagcacgcgcgagcagctgctcaaccggtacctggtggagaagaaccccatcacccagtgggtggcctccgtgctgaccgagaagtacggcgacaacggcacccgcgtgctcacgatcaacccccgcatggtctaccagatgcggcgccagttcaacctggtgaacctgccggaggtgaacgactacgaccacgggctcgacgcctacctggcggccttcatcggcaactacgtcgaccggcgctacccccggctgcgcagctacttcgtgtacggggacttctccagcagcaaggagatcgtgttccggctcaaccgcttcaacttcctgttcgacctgggccaggccgagcccaacgagctcaccgactgggagaccggcgagatgatctgggacaaggccgccgcgaactccgtcctgcgggacgtgtaccagtacaagttcatgctgatcagccaggccgtgtactcccgccagggggccatgttcaaccagaccatctaccccgccagccaggcggccggccggcagctcatcccggtcaagaagaaccgcgccacgaagctgtacgggggctactccgggaacgtggacgcctacctggccatcgtgcggctcggcggccccaagagcgaccagtaccgcgtcgtggggatccccacccggatggtgggccgcctgcagtccgcgatgaagcagggggccgacacctacgccaacaccctgcacaagatcctccagccccagttcacgaagcggaagaagaaccgccagaccggctactacgaggagaccaccgagccgttcgccgtcatcctggacaaggtgtactaccggcagctgatcatcgacgggcagcagaagttcatgctcggcagctccacgtaccagttcaacgccaagcagctggtgctgagctcccgcgcgcgccagatcctcagcggcgaggagcggctgaccgacgagaacgggtcccaggacctgatcgacgtctacgacgagatcctcaccaagatcgaccgctacttcgagctgtacgaccagcggcacttccgccagagcctgcacgacggccggaagcagttcatctccctccccatccacaacgtgtaccgcgccaaccggctgatcgagcacgggaagtacgagaccctgagccagatcctcaacggcctgcacgccaacacgatgatgaccaacctgcgctacctcgggatctccagccccttcggcaagttccagtcccccaacggcatcaagctgagcaaggacgccgtgctggtctaccagagcccgtccgggctgttcgagcggcgcgtgcggctccgcgacctgtga

SEQ ID NO: 2023 - RNA, 4131 nt, synthetic construct
  misc_feature 1..4131: note = Cas9 variant
  source 1..4131: mol_type = other RNA
atgaacaacaagccctacagcatcggcctggacatcgggaccaactccgtgggctgggccgtcatcaccgacgactacaaggtgccgagcaagaagatgaaggtgctcgggaacacggacaagcacttcatcaagaagaacctgctgggcgccctcctgttcgacgaggggaccaccgcggaggaccgccggctgaagcgcaccgcccggcgccggtacacgcgccggaagaaccgcctccggtacctgcaggagatcttcaccgaggagatgtccaaggtcgacatcagcttcttccaccgcctggacgactccttcctcgtgcccgaggacaagcggggcagcaagtaccccatcttcgccaccctggaggaggagaaggagtaccacaagaacttccccaccatctaccacctccgcaagcacctggccgactccaaggagaaggccgacttccggctgatctacctggcgctcgcccacatcatcaagtaccgcggccacttcctgtacgaggagagcttcgacatcaagaacaacgacatccagaagatcttcaacgagttcatctccatctacgacaacacgttcgaggggagctccctgaacggccagaacgcccaggtggaggccatcttcaccgacaagatcagcaagtccgcgaagcgggagcgcgtcctcaagctgttcccggacgagaagtccaccgggctgttcagcgagttcctcaagctgatcgtgggcaaccaggccgacttcaagaagcacttcgacctggaggagaaggcgcccctccagttcagcaaggacacctacgacgaggacctggagaacctgctcgtgcagatcggggacgacttcgccgacctgttcctggtcgccaagaagctctacgacgccatcctgctgtccggcatcctcacggtgaccgaccccagcaccaaggcgcccctgtccgccagcatgatcgaccggtacgagaaccaccagaaggacctggccgccctcaagcagttcatcaagaccaacctgccggagaagtacgacgaggtgttcagcgaccagtccaaggacggctacgccgggtacatcgacggcaagacgacccaggaggccttctacaagtacatcaagaacctgctcagcaagctggagggggccgactacttcctggacaagatcgagcgcgaggacttcctccggaagcagcgcaccttcgacaacggctccatcccccaccagatccacctccaggagatgaacgccatcatccggcgccagggcgagcactaccccttcctgcaggagaacaaggagaagatcgagaagatcctgaccttccgcatcccctactacgtcgggccgctggcccggggcaaccgcgacttcgcgtggctgacgcggaacagcgaccaggccatccgcccctggaacttcgaggagatcgtggacaaggcccggtccgccgaggacttcatcaacaagatgaccaactacgacctctacctgcccgaggagaaggtgctgcccaagcacagcctgctctacgagaccttcgccgtctacaacgagctgaccaaggtgaagttcatcgcggaggggctgcgcgactaccagttcctcgactccggccagaagcagcagatcgtgacgcagctgttcaaggagaagcggaaggtcaccgagaaggacatcatccagtacctgcacaacgtggacagctacgacgggatcgagctcaagggcatcgagaagcagttcaacgcctccctgagcacctaccacgacctgctcaagatcatcaaggacaaggagttcatggacgactccaagaacgaggccatcctggagaacatcgtgcacaccctgacgatcttcgaggaccgcgagatgatcaagcagcggctcgcccactacgcgagcatcttcgacgagaaggtcatcaaggccctgacccgccggcactacaccggctgggggaagctgtccgccaagctcatcaacggcatctacgacaagcagagcaagaagaccatcctggactacctgatcgacgacggggagatcaaccgcaacttcatgcagctcatcaacgacgacggcctgtccttcaaggagatcatccagaaggcccaggtggtggggaagacgaacgacgtcaagcaggtcgtgcaggagctgccgggcagccccgccatcaagaagggcatcctccagtccatcaagctggtggacgagctggtgaaggtcatggggcacgcgcccgagagcatcgtgatcgagatggcccgggagaaccagaccaccgcccgcggcaagaagaactcccagcagcggtacaagcgcatcgaggacgccctcaagaacctggcccacgggctggacagcaacatcctcaaggagcaccccaccgacaacatccagctgcagaacgaccggctgttcctctactacctgcagaacggcaaggacatgtacacggggaagtccctggacatcaaccagctcagcagctgcgacatcgaccacatcatcccgcaggcgttcatcaaggacgactccctggacaaccgcgtgctgaccagctccaaggacaaccggggcaagagcgacaacgtcccctccctcgagatcgtgcagaagcgcaaggccttctggcagcagctgctggacagcaagctcatctccgagcgcaagttcaacaacctgaccaaggccgagcggggcgggctggacgagcgcgacaaggtgggcttcatcaagcggcagctcgtcgagacccgccagatcaccaagcacgtggcccagatcctggacgcccggttcaacacggaggtgaccgagaaggacaagaaggaccgcagcgtcaagatcatcaccctgaagtccaacctcgtgagcaacttccggaaggagttccgcctgtacaaggtgcgggagatcaacgactaccaccacgcgcacgacccctacctgaacgccgtcgtggccaaggccatcctcaagaagtaccccaagctggagccggagttcgtgtacggggactaccagaagtacgacctgaagcgctacatctcccggaccaaggaccccaaggaggtcgagaaggcgacggagaagtacttcttctacagcaacctcctgaacttcttcaaggaggaggtgcactacgccgacggcaccatcgtgaagcgcgagaacatcgagtactccaaggacaccggcgagatcgcctggaacaaggagaaggacttcgccaccatcaagaaggtcctgagcctcccccaggtgaacatcgtgaagaagacggaggagcagaccgtcgggcagaacggcgggctgttcgacaacaacatcgtgtccaagaagaaggtggtcgacgccagcaagctgacccccatcaagagcggcctctccccggagaagtacgggggctacgcgcggcccaccatcgcctacagcgtgctggtgatcgccgacatcgagaagggcaaggccaagaagctgaagcgcatcaaggagatggtcgggatcacggtgcaggacaagaagaagttcgaggccaaccccatcgcgtacctcgaggagtgcggctacaagaacatcaacccgaacctgatcatcaagctgcccaagtactccctcttcgagttcaacaacgggcagcggcgcctgctggccagctccatcgagctccagaagggcaacgagctgatcgtgccctaccacttcaccgccctgctctaccacgcccagcggatcaacaagatcagcgagcccatccacaagcagtacgtcgagacccaccagtccgagttcaaggagctgctgaccgccatcatcagcctctccaagaagtacatccagaagccgaacgtggagagcctgctgcagcaggcgttcgaccagtccgacaaggacatctaccagctcagcgagtccttcatcagcctgctgaagctcatctccttcggggcccccggcacgttcaagttcctgggcgtggagatcagccagtccaacgtccgctaccagagcgtgtccagctgcttcaacgccaccctgatccaccagagcatcaccgggctctacgagacccggatcgacctgtccaagctgggcgaggactga

SEQ ID NO: 2024 - RNA, 4131 nt, synthetic construct
  misc_feature 1..4131: note = Cas9 variant
  source 1..4131: mol_type = other RNA
atggacaagaagtacggcatcgggctggacatcggcaccagctccatcgggtggaccgtggtcgacaagtacggccacatcatccgcgtgaaggggcagacgggcatcggcgtgcggctgttccgcgaggggcagaccgccgccgagcggcgcaccttccggaccacgcgccggcgcctgagccggcgccggtggcgcctgcggctcctgcgcgagatcttcgacgagcccatctccgcgatcgacgagaacttcttcgcccggcagaaggccagctccctggccccgggcgacgcccgctaccagcaggcgttccagctgttcaacgaccggaccgaccaggccttctactgcaagtaccccaccatctaccacctccgccaggccctgatgaccgagagccggcagttcgacatccgcgagatctacctcgccctgcaccagatcatcaagtaccgggggcacttcctgctcggcggggcggccaaggacttccagtccgacaagctggacctggaggcctacttcacgaccatcaacgcccagctcgccggcatctacagcgacggctccgtccagctgcccaccctggactggaaccaggcgtgccaggagctcaccgacacgagccgcacccagtccgaccgcaagaactggctggtgaaggagctcaagagctacggggactcccagctcaagcccatctacacccagatcgccaacgccatcctgggcttcaagaccgacctggccaagatcatggggatcaacgacccggagaaggccctcagcttcaacctggacgcgctggacgaccaccgggacgacgtggccgagctcctgacggacgagcagatccccctggtcaacctcctggccaagctgcacaccgccctcgagctggccgcgatcctgcccgacggccagaccctctccggcaagatggtggagatctacgagacccaccgcaagcagctgaagacgtacaaggccttcatccggcagctgcccgaccgccagcagcggctcgccctgaagcaggcctacgaccactacatcgaccaggggctgaaccgcgaggccttctacagcgaggtgaaggcgatcctcgagaagcagaagccgctgaccgccaccggccaggccatgaagaaggccatggaccagaacgcgttcctgctcaagcagcggaccaagacgaacatcgccatcccctaccaggtccagcagcaggagatggaccagatcatcgccaaccagtccaagtactacccctggctggccacccccaacccggtgaagtcccgccgggtgatcgccccctacaagctggacgagctcgtctgcttccgcgtgaactactacgtggggcccctggtccagtccaagcccggcgaggcgaccaaggaggccaagttcgcctggatgacccggaaggacccgcagagcacggtggccatcaccccctggaacttcgaccagcaggtcgaccgccaggccagcgcgaacgccttcatccagcggatgaagaccaccgacacgtacctgctgggggaggacgtgatccccaagaactccctcctgtaccagaagtacgaggtgctgaacgagctcaacaacgtgcgcgtcaacggcgactggctggacccccagcggaagcagtacctgttcaagaagctgttcatggaccagccgcagagcgtggtgaccgtcaaggccctgcagaagaccctggtggtcatcggcgcctgccccaccctccccacggtggaggggctggccaaccccaagcgcttcctgtcccagctcaccacctaccacgacttctgcaagctgctgccggacgacatccagcgggcggaccgccaggccgacatcgagaagatcatcaactggagcaccatcttcgaggacaccgccatcttcaaggagaagctccgggacatcaagtggctgtccgccgaccagatccgccgcctgagctcccggccccgctaccggggctgggggcgcttcagcgcgaagctcctgtgcggcctgcacgaccggcaggggaacacggtgatggacgagctctggcagacctcccgcaacttcatgcagatcatccggcagagcgacttccagaccgccatcgccgccgtcaaccagcaggacctgggccgccaggacctgcagcgggtgatcgacgacctctacaccagcccccagaacaagaaggccatccgccaggtgctggcggtcgtgacggacatccagaaggccatgcacggcaaggcccccagctggctgttcgtggaggtcgccaagggggcccagaagaacccgcagcggacccagtcccgccagagcaagctcgcggaggcctaccgggagtccgcccgcgagctggtggacgaggccgtgaaggagcagctgctcaccctgcccgacgaccggcagaccttcagcgaccgcctggtcctctacttccagcagaacggccgggacatctacacgggggagcccctggacttcgagcgcctgtccaactaccacatcgaccacatcatcccgcaggccgtggtgaaggacgacagcctcgacaaccgggtcctgacctccaaccaggcgaacctggagaagggcgcccacgtgcccaccatcttccgcgacaagcaggagcccgtgtggcaggagctctaccgggtcgggctgatcagccaccgcaagctgcgcaacctcctgaccacgcccgacgacctggacgaccggggccgcgccaccggcttcatcgcccggcagctcgtggagacccgccaggtgatcaagctggtcatggaggtgctgagccagtactacgacaccacggagaccgagctcatctccatcaaggcggggctgagccaccagttccggcaggagctgaacctcccgaagctgcgcgccctgaacgactaccaccacgcccaggacgcctacctcgccgcgcggatcggcacctacctgctgcagcgctaccccaacctcaagcggttcttcgtgtacggggacttcaagaagacccacttcgacctgcagcgccggttcaacttcatcggcggcatgatctcccgcgagaagcagccctacaacctgatcaagaaccccgtcacgcaccaggtgatctgggacgaggagatggagatcggggactgccagaagaagaacccggagcagcccaagcacgacgccaccgtgaagatgatgaacctcaccaagatcatgaacctgaagcacatcctggtcacccacgaggtgtacgagaaccacggcgccctcttcaaccagacgatctaccccgccagccaggcccacaagaagaagctgatcccccagaagaccgagaagccgatcgagctgtacgggggccactccagcgagcaggcggggtacatggccatcatccggctcctgggcaagcgccccggctacaaggtgatgcgggtccccgtgcgctacgtgtcccagctgcagcaccaggacgtcgccgagcagaagaagctcctgtacaagatcttcgtgagcgagctgacctcccggaacaaggtgaagcccttcgaggtcgtggtgccgcacgtctgcctcaaccagcccgtggaggacatgatcaaggggcagtggcaccgcttcgccctgcggaccaacggctactaccagaaccagcagcagctgatcctcagcctggtggcccagcgcacgctggcggggtacaagcccaaggacgacgagctcatggccgtctaccacgagatctgcaagcaggtcaagtactacttccccctgtacaagatgaacaagttccagtcccgcctgttcgccgccgaggagctcctgcagaagcggagcaccgtgaactccttcagcatcaccatcggcaagaacgggaaggagaacaagaccctgaacctcggcaagcgcgagctgctgctccggctgctgggcgggctccacgccaacgcgacgcgcgtggacctgaaggacatcggctgcaccgggcagttcggccagctccaggtgaagaacgggatcaagctcaccgagcaggccgtgctgatccacgagtccccgaccggcctgttccaccggcgcgtccggctgaacgacctctga

SEQ ID NO: 2025 - RNA, 4134 nt, synthetic construct
  misc_feature 1..4134: note = Cas9 variant
  source 1..4134: mol_type = other RNA
atgaccaagaagaactacagcatcggcctggacatcgggaccaactccgtgggctgggccgtcatcacggacgactacaaggtgcccgccaagaagatgaaggtgctcgggaacaccgacaagaagtacatcaagaagaacctgctgggcgcgctcctgttcgacagcggggagaccgccgaggccacccgcctgaagcggacggcccgccggcgctacacccggcgcaagaaccggctccgctacctgcaggagatcttcgccgaggagatgaccaaggtcgacgagtccttcttctaccggctggacgagagcttcctcaccacggacgagaaggacttcgagcgccacccgatcttcggcaacaaggcggacgagatcaagtaccaccaggagttccccaccatctaccacctccggaagcacctggccgactccagcgagaaggccgacctgcgcctggtgtacctggccctcgcgcacatgatcaagttccggggccacttcctgatcgagggggagctgaacgccgagaacaccgacgtgcagaagatcttcgccgacttcgtcggcgtgtacgaccgcaccttcgacgactcccacctcagcgagatcacggtggacgccgcctccatcctgaccgagaagatcagcaagtcccggcgcctggagaacctcatcaagtactaccccaccgagaagaagaacaccctgttcgggaacctgatcgcgctcgccctgggcctgcagcccaacttcaagatgaacttcaagctcagcgaggacgccaagctgcagttctccaaggacagctacaacgaggacctggaggagctcctggggaagatcggcgacgactacgccgacctgttcacgtccgccaagaacctctacgacgcgatcctgctgagcggcatcctcaccgtcgacgacaactccaccaaggccccgctgagcgcctccatgatcaagcggtacgccgagcaccacgaggacctggagaagctcaaggagttcatcaaggccaacaagagcgagctgtaccacgacatcttcaaggacgagaccaagaacgggtacgcgggctacatcgagaacggggtgaagcaggacgagttctacaagtacctgaagaacacgctcagcaagatcgccggctccgactacttcctggacaagatcgagcgcgaggacttcctgcggaagcagcgcaccttcgacaacggcagcatcccccaccagatccacctccaggagatgcacgccatcctgcggcgccagggggactactaccccttcctgaaggagaaccaggaccgcatcgagaagatcctcaccttccggatcccctactacgtgggcccgctggcccgcaaggactcccggttcagctgggccgagtaccactccgacgagaagatcaccccctggaacttcgacaaggtcatcgacaaggagaagtccgcggagaagttcatcacgcgcatgaccctgaacgacctgtacctccccgaggagaaggtgctgcccaagcacagccacgtgtacgagacctacgccgtctacaacgagctgaccaagatcaagtacgtgaacgagcaggggaaggacagcttcttcgactccaacatgaagcaggagatcttcgaccacgtgttcaaggagaaccggaaggtcacgaaggagaagctcctgaactacctgaacaaggagttcccggagtaccgcatcaaggacctcatcggcctggacaaggagaacaagagcttcaacgcctccctggggacctaccacgacctcaagaagatcctggacaaggccttcctggacgacaaggtgaacgaggaggtgatcgaggacatcatcaagaccctcaccctgttcgaggacaaggacatgatccacgagcggctgcagaagtacagcgacatcttcacggcggaccagctcaagaagctggagcgccggcactacaccggctggggccgcctgtcctacaagctcatcaacgggatccggaacaaggagaacaacaagaccatcctggactacctgatcgacgacggcagcgccaaccgcaacttcatgcagctcatcaacgacgacaccctgcccttcaagcagatcatccagaagtcccaggtcgtgggggacgtggacgacatcgaggccgtcgtgcacgacctgcccggcagccccgccatcaagaaggggatcctccagtccgtcaagatcgtggacgagctggtgaaggtcatgggcgacaacccggacaacatcgtgatcgagatggcccgggagaaccagacgaccaaccgcggccggagccagtcccagcagcgcctgaagaagctccagaacagcctgaaggagctggggagcaacatcctcaacgaggagaagccctcctacatcgaggacaaggtggagaacagccacctccagaacgaccagctgttcctgtactacatccagaacggcaaggacatgtacaccggggacgagctggacatcgaccacctgtccgactacgacatcgaccacatcatcccccaggcgttcatcaaggacgacagcatcgacaaccgggtcctcacctccagcgccaagaaccgcggcaagtccgacgacgtgcccagcctggacatcgtgcgggcccgcaaggccgagtgggtccgcctgtacaagtccgggctcatcagcaagcggaagttcgacaacctgaccaaggccgagcgcggcggcctgacggaggcggacaaggccgggttcatcaagcggcagctcgtggagacccgccagatcaccaagcacgtggcccagatcctggacgcccggttcaacaccgagtccgacgagaacgacaaggtcatccgcgacgtgaaggtgatcacgctcaagagcaacctggtctcccagttccggaaggacttcgagttctacaaggtgcgcgagatcaacgactaccaccacgcccacgacgcgtacctgaacgccgtggtcggcaccgccctgctcaagaagtacccgaagctggccagcgagttcgtgtacggggagtacaagaagtacgacgtgcacaagctgatcgcgaagtccagcgacgaccactccgagatgggcaaggccaccgccaagtacttcttctacagcaacctcatgaacttcttcaagcgggtcatccgctacagcaacggcaaggtgatcgtgcggcccgtcgtggagtactccaaggacaccgaggacatcgcctgggacaagaagtccaacttccgcacgatctgcaaggtgctgagctacccccaggtcaacatcgtgaagaaggtggagacccagaccgggggcttcagcaaggagtccatcctgcccaagggggacagcgacaagctcatcccgcggaagaccaagaaggcctactgggacacgaagaagtacggcgggttcgactcccccaccgtcgcgtacagcgtgttcgtggtcgccgacgtggagaagggcaaggccaagaagctgaagaccgtgaaggagctggtcggcatctccatcatggagcgcagcttcttcgaggagaaccccgtggagttcctcgagaacaaggggtaccacaacatccgggaggacaagctgatcaagctgcccaagtactccctcttcgagttcgagggcgggaagcgccggctgctggccagcgcctccgagctccagaagggcaacgagatggtgatcccggggcacctggtcaagctgctctaccacgcgcagcgcatcaacagcttcaactccaccaagtacctggactacgtgagcgcccacaagaaggagttcgagaaggtgctgtcctgcgtcgaggacttcgccaacctctacgtggacgtggagaagaacctgagcaagatccgggccgtcgccgactccatggacaacttcagcatcgaggagatcagcaactccttcatcaacctgctcacgctgaccgcgctgggcgcccccgccgacttcaacttcctcggcgagaagatcccccgcaagcggtacaccagcaccaaggagtgcctgaacgccacgctgatccaccagtccatcaccgggctctacgagacccgcatcgacctgagcaagatcggcgaggagtga

SEQ ID NO: 2026 - RNA, 4134 nt, synthetic construct
  misc_feature 1..4134: note = Cas9 variant
  source 1..4134: mol_type = other RNA
atgaagaagccctacagcatcggcctggacatcgggaccaactccgtgggctgggccgtcatcaccgacgactacaaggtgccgagcaagaagatgaaggtgctcgggaacacggacaagcacttcatcaagaagaacctgatcggcgccctgctgttcgacgaggggaccaccgcggaggaccgccggctgaagcgcacctcccggcgccggtacacgcgccggaagaaccgcctgcggtacctccaggagatcttcagcgaggagatctccaagctggacagctccttcttccaccgcctggacgacagcttcctcgtccccgaggacaagcggggctccaagtaccccatcttcgccaccctggaggaggagaaggagtaccacaagaagttccccaccatctaccacctccgcaagcacctcgccgacagcaaggagaagaccgacctgcggctgatctacctcgccctggcccacatgatcaagtaccgcggccacttcctgtacgaggagtccttcgacatcaagaacaacgacatccagaagatcttcaacgagttcatcagcatctacgacaacacgttcgaggggtccagcctctccggccagaacgcccaggtggaggccatcttcaccgacaagatcagcaagtccaccaagcgggagcgcgtgctgaagctgttcagcgacgagaagtccaccgggctgttcagcgagttcctgaagctgatcgtcggcaaccaggccgacttcaagaagcacttcgacctcgaggagaaggccccgctgcagttcagcaaggacacgtacgacgaggacctggagaacctcctggggcagatcggcgacggcttcgcggacctgttcctcgtggccaagaagctgtacgacgccatcctgctctccgggatcctgaccgtgaccgaccccagcaccaaggcgcccctgtccgccagcatgatcgagcggtacgagaaccaccaggaggacctcgcggccctgaagcagttcatcaagaacaacctgtccgagaagtacgccgaggtcttcagcgaccagtccaaggacggctacgccgggttcatcgacggcaagacgacccaggaggccttctacaagtacatcaagaacctcctgagcaagctggagggcgcggactacttcctcaacaagatcgagcgcgaggacttcctgcggaagcagcgcaccttcgacaacgggtccatcccccaccagatccacctccaggagatgaacgccatcctccggcgccagggcgagcactacctgttcctgaaggagaaccgcgagaagatcgagaagatcctcgccttccggatcccgtactacgtggggcccctggcccgcggcaaccgggacttcgcctggctgacccgcaacagcgaccaggcgatccggccctggaacttcgaggaggtggtcgacaaggcctccagcgccgaggacttcatcaacaagatgacgaactacgacctgtacctccccgaggagaaggtgctgccgaagcactccctgctctacgagaccttcgccgtgtacaacgagctgaccaaggtcaagttcatcgccgaggggctgcgcgactaccagttcctcgacagcggccagaagaagcagatcgtgaaccagctgttcaaggacaagcggaaggtgaccgagaaggacatcatccactacctgcacaacgtcgacggctacgacgggatcgagctcaagggcatcgagaagcagttcaacgcgtccctgagcacgtaccacgacctgctcaagatcatcaaggacaaggagttcatggacaaccccaagaacggggagatcctggagaacatcatccacaccctgaccatcttcgaggaccgcgagatgatcaagcagcggctcgcccagtacgacaccctgttcgacgagaaggtgatcaaggccctgacgcgccggcactacaccggctgggggaagctctccgccaagctgatcaacggcatccgcgacaagcagaccggcaagaccatcctggagtacctcatcgacgacggggactgcaaccggaacttcatgcagctgatcaacgacgacggcctgagcttcaaggagatcatccagaaggcccaggtggtcgggaagacggacgacgtgaagcaggtcgtgcaggagatccccggctcccccgcgatcaagaaggggatcctccagagcatcaagatcgtggacgagctggtcaaggtgatgggccacaacccggagagcatcgtgatcgagatggcccgcgagaaccagaccaccgccaagggcaagaagaactcccagcagcggtacaagcgcatcgaggacgccctgaagaacctcgcgcccgggctggacagcaacatcctgaaggagaaccccaccgacaacatccagctccagaacgaccggctgttcctgtactacctccagaacggcaaggacatgtacacggggaaggccatcgacatcaaccagctgtccaactacgacatcgaccacatcatcccccaggccttcatcaaggacgacagcctggacaaccgcgtcctcacctccagcaaggacaaccggggcaagtccgacaacgtgccgagcatcgaggtggtccagaagcgcaaggccttctggcagcagctgctggactccaagctcatcagcgagcgcaagttcaacaacctgaccaaggccaagcggggcgggctggacgagcgcgacaaggtgggcttcatcaagcggcagctcgtggagacccgccagatcaccaagcacgtcgcgcagctgctggacacgcggttcaacaccgaggtgaacgaggagaaccagaagatccgcaccgtgaagatcatcaccctcaagtccaacctggtcagcaacttccggaaggagttcgggctgtacaaggtgcgcgagatcaacgactaccaccacgcccacgacgcctacctcaacgccgtggtcgccaaggcgatcctgaagaagtaccccaagctggagcccgagttcgtgtacggcgactaccagaagtacgacctcaagcggtacatcctgaagtccaaggccagcaacacgatcgacaaggccaccgagaagtacttcttctactccaacctgctcaacttcttcaaggagaaggtgcgctacgccgacgggaccatcaagaagcgggagaacatcgagtacagcaacgacaccggcgagatcgcgtggaacaaggagaaggacttcgccacgatcaagaaggtcctgtccctgccccaggtgaacatcgtgaagaagaccgaggagcagaccgtcggccagaacgggggcctcttcgacaacaacatcgtgagcaagaagaaggtggtcgacgccagcaagctgatcccgatcaagtccagcctgtcccccgagaagtacgggggctacgcccgccccaccatcgcctacagcgtgctcgtgatcgcggacatcgagaaggggaagggcaaggccaagaagctgaagcggatcaaggagatcgtcggcatcacgatccaggacaagaagaagttcgagtccaaccccgtgacctacctggaggagtgcgggtacaagaacatcaacagcaacctcatcatcaagctgccgaagtactccctgttcgagttcaacgacggccagcgccggctcctggccagctccatcgagctgcagaaggggaacgagctcatcctgccctaccacctgaccgccctcctgtaccacgcccagcgcatcaacaagatcagcgagcccatccacaagcagtacgtggaggcgcaccagaacgagttcaaggagctgctcaccacgatcatctccctgagcaagaagtacatccagaagccgaacgtcgagctgctcctgcagcaggccttcgaccaggccgacaaggacatctaccagctgtccgagagcttcatctccctcctgaagctgaccagcttcggcgcccccggggccttcaagttcctcggcgtggagatctcccagagctccgtgcggtacaagcccaacagccagttcctggacaccaccctgatccaccagagcatcacgggcctctacgagacccgcatcgacctgtccaagctgggggaggactga

SEQ ID NO: 2027 - RNA, 4134 nt, synthetic construct
  misc_feature 1..4134: note = Cas9 variant
  source 1..4134: mol_type = other RNA
atgaacaacaagccctacagcatcggcctggacatcgggaccaactccgtgggctggagcgtcatcaccgacgactacaaggtgccgtccaagaagatgaaggtgctcgggaacacggacaagcgcttcatcaagaagaacctgatcggcgccctgctgttcgacgaggggaccaccgccgaggcgcggcgcctgaagcggaccgcccgccggcgctacacgcggcgcaagaaccggctgcgctacctccaggagatcttcgccgaggagatgagcaaggtcgactccagcttcttccaccggctggacgactccttcctgatccccgaggacaagcgcggcagcaagtaccccatcttcgccaccctcgtggaggagaaggagtaccacaagcagttccccaccatctaccacctccggaagcagctggccgactccaaggagaaggcggacctccgcctgatctacctggtgctcgcccacatgatcaagtaccggggccacttcctgtacgaggaggccttcgacatcaagaacaacgacatccagaagatcttcaacgagttcatcagcatctacgacaacaccttcgaggggtccagcctgtccggccagaacgcccaggtcgagacgatcttcaccgacaagatcagcaagtccgcgaagcgcgagcgggtgctcaagctgttcccggacgagaagtccaccgggctgttcagcgagttcctcaagctgatcgtgggcaaccaggccgacttcaagaagcacttcgacctggaggagaaggcgcccctccagttcagcaaggacacctacgacgaggacctggagaacctgctcgagcagatcggggacgacttcgccgacctgttcgtcgccgcgaagaagctgtacgacgccatcctcctgtccggcatcctgacggtgaccgaccccagcaccaaggcgcccctcagcgcctccatgatcgagcgctacgagaaccaccagaaggacctggccgtgctgaagcagttcatcaagaccaacctcccggagaagtacgtcgaggtgttcagcgaccagtccaaggacggctacgccgggtacatcgacggcaagacgacccaggaggccttctacaagtacatcaagaacctgctgagcaagttcgacggggccgactacttcctcgacaagatcgagcgggaggtgttcctgcgcaagcagcggaccttcgacaacggctccatcccccaccagatccacctccaggagatgaacaccatcctgcgccgccagggcgagcactaccccttcctgaaggagaacaaggagaagatcgagaagatcctgacgttccggatcccctaccacgtcgggccgctcgcccgcggcaaccgggacttcgcctggctgacccgcaacagcgaccaggcgatccggccctggaacttcgaggagatcgtggacaaggcctccagcgccgaggacttcatcaacaagatgaccaactacgacctgtacctccccgaggagaaggtgctgcccaagcactccctgctgtacgagaccttcgccgtctacaacgagctcacgaaggtgaagttcatcgccgaggggatgcgcgactaccagttcctggacagcggccagaagaagaagatcatcaaccagctgttcaagaagaagcggaaggtgaccgaggacgacatcatcgactgcctccagaagatcgacaactacgacgggatcgagctgaagggcatcgagaagcagttcaacgcgtccctgagcacctaccacgacatcctcaagatcatccgcgacaaggagttcatggacgacccgaagaacggcgacatcctggagaacgtcatccacaccctgacgatcttcgaggaccgggagatgatcaagcagcgcctcgcccagtacaactccatcttcgacgagaaggtgatcaaggccctgagccggaagcactacaccgggtggggcaagctgtccgccaagctcatcgacgggatccgcgacaagcagaccggcaagaccatcctggactacctgatggacgacggcaagagcaaccggaacttcatgcagctcatcaaggacgacgagctgtccttcacggagatcatccagaaggcccaggtggtcggggacaccgacaacctgcgccaggtggtccagaacctccccggcagccccgccatcaagaaggggatcctgcagtccatcaagatcgtggacgagctggtgaaggtcatgggccacgcccccgagagcatcgtgatcgagatggcccgggagaaccagaccaccgcccgcgggaagaagaacagccagcagcggtacaagcgcatcgaggactccctcaagaacctggcgagcggcctggactccaacatcctcaaggagaacccgacggacaacatccagctgcagaacgaccggctgttcctctactacctgcagaacgggaaggacatgtacaccggcgaggccctgaacatcaaccagctcagctcctacgacatcgaccacatcatcccccaggccttcatcaaggacgacagcctggacaaccgcgtgctgacctccagcaaggacaaccgcggcaagtccgacaacgtccccagcctcgaggtggtggagaagatgaaggccttctggcagcagctgctggactccaagctcatcagcgagcggaagtacaacaacctgaccaaggccgagcgcgagcgcgggggcctgaacgagctcgacaaggtcgggttcatcaagcggcagctggtggagacccggcagatcacgaagcacgtggcgcagatcctggacgcccgcttcaacaaggaggtcaccgagaagaacaagaagaaccggaacgtgaagatcatcaccctcaagtccaacatggtgagcaacttccgcaaggagttcggcctgtacaaggtccgggagatcaacgactaccaccacgcccacgacgcctacctgaacgccgtggtggcgaaggccatcctcaagaagtaccccaagctggagccggagttcgtctacggcgactaccagaagtacgacctgaagcgctacatctcccggagcaaggaccccaaggaggtggagaaggccaccgagaagtacttcttctactccaacctcctgaacttcttcaaggaggaggtgcactacgccgacgggacgatcgtcaagcgcgagaacatcgagtacagcaaggacaccggcgagatcgcgtggaacaaggagaaggacttcgccaccatcaagaaggtgctgagcctcccccaggtgaacatcgtcaagaagaccgaggagcagacggtggggcagaacggcgggctgttcgacaacaacatcgtgtccaagaagaaggtcgtggacgccagcaagctgatccccatcaagtccggcctcagcccggagaagtacggcgggtacgcccggcccaccatcgcctactccgtgctggtcacctacaagcagaacaacaagatcaagaacaccatggtgggcatccccgtgctgacgaagctcgagttcgagcgcgacccgaacctgtacctgcggaacctcgggatcaacaacgtcagccacgtgatcaagctggtgaagtacaccgtcctggagttcaagcacaagtacggcacctaccgccggttcatcgtgtccaaccaggagctcaagcgcgcgaaccagatcttcgtgaccacgaagcagatgaagctgatcagccagtacaccaccctggacaagaacgagcacgactccctcctgaagaacaaccagcagctgatccagagcatctggaaccagttcctcgagttcatgctggccaccgacctggtcaacaagaagcagtacgacgagctcatcctgacgaacaaccagaccatcgaggagtgccggaacatcatgaaccgcgtgatcaccaccctgtccttcacgaacatcaacgccgggcagaagaagatcatcttcgacgacaccctcagcctgcccatcaagcggtggcagttcaccgactccgacaagatggtgaagaagatcatcgagagcaccctgatccaccagtccatcacgggcctctacgagacccgcatcgacctgagcaagctgggcgaggactga

SEQ ID NO: 2028 - RNA, 4134 nt, synthetic construct
  misc_feature 1..4134: note = Cas9 variant
  source 1..4134: mol_type = other RNA
atggagagcaaccacgacggcgagcaggtcaagtacaccctggggctcgacatcggcacctccagcatcgggtacgccgccatcgacaagcaccagaagcccatccgcgcgaagggcaagcacgtgatcggggtgcggctgttccaggagggccagacggccgccgaccgccgggccttccgcaccacccggcgccggctgaagcgccggaagtggcgcctcaacctgctgaaccgcctcttcgacccgtacctgtccgaggtggaccccaacttcctgccccggctccggcagagcaacctgtcccccaaggacgacaacaagcacttcaacggcagcaccctgttcccggacaagacggacgccgcgttctaccgccagtaccccaccatgtaccacctccggtacgccctgatgaccgagaagcgcaagttcgacatccgggaggtgtacctggccatccaccacatcgtgaagtaccgcgggaacttcctcaactccgccaccgtggacagcttcaagacgtccaacatcgacttcaccagccagttcgaccggctgaacgagctgtaccgccaggtcatcctcgacgagcccttccagatcaacatggaccaggtggacgagatgaccaacaagctgctggacaacgacgcgctcaagctggacacccagaagcaggtcgccaagctgctccccgtgatctacaacgacaagccgatcgacaagcagtacacgcggatcgccaccgagttctccaaggccatcctgggctacaagaccaagctggacgtgatcctcaacctggacacccagaacgccaaggactgggtgatccgcctggacgacgaggacatcgacgacaagctccccgcgctggtcgagaacctggacgagagccgccaggagatcgtgacgatcatccgggacctctacgcccagatcaccctgaacgccatcgtgcccaaggggaagtccctgagcgagtccatggtcgacaagtacaacgaccacaaggaccacctcgacctgctgatgggcctcatccacgagctgggggacgacagcgccaagggcatcaagctgcgcgaggcctacacccagtacgtgggcaagtccgacgacaagaccctcaaccaggacgacttctacgcggccatcaagaagaacctggacgaggacagcaagcggtcccccaagatccagcgcctgatcgagcaggccagcttcatgccgaagcagcggacgagcgccaacggggtgatcccccaccagctccaccagctggagctggaccgcatcatcgagaaccagggccggtactaccccttcctcaagaagcccaacccgaacacccacaagcccaacgggggcaagtacaagctggacgagctggtcgccttccgcatcccctactacgtgggccccctgatcaccaagcgggaccaggagaagacctccggggcggacttcgcctggatgatccgcaagccgggccaggagggggagatcacgccctggaacttcgaccagaaggtggaccggatggccagcgccaaccgcttcatccggcgcatgaccaccaaggactcctacctcgtcgccgaggacgtgctgcccgacgcgagcctgatctacgagaagttcaaggccctcaacgagctgaacatgctgaaggtgaacgactcccggctcagcccctcccagaagcaggacctgttcaacaacctgttcaagaagcagaagaccatccgcacgaagaagctccagacctacatccggaccaactgggagctgccgagcgtcatgatctccggcctggccgaccccgacaagttcaacagctccctcagcacctacatcgacttccgcgacatcttcggggagaaggtggacgaccccaaccggcaggccgactacgaggagatcatcgagtggtccacggtcttcgaggaccgcaagatctaccaggcgaagctgaaccagctggactggctcaccgagccccagcgcaaggccctgctgaccaagcggtacaccggctggggccgcctcagcaagaagctgctgacggggctcaaggaccagaacggcgactccatcctggaccagctgtggaagaccaacgacaacttcatgcagatccagagccgggacgagttcgccaagcagatccacgacgagaacgccaagcagttccacgaggccaacaacgtggacgacatcctcgacgacgcgttcacctccccgcagaacaagaaggccatccgccaggtggacaaggtcgtgcaggacgtggtcaaggccgtggggtacgcccccgacaagatcgccatcgagttcacccggagcctggagaacaacccccagcgcaccgtgtcccggcagcgccagctgcaggcggcctacaagaacatcccgcgggagatcatgaagtccggcctcatggccgagctggggagcgtcgccgacagcaagaaggtgctgagcgacaagctctacctgtacttcacgcagatgggcaaggacatgtacgaggacaagaccatcaacatcgacaacctgcccaactacgacatcgaccacatcctcccccaggccttcatcaaggacgactccatcgacaaccgcgtgctgatcagcaaggaggagaacgcgcggaagtccaaccgcgtccccctgaagttcttcggcgccaagcggatggggttctggaaggacctcctgaacaacggcctgatcagcaaccgcaagttccagaacctcaccaccgacccggagaagatctccaagtacagcgccaaggggttcatccaccggcagctggtggagacgtcccaggtgatccgcctggtcgccaacatcctcggcaacgagtacagccaggcggggaccaccatcatcgaggtgtccgccaagatgaaccggcagctgcgcgaggacttccacctgatcaagaaccggaacgtgaacgactaccaccacgccatggacgcctacctcaccgcctacgtcggcgactacctgtacctgcgctaccccaagctccggccctacttcgtgtacggcgacttcaagaaggcggaggaccaggacctgaacatccgcaacttcaacttcctgcacgacctcaaggacaacgagagcctggacaagatcgtggactccgagacgggggagatcgtctgggagaagcacggcagcgtgaagcagctgaagaaggtgtaccactacaagttcatgctcgtctcccaggaggtgtacacccgccaggacgccctgttcaaccagaccatctaccccgccagcgacgccgacaagcggaagctgatcccgatcaagaactccaagcccgtggacgtctacgggggctacagcggcaacatcgacgcctacatggcgatcgtgcgcgtgcacgggaagaaggaggacaactacaaggtcgtgggcatccccatgcgggccgtgaccaagctcaagaaggccgagaaggaggggcacgacagctacctgaacgccgtccacgaggtgctgaagccccagttcacgaagaagaagaagaaccgcaagaccggcgagatcaccgagaccgtggacgagttcgacgtcctcctggggaaggtgtactaccggcagctgatcgtggacggcaacaagaagttcatgctcggctccagctcctaccagtacaacgccaagcagctggtcctgagcgacaaggcgatgcaggtcctctccaagaacgggaaggtcaagagccaggacgagaaccagaacctgatcgacgtgtacgacgagatcctggagaaggtggaccagtacttcgagctctacgaccagcgccactaccgggagtccctgcacaagggccgcgggatcttcgtgaacctgccgctcagcaaccagtacgacggctccaagctgacgagctacgggaagtacgagaccatcgacgccatcctgaacggcctccacgccaacgccaccatgtccaacctgcggtacctgggcatcagctcccccttcgggaagatgcaggcgagcaacggcctcaccatcgaccccgactccatcatctgctaccagagccccacggggctgttcgagcgccagatcaagctgtccgacctctga

SEQ ID NO: 2029 - RNA, 4134 nt, synthetic construct
  misc_feature 1..4134: note = Cas9 variant
  source 1..4134: mol_type = other RNA
atgaacaagccctacagcatcggcctggacatcgggaccaactccgtgggctggagcatcatcaccgacgactacaaggtcccggccaagaagatgcgcgtgctcgggaacacggacaaggagtacatcaagaagaacctgatcggcgccctgctgttcgacgggggcaacaccgcggccgaccggcgcctgaagcggaccgcccgccggcgctacacccggcgccggaaccgcatcctgtacctccaggagatcttcgccgaggagatgtccaaggtggacgacagcttcttccaccggctggaggactccttcctggtcgaggaggacaagcgcggcagcaagtaccccatcttcgccacgatgcaggaggagaagtactaccacgagaagttccccaccatctaccacctccggaaggagctggcggacaagaaggagaaggccgacctgcgcctcgtgtacctggccctggcccacatcatcaagttccgggggcacttcctcatcgaggacgaccgcttcgacgtgcggaacaccgacatccagaagcagtaccaggcgttcctggagatcttcgacaccacgttcgagaacaaccacctcctctcccagaacgtcgacgtggaggccatcctgaccgacaagatcagcaagtccgccaagaaggaccgcatcctggcccagtaccccaaccagaagtccaccggcatcttcgccgagttcctcaagctgatcgtggggaaccaggcggacttcaagaagcacttcaacctggaggacaagaccccgctccagttcgccaaggacagctacgacgaggacctggagaacctgctcggccagatcggggacgagttcgccgacctgttcagcgtcgccaagaagctgtacgactccgtgctcctgagcggcatcctgacggtgaccgacctctccaccaaggcgcccctgagcgcctccatgatccagcggtacgacgagcaccacgaggacctgaagcacctcaagcagttcgtcaaggccagcctgcccgagaactaccgcgaggtgttcgccgactccagcaaggacggctacgccgggtacatcgagggcaagaccaaccaggaggccttctacaagtacctgctcaagctgctgacgaagcaggaggggagcgagtacttcctcgagaagatcaagaacgaggacttcctgcggaagcagcgcaccttcgacaacggctccatcccccaccaggtgcacctgaccgagctccgcgcgatcatccggcgccagagcgagtactacccgttcctgaaggagaaccaggaccggatcgagaagatcctgaccttccgcatcccctactacgtcggccccctcgcccgggagaagtccgacttcgcctggatgacgcgcaagaccgacgacagcatccggccctggaacttcgaggacctggtggacaaggagaagtccgccgaggccttcatccaccgcatgaccaacaacgacctgtacctgccggaggagaaggtgctccccaagcacagcctgatctacgagaagttcaccgtctacaacgagctgacgaaggtgcggttcctcgcggaggggttcaaggacttccagttcctgaaccgcaagcagaaggagaccatcttcaactccctgttcaaggagaagcggaaggtgaccgagaaggacatcatcagcttcctcaacaaggtcgacggctacgaggggatcgccatcaagggcatcgagaagcagttcaacgcctccctgagcacctaccacgacctgaagaagatcctcgggaaggacttcctggacaacacggacaacgagctgatcctcgaggacatcgtgcagaccctgaccctgttcgaggaccgcgagatgatcaagaagtgcctcgacatctacaaggacttcttcaccgagtcccagctgaagaagctgtaccggcgccactacacgggctggggccggctcagcgccaagctgatcaacgggatccgcaacaaggagaaccagaagaccatcctggactacctcatcgacgacggctccgcgaaccggaacttcatgcagctgatcaacgacgacgacctgagcttcaagcccatcatcgacaaggcccgcaccgggtcccacagcgacaacctcaaggaggtggtcggcgagctggccgggtcccccgccatcaagaagggcatcctgcagagcctcaagatcgtggacgagctggtcaaggtgatgggctacgagccggagcagatcgtggtcgagatggcccgggagaaccagaccacggcgaaggggctgtcccgcagccgccagcggctcaccaccctgcgcgagagcctggccaacctcaagtccaacatcctggaggagaagaagcccaagtacgtgaaggaccaggtggagaaccaccacctgagcgacgaccgcctcttcctgtactacctgcagaacggccgggacatgtacaccaagaaggccctcgacatcgacaacctgtcccagtacgacatcgaccacatcatcccccaggccttcatcaaggacgacagcatcgacaaccgggtcctggtgtccagcgccaagaaccgcgggaagtccgacgacgtgcccagcatcgagatcgtcaaggcgcggaagatgttctggaagaacctcctggacgccaagctgatgtcccagcgcaagtacgacaacctcaccaaggccgagcggggcgggctgacgagcgacgacaaggcccgcttcatccagcggcagctggtggagacccgccagatcaccaagcacgtggcccggatcctcgacgagcgcttcaacaacgaggtcgacaacggcaagaagatctgcaaggtgaagatcgtgaccctgaagtccaacctggtcagcaacttccggaaggagttcggcttctacaagatccgcgaggtgaacgactaccaccacgcgcacgacgcctacctcaacgccgtggtcgccaaggcgatcctgacgaagtacccgcagctggagcccgagttcgtgtacgggatgtaccggcagaagaagctctccaagatcgtgcacgaggacaaggaggagaagtacagcgaggccacccgcaagatgttcttctactccaacctgatgaacatgttcaagcgggtcgtgcgcctggccgacggcagcatcgtggtccggcccgtgatcgagaccgggcgctacatgcgcaagaccgcctgggacaagaagaagcacttcgccacggtgcggaaggtcctctcctacccccagaacaacatcgtgaagaagaccgagatccagaccggcggcttcagcaaggagagcatcctggcgcacgggaactccgacaagctgatcccgcgcaagaccaaggacatctacctcgaccccaagaagtacggcgggttcgacagccccatcgtggcctactccgtcctggtggtggccgacatcaagaagggcaaggcccagaagctgaagacggtcaccgagctcctggggatcaccatcatggagcggagccgcttcgagaagaacccctccgccttcctggagagcaagggctacctcaacatccgggacgacaagctgatgatcctgccgaagtactccctcttcgagctggagaacggccgccggcgcctgctcgcgagcgccggggagctgcagaagggcaacgagctggccctccccacccagttcatgaagttcctgtacctggcctcccggtacaacgagagcaaggggaagcccgaggagatcgagaagaagcaggagttcgtgaaccagcacgtgtcctacttcgacgacatcctccagctgatcaacgacttcagcaagcgcgtcatcctggccgacgcgaacctcgagaagatcaacaagctgtaccaggacaacaaggagaacatcccggtggacgagctggccaacaacatcatcaacctcttcacgttcacctccctgggcgcccccgccgcgttcaagttcttcgacaagatcgtggaccggaagcgctacaccagcaccaaggaggtcctgaactccacgctcatccaccagagcatcaccgggctgtacgagacccggatcgacctgggcaagctcggcgaggactga

SEQ ID NO: 2030 - RNA, 4134 nt, synthetic construct
  misc_feature 1..4134: note = Cas9 variant
  source 1..4134: mol_type = other RNA
atggagaagacctacagcatcggcctggacatcgggaccaactccgtgggctgggccgtcatcacggacgactacaaggtgcccgccaagaagatgaaggtgctcgggaacaccgacaagaagtacatcaagaagaacctgctgggcgcgctcctgttcgacagcggggagaccgccgaggccacccgcctgaagcgggccgcccgccggcgctacacgcggcgcaagaaccggctccgctacctgcaggagatcttcgcgaaggagatggccaaggtcgacgagtccttcttccagcggctggaggagagcttcctcaccgacgacgacaagaccttcgactcccacccgatcttcggcaacaaggccgaggaggacacctaccaccaggagttccccacgatctaccacctccgcaagcacctggccgacagccccgagaaggtggacctgcggctggtgtacctggcgctcgcccacatgatcaagttccgcggccacttcctgatcgaggggcagctgaacgccgagaacaccgacgtccagaagatcttcgccgacttcgtgggcgtgtacgaccggaccttcgacgactcccacctcagcgagatcaccgtcgacgccgcgtccatcctgacggagaagatcagcaagtcccgccggctggagaacctcatcaagcagtaccccaccgagaagaagaacaccctgttcgggaacctggtggccctcgccctgggcctgcagccgaacttcaagaccaacttcaagctcagcgaggacgccaagctgcagttctccaaggacacgtacgacgaggacctggaggagctcctggggaagatcggcgacgactacgccgacctgttcaccgcggccaagaacctctacgacgccatcctgctgagcggcatcctcaccgtggacgacaactccaccaaggcgcccctgagcgcctccatgatcaagcgctacgaggagcaccacgaggacctggagaagctcaagacgttcatcaaggtcaacaacttcgacaagtaccacgagatcttcaaggacaagagcaagaacgggtacgccggctacatcgagaacggggtgaagcaggacatcttctacaagcacctgaagtccatcatcagcgagaagaacggcggccagtacttcctggacaagatcgagcgggaggacttcctccgcaagcagcggaccttcgacaacgggagcatcccctaccagatccacctccaggagatgcgcaccatcctgcggcgccagggcgagtactaccccttcctgaaggagaaccaggccaagatcgagaagatcctgaccttccgcatcccgtactacgtggggcccctggcccggaagaactcccgcttcgcctgggccaagtaccacagcgacgagcccatcacgccctggaacttcgacgaggtcgtggacaaggagaagtccgcggagaagttcatcacccggatgaccctcaacgacctgtacctgccggaggagaaggtgctgcccaagcacagctacgtctacgagaccttcgccgtgtacaacgagctcacgaagatcaagtacgtgaacgagcagggcaagtccttcttcttcgacgccaacatgaagcaggagatcttcgaccacgtcttcaaggagaaccgcaaggtgaccaaggccaagctgctgagctacctcaacaacgagttcgaggagttccggatcaacgacctgatcgggctggacaaggactccaagagcttcaacgcgtccctcggcacctaccacgacctgaagaagatcctggacaagagcttcctcgacgacaagaccaacgagcagatcatcgaggacatcgtgctgacgctgaccctcttcgaggaccgcgacatgatccacgagcggctgcagaagtactccgacatcttcaccagccagcagctgaagaagctcgagcgccggcactacaccggctgggggcgcctgtcctacaagctgatcaacggcatccggaacaaggagaacaacaagacgatcctcgacttcctgatcgacgacggggacgccaaccgcaacttcatgcagctgatcaacgacgacagcctctccttcaagaccaccatccaggaggcccaggtcgtgggcgacgtcgacgacatcgaggccgtggtgcacgacctgcccgggagccccgccatcaagaagggcatcctgcagtccgtcaagatcgtggacgagctcgtgaaggtcatgggccacaacccgcagaacatcgtgatcgagatggcgcgggagaaccagatcaccgggtacggccgcaaccggagcaaccagcgcctgaagcggctgcaggactccctcaaggagttcgggagcgacatcctgagcaagaagaagccctcctacgtggacagcaaggtcgagaactcccacctccagaacgaccgcctgttcctgtactacatccagaacggcaaggacatgtacaccggggaggagctggacatcgaccacctcagcgactacgacatcgaccacatcatcccccaggccttcatcaaggacaactccatcgacaaccgggtgctgacgagctccgccaagaaccgcggcaagagcgacgacgtgccctccatcgagatcgtccgcaaccgcaagagctactggtacaagctgtacaagtccggcctcatcagcaagcggaagttcgacaacctgaccaaggccgagcgcgggggcctgaccgagaccgacaaggccgggttcatcaagcggcagctcgtggagacgcggcagatcaccaagcacgtggcgcagatcctggacgcccgcttcaacaccaagtgcgacgagaacgacaaggtcatccgggacgtgaaggtgatcaccctgaagtccagcctcgtctcccagttccgcaaggagttcaagttctacaaggtgcgggagatcaacgactaccaccacgcccacgacgcctacctgaacgccgtggtcggcacggcgctgctcaagaagtacccgaagctggcccccgagttcgtgtacggcgagtacaagaagtacgacgtgcgcaagctggtcgccaagagctccgacaaccacagcgagctcgggaaggccaccgcgaagtacttcttctacagcaacctgatgaacttcttcaagaccgaggtgaagtacgccgacggccgggtgttcgagcgccccgacatcgagaccaacgccgacggggaggtcgtgtggaacaagcagcgggacttcaacatcgtgcgcaaggtcctgtcctacccccaggtgaacatcgtgaagaaggtcgaggtgcagacgggcgggttcagcaaggagtccatcctcccgaagggcgacagcgacaagctgatcccccggaagaccaagaagctgcagtgggagacccagaagtacggcgggttcgactcccccaccgtggcctacagcgtcctcgtggtggccgacgtcgagaagggcaagacgcgcaagctgaagaccgtgaaggagctggtggggatctccatcatggagcggagctccttcgaggagaaccccgtcagcttcctcgagaagaagggctaccacaacgtgcaggaggacaagctgatcaagctgccgaagtactccctcttcgagttcgagggcgggcgccggcgcctgctggcgagcgccaccgagctccagaagggcaacgaggtggtcctgccccagtacatggtgaacctgctctaccactcccagcacgtgaacaacagccacaagcccgagcacctgaactacgtcaagcagcacaaggacgagttcaaggacatcttcaacctgatcatctccatcgcccggatcaacatcctcaagccgaaggtggtggacaacctgatcaacgagttcaccgagtacgggcaggaggacatcagctccctgagcgagtccttcatcaacctcctgaagttcatcagcttcggcgcccccggggccttcaagttcctgaagctcgacgtcaagcagagcaacctgcgctacaagtccacgaccgaggcgctgagcgccaccctcatccaccagtccgtgaccggcctgtacgagacgcgcatcgacctgagcaagctcggggaggagtga

SEQ ID NO: 2031 - RNA, 4137 nt, synthetic construct
  misc_feature 1..4137: note = Cas9 variant
  source 1..4137: mol_type = other RNA
atgaagaccttcgccgaggagtacgtgatggacaagagcaagccctacggcatcgggctggacatcggcaccaactccgtcgggttcgtggccacggacgcggagggccacctcatccgcctgaaggggaagaccgtgatcggcgcctacctgttcaacgccggcatcagcgccgccgagcggcgcgggttccggaccacccgccggcgcctctcccgggtcaagtggcgcctgggcctgctccgggagatcttcgagacgcacttccaggagagcatgggggagaacgaggacaacgacttcttcctgcgcttcaagtactccaacatcagccccaaggacccccagttctccaccgcgaagggcctgttcaacgaccggaccgacaaggagttctacgaccagtaccccaccatctaccacctccgccgggccctgatgacggaggaccaccagttcgacatccgcgagatctacatcgccatgcaccacatcgtgaagtaccgggggcacttcctgaaggagggccgcgccaaggacttcaaggtgggcgacctccggctgctggacaacttcaagatgatgaacgagcagatcgaggagatcaaccccctctggcagctgaagctgccgaccgacgacgcgagcatcaagtccatcaccgccatcctcctggacaacacccagagccagaacgaccgccagaaggccgtcacgaaggtgatcctggccaccctcgtgaaggcctccgacaaggacatcaacgcggcccggaagcgcttcgtcggggagctgagcaaggccatggtgggcctgaagaccaagctctgggtgctggccgacgtctcccagaacggggactgggagatcaagtacgagaactacgccgacttcgcggagaccatcggcagcggcgagtccgacacgatccagagcctgttcaacgagatcaacgacctctacggggtgatcaccctggccggcatcatccccaaggaggccgagtccttcagcgacgggatggtgcggaagtacgagcaccaccgcaagaacctggagctcctgaaggtctactgcgccgagcagtccgacggcaagcgcgggcggcagatccgccagacctacgacaagtacatcgacggcgtggacagcaagcagttcacccaggaggacttctacaaggccctgagcaagttcacggcgaaggacgaggccacctccgagaacgccaagctcatcgcccaggagatcgccgtgggcaccttcatgcccaagctgcggaccaaggcgaacgggacgatcccccaccagctgcaccagaaggagctcgacgccatcatcgagaaccagaagaagtactacccgtggctgggcgaggtcaaccccgtggagagccaccgccgggccctgccctacaagctcgacgagctggtgtccttccgcatcccctactacgtcgggccgatggtgacccccaccaagggcgaccccgagaagtccaagttcgcctggatggtgcggaaggagcccgggaccatcacgccgtggaacttcgaccagaaggtcgaccgcagcgcgagcggcgaggccttcatccagcggatgaagaccaccgacaccttcctgatcggcgaggacgtgctcccccagcagtccctgctgtaccagaagttcgaggtcctcaacgagctgaacaagatcatgatcaacgggaagcccatctgccgcgagcagaagcagcggctgttcaagcagctgttcatgcagtacaagacggtgaccgtgaagaaggtccagcagaacctcatcgccaacggcgaggagagcgagaacgtgcccatcaccgggctgtccgacccgctgcgcttcaacagctccttcagcacctacatcgactacaaggacatcctcggcacggccgccgtgaacgacaacgcgaagcagtccgacatcgagcagatcatcgcctggagcaccatcttcgaggacgccgccatcttccgggagaagctgaacgacatcacctggctgaacgacgaccagcgcaacaagctctcccacaagcggtaccgcgggtggggccggcacagccgcaagctgctggccggcctccgggacggggagggccagaccatcatcgagcgcctgtggaacaccaacgacaacttcatgcagatccagaacgactccgagatcgcgcgccagatcacggaggccaacagctccaagatggccaccgccgaggggaccgacgagatcatcgacggcttctacaccagccccgagaacaagaaggccctgcgggaggtcatgaaggtggtgaaggacatccagcgcgcgcaccacggccaggcccccgcctgggtctacatcgagagcccccgggagacgccgcgccccgggcagcggaccgtgtcccgcgagcagcagctcaccgacctgtacgagggcgccgcgaaggagatcgtggacgacgccgtcctgaacgagctcaaggacaaggtcaagagcaaggagaacttcaccgacaagctggtgctgtacttcctccagaacgggcacgacatctacgccaacgactccatcaacatcgacaacctgaacgcctacgacatcgaccacgtgctgccccagagcctcatcaaggacgactccctggacaaccgggtgctgacgacccacgagcgcaacctcaagaagtccaaccggttcgccaccgagctgttcgcggaccagcgcaagaagtgggagaagtggcaccggctgggcctcatcagcagccgcaagctgaagcacctgaccatgcagcccaactccgtggagaagttcgcccacgggttcatcgcccggcagctcacggagacccgccagatcatccacctgaccgccaacgtcctgagcaacctctaccaggagaacgacaccaagatcgtgatgatcaaggccggcctgaactccgagttccggcgcacgttcgacttcccgaagaaccggagcgtgaacgactaccaccacgcgttcgacgccttcctgaccgccaagatcggccgctacctcctggcccggtaccccaagctggagcccttcttcgtctacgggaacttcgtgaagaacccgaaggccatgaagcgcctctccagcttcgacttcatcgcgcagctggccgccaagaccgacgacacctcccacatcgaccagcggagcctgaagcaggtccccgtggtgaacgaggagacgggcgagatcgtgtgggacaaggacatcgagctcgccgagctggacaagacctacaactacaagaccatgctggtcaagcgcgcgcagaccgagaacaacgcccagatgttcaagcagacggtgttcaaggcccgcgacaaccagaacaagaccctcatccccgtgaagaacgggctgtccaccgacgtctacggcgggcacagccagcaggccatcagctacctgtgcatcgtgtgggtgggccagaagaagaagtaccgggtcctcggcatctccaccgcccacgcggggatcctgaacaacttcgagaagaactacggccgcttcgaggccaagaagaagctgcaggagatcgtgagcaacacgctcgacaacgccgaccggaacgacttcaagatcgtggcccccaaggtcctgttcgagcaggtcgtggaggacgacaacatgaagttcgggctgggctccgccagcgactaccgcaacgtgcagcagctgttcctctcccggaagaaccagctgctcctggcgaacatgatgaccgaccagatccacgaccaggacctggtgcacctcttcgacgagatcgtggggcagatgaacgcccacttcccgatcttcgaccgcggcggctaccggagctccctgacccagagccgcgacaagttcctgaagctccccttcaagaagaacgaggacctgatcaccaagcaggaggtcatccggcgcatcctggacgggctccacgccaacgccaaccggaaggacctgaagatcatcggctccaagggggacttcggccgcctggggacgaagaagatctacctcagcaaggacgccaagctgatctacacctccccgacctgcctgttcacccggacggtgcccctcagctccctgtga

SEQ ID NO: 2032 - RNA, 4137 nt, synthetic construct
  misc_feature 1..4137: note = Cas9 variant
  source 1..4137: mol_type = other RNA
atgaccaacgagaagtacagcatcggcctggacatcgggacctccagcatcggcttcgccgtggtcaacgacaacaaccgcgtgatccgggtgaaggggaagaacgccatcggcgtccgcctcttcgacgaggggaaggcggccgccgaccggcgctccttccggacgacccgccggcgcctgagccggcgccggtggcgcctgaagctcctgcgggagatcttcgacgcctacatcacccccgtggacgaggccttcttcatccgcctgaaggagtccaacctcagcccgaaggactccaagaagcagtacagcggcgacatcctgttcaacgaccggtccgacaaggacttctacgagaagtaccccaccatctaccacctccgcaacgcgctgatgacggagcaccggaagttcgacgtgcgcgagatctacctggccatccaccacatcatgaagttccggggccacttcctgaacgccacccccgccaacaacttcaaggtcgggcgcctcaacctggaggagaagttcgaggagctgaacgacatctaccagcgggtgttccccgacgagagcatcgagttccgcaccgacaacctcgagcagatcaaggaggtgctgctggacaacaagcgctcccgggcggaccgccagcggaccctcgtcagcgacatctaccagtccagcgaggacaaggacatcgagaagcgcaacaaggccgtggccacggagatcctgaaggcctccctgggcaacaaggccaagctcaacgtgatcaccaacgtcgaggtggacaaggaggcggccaaggagtggagcatcaccttcgactccgagagcatcgacgacgacctggccaagatcgaggggcagatgaccgacgacggccacgagatcatcgaggtgctgcggtccctctacagcgggatcacgctgagcgccatcgtcccggagaaccacaccctgtcccagagcatggtggccaagtacgacctccacaaggaccacctgaagctgttcaagaagctcatcaacggcatgaccgacaccaagaaggcgaagaacctgcgcgccgcctacgacggctacatcgacggggtgaagggcaaggtcctgccccaggaggacttctacaagcaggtccaggtgaacctcgacgactccgccgaggccaacgagatccagacgtacatcgaccaggacatcttcatgcccaagcagcggaccaaggcgaacgggagcatcccccaccagctgcagcagcaggagctggaccagatcatcgagaaccagaaggcctactacccgtggctcgccgagctgaaccccaaccccgacaagaagcgccagcagctggccaagtacaagctcgacgagctggtgaccttccgggtgccctactacgtgggcccgatgatcaccgccaaggaccagaagaaccagtccggcgcggagttcgcctggatgatccgcaaggagcccgggaacatcacgccctggaacttcgaccagaaggtcgaccggatggccaccgccaaccagttcatcaagcgcatgaccaccacggacacctacctgctcggcgaggacgtgctgcccgcgcagagcctgctctaccagaagttcgaggtcctgaacgagctgaacaagatccggatcgaccacaagccgatctccatcgagcagaagcagcagatcttcaacgacctcttcaagcagttcaagaacgtgaccatcaagcacctccaggactacctggtgagccaggggcagtactccaagcgccccctgatcgagggcctggccgacgagaagcggttcaacagctccctgagcacctactccgacctgtgcgggatcttcggcgccaagctcgtcgaggagaacgaccgccaggaggacctggagaagatcatcgagtggagcacgatcttcgaggacaagaagatctaccgggccaagctgaacgacctcacctggctgaccgacgaccagaaggagaagctggccaccaagcgctaccagggctgggggcggctctcccgcaagctgctggtgggcctcaagaacagcgagcaccgcaacatcatggacatcctgtggatcacgaacgagaacttcatgcagatccaggcggagcccgacttcgccaagctggtgaccgacgccaacaaggggatgctcgagaagaccgactcccaggacgtcatcaacgacctgtacaccagcccccagaacaagaaggccatccggcagatcctgctcgtggtgcacgacatccagaacgccatgcacggccaggcgccggccaagatccacgtcgagttcgcccgcggggaggagcggaacccccgccggtccgtgcagcgccagcgccaggtggaggccgcctacgagaaggtcagcaacgagctggtgagcgcgaaggtgcggcaggagttcaaggaggccatcaacaacaagcgggacttcaaggaccgcctgctcctgtacttcatgcagggcggcatcgacatctacacggggaagcagctgaacatcgaccagctctccagctaccagatcgaccacatcctgccccaggccttcgtcaaggacgactccctgaccaaccgggtgctcaccaacgagaaccaggtgaaggccgacagcgtccccatcgacatcttcggcaagaagatgctgtccgtgtgggggcgcatgaaggaccagggcctgatcagcaaggggaagtaccggaacctcaccatgaacccggagaacatctccgcgcacaccgagaacggcttcatcaaccgccagctggtggagacgcggcaggtcatcaagctggccgtgaacatcctcgccgacgagtacggcgacagcacccagatcatctccgtgaaggccgacctgagccaccagatgcgcgaggacttcgagctgctcaagaaccgggacgtcaacgactaccaccacgccttcgacgcgtacctggccgccttcatcgggaactacctgctcaagcgctaccccaagctggagtcctacttcgtgtacggcgacttcaagaagttcacccagaaggagaccaagatgcggcgcttcaacttcatctacgacctgaagcactgcgaccaggtggtcaacaaggagacgggggagatcctctggaccaaggacgaggacatcaagtacatccggcacctgttcgcctacaagaagatcctggtgagccacgaggtgcgcgagaagcgcggcgccctctacaaccagaccatctacaaggcgaaggacgacaagggctccgggcagggcagcaagaagctgatccggatcaaggacgacaaggagaccaagatctacgggggctactccggcaagagcctggcctacatgacgatcgtccagatcaccaagaagaacaaggtgtcctaccgcgtgatcgggatccccaccctcgccctggcccggctgaacaagctcgagaacgacagcaccgagaacaacggcgagctgtacaagatcatcaagccccagttcacgcactacaaggtcgacaagaagaacggggagatcatcgagaccaccgacgacttcaagatcgtggtgagcaaggtccgcttccagcagctgatcgacgacgccggccagttcttcatgctcgcgtccgacacctacaagaacaacgcccagcagctggtgatcagcaacaacgccctgaaggccatcaacaacacgaacatcaccgactgcccgcgggacgacctcgagcgcctggacaacctgcggctcgactccgcgttcgacgagatcgtgaagaagatggacaagtacttcagcgcctacgacgccaacaacttccgcgagaagatccggaactccaacctgatcttctaccagctgcccgtcgaggaccagtgggagaacaacaagatcaccgagctcgggaagcgcaccgtgctgacgcggatcctgcagggcctccacgccaacgccaccaccaccgacatgagcatcttcaagatcaagacgcccttcgggcagctgcgccagcggtccggcatcagcctgtccgagaacgcgcagctcatctaccagagcccgaccggcctgttcgagcgccgggtgcagctgaacaagatcaagtga

SEQ ID NO: 2033 - RNA, 4137 nt, synthetic construct
  misc_feature 1..4137: note = Cas9 variant
  source 1..4137: mol_type = other RNA
atgaagaacaaggactacagcatcgggctggacatcgggacctccagcatcggcttcgccgtggtcgacgagaacaaccacgtgatgcgcgtgaaggggaagaacgccatcggcgtccggctgttcgacgaggggaagcccgcggccgaccgccgggccttccgcaccacgcggcgccggctgtcccgccggcgctggcggctgaagctcctgcgcgagatcttcgacagctacatcaccccggtggacgaggccttcttcatccggctgaaggagtccaacctcagccccaaggactccaagaagcagtacagcggcgacatcctgttcaacgaccgctccgacaaggacttctacaccaagtaccccaccatctaccacctccggaacgccctcatgacggagcaccagcgcttcgacatccgggagatctacctggcgatccaccacatcgtgaagttccgcggccacttcctgaacgccacccccgccaacaacttccaggtcgggaagctcgacctggaccagaagttcgaggacctgaacgacatctaccagcgggtgttcccggacgacagcatcgagttccgcatcgacaacctcgagcagatcaaggccgtgctgctggactccaagcggagccgctccgaccgccagcggagcctcgtcgacgacgtgtaccagacctccgaggacaaggaggtggagaagcagaacaaggcggtcgccaccgaggtgctgaaggccatcctgggcaacaaggccaagctcaacatcatcgccaacgtggaggtcgacaaggaggcggccaaggagtggacgatcaccttcgacagcgagtccatcgacgacgacctggccaagatcgacgggcagatgaccgacgacggccgcgccatcgtggagatcctgcggagcctctactccgggatcaccctgagcgccatcgtgcccgagaaccacacgctgagccaggcgatggtcgccaagtacgacctccacaagaagcacctgaccctgctcaagaagctgatcaactccatgaccgacaccaagaaggccaagaacctgcgcgccgcctacgacggctacgtggacggcgtgaaggggaaggtcctcacgcaggacgagttctacaagcagatccagagcaacctggacgagtccgtggaggcgagcgagatccagacctacatcgaccaggacatcttcatgcccaagcagcggaccaaggccaacggctccatcccccaccagctgcagcagcaggagctcgaccagatcatcgagaaccagaaggagtactacccgtggctggccgagctgaaccccaaccccgacaagaagcgccagcagctcgccaagtacaagctggacgagctggtgaccttccgggtcccctactacgtggggccgatgatcacggccgaggcgcagaagaagcagagcggcgccgagttcgcctggatgatccgcaaggagtccggcaacatcaccccctggaacttcgaccagaaggtcgaccggatggccaccgcgaaccagttcatcaagcgcatgaccacgaccgacacctacctcctgggggaggacgtgctgcccagccagtccctcctgtaccagcggttcgaggtgctgaacgagctcaacaagatccgcatcgaccggaagcccatcagcgtcgagctgaagcagcagatcttcaacgacctgttcaagaagttcaagaacgtgaccatcaagcacctccaggactacctcgtggcccagggccagtactccaagcgcccgctgatcgaggggctggccgacgagaagcggttcaacagcggcctctccacgtacaacgacttctgcgggatcttcggcgccaagctggtcgacgagaacgaccgccaggccgacctggagaagatcatcgagtggagcaccatcttcgaggacaagaagatctaccgggcgaagctcaacgacctggcctggctgaccgacgagcagaaggacaagctcgccaccaagcgctaccagggctgggggcggctgtccagcaagctgctcatcggcctgcagaactccgagcaccgcaacatcatggacctgctctggatcgggaacgagaacttcatgcagatccaggccgacagcgacttcgccaagctgatcaaggacgcgaaccagaacgccctgcagaacaacgactcccaggacgtgatcaacgacctctacacgagcccccagaacaagaaggccatccgccagatcctgctggtggtccacgacatccagaacgccatgcacggccaggcccccaccaagatccacgtggagttcgcgaagggggaggagcggaacccccgccggagcgtgcagcgccagcggcaggtcgaggccgcctacgagaaggcctccaacgagctcgtgggcgcgaacgtgcgcgaggagctgaaggacgccatcaccaacaagcgggacttcaaggaccgcctgttcctctacttcatgcagggcggggtcgacatgtacagcggcgagccgatcaacatcgacaacctgtcccggtacgacatcgaccacatcctgccccaggccttcgtgaaggacgacagcctcaacaaccgcgtgctgaccgacgccgagaagaaccggcgcaagtccgacgccgtccccaacgagctgttcggggcgaagatgcgggtgacgtgggagcgcatgaaggagcagggcctcatcagcaaggggaagtaccggaacctgaccatgaaccccgagaacatcaacaagtacaccgagaacggcttcatcaaccgccagctggtggagacccggcaggtcatcaagctcgccgtgaacatcctggccgacgagtacaaggagaacacccagatcatctccgtgaaggccgacctgagccaccagatgcgcgaggacttcgagctcctgaagaaccgggacgtcaacgactaccaccacgccttcgacgcgtacctggccgccttcatgggcaactacctcctgaagcgctacccgaagctgcggtcctacttcgtgtacggggacttcaagaagttcacgcagaaggagatcaagctccgccgcttcaacttcatctacgacctgaagcacgaggaccaggtgatcgacaaggagaccggcgagatcctgtggaacaagaacgaggacatcgcctacatccggcacctcttcgcctacaagaagatcctgatcagccacgaggtctccgagcgccgcggggcgctgtacaaccagaccgtgtacaaggccagcgacgacaaggcctccggccagggcagcaagaagctcatccccatcaagtccgacaagcccaccgagatctacgggggctacacggggcggaccctggcctacatgaccatcgtgaaggtcaccaagggcaagaagatcagctacaaggtggtgggggtccccacggcggtgctggccaagatggccggcgtgcggcagggctcccaggaggagcaggacaagctctacggggtcctgaagccgcagttcacccaccagaaggagaacaagaagaccggcgagatcaccgagacggtggacaagttcgacatcatcgtgcccaaggtcaagtaccagcagctggtgaacgacaacgggcagctgttcatgatcggcagcgacaccctgccctacaacgccgagcagctggtgctcagcaaggagtccgtccagaccatcaacaacccggggatcaaggacgagggcagcgacgaggagtccgagaacaagaagctggacaacgtgtacgacgagatcgtgctgtgcatgaacaagtacttccccctctacgacaaccgcggcttccggaacagcatcaccaacgggaagaacaagttcctgaagctgcccatcaagaacatctacaagaacggcaagctcatcaacgtcgggaagcgcgaggtgatcaaccggatcctgcagggcctgcacgccaacgcgtccgtgacggacctcagcaacctggggatcaagtcccccttcggcttcctgcagaagggcgccgggctcagcctgtccggcgaggcccagctgatccaccagagcgccaccggcctcttcgagcaccgcgtccagctgaacaagatcaagtga

SEQ ID NO: 2034 - RNA, 4137 nt, synthetic construct
  misc_feature 1..4137: note = Cas9 variant
  source 1..4137: mol_type = other RNA
atgagcaacaagccctactccatcggcctggacatcgggaccaacagcgtgggctgggccgtcatcaccgacgactacaaggtgccgtccaagaagatgaaggtgctcgggaacacggacaagcacttcatcaagaagaacctgatcggcgccctgctgttcgacgaggggaccaccgcggagggccgccggctgaagcgcaccgcccggcgccggtacacgcgccggaagaaccgcctgcggtacctccaggagatcttcagcgaggagatctccaaggtcgacagctccttcttccaccgcctggacgacagcttcctggtgcccgaggacaagcggggctccaagtaccccatcttcgccaccctcgccgaggagaaggagtaccacaagaacttccccaccatctaccacctccgcaagcagctggccgacagcaaggagaaggcggacctccggctgatctacctggccctcgcccacatgatgaagtaccgcgggcacttcctgtacgaggagtccttcgacatcaagaacaacgacatccagaagatcttcaacgagttcatcagcatctacgacaacaccttcgagggctccagcctgtccgagcagaacgtgcaggtcgaggccatcttcacggacaagatcagcaagtccgcgaagcgggagcgcgtgctcaagctgttcccggacgagaagtccaccgggctgttcagcgagttcctcaagctgatcgtgggcaaccaggccgagttcaagaagcacttcgacctggaggagaaggcgcccctccagttcagcaaggacacctacgacgaggacctggagaacctgctcgggcagatcggcgacggcttcgccgacctgttcctggtcgccaagaagctctacgacgccatcctgctgagcgggatcctcaccgtgacggacccctccaccaaggcgcccctgagcgcctccatgatcgagcggtacgagaaccaccagaaggacctggccagcctcaagcagttcatcaagaacaacctgccggccgagaagtgcgtggaggtcttctccgaccagagcaaggacggctacgccgggtacatcgacggcaagaccacccaggaggccttctacaagtacatcaagaacctgctctccaagctggagggcgcctactacttcctggacaagatcgagcgcgaggacttcctccggaagcagcgcacgttcgacaacgggagcatcccccaccagatccacctccaggagatgaacgccatcctgcggcgccagggcgagcactaccccttcctgaaggagaaccgcgagaagatcgagaagatcctgaccttccggatcccctaccacgtggggccgctggcccgcggcaaccgggacttcgcgtggctcacccgcaactccgacgaggccatccggccctggaacttcgaggagatcgtggaccaggccagctccgccgaggacttcatcaacaagatgaccaactacgacctgtacctgcccgaggagaaggtcctgcccaagcacagcctcctgtacgagacgttcgccgtgtacaacgagctgaccaaggtgaagttcatcgcggaggggctcacccgctaccagttcctggacaagaagcagaagaaggacatcttctacaccttcttcaaggccgaggacaagcggaaggtcacggagaaggacatcatccactacctgcacaacgtggacggctacgacggcatcgagctcaaggggatcgagaagcagttcaacgcctccctgagcacctaccacgacctgctcaagatcatcaaggacaaggagttcatggacgacccgaagaacgaggagatcctggagaacatcgtgcacaccctgaccatcttcgaggaccgcgagatgatcaagcagcggctcgcccagtacgactccctgttcgacgagaaggtcatcaaggcgctgacgcgccggcactacaccggctgggggaagctcagcgccaagctgatcaacggcatctgcgacaagcagaccgggaagaccatcctggactacctcatcgacgacggcaagatcaaccgcaacttcatgcagctgatcaacgacgacggcctgtccttcaaggagatcatccagaaggcccaggtggtggggaagacgtacgacgtcaagcaggtcgtgcaggagctccccggcagccccgccatcaagaaggggatcctgcagtccgtgaagctggtggacgagctcgtcaaggtgatgggccacgcccccgagagcatcgtgatcgagatggcgcgggagaaccagaccaccgccaaggggaagaagaacagccagcagcgctacaagcggatcgaggacgccatcaagaacctggccccgggcctggactccaccatcctcaaggagcaccccacggacaacatccagctgcagaacgaccgcctgttcctctactacctgcagaacggccgggacatgtacaccgggaagcccctggagatcaaccagctcagcaactacgacatcgaccacatcatcccccaggccttcatcaaggacgactccctggacaaccgcgtcctgaccagctccaaggagaaccggggcaagagcgacaacgtgccgtccctcgaggtggtcgagaagatgaaggcgttctggcagcagctgctggacagcaagctcatctccgagcgcaagttcaacaacctgaccaaggccgagcgcgggggcctggacgagctcgacaaggtgggcttcatcaagcggcagctggtggagacccgccagatcacgaagcacgtcgcccagatcctggacgcccggttcaacaaggaggtgaccgagaagaacaagaagaaccgcaacgtgaagatcatcaccctcaagagcaacatggtctccaacttccggaaggagttcgggctgtacaaggtgcgcgagatcaacgactaccaccacgcccacgacgcgtacctgaacgccgtggtcgccaaggccatcctcaagaagtaccccaagctggagcccgagttcgtgtacggcgactaccagaagtacgacctgaagcggtacatcagcaagtccaaggaccccaaggaggtggagaaggcgaccgagaagtacttcttctacagcaacctcctgaacttcttcaaggaggaggtccactacgccgacgggacgatcgtgaagcgcgagaacatcgagtactccaaggacaccggcgagatcgcctggaacaaggagaaggacttcgccaccatcaagaaggtgctgagcttcccgcaggtcaacatcgtgaagaagaccgaggagcagacggtggggcagaacggcggcctcttcgacaacaacatcgtctccaaggagaaggtggtggacgccagcaagctgatccccatcaagagcgggctgtcccccgagaagtacggcgggtacgcgcggccgaccatcgcctacagcgtcctcgtgacctacaagcagaacaacaagatcaagaacaccatggtgggcatccccgtcctgacgaagctggagttcgagcgcgaccccaacctctacctgcggaacctggggatcaacaacgtgtcccacgtgatcaagctcgtcaagcacaccgtgctggagttcaagcacaagtacggcacctaccgccggttcatcgtgagcaaccaggagctgaagcgcgccaaccagatcttcgtcaccacgaagcagatgaagctcatctcccagtacaccaccctggacaagaacgagcacgacagcctgctcaagaacaaccagcagctgatccagtccatctggaaccagttcctggagttcatgctcgccaccgacctggtgaacaagaagcagtacgacgagctgatcctcacgaacaaccagaccatcgaggagtgccggaacatcatgaaccgcgtgatcaccaccctgagcttcacgaacatcaacgccggccagaagaagatcatcttcgacgacaccctgtccctccccatcaagcggtggcagttcaccgacagcgacaagatggtcaagaagatcatcgagtccaccctgatccaccagagcatcacggggctgtacgagacccgcatcgacctcaacaagctgggcgaggactga

SEQ ID NO: 2035 - RNA, 4137 nt, synthetic construct
  misc_feature 1..4137: note = Cas9 variant
  source 1..4137: mol_type = other RNA
atgaacaagccctacagcatcggcctggacatcgggaccaactccgtgggctggagcatcatcaccgacgactacaaggtcccggccaagaagatgcgcgtgctcgggaacacggacaaggagtacatcaagaagaacctgatcggcgccctgctgttcgacgggggcaacaccgcggccgaccggcgcctgaagcggaccgcccgccggcgctacacccggcgccggaaccgcatcctgtacctccaggagatcttcgccgaggagatgtccaaggtggacgacagcttcttccaccggctggaggactccttcctggtcgaggaggacaagcgcggcagcaagtaccccatcttcgccacgatgcaggaggagaagtactaccacgagaagttccccaccatctaccacctccggaaggagctggcggacaagaaggagaaggccgacctgcgcctcatctacctggccctggcccacatcatcaagttccgggggcacttcctcatcgaggacgaccgcttcgacgtgcggaacaccgacatccagaagcagtaccaggcgttcctggagatcttcgacaccacgttcgagaacaacgacctgctctcccagaacgtggacgtcgaggccatcctgaccgacaagatcagcaagtccgccaagaaggaccgcatcctggcccggtaccccaaccagaagtccaccggcatcttcgccgagttcctcaagctgatcgtggggaaccaggcggacttcaagaagcacttcaacctggaggacaagaccccgctccagttcgccaaggacagctacgacgaggacctggagaacctgctcggccagatcggggacgagttcgccgacctgttcagcgccgccaagaagctgtacgactccgtgctcctgagcggcatcctgacggtcatcgacctctccaccaaggcgcccctgagcgcctccatgatccagcgctacgacgagcaccacgaggacctgaagcacctcaagcagttcgtgaaggccagcctgcccgagaactaccgggaggtgttcgccgactccagcaaggacggctacgccgggtacatcgagggcaagaccagccaggaggcgttctacaagtacctgctcaagctgctgaccaagcaggaggggtccgagtacctcctggagaagatcaagaacgaggacttcctgcgcaagcagcgcacgttcgacaacggcagcatcccccaccaggtccacctcaccgagctgcgggccatcatccgccggcagtccgagtactacccgttcctgaaggagaacctcgaccgcatcgagaagatcctgaccttccggatcccctactacgtgggccccctggcccgcgagaagtccgacttcgcctggatgacccggaagacggacgacagcatccgcccctggaacttcgaggacctggtggacaaggagaagtccgccgaggcgttcatccaccggatgaccaacaacgacctctacctgccggaggagaaggtcctgcccaagcacagcctcatctacgagaagttcaccgtgtacaacgagctgaccaaggtgcgcttcctggccgaggggttcaaggacttccagttcctcaaccggaagcagaaggagacgatcttcaacagcctgttcaaggagaagcgcaaggtcaccgagaaggacatcatctccttcctgaacaaggtggacggctacgaggggatcgccatcaagggcatcgagaagcagttcaacgccagcctctccacctaccacgacctgaagaagatcctggggaaggacttcctcgacaacaccgacaacgagctgatcctggaggacatcatccagacgctcaccctgttcgaggaccgggagatgatcaagaagcgcctggacatctacaaggacttcttcaccgagagccagctcaagaagctgtaccggcgccactacaccggctggggccggctgtccgcgaagctcatcaacgggatccgcaacaaggagaaccagaagacgatcctggactacctgatcgacgacggcagcgccaaccggaacttcatgcagctcatcaaggacgccgggctgtccttcaagcccatcatcgacaaggcccgcaccggcagccactccgacaacctgaaggaggtggtcggggagctcgccggcagccccgcgatcaagaagggcatcctgcagtccctgaagatcgtggacgagctcgtgaaggtcatggggtacgagccggagcagatcgtggtcgagatggcccgcgagaaccagaccaccgccaagggcctgagccggagccgccagcggctgacgaccctccgcgagtccctggggaacctcaagagcaacatcctcgaggagaagaagcccaagtacgtgaaggaccaggtggagaaccaccacctgtccgacgaccggctgttcctctactacctgcagaacggcaaggacatgtacaccgacgacgagctggacatcgacaacctcagccagtacgacatcgaccacatcatcccccaggccttcatcaaggacgactccatcgacaaccgcgtcctggtgagctccgccaagaaccggggcaagagcgacgacgtgccctccatcgagatcgtcaaggcgcgcaagatgttctggaagaacctgctcgacgccaagctgatgagccagcggaagtacgacaacctgaccaaggccgagcgcgggggcctcacctccgacgacaaggcccggttcatccagcgccagctggtggagacgcggcagatcaccaagcacgtggcccgcatcctggacgagcggttcaacaacgagctcgacagcaaggggcgccggatccgcaaggtcaagatcgtgaccctgaagtccaacctggtgagcaacttccggaaggagttcggcttctacaagatccgcgaggtcaacaactaccaccacgcgcacgacgcctacctcaacgccgtggtggccaaggcgatcctgaccaagtacccgcagctggagcccgagttcgtctacgggctctaccggcgcaagaagctgtccaagatcgtgcgcgaggacaaggaggagaagtacagcgaggccacgcggaagatgttcttctactccaacctgatgaacatgttcaagcgcgtggtccggctcgccgacggcagcatcgtggtgcgccccgtcatcgagaccggccggtacatggggaagaccgcctgggacaagaagaagcacttcgccaccgtgcgcaaggtgctgagctacccccagaacaacatcgtcaagaagacggagatccagaccggcgggttctccaaggagagcatcctggcgcacggcaactccgacaagctcatcccgcggaagaccaaggacatctacctggaccccaagaagtacgggggcttcgacagccccatcgtggcctactccgtgctggtcgtggccgacatcaagaagggcaaggcccagaagctcaagaccgtgacggagctgctggggatcaccatcatggagcgcagccggttcgagaagaacacctccgccttcctcgagagcaagggctacctgaacatccgcgacgacaagctgatgatcctccccaagtactccctgttcgagctggagaacgggcggcgccggctcctggcgagcgccggcgagctgcagaaggggaacgagctcgccctgccgacccagttcatgaagttcctgtacctcgcctcccgctacaacgagagcaagggcaagcccgaggagatcgagaagaagcaggagttcgtcaaccagcacgtgtcctacttcgacgacatcctgcagctgatcaacgacttcagcaaccgggtgatcctcgccgacgcgaacctggagaagatcaacaagctgtaccaggacaacaaggagaacatccccgtcgacgagctcgccaacaacatcatcaacctgttcacgttcacctccctgggcgccccggccgcgttcaagttcttcgacaagatcgtggaccgcaagcggtacaccagcaccaaggaggtgctcaactccacgctgatccaccagagcatcaccgggctgtacgagacccgcatcgacctcggcaagctgggggagggctga

SEQ ID NO: 2036 - RNA, 4137 nt, synthetic construct
  misc_feature 1..4137: note = Cas9 variant
  source 1..4137: mol_type = other RNA
atgaccaacgagaagtacagcatcggcctggacatcgggacctccagcatcggcttcgccgtggtcaacgacaacaaccgcgtgatccgggtgaaggggaagaacgccatcggcgtccgcctcttcgacgaggggaaggcggccgccgaccggcgctccttccggacgacccgccggcgcctgagccggcgccggtggcgcctgaagctcctgcgggagatcttcgacgcctacatcacccccgtggacgaggccttcttcatccgcctgaaggagtccaacctcagcccgaaggactccaagaagcagtacagcggcgacatcctgttcaacgaccggtccgacaaggacttctacgagaagtaccccaccatctaccacctccgcaacgcgctgatgacggagcaccggaagttcgacgtgcgcgagatctacctggccatccaccacatcatgaagttccggggccacttcctgaacgccacccccgccaacaacttcaaggtcgggcgcctcaacctggaggagaagttcgaggagctgaacgacatctaccagcgggtgttccccgacgagagcatcgagttccgcaccgacaacctcgagcagatcaaggaggtgctgctggacaacaagcgctcccgggcggaccgccagcggaccctcgtcagcgacatctaccagtccagcgaggacaaggacatcgagaagcgcaacaaggccgtggccacggagatcctgaaggcctccctgggcaacaaggccaagctcaacgtgatcaccaacgtcgaggtggacaaggaggcggccaaggagtggagcatcaccttcgactccgagagcatcgacgacgacctggccaagatcgaggggcagatgaccgacgacggccacgagatcatcgaggtgctgcggtccctctacagcgggatcacgctgagcgccatcgtcccggagaaccacaccctgtcccagagcatggtggccaagtacgacctccacaaggaccacctgaagctgttcaagaagctcatcaacggcatgaccgacaccaagaaggcgaagaacctgcgcgccgcctacgacggctacatcgacggggtgaagggcaaggtcctgccccaggaggacttctacaagcaggtccaggtgaacctcgacgactccgccgaggccaacgagatccagacgtacatcgaccaggacatcttcatgcccaagcagcggaccaaggcgaacgggagcatcccccaccagctgcagcagcaggagctggaccagatcatcgagaaccagaaggcctactacccgtggctcgccgagctgaaccccaaccccgacaagaagcgccagcagctggccaagtacaagctcgacgagctggtgaccttccgggtgccctactacgtgggcccgatgatcaccgccaaggaccagaagaaccagtccggcgcggagttcgcctggatgatccgcaaggagcccgggaacatcacgccctggaacttcgaccagaaggtcgaccggatggccaccgccaaccagttcatcaagcgcatgaccaccacggacacctacctgctcggcgaggacgtgctgcccgcgcagagcctgctctaccagaagttcgaggtcctgaacgagctgaacaagatccggatcgaccacaagccgatctccatcgagcagaagcagcagatcttcaacgacctcttcaagcagttcaagaacgtgaccatcaagcacctccaggactacctggtgagccaggggcagtactccaagcgccccctgatcgagggcctggccgacgagaagcggttcaacagctccctgagcacctactccgacctgtgcgggatcttcggcgccaagctcgtcgaggagaacgaccgccaggaggacctggagaagatcatcgagtggagcacgatcttcgaggacaagaagatctaccgggccaagctgaacgacctcacctggctgaccgacgaccagaaggagaagctggccaccaagcgctaccagggctgggggcggctctcccgcaagctgctggtgggcctcaagaacagcgagcaccgcaacatcatggacatcctgtggatcacgaacgagaacttcatgcagatccaggcggagcccgacttcgccaagctggtgaccgacgccaacaaggggatgctcgagaagaccgactcccaggacgtcatcaacgacctgtacaccagcccccagaacaagaaggccatccggcagatcctgctcgtggtgcacgacatccagaacgccatgcacggccaggcgccggccaagatccacgtcgagttcgcccgcggggaggagcggaacccccgccggtccgtgcagcgccagcgccaggtggaggccgcctacgagaaggtcagcaacgagctggtgagcgcgaaggtgcggcaggagttcaaggaggccatcaacaacaagcgggacttcaaggaccgcctgttcctctacttcatgcagggcggcatcgacatctacacggggaagcagctgaacatcgaccagctgtccagctaccagatcgaccacatcctcccccaggccttcgtcaaggacgactccctgaccaaccgggtgctgaccaacgagaaccaggtgaaggccgacagcgtccccatcgacatcttcggcaagaagatgctctccgtgtgggggcgcatgaaggaccagggcctgatcagcaaggggaagtaccggaacctgaccatgaacccggagaacatctccgcgcacaccgagaacggcttcatcaaccgccagctcgtggagacgcggcaggtcatcaagctggccgtgaacatcctggccgacgagtacggcgacagcacccagatcatctccgtgaaggccgacctcagccaccagatgcgcgaggacttcgagctgctgaagaaccgggacgtcaacgactaccaccacgccttcgacgcgtacctcgccgccttcatcgggaactacctgctgaagcgctaccccaagctcgagtcctacttcgtgtacggcgacttcaagaagttcacccagaaggagaccaagatgcggcgcttcaacttcatctacgacctgaagcactgcgaccaggtggtcaacaaggagacgggggagatcctgtggaccaaggacgaggacatcaagtacatccggcacagcttcgcctacaagaagatcctcgtgtcccacgaggtgcgcgagaagcgcggcgccctgtacaaccagaccatctacaaggcgaaggacgacaagggcagcgggcagggctccaagaagctgatccggatcaaggacgacaaggagaccaagatctacgggggctacagcgggaagtccctcgcctacatgacgatcgtccagatcaccaagaagaacaaggtgagctaccgcgtgatcggcatccccaccctggccctggcccggctcaacaagctggagaacgacagcaccgagaacaacggcgagctgtacaagatcatcaagccccagttcacgcactacaaggtcgacaagaagaacggggagatcatcgagaccaccgacgacttcaagatcgtggtgtccaaggtccgcttccagcagctcatcgacgacgccggccagttcttcatgctggcgagcgacacctacaagaacaacgcccagcagctggtgatctccaacaacgccctcaaggccatcaacaacacgaacatcaccgactgcccgcgggacgacctggagcgcctggacaacctccggctggacagcgcgttcgacgagatcgtgaagaagatggacaagtacttctccgcctacgacgccaacaacttccgcgagaagatccggaacagcaacctgatcttctaccagctccccgtcgaggaccagtgggagaacaacaagatcaccgagctggggaagcgcaccgtgctgacgcggatcctccagggcctgcacgccaacgccaccaccaccgacatgtccatcttcaagatcaagacgcccttcgggcagctgcgccagcggagcggcatctccctcagcgagaacgcgcagctgatctaccagtccccgaccggcctgttcgagcgccgggtgcagctcaacaagatcaagtga

SEQ ID NO: 2037 - RNA, 4137 nt, synthetic construct
  misc_feature 1..4137: note = Cas9 variant
  source 1..4137: mol_type = other RNA
atgaccaacgagaagtacagcatcggcctggacatcgggacctccagcatcggcttcgccgtggtcaacgacaacaaccgcgtgatccgggtgaaggggaagaacgccatcggcgtccgcctcttcgacgaggggaaggcggccgccgaccggcgctccttccggacgacccgccggcgcctgagccggcgccggtggcgcctgaagctcctgcgggagatcttcgacgcctacatcacccccgtggacgaggccttcttcatccgcctgaaggagtccaacctcagcccgaaggactccaagaagcagtacagcggcgacatcctgttcaacgaccggtccgacaaggacttctacgagaagtaccccaccatctaccacctccgcaacgcgctgatgacggagcaccggaagttcgacgtgcgcgagatctacctggccatccaccacatcatgaagttccggggccacttcctgaacgccacccccgccaacaacttcaaggtcgggcgcctcaacctggaggagaagttcgaggagctgaacgacatctaccagcgggtgttccccgacgagagcatcgagttccgcaccgacaacctcgagcagatcaaggaggtgctgctggacaacaagcgctcccgggcggaccgccagcggaccctcgtcagcgacatctaccagtccagcgaggacaaggacatcgagaagcgcaacaaggccgtggccacggagatcctgaaggcctccctgggcaacaaggccaagctcaacgtgatcaccaacgtcgaggtggacaaggaggcggccaaggagtggagcatcaccttcgactccgagagcatcgacgacgacctggccaagatcgaggggcagatgaccgacgacggccacgagatcatcgaggtgctgcggtccctctacagcgggatcacgctgagcgccatcgtcccggagaaccacaccctgtcccagagcatggtggccaagtacgacctccacaaggaccacctgaagctgttcaagaagctcatcaacggcatgaccgacaccaagaaggcgaagaacctgcgcgccgcctacgacggctacatcgacggggtgaagggcaaggtcctgccccaggaggacttctacaagcaggtccaggtgaacctcgacgactccgccgaggccaacgagatccagacgtacatcgaccaggacatcttcatgcccaagcagcggaccaaggcgaacgggagcatcccccaccagctgcagcagcaggagctggaccagatcatcgagaaccagaaggcctactacccgtggctcgccgagctgaaccccaaccccgacaagaagcgccagcagctggccaagtacaagctcgacgagctggtgaccttccgggtgccctactacgtgggcccgatgatcaccgccaaggaccagaagaaccagtccggcgcggagttcgcctggatgatccgcaaggagcccgggaacatcacgccctggaacttcgaccagaaggtcgaccggatggccaccgccaaccagttcatcaagcgcatgaccaccacggacacctacctgctcggcgaggacgtgctgcccgcgcagagcctgctctaccagaagttcgaggtcctgaacgagctgaacaagatccggatcgaccacaagccgatctccatcgagcagaagcagcagatcttcaacgacctcttcaagcagttcaagaacgtgaccatcaagcacctccaggactacctggtgagccaggggcagtactccaagcgccccctgatcgagggcctggccgacgagaagcggttcaacagctccctgagcacctactccgacctgtgcgggatcttcggcgccaagctcgtcgaggagaacgaccgccaggaggacctggagaagatcatcgagtggagcacgatcttcgaggacaagaagatctaccgggccaagctgaacgacctcacctggctgaccgacgaccagaaggagaagctggccaccaagcgctaccagggctgggggcggctctcccgcaagctgctggtgggcctcaagaacagcgagcaccgcaacatcatggacatcctgtggatcacgaacgagaacttcatgcagatccaggcggagcccgacttcgccaagctggtgaccgacgccaacaaggggatgctcgagaagaccgactcccaggacgtcatcaacgacctgtacaccagcccccagaacaagaaggccatccggcagatcctgctcgtggtgcacgacatccagaacgccatgcacggccaggcgccggccaagatccacgtcgagttcgcccgcggggaggagcggaacccccgccggtccgtgcagcgccagcgccaggtggaggccgcctacgagaaggtcagcaacgagctggtgagcgcgaaggtgcggcaggagttcaaggaggccatcaacaacaagcgggacttcaaggaccgcctgttcctctacttcatgcagggcggcatcgacatctacacggggaagcagctgaacatcgaccagctgtccagctaccagatcgaccacatcctcccccaggccttcgtcaaggacgactccctgaccaaccgggtgctgaccaacgagaaccaggtgaaggccgacagcgtccccatcgacatcttcggcaagaagatgctctccgtgtgggggcgcatgaaggaccagggcctgatcagcaaggggaagtaccggaacctgaccatgaacccggagaacatctccgcgcacaccgagaacggcttcatcaaccgccagctcgtggagacgcggcaggtcatcaagctggccgtgaacatcctggccgacgagtacggcgacagcacccagatcatctccgtgaaggccgacctcagccaccagatgcgcgaggacttcgagctgctgaagaaccgggacgtcaacgactaccaccacgccttcgacgcgtacctcgccgccttcatcgggaactacctgctgaagcgctaccccaagctcgagtcctacttcgtgtacggcgacttcaagaagttcacccagaaggagaccaagatgcggcgcttcaacttcatctacgacctgaagcactgcgaccaggtggtcaacaaggagacgggggagatcctgtggaccaaggacgaggacatcaagtacatccggcacctcttcgcctacaagaagatcctggtgagccacgaggtgcgcgagaagcgcggcgccctgtacaaccagaccatctacaaggcgaaggacgacaagggctccgggcagggcagcaagaagctcatccggatcaaggacgacaaggagaccaagatctacgggggctactccggcaagagcctggcctacatgacgatcgtccagatcaccaagaagaacaaggtgtcctaccgcgtgatcgggatccccaccctggccctcgcccggctgaacaagctggagaacgacagcaccgagaacaacggcgagctctacaagatcatcaagccccagttcacgcactacaaggtcgacaagaagaacggggagatcatcgagaccaccgacgacttcaagatcgtggtgagcaaggtccgcttccagcagctgatcgacgacgccggccagttcttcatgctggcgtccgacacctacaagaacaacgcccagcagctcgtgatcagcaacaacgccctgaaggccatcaacaacacgaacatcaccgactgcccgcgggacgacctggagcgcctcgacaacctgcggctggactccgcgttcgacgagatcgtgaagaagatggacaagtacttcagcgcctacgacgccaacaacttccgcgagaagatccggaactccaacctcatcttctaccagctgcccgtcgaggaccagtgggagaacaacaagatcaccgagctggggaagcgcaccgtgctcacgcggatcctgcagggcctgcacgccaacgccaccaccaccgacatgagcatcttcaagatcaagacgcccttcgggcagctccgccagcggtccggcatcagcctgtccgagaacgcgcagctgatctaccagagcccgaccggcctcttcgagcgccgggtgcagctgaacaagatcaagtga

SEQ ID NO: 2038 - RNA, 4140 nt, synthetic construct
  misc_feature 1..4140: note = Cas9 variant
  source 1..4140: mol_type = other RNA
atgaagcagatcctgggcctcgacctggggaccaccagcatcggctgggccctggtgcgcgaggccgagaacaaggacgagcagtccagcatcgtccggatcggggtgcgcgtgaaccccctcacgtccgacgagcagaagaacttcgagcagggcaagagcatcaccaccaacgcggaccggaccctgaagcgctccatgcggcgcaacctgcagcggtacaagctccgccgggaccacctgaaggactgcctgcagaagaacgggatcatcacggacaaggccgtcctcagcgagaacggcaactacaccaccttccagacctactacctgcgcgccaaggccgtgaacgagaagatctccctggaggagttcgcccgggtgctcctgatgctgaacaagaagcgcggctacaagagctcccggaagatgaagtccgcggacgaggggcagctcatcgacggcatgagcgtcgccaagcgcctgtacaacgacaacatcacgccggggcagtacgtgctgagcctcctggaggagggccggaagtacatccccgacttctaccgctccgacctgctcgacgagctggacaagatctggaccttccagcagtgcttctaccccgagatcctgacccccgagtgccggaagctcatcgccgggaagggcaagcaggccaccgcgaagatcttcctgggcaagtacaagatctacacggccgacaacaagagcaaggacaagcgcctgcaggcctaccagtggcgggtggaggccctctccgggcagctgccgatcgaggtcgtggccttcgtggtctgcgagatcaacggcgcgatccaggccagctccgggtacctgggcgccatcagcgaccgctccaaggagctctacttcgagggcctgaccgtggggcagtacctggtgaagcagctcgagaagaaccccgacaccagcctgaagaacaaggtcttctaccggcaggactacctgaacgagttcgagaagatctgggagaagcaggccgagtaccacaccgagctcacgccccagctgaagaaggaggtgcgcgacatcatcatcttctaccagcgcaccctcaagagccagaagggcctggtggggttctgcgagttcgagtcccggcagatcgaggtcatgatcgacggcaagctgaagaagaagaccgtggggtgccgcgtgtgccccaagagctccccgctgttccaggagtacaagatctggcacaacctcaacaacctgaagatcgtcgagaaggagctgggcaagagccggttcctcaaccaggacgagaaggagtccctgttccaggagctgaacatcaaggagaagctcagcaagaccgacatcctgaagctgctgtgcctcaaggccaaggagttcgacctgaacttcgagaaggtggagggcaaccgcacgcaggcggagctgttccgggcctaccaggccatcatcgagatgtccgggaacggcgactacgacttcagcaagatgacctccagcgagatccaggacaccgtgaccggggtcttccgcggcctcgggtacaacacggacatcctgtccttcgacgccgagaaggaggagaagaccttcgacaagcagcccatgtacctgctctggcacctcctgtacagctacgagggcgactccagcgacaccggcaacaaggccctgatcaccaagatcaagaagctgtgcgggttcgagtccgaggagtacgcgcggatcctgacggacgtgaccttccagagcgagtacggcaacctctccaccaaggccatccgccggatcctgcccttcatgaagaaggggagcgagtactccgaggcctgccgccacgccggctaccggcacagcgagcgcagcctgaccaaggaggagctcgacaagaaggtctacaaggaccacctggagctgctcccccggaactccctgcgcaacccggtggtggagaagatcctgaaccagatgatccacgtcgtgaacacggtggtcgacacctacgggaagcccgacgagatccggatcgagctcgcccgcgagctgaagaagtccgcgaaggagcgggacgagatgaccgccagcatcaacaagaccgccgccgagcacaagaagtactgcgaggtgctgcagaaggagttcggcttcacgcacgtgagccgcaacgacatcatccggtacaagctctacctggagctggagaacaacggctacaagaccctctactccgacacctacatcccccgcgagaagctgttcagcaaggagttcgacatcgagcacatcatcccccagtccaagctgttcgacgacagcttctccaacaagaccctcgagtgccgcagcgtcaacatcgagaagtccaacgacaccgcgtacgactacgtgctgaacaagtacggggagcagggcatcctggactacaagaaccggatcgagaacctctacaaggacagcaagatctcccgcacgaagtaccagaagctgatgatgaagaacagcgacatctccgggaacttcatcgagcgggagctgcgcgacagccagtacatcgccaagaaggcccgggagatcctcgaggagctggtgaagttcgtcgtgccgaccaccggctccgtgaccgcccgcctgcgggaggactggcagctcgtcgacgtgatgcaggagctgaactggaagaagtacgacaagctgggcctcacggacgtgcgctacgacaaggacgggcgggagatccgctacatcaaggactggagcaagcggaacgaccaccgccaccacgccatggacgcgctgaccatcgccttcaccaagcggagcatcatccagtacctgaacaacctcaacgccaagtccgacaagagcggctccatctacgccatcgagcagaaggagctgttccgcgacaagcgggggaagctgaagttcatcccgcccatgccctgcaacatcttccgcgccgaggcgaagcggcacctcgagaacgtcctggtgagcgtgaaggccaagaacaaggtcgtgacccccaacatcaaccgctccaagggcaagaacgggatcaacaagaagatccagctgacgccccggggccagctccacaacgagaccatctacggcagcatgaagcgctacgagaccaagtgggagaagatcgggtccggcttcgacgagcggcagatcgccaaggtggccaacaagaagttccgcgaggccctgctgagccgcctcgcggagttcgggaacgacccccagaaggccttcaccggcaagaactccctggagaagaaccccctgtacgtcgacgagctccacacgcagaaggtgccggagaaggtgaagatcgtcaccctggagaacctgtacaccatccggaaggagatcacccccgacctcaagatcgacaaggtggtggacgccggggtccgccgggtgctgcaggagcgcctggacgagttcgacgacgacagcaagaaggccttctccaacctcgacgagaaccccatctggctgaacggcaagaagatgaagcgggtgacgatcatgggcgtcagcaacgcggtgcccctgcacgacaagaaggactacaaggggaacctcgtgttcgactccaagggccgcaagcagccggtcgacttcgtgaacaccgggagcaaccaccacgtggccatctaccgggacgagtccggcgagctgcaggacatcgtcgtgagcttctacgaggccaccacccgctccacgctggggatccccgtgatcgacaaggagtacaagaaggccgagggctggaacttcctcttcagcatgaagcagaacgagtacttcgtcttccccaacgaggagaccggcttcaacccgaaggagatcgacctgatgaaccccgacaactacaccaccatctcccccaacctgtaccgggtgcagaagttcagcaagtgcatgtacgggaacagctccgtgcgcgagtacgtcttccggcaccacctcgagacgagcgtgaacgactccaagggcctgaagaacatcgcctacaagaacgtcaagagcctggtgtacctcgaggggatcgtgaaggtgcgcatcaaccacatcggccagatcgtctccgtgggggagtactga

SEQ ID NO: 2039 - RNA, 4140 nt, synthetic construct
  misc_feature 1..4140: note = Cas9 variant
  source 1..4140: mol_type = other RNA
atgcgcatcgacaacggcctggaggagctcaaggtgaacaaccggatctacaacatcgggctggacatcggcaccagctccgtcgggttcgccgtgaccgacgcccaggacaagctggtgcgcgtcaagggcaagacggcgatcggggtgcggctgttcgaggagggccacaccgccgccgagcgccggggcttccgcaccacccggcgccggctgagccgccggaagtggcgcatcaacctgctcaaccagatcttcgagccctacatctccgagatcgacccgacgttcttcgcccggctgaagaacagctccctggccgggaaggacaagaagttcgagggcagcctcctgttccccgaccgcaccgactaccagttctacaaggacaaccccaccatgtaccacctccggaagcacctcatggagaaggaccgccagttcgacctgcgggagatctacctggcgatgcaccacatcatcaagtaccgcgggaacttcctcaacaccacgcccatgaaccacttcaagaacgaggagatcgacttctccgccctgttcagccggctgaacgagctctaccaggagatcgacgacgagaacatcttcgagctgaacatcgagaacgtggacgagatcaagaagatcctgctcaaccacgacctgttcaagatggagaagcagaagcaggtcgccaagctgctcaacgtggacaccgacgacaagcagctgaagaaggagaacaccgccctggcgtccaacttcagcaaggccatcctcggctacaagttcaacctggccctggtgaccaagatcccggaccaggacaagaaggagtggacgatctccctcggggacgaggacttcgacgaccgcctggacaacgtccccgtggccctgaccgagagccagctcgaggtggtcgaggtgctgcactccatcttcaacagcatctccctgaacgagatcgtggagaacggcgagaccctcagctccgccatggtccggaagtacaacgaccacaagcacgacctgaagctgctcaagaacgtgatgaccacgctggaggaccgcaagaaggcgaagaagatccagggcatctacaacgtgttcgtcgggaaggacaccgacctgatcagcgacaaggacaagaacaagtacaaggacaaggacgagttctacaaggagatccagaagaacctcgacaactccagcgacgccgaggagatcatcaagcgcatcaagcaggaccagttcctgcccaagcagcggaccagcaagaacggcgtgatcccccaccagctgcaccagcgcgagctcgacctgatcatcgagaaccaggccaagtactacccgttcctgaaggaggccaaccccaacaagaagcggctcaagcaggccaagtacaagctggacgagctgatcgcgttcaagatcccctactacatcgggcccacctccggcgccgagaacagcgacttctcctggctgaagcgcaagaaggacggccagatcacgccgtggaacttcgacgagaaggtggaccggatcgagagcgccaaccgcttcatccggcgcatgaccaccaaggacacctacctcctggccgaggacgtcctgcccctcgagtccctgatctacgagaagtacagcgtgctgaacgagctcaacaacgtgcggatcaaccgccagaagctgtccgtcaacgacaagcaggacatctacaacgagctgttcaagaacagcaagacggtgaccctcaagcagctgcagaagtacttcgaggtcaccaagaagctgaagaccgtggtggtcgaggggctcgccgaccccaagaagttcctgtccaacctgggcacgtaccacgacttcaagctcatcttcggggacatcgtggacgaccccgagtaccagaccgacctggagaacatcatcgagtggagcaccatcttcgaggaccggggcatcttcaactccaagctgaacgagatcacctggctcacggacgagcagcgcaagaaggtgctgagcaagcggtaccaggggtggggccgcttctccaagaagctgctcgtcggcctgaagaacagccaggggaactccatcctggacgagctctggaacaccaacctgaacttcatgcagctgcagagccaggacgacttcgcggagctcatccacgccgagaacgccaagcagttcaaggccaacgacccggacaacccctggaacggcatcgacgccatcctgaacgacgcgtacaccagcccccagaacaagaaggccatccgccaggtggtgaaggtcgtgcaggacatcgagaaggccatggggaacaagccccagaagatcgccatcgagttcacccggagcgcggacaagaacccgcggcgcacggactcccggatcaagcgcctgagcgacatctacaaggaggccgccgagaaggtggtcggcgagagcctcaagctggagctgaacgagtacctcacctccaagaagaagatgaccgacaagatgtacctgtacttcacccagctggggaccgacatctacacgggcaagaagatcgacatcgaccagctcaacaactacgacatcgaccacgtgctgccccagagcttcctgaaggacgactccctcgacaaccgcgtgctgaccaaccggagcgacaactccgagaagtccgacaccgtccccctgcacaagttcggcgccaagatggggaacttctggcgccagctcgccgacgagggcctgatcaccaagcggaagtacaagaacctgacgaccgaccccgcgaccatcgacaagtacaccatccaggggttcatccgccggcagctcgtggagacgtcccaggtgatcaagctgaccgccaacatcctgggcgggctctacccggaggagaccgagatcctggagatccccgccaagctgaaccaccagttccgcgacatgttcgacctcgtcaaggtgcgggaggtgaacgactaccaccacgccttcgacgcctacatcaccgtcttcgtgggcaacttcctgtaccgccggtaccccaagctgcgcagctacttcgtgtacggcgacttcaagaagctcaacaagacggacgacgacatccggaagttcaacttcctgaacctgttcaacaaggacaaggtcgaggacaacgagaccgacgagatcctctggtccaaggcggagagcatccgcgacatcaagaacatctacaactacaagttcatgctggtgtcccgggaggtgtacacccgccacggggccatgttcaaccagaccatctaccccgccagcaagaacgactccaagaagctgatcccgatcaagaagggcaaggacacggccatctacgggggctacagcggcaacaccgacgcctacatggcgatcgtcgccgtggaggacaagaagggggagaagttcaaggtggtcggcgtgcccacccgggccgtgtcccgcctcgagcagctggccgcggacgaccacgaccagtacctgaccgccctccacgacgtcctgaagcccaacttcacgaagatcaagaccaaccggaagaccaaggccaaggaggaggtgaccacgccgttccgcatcctggtggggaaggtcggctaccggcagctcatccaggacggccaggtgaagatgatgctggggagctccgcctacaagtacaacgccaagcagctggtgctcagcgagaagtccctgaaggtcatcaagaacaacaagaagtacaaccccgacgacgagaaccaggacctgatcgacgtgtacgacgagatcctcggcgtggtcaaccgcgcgttcaacctgtacgacaccaacgggttccggaagaagctgaacgacaaccgcgtgaagttcgtggagctccccatcaacaacatcttcgacggcaccaagctggtccagatggggaagcgcgccgtgctgacccagatcctcaacggcctgcacgccaacgccgccctgggggacctcaaggcgctgggcatcagcacgcccttcggcaagatgcagagcaagtccgggatcccgctgagcatggacgcctccctcgtgtaccagagccccaccggcctgttcgagcggaagctgaacctctccgacctgtga

SEQ ID NO: 2040 - RNA, 4140 nt, synthetic construct
  misc_feature 1..4140: note = Cas9 variant
  source 1..4140: mol_type = other RNA
atgaccaagaagaactacagcatcggcctggacatcgggaccaactccgtgggctgggccgtcatcacggacgactacaaggtgcccgccaagaagatgaaggtgctcgggaacaccgacaagaagtacatcaagaagaacctgctgggcgcgctcctgttcgacagcggggagaccgccgaggccacccgcctgaagcggacggcccgccggcgctacacccggcgcaagaaccggctccgctacctgcaggagatcttcgccgacgagatggcgaaggtcgacgagtccttcttccagcggctggacgagagcttcctccgctgggacgacgacaacaagaagctgggccggtacccgatcttcggcaacaaggccgacgtggtgaagtaccaccaggagttccccaccatctaccacctccgcaagcacctcgccgactccagcgagaaggccgacctgcggctggtctacctcgcgctggcccacatgatcaagttccgcgggcacttcctgatcgagggcgagctcaacgccgagaacaccgacgtgcagaagatcttctccgacttcgtgcgggtctacgaccgcacgttcgacgacagccacctgtccgagatcaccgtggacgccgccagcatcctgaccgagaagatctccaagagccggcgcctcgagaacctgatcaagtactaccccaccgagaagaagaacacgctgttcgggaacctcatcgcgctggccctgggcctccagcccaacttcaagatgaacttcaagctgtccgaggacgccaagctgcagttcagcaaggactcctacaacgaggacctcgaggagctgctggggaagatcggcgacgactacgccgacctcttcaccagcgccaagaacctgtacgacgcgatcctgctctccggcatcctgaccgtggacgacaacagcaccaaggccccgctgtccgccagcatgatcaagcggtacgccgagcaccacgaggacctcgagaagctgaaggagttcatcaaggccaacaagagcgagctgtaccacgacatcttcaaggacgagacgaagaacgggtacgcgggctacatcgagaacggggtcaagcaggacgagttctacaagtacctcaagaacaccctgtccaagatcgccggcagcgactacttcctggacaagatcgagcgcgaggacttcctccggaagcagcgcaccttcgacaacggctccatcccccaccagatccacctccaggagatgcacgccatcctgcgccggcagggggactactaccccttcctgaaggagaaccaggaccgcatcgagaagatcctgaccttccggatcccctactacgtgggcccgctggcccgcaaggacagccggttctcctgggccgagtaccacagcgacgagaagatcacgccctggaacttcgacaaggtgatcgacaaggagaagtccgcggagaagttcatcacccgcatgaccctgaacgacctctacctgcccgaggagaaggtcctgcccaagcacagccacgtgtacgagacctacgccgtgtacaacgagctcacgaagatcaagtacgtcaacgagcaggggaaggactccttcttcgacagcaacatgaagcaggagatcttcgaccacgtgttcaaggagaaccggaaggtgaccaaggagaagctgctgaactacctcaacaaggagttcccggagtaccgcatcaaggacctgatcggcctggacaaggagaacaagtccttcaacgccagcctcgggacctaccacgacctgaagaagatcctggacaaggccttcctcgacgacaaggtcaacgaggaggtgatcgaggacatcatcaagaccctgacgctgttcgaggacaaggacatgatccacgagcggctccagaagtactccgacatcttcaccgcggaccagctgaagaagctggagcgccggcactacaccggctggggccgcctcagctacaagctgatcaacgggatccggaacaaggagaacaacaagaccatcctggactacctcatcgacgacggctccgccaaccgcaacttcatgcagctgatcaacgacgacacgctgcccttcaagcagatcatccagaagtcccaggtggtcggggacgtggacgacatcgaggccgtcgtgcacgacctccccggcagccccgccatcaagaaggggatcctgcagagcgtgaagatcgtcgacgagctggtgaaggtgatgggcgacaacccggacaacatcgtcatcgagatggcccgggagaaccagaccaccaaccgcggccggtcccagagccagcagcgcctcaagaagctgcagaacagcctgaaggagctcgggtccaacatcctgaacgaggagaagcccagctacatcgaggacaaggtggagaactcccacctccagaacgaccagctgttcctgtactacatccagaacggcaaggacatgtacaccggggacgagctggacatcgaccacctgagcgactacgacatcgaccacatcatcccccaggcgttcatcaaggacgactccatcgacaaccgggtgctgacgagctccgccaagaaccgcggcaagagcgacgacgtcccctccctggacatcgtgcgcgcccggaaggccgagtgggtgcgcctctacaagagcgggctgatctccaagcggaagttcgacaacctgaccaaggccgagcgcggcggcctcaccgaggcggacaaggccgggttcatcaagcggcagctggtcgagacccgccagatcaccaagcacgtggcccagatcctggacgcccggttcaacacggagagcgacgagaacgacaaggtgatccgcgacgtcaaggtgatcaccctcaagtccaacctggtgagccagttccggaaggacttcgagttctacaaggtccgcgagatcaacgactaccaccacgcccacgacgcgtacctgaacgccgtggtgggcaccgccctcctgaagaagtacccgaagctggcctccgagttcgtctacggggagtacaagaagtacgacgtgcacaagctcatcgccaagagctccgacgaccacagcgagatgggcaaggcgaccgccaagtacttcttctacagcaacctgatgaacttcttcaagcgggtgatccgctactccaacggcaaggtcatcgtgcggcccgtggtcgagtacagcaaggacacggaggacatcgcctgggacaagaagtccaacttccgcaccatctgcaaggtgctgagctacccccaggtgaacatcgtcaagaaggtggagacccagaccgggggcttctccaaggagagcatcctccccaagggggactccgacaagctgatcccgcggaagacgaagaaggcctactgggacaccaagaagtacggcgggttcgacagccccaccgtggcgtactccgtcttcgtggtggccgacgtcgagaagggcaaggccaagaagctgaagaccgtgaaggagctcgtgggcatcagcatcatggagcgctccttcttcgaggagaaccccgtcgagttcctggagaacaaggggtaccacaacatccgggaggacaagctgatcaagctccccaagtacagcctgttcgagttcgagggcgggaagcgccggctgctcgcctccgccagcgagctgcagaagggcaacgagatggtgatcccggggcacctggtgaagctcctgtaccacgcgcagcgcatcaactccttcaacagcacgaagtacctggactacgtctccgcccacaagaaggagttcgagaaggtgctcagctgcgtggaggacttcgccaacctgtacgtcgacgtggagaagaacctgtccaagatccgggccgtggccgacagcatggacaacttcagcatcgaggagatctccaacagcttcatcaacctcctgaccctgaccgcgctcggcgcccccgccgacttcaacttcctgggcgagaagatcccccgcaagcgctacacctccacgaaggagtgcctgaacgccaccctcatccaccagagcatcaccgggctgtacgagacccggatcgacctgtccaagatcggcgaggagtga

SEQ ID NO: 2041 - RNA, 4143 nt, synthetic construct
  misc_feature 1..4143: note = Cas9 variant
  source 1..4143: mol_type = other RNA
atgggcaagtacaacctggggctcgacatcggcaccaacagcgtggggtgggccgtcgtggacgagaacaaccagatcgtgaagaagggcgggaaggccctgtggggcgtccgcatgttcgacgaggcgcagtccgccaaggagacccggatctaccgcaacagccggcgccggatcgtgcgccggaaccagcgcctgctcctgctgcagaaggagttctacgacgagatcatcaaggtggaccagacgttcttccagcggctcaaggactccttcttcaagaaggaggacaagctgaacaagaacaactacaccttcttcgacgacgacatcaccgaccgcgagtacttcaagaagttccccaccatctaccacctccggagccacctcctgtacaacgacgagaagatcgacatccgcatgctgtacctggccctgcaccacatcgtcaagtaccggggccacttcctggactccggggaggtgaacgagagcaacttctccaagatcaaggacgtgctcgacacgttcaacaacaagatgagcgagatgtccctggagttcgaggacaacgaggactacttctgcaagatcgagttcgacgagaacttcgagaacaagctgaaggacatcatgctcagccagctgtccaagaaggagaagcgccaggagctgatcgacctcttcaaggtcgacaagaagtccctggtgaacgagctgctcatcgagctgctggtgaacaagaaggtcaagctcaacagcctgagcatcaccaacggcaagaagtacgaggtgtgcgagatcgacttcgagaaggaggagctgttcgagaagctcgaggacgccaagaagatcatcaccgagctgttcgacatcctggacgagatcgtgaacatcaagaagatcgtcgactactactacgtgctcaagatcatcggggacaacgagtacctgtccgaggccatggtgaagaagtacgacaagcacgacaaggacctgcgggagctcaagagcttcatcaagacctactgcccgaacaagtactacgagtgcttccgcaagacgtccaaccccaacctgtgcaactaccccaagtacgtcggcatcaacagcgtgaacaagaagatcgagcggttcgcgcactgcaagaaggaggagttctacaagtacctgaagtccctcttcaacaccatcaaggacgagaacgccaagctgaagatcgacctgttccagaaggacatggagaacgacgacttcctcaaccgccagaacagcaaccacaacagctccatccccatgcagctgaacttctgcgagctgaagaagatcctcgagaaccagagcaagtactacccgttcctgatgctgaagaactccgacgggtacagcacctccgaccggatcatcgccatcttcaagtacaagatcccctactacgtgggccccctcaacaagaacagcaagtactcctggctggtcaagaagtccaacgagaacatcaccccctggaactacgagaaggtgatcgacctggacgccagcgcgaaggagttcatccagcgcatgcagaacaagtgcacgtacctgaagggcgagaacgactactgcctcccgaagaagtccatcctgttcagcgagtacaactgcctgcagtacctcaaccggctgatcatcaacggggccctgatcgagaacaagctcaagaacgagatctacgagaacatcttcctgtgctacaagaagcccaccaagaagtccatcgtggagtacctgaagaccaactacaactacgacgagaccacgctcaagagcaacatcctggaggtcaactgcgacatgagctcctacatccagttcaaggagatctacggcgaggacttcgagcagaacctgaacatcgtggaggacatcatcaaggacatcaccatcttcgaggacaagaagatcctcgagaagcgcctgcgcgagatctaccacctgagcgaggacaaggtccagaagatcaaggggctcaactacaagggctacgccaccctgtccaagcacttcctgaacaacttctacagcgtgaacgaggagaccggcgagatctacgggcccatcatccagatcatgcgggacacgaactacaacctccagcaggtcatctacaacgaccgctacaacttcatgaaggccatcgacaagtacaacaagaagaacctggacaccgagaagaagctgaacgtgtccgacttcatcgacgagtacatctacgtgagccccatcatgaagcggagcctcatccagtcctacaacatcatccaggagctggagaagatcctgggcgagagcatctccaagtactacatcgagtgcgcccgcgtgcggagcaactccaaggacgtcatcaacagccgctaccggcagctctccgagctgtacaaggactgcgagcaccaggtgagcgacatctccaagaactacatcaacatcaacaagctgaagaagcagctcgaggacaacaagaacgagctgcgcgcggacaagctgtacctctacttcacccagttcgggaagtgcatgtacaccctgaaggacatcgacctggacgacgtgttcctcggcaagtacgacatcgaccacatctacccgcagagcctgatcaaggacgactccctgaacaaccgggtcctcgccagcaaggagaagaacgggaagaaggacaaccagttcatcttcaacatccccgagttcctgcccaagaacgccgagctgttctacaagaagctcctggagtgcaagctgatcacgaaggagaagtaccgccggctcaccatgaagaagatcgacgacgacgagctggacatcttcgtgaaccgccagctggtggccaccaaccagtccgtcaagggcctcgtggacgtgctgaagatctacaagggcgtcaagcccaccaacatcgtgtacagcaaggccgtgaacatctccgacttccggaacaactacaacctgtacaagagccgcacggcgaacaactaccaccacgcccacgacgcctacctcaacgtcgtgatcgggaaggccctggacgtgtactaccagtgcaactacttccagaactacaaggacgtcatcaagctgaaggaccggaacatcaccatcaacccggagatcatcctctccaagaaccgctacgtgaaccggaacggcgagaagaaggtgatctgggacctggacaacaccctgaagctcatcaagaacaacctgtacaaccgcttcgacatcaccgagacgatcatgacccgcaagagcaacaagatgttcagcaagtccagcatctcccccgccaagaacagcaagaacctgatccccatcaagacctccgacccccggtgcaacgtcctcaagtacgggggcatcaagagcaactcctacaacttctactgcatcgtggagctgtacgacaagaaggggaagaagtcctacatcctggaggcgatcccgaagacccacagcgacaagctcgaggagtacatcaagaacagcatcgacgagaagaacgtgtccaacttcaagatcatcaacaagaacatcaagagcaacatcatcatcgagtacaagaagctgcgctacgtcatcacgggcaagtccggcaagtactacctgatcaagaacttcaaggaccggaacttcagctacaacgccatcaagaccatcaagtacatcgagaagtacaactaccagaagaagtacgagatccccttcgaggagaccaaggagaagatcatcctcgcccccaagaagaaggacaccaaggagatctccctgaccctggacaactgccaggccctcctggacgagatcatcagcctgttcaagaaggacatctacaactacgacatcatctacaagatcacgtccaagctcgaggagaacaagcagaacctgaccctgaccaacctcatcaaggtgctgaccgagatcctgatcctcctgaagacgaacgagcgcgggaccgccgacctgaccctcatcgacatgagcaaggacaccggcacgctgtgcatctccaagaccctgaagcccgggatgaagttcatcagcgagagcccgaccggctactaccggaagatcatcttcgaggtgcccaacgggatctga

SEQ ID NO: 2042 - RNA, 4143 nt, synthetic construct
  misc_feature 1..4143: note = Cas9 variant
  source 1..4143: mol_type = other RNA
atgaagcgcatcctgggcctcgacctggggaccaccagcatcggctgggccctggtgaacgaggccgagaacaacaacgaggcgtccagcatcgtccggctcggggtgcgcgtgaaccccctgacggtcgacgagaagtccaacttcgagaagggcaaggccatcaccaccaacgccgaccggcagctgcgccacggggcccggatcaacctccagcgctacaagctgcggcgccagaacctgcacgactgcctccagaagcagggctggctgggcaccgaggccatgtacgaggaggggaaggcgagcacgttcgagacctacaagctgcgggccaaggccgccgaggaggagatctccctccacgagttcgcgcgcgtgctgttcatgctgaacaagaagcggggctacaagagcaaccgcaaggccaacaacaaggaggacgggcagctgttcgacggcatgaccatcgccaagaagctgtacgaggagcacctgaccccggccgagtactccctccagctgctgaacaaggggaagaagttcacgcagggctactaccggagcgacctcaacgccgagctggagcgcatctgggacgagcagaagaagtactaccccgagatcctgaccgacgagttcaagcagcagctcgagggcaagaccaagaccaacacgtccaagatcttcctggcgaagtacgggatctacagcgccgacctgaagggcctcgaccggaagttccagcccctgaagtggcgcgtggaggccctgcagcagcaggtcgacaaggaggtgctcgccttcgtgatctccgacctgaaggggcagatcgccaacaccagcggcctgctcggcgcgatctccgaccggagcaaggagctgtacttcaacaagcagaccgtcgggcagtacctgtgggcctccctcgaggagaacccccacatcagcatcaagaacaagccgttctaccgccaggactacctggacgagttcgagaagatctgggagacccaggccgccttccacaagcagctgacgcccgagctcaagcaggagatccgggacatcatcatcttctaccagcgccccctgaagtccaagaagtccctgatcagcgtgtgcgagctcgagcagcggaaggtgaaggccaccatcgacggcaaggagaaggagatcaccatcgggcccaaggtcgcgcccaagagcagcccggtgttccaggagttccgcatctggcagaacctgaacaacgtgctgctcatcgacaacgacaccaacgagaagcgccccctggacgaggtcgagcggaacctgctctacaaggagctgtccatcaaggccaagctgagcaagacggaggccctgaagatcctcaacaagaagggcaagcagtgggacctgaactaccgcgagctggaggggaaccggacccaggccatcctcttcgactgctacaaccgcatcatcaccctgaccggccacgaggagtgcgacttcaagaagatcaaggcctccgagatccggcactacgtgagcacgatcttcaagaacctgggcttctccaccgagatcctcgacttcgaccccagcctgaagaagcacgagctggagaagcagccgatgtaccagctctggcacctcctgtactcctacgagagcgacaactcccgcaccgggaacgagagcctcctgcggaagctggagaccacgttcggcttccccgaggagtacgcgaccgtgctctgcgacgtcgtgttcgaggaggactacgggaacctgtccgtgaaggccatgcgcgagatcctgccctacctccaggccggcaacgactacagccaggcctgcgcgtacgccgggtacaaccactcccggcacagcctgaccaaggaggagctggaccagaaggtctacaaggagcgcctcgagctgctgcccaagaactccctccggaacccggtggtggagaagatcctgaaccagatgatcaacgtcatcaacgccatcatcgacgagtacggcaagcccgacgagatccgcatcgagatggcccgggagctcaagagctccgccgcggaccgcaagaagaccacgcacgccatcagccagggcaacgccgagaaccagcggatccgcgagatcctggagaaggagttctccctgagctacatcagccggaacgacatcatcaagtacaagctgtacgaggagctcgagcccaactactacaagaccctgtactccgacacctacatcaccaaggacaagctgttcagcaaggacttcgacatcgagcacatcatccccaaggcccgcctcttcgacgactccttcagcaacaagacgctggaggcccggaacatcaacctggagaagtccaacaagaccgcgttcgacttcatcaaggagaagtacggggaggacggcgccgaggcctacaagaagaagctcgacatgctgctggagaacgacgccatcagccgcccgaagtacaacaacctcctgcgcgccgaggcggacatcccctccgacttcatcaaccgggacctgcgcaacacccagtacatcgccaagaaggcctgcgagatcctcggggagctggtgaagaccgtcacccccacgaccggcaagatcaccaaccggctgcgcgaggactggcagctcgtggacgtgatgaaggagctgaacttcgagaagtacgagaagctggggctcaccgagatcgtcgaggaccgggacggccgcaagatcaagcggatcaaggactggacgaagcgcaacgaccaccggcaccacgccatggacgcgctggccatcgccttcaccaagcccagcttcatccagtacctgaacaacctcaacgcccgctccaacaagggcgacagcatctacgccatcgagaacaaggagctgcactacgaggaggggaagctgcggttcaacgcgccgatccccgtgaacgagttccgcgccgaggccaagcggcacctctccgccatcctggtgagcatcaaggccaagaacaaggtcatgacccagaacgtgaacaagatcaagaccaagcacggcatcatcaagaagatccagctgacgccccgcgggcccctccacaacgagaccatctacggcaccaagatgcggccgatcatcaagatggtgaaggtcggcgcggccctggacgaggccaccatcaacaaggtgtccagccccgccatccgcgaggccctgctcaagcggctgaacgagtactccgggaacgcgaagaaggccttcacgggcaagaacaccctggagaagaaccccatctacctcaacgccgggcgcaccaagaccgtgccgagcctggtcaagacggtggagtgggagtccttccaccccacccggaagctgatcgacaaggacctcaacgtggacaaggtcgtggacaagggcatccgcgagatcctgaaggcccggctggaggagttcaacggggacgcgaagaaggccttcagcaacctcgaggagaaccccatctacctggacgaggccaagaagatcgccctgaagcgcgtgagcatcgagggcgtcctctccgccatccccctgcacaccctgaagaaccaggcgggcaagccgatcaccgggaaggacggcaagcccgtgctcgggaactacgtgcagacgagcaacaaccaccacatcgccttctactacgacgaggacggcaacctgcaggacaacgccgtctccttcttcgaggccgccgagcgcaagagccaggggatccccgtgatcgacaaggactacaaccgggacaagggctggcgcttcctgttcaccatgaagcagaacgagtacttcgtgttccccaacgaggcgaccggcttcatcccgtccgaggtcgacctcaccgacgaggccaactacgggatcatcagccccaacctgtaccgggtgcagaaggtgtcccgcatcgacaagggcacgagcgcctcccgggactactggttccgccaccacctggagaccatcctcaacgacgacgccaagctgaagaacctggccttcaagcggatccgcgggctcctggagctgaaggacatcatcaaggtccggatcaacagcaccggcaagatcgtggcggtgggggagtacgactga

SEQ ID NO: 2043 - RNA, 4143 nt, synthetic construct
  misc_feature 1..4143: note = Cas9 variant
  source 1..4143: mol_type = other RNA
atgaagaagatcctgggcctcgacctggggaccaccagcatcggctgggccctggtgaacgaggccgagacggagtccgagaagtccagcatcatccgcctcggggtccgggtgaaccccctgaccatcgacgagaagggcaacttcgagaaggggaaggcgatcaccaccaacagcgaccgccagcagcggcactccgcccgcatcaacctgcagcggtacaagctccgccggcagaacctgtgcgactgcctgcagatcggcggcctcctggggagcgagtccatgtacgaggagggcaaggagagcacgttcgagacctacaagctgcgcgccaaggccgccaccgagaaggtggcgctccacgagttcgcccggatcctgttcatgctgaacaagaagcgcgggtacaagtccaaccggaaggccaacagcaaggaggacggccaggccttcgacgggatgaccatcgcgaagaagctctacgaggagaacctgacgccggccgagtactccctgcagctcctgaacaagggcaagaagttcagcccctcctactaccgcagcgacctggagtccgagctcaaccggatctgggaggagcagaagaagtactaccccgagatcctgaccgacgacttctaccagcagctggagggcaagaccaaggtcaacaccacgaagatcttcctcgccaagtacgggatctacaccgccgacctgaagggcctggacaagaagatgcagcccctcaagtggcgcatcgaggccctgaacaagcaggtcgacaaggaggtgctgaccttcgtggtgagcgacctcaaggggcagatcgagaagacctccggcctgctgggcgagatcagcgaccggtccaaggagctctacttcaacaagcagacggtggggcagtacgtctgggcgagcctgaaggagaacccgcacgtgagcatcaagaacaagcccttctaccgccaggactacctggacgagttcgagaagatctgggagacccaggccgccttccacaaggagctcacccccgagctgaagaaggagatccgggacatcatcatcttctaccagcgccccctgaagtccaagaagggcctcatcagcatctgcgagctggagcagaagaaggagaaggtgatcatcgaggggaaggagaaggagatcctgatcggctccaaggtcgcccccaagagctcccccatgtaccaggagttccggatctggcagaacctcaacaacgtgctgctgatcgacaccgagatcaacgagagccgccccctcgacgaggaggagaaggccctgctgtacaacgagctctccgtgcgggcgaagctgagcgagacggaggccctgaagaccatcaacaagaaggggaagcactgggacctgaacttcaaggagctcgagggcaaccgcacccaggccgtcctgttcgagtgctacaaccgcatcatcacccagacgggccacgaggagtgcaacttcaagaagatctccgccgaggacatccggcactacgtggccaccatcttcaagaacctggggttcaacaccgacatcctcgacttcaaccccagcctggagaagcacgagctggagaagcagccgatgtaccagctctggcacctcctgtactcctacgagagcgacaagtcccgcaccggcaacgagagcctgctgaacaagctggaggcgaacttcgggttcccccaggagtacgcctccgtgctcgccgacgccacgttcgaggacgactacggcaacatcagcgtcaaggccatccggaagatcctgccccacctccacgacgggtacgactactccgaggcgtgcgagcgcgccggctacaaccacagcgtgcggtccctgaccaaggaggagctggcccagaaggtgtacaaggaccgcctggacctcctgcccaagaacagcctgcggaacccggtcgtggagaagatcctcaaccagatgatcaacgtgatcaacgccatcatcgtcgagtacggcaagcccgacgagatccgcatcgagatggcgcgggagctcaagagctccgccgccaagcgcgaggagcggaccaagagcatcaaccagaacgccgccgagaacaagcgcatcaccgagatcctgcagacggagttcgggctgtcctacatcagccggaacgacatcgtgaagtacaagctgtaccaggagctggaggcgaacggcttcaagaccctctactccaacacctacatccccaaggagaagctgttcagcaaggacttcgacatcgagcacatcgtccccaaggcccgcctgttcgacgactccttcgggaacaagaccatcgaggcccgggacgtgaacctcgccaagagcaacaagacggccttcgacttcgtgaaggagaagtacggcgagcaggggatcgaggagtacaagaagaagctggacaccctgctcaaggagaacgcgatctccagcggcaagtacaagaagctgatgatgtccgaggccgacatcccgagcgacttcatcaaccgcgacctgcggaacacccagtacatcgcccgcaaggcctacgagatcctcggcgagctggtcaagaccatcacccccacgaccgggaagatcaccgaccggctgcgcgaggactggcagctcatcgacgtgatgaaggagctgaacttcgagaagtacgaccgcctgggcctcaccgaggtgatcgaggaccgggacgggcgcaagatcaagcggatcaaggactggacgaagcgcaacgaccaccggcaccacgccatggacgcgctgaccatcgccttcaccaagccctcctacatccagtacctgaacaacctcaacgcccgcagcgacaagtccggcagcatctacgccatcgagaccaaggagctgcaccgggagaacaacacgctgcgcttcaacgcgcccatgccgctcaacgagttccggaaggaggccaagcgccacctgtccgccatcctggtcagcatcaaggccaagaacaaggtgatgacccagaacgtgaacaagatcaagaccaagaacggcatcatcaagaaggtccagctcaccccgcgcggggccctgcacaacgagacgatctacggcaccaagatgcggcccatcatcaagatggtgaagatcggggcggccctggacgaggccaccatcaacaaggtgagctcccccaccatccgggaggccctcctgaagcgcctgaacgagtacagcggcgacgccaagaaggcgttcgccgggaagaacgccatcacgaagaacccgatctacctcaacgccgagcacaccaagaccgcccccgcgatggtcaagatcgtggagtgggagatgtactaccccatccggaagctgatcaccccggacctgaagatcgagaaggtgatcgacaacggcatcaaggagatcctcaagaagcgcctgaaggagttcggcggggacgccaagaaggccttctccaacctggacgagtgccccatctacctcgacgaggagaagaacatcacgctgaagcgggtcagcatcgagggcgtgctgtccgccatccccgtgcacaccctcaagaaccacgcggggaaggagatcaaggacgaggacggcaaggccgtcctgggggactacgtgcagaccagcaacaaccaccacgtggccatctaccaggacgccaagggcaacctgcaggacaacgtcatctccttcttcgaggccgcggagcgcaagagccagaacgtgcccatcgtggacaagaacctcaaccgggacaagggctggcacttcctgtacaccatgaagcagaacgagtacttcgtcttcccgaacgaggagacggggttcgtgccctccgagatcgacctgatggacgagaacaactacgagatgatcagccccaacctcttccgcgtgcagaccatgtcccgggtcgactacggcaagaccatcatccgcgagtacgtgttccgcaaccacctggagaccatcctgaacgacaacctcaagctgaaggggctggtgttcaagaagatcaagagcctcaaggccctggagggcatcgtcaaggtgcgggtgaacgccatcgggaagatcgtcgccgtgggcgagtacgactga

SEQ ID NO: 2044 - RNA, 4143 nt, synthetic construct
  misc_feature 1..4143: note = Cas9 variant
  source 1..4143: mol_type = other RNA
atgaagaagaagtacgccatcggcatcgacatcgggaccaacagcgtgggctggtccgtcgtgaccgacgactacaaggtgcccagcaagaagatgaaggtcttcgggaacacggagaagcgctacatcaagaagaacctgctcggcaccctgctgttcgacgaggggaacaccgccgagaaccggcgcctcaagcggaccgcgcgccggcgctacacgcggcgccggaaccgcatcctgtacctgcaggagatcttcgccgaggagatcaacaagatcgacgactccttcttccagcggctcgacgacagcttcctgatcgtggaggacaagcagggctccaagcacccgatcttcggcaccctgcaggaggagaaggagtaccacaagcagttccccaccatctaccacctccgcaagcagctggccgacagctcccagaaggccgacatccggctgatctacctcgccctggcgcacatcatcaagtaccgcgggcacttcctgttcgagggcgacctcaagagcgagaacaaggacgtgcagcacctgttcaacgacttcgtcgagatgttcgacaagaccgtggaggggtcctacctgagcgagaacctccccaacgtggccgacgtcctggtggagaaggtgtccaagagccggcacctggagaacatcctccactacttccccaacgagaagaagaacggcctgttcgggaacttcctggccctcgccctgggcctgcagccgaacttcaagacgaacttcgagctcgcggaggacgccaagatccagttctccaaggagacctacgaggaggacctggaggagctgctcggcaagatcggggacgactacgccgacctgttcatcgccaccaagagcctgtacgacggcatcctcctggccgggatcctgtccaccacgaacagcaccaccaaggcgcccctctccagctccatggtcaaccgctacgaggagcaccagaaggacctggccctgctcaagaacttcatccaccagaacctgagcgacagctacaaggaggtgttcaacgacaagctgaaggacggctacgccggctacatcgaggggaagaccacgcaggagaacttctaccggttcatcaagaaggccatcgagaagatcgacggctccaactacttcatcgagaagatcgagcgcgaggacttcctccggaagcagcgcaccttcgacaacgggagcatcccccaccagatccacctccgggagatgcaggccatcatccgccgccaggcgaagttctaccccttcctggaggagaaccaggacaagatcgagaagatcctcaccttccggatcccgtactacgtgggccccctggcccgcgggaagtccgagttcgcctggctgaaccgcaagagcgacgagaagatccggccctggaacttcgacgagatggtcgacaaggagacctccgccgagaacttcatcacgcggatgaccaactacgaccagtacctccccgaccagaaggtgctgccgaagcacagcctgctgtacgagaagttcgccgtgtacaacgagctcaccaaggtccgctacgtgaccgagcagggcaagtccttcttcttcgacgcgaacatgaagcaggagatcttcgaccggacgttcaaggtgtaccgcaaggtcaccaaggagaagctgatggacttcctgagcaaggagttcgacgagttccggatcgtggacctcctgggcctggacaaggacaacaagtccttcaacgccagcctcgggacctaccacgacctgaagaagatcgtgtccgaggacttcctggacaacagcgagaacgaggacatcctcgagaacgtcgtgctgaccctgacgctgttcgaggaccgcgagatgatccggaagcgcctggagaagtacaaggacgtcctgaccgaggagcagcggaagaagctcgagcgccggcactacaccggctgggggcgcctgtccgccaagctgatcaacggcatccgggacaaggtgacccgcaagacgatcctcgactacctgatcgacgacgggaccagcaaccggaacttcatgcagctgatcaacgacgacaccctctccttcgtggacgagatccgcctggcccagggcagcggcaaggccgaggactaccgcgcggaggtccagaacctggccgggtcccccgccatcaagaagggcatcctccagagcctgaagatcgtggacgagctgatcgaggtgatggggtacgaccccgagcacatcgtcgtggagatggcccgggagaaccagttcaccaaccagggccgccggaactcccagcagcgctacaagaagatcgagaacgcgatcaagaacctcgacagcaacctgaacagcaagatcctgaaggagtaccccacgaacaaccaggccctccagaacgaccggctgttcctgtactacctccagaacgggaaggacatgtacaccgacgaggagctggacatcgaccagctgtcccagtacgacatcgaccacatcatcccgcaggccttcatcaaggacgacagcctcgacaacaaggtgctgaccaagtccgccaagaaccgcggcaagagcgacgacgtcccctccctggagatcgtgtacaagaagaagaacttctggaagcagctcctggacagccagctgatctcccagcggaagttcgacaacctcaccaaggccgagcgcggcgggctgaccaacgaggacaaggcgcggttcatccagcgccagctggtggagacgcggcagatcaccaagcacgtcgcccgcatcctcgacacccggttcaacaccaagctggacgaggccggcaaccgcatccgggaccccaaggtgaacatcatgacgctcaagagctccctcgtgagccagttccgcaaggactaccagctgtacaaggtccgggagatcaacaactaccaccacgcccacgacgcctacctgaacgcggtggtggccaccgccctcctgaagaagtacccccagctggccccggagttcgtctacggggactaccccaagtacaactcctacaagagccgcaagtccgccaccgagaaggtgctgttctacagcaacatcatgaacttcttcaagcgggtgctggtctactccaagaccggcgaggtgcgcatccggcccgtgatcgaggtcaacaaggagacgggcgagatcgtgtgggacaagaagtccgacttccgcaccgtgcgcaaggtcctgagctacccccaggtgaacgtggtcaagaagaccgaggtgcagaaccacgggctcgaccggggcaagccgaaggggttctacaacgcgaacctgagcccccgccccaaggagggcagcgtggagaacctggtccccgccaagcagtccttcgacaccaagcggtacgggggctacgccggcatcagcaactcctacgccgtgctcgtgaacgggatcatcgagaagggcaagaagaagtccaaggcggaggtcacggagttccaggggatcagcatcctggcccgcaaggacttcgacaagaacccgaagcagtacctgctcaacctgggctacaaggacatcaagagcatcatcaagctgcccaagtactccctcttcgagctggagaacgggagccggcgcatgctggcctccatcctcagcaccaacaacaagcggggcgagatccacaagggcaacgagatgtacctgcccgacaagttcgtgaccctgctctaccacgccatgcgcgtgaaccggaccctggagccggggcacaagaagtacgtcgaggcccaccgccacgtgttcgacgagctgctcacgtacatcctggagtacaacgagaagatcgtgggcgcgaaggccaacgggaagcggatcgtcgaggcctactccgcccgcaaggacaccgacaacctggaggagctctgcaacagcttcatcaacctgctgaacctcaccgccctgggctccgcggtggacttcgagttcctggggaccaagatcccccggtaccgcgactacacgcccagctccctcctgaaggccaccctgatccaccagagcgtgaccggcctctacgagacccggatcgacctgtccaagctgggcggggactga

SEQ ID NO: 2045 - RNA, 4143 nt, synthetic construct
  misc_feature 1..4143: note = Cas9 variant
  source 1..4143: mol_type = other RNA
atgaagaagatcctgggcctcgacctggggaccaccagcatcggctgggccctggtgtacgagtccgagaacgccgacgagaagtcctccatcgtccgcctcggggtgcgggtgaaccccctgagcgtcgacgagaagggcaacttcgagaaggggaagtccatcacgaccaacgcggaccgccagcagacccacggcgcccggatcaacctgcagcgctacaagctccggcgcgagaacctgaaggactgcctgcagaagcagggctggatcgggaccgaggccctctacgaggagggcaagacgagcaccttcgagacctacatgctgcgggccaaggccgcggaggaggagatctccctgcacgagctctgccgcgtgctgttcatgctgaacaagaagcgggggtacaagagcaaccgcaaggccaacaacaaggaggacggcaagctgttcgacgggatgaccgtggccaagaagctgtacgaggagcacctgacgccggccgagtactccctcaagctgctgagctccggcaagaagttcaagcaggagtactaccggagcgacctcaaggaggagttcgaccgcatctggaacgagcagcagaagtactaccccgagatcctgaccgacgacttcaagcagcagctgcagggcaagtccaaggggaacaccagcaagatcttcctcggcaagtacgggatctactccgcggacctgaagggcctggaccggaagctccagcccctgaagtggcgcgtcgaggccctgaagcagaaggtggacaaggaggtgctcgccttcgtcatcagcgacctgaacggccagatcgcctccaccagcgggctgctcggcgccatctccgaccggagcaaggagctgtacttcaacaagcagacggtggggcagtacctgtggaccagcctcaaggagagcccccacgtgagcatcaagaacaagccgttctaccgccaggactacctggacgagttcgagaagatctgggagacccaggcgacctaccacaaggagctgacgcccgagctcaagcaggagatccgggacatcatcatcttctaccagcgccccctgaagtccaagaagggcctgatcagcgtctgcgagctcgagcagcggaaggtgaaggtgaccatcgacgggaaggagaaggagatctccatcggccccaaggtcgcccccaagagctcccccatgttccaggagttccgcatctggcagaacctgaacaacatcctgctcatcgacaagggcaacaacagcaaccggcccctgtacgaggaggagcgcaacctgctctacgaggagctgtccgtgaaggagaagctgagcaaggccgaggccctgaaggtgctcaacaagaacgggaagcagtgggacctgaactacaaggagatcgagggcaaccgcacccaggccgtcctgtacgactgctacaaccggatcatcgggatgaccggccacgaggagtgcaacttcaagaagctcaaggcgtccgacatccgctacaacgtgaagacgatcttcaagaacctggggttcagcaccgacatcctggacttcgactccagcctccagggccacgagctggagcggcagccctcctaccagctgtggcacctcctgtacagctacgagtccgacaacagccgcaccggcaacgacgccctgctccggaagctggagaccgccttctccatcccgaaggagtacgccgccgtgctgagcgacgtcgtgttcgaggacagctacgggaacctctccgtgaaggcgatgcgcaacatcctgccccacctccaggccggcctcgactacagccaggcctgcgagaaggccgggtacaagcactcccggcgcagcctgacgaagaacgagctggacaagaaggagtacaaggagaagctcgagctgctgcccaagtccagcctccacaaccccgtcgtggagaagatcctgaaccagatgatcaacgtcatcaacgccgtgatcgacgagtacggcaagccggacgagatccggatcgagctggcgcgcgagctcaagatcggggccgccgagcgggagaacatgacccgctccatcaaccagggcaacgccgagaacaagcggatccgcgagatcctggagaaggagttcgcgctgagctacatctcccggaacgacatcatcaagtacaagctctacgaggagctcaagagcaacggcttcaagaccctgtactccgacacctacatcagcaaggacaagctgttctccaaggacttcgacatcgagcacatcatccccaaggcccgcctgttcgacgacagcctgtccaacaagacgatcgaggcccgggacgtgaacatcgccaagagcaacaagaccgccttcgacttcatctccgagaagtacgaccagcaggggatcgaggcgtacaagaagaagctcgacatcctgctgcaggacggcagcatcagcaaggccaagtacaaccgcctcctgatgaaggaggccgacatcccctccgggttcatcgaccgggacctgcgcgacacccagtacatcgccaagaaggcctacgagatcctcagcgacctggtccgcaacgtgacccccacgaccggcgcggtgacctcccggctgcgcgaggactggcagctcgtcgacgtgatgaaggagctgaacttcgagaagtaccagaagctgggcctcgtggaggtcatcgaggaccgggacgggcgcaagatcaagcggatcaaggactggaccaagcgcaacgaccaccggcaccacgccatggacgccctgacgatcgccttcaccaagccgagctacatccagtacctgaacaacctcaacgcccgctccgacaagaacagctccatctacggcatcgagaacaaggagctgcaccgggaggacaacaagctgcgcttcaacgcgcccctccccatcaacgagttccgggccgaggcccgccggcacctcaagagcatcctggtgtccgtgaaggccaagaacaaggtcatgacccagaacgtgaacgtgatcaagaccaagcacggggtcatcaagaaggtgcagctgaccccgcgcggcgagctgcacaacgcgacgttctacgggaccaagaagcggccgatcatcaagatggtgaaggtcggcgccgccctggacgaggtgaccatcaagaaggtgagctccagcttcatccgcgaggccctcctggaccggctgcacgagtacaacggcgacgccaagaaggcgttcaccgggcgcaactccatcgacaagaaccccatctacatcgacgaggagcacaagaagacggtccccgccctcgtgaagaccatcgagtgggagatgtaccaccccacccggaagatgatcagcccggacctgaagatcgacaaggtgatcgacaagggcatccgcgagatcctgcggacccgcctcgccaagttcaacggggacgcccagaaggccttctccaacctggacgagaaccccatctacaaggacgaggcgaagaagatcacgctgaagcgcgtcagcctcgagggcgtgtccagcgtgatccccctgcacaagctgaaggacatgggcgggaagccggtcgtgggcaaggacgggaagcccgtgtggggcgactacgtccagacctccaacaaccaccacatcgccttctacatggacgagaacgggaacctccaggacgacgtggtgaccttcttcaaggccgcccggcgcaagagccagggcgtccccgtgatcgacaagaactacaaccacgacaaggggtggcacttcctgttcaccatgaagcagaacgagtacttcgtgttccccaacgaggccacgggcttcatcccgaccgaggtcgacctgatggacgaggcgaactacgacatgatcagccccaacctctaccgggtgcagaagatgtccaagaccaagcagggcatcaccgacaagcgcgactactggttccggcaccacctggagacggtgctgaacaacgacctcaaggtccgcaacagcatcttcaagcagatcaactccctgaagcccctggaggggatcgtgaaggtgcggatcaacgccatcggcaagatcgtcgccatcggggagtacgactga

SEQ ID NO: 2046 - RNA, 4143 nt, synthetic construct
  misc_feature 1..4143: note = Cas9 variant
  source 1..4143: mol_type = other RNA
atgaagcgcatcctgggcctcgacctggggaccaccagcatcggctgggccctggtgaacgaggccgagtccaacaacgaggcgagctccatcgtccggctcggggtgcgcgtgaaccccctgacggtcgacgagaagtccaacttcgagaagggcaaggccatcaccaccaacgccgaccggcagctgcgccacggggcccggatcaacctccagcgctacaagctgcggcgccagaacctgcacgactgcctccagaagcagggctggctgggcaccgaggccatgtacgaggaggggaaggcgagcacgttcgagacctacaagctgcgggccaaggccgccgaggaggagatcagcctccacgagttcgcgcgcgtgctgttcatgctgaacaagaagcggggctacaagtccaaccgcaaggccaacaacaaggaggacgggcagctgttcgacggcatgaccatcgccaagaagctgtacgaggagcacctgaccccggccgagtacagcctccagctgctgaacaaggggaagaagttcacgcagggctactaccggtccgacctcaacgccgagctggagcgcatctgggacgagcagaagaagtactaccccgagatcctgaccgacgagttcaagcagcagctcgagggcaagaccaagaccaacacgagcaagatcttcctggcgaagtacgggatctactccgccgacctgaagggcctcgaccggaagctgcagcccctgaagtggcgcgtggaggccctcaagcagcaggtcgacaaggaggtgctggccttcgtgatcagcgacctgaaggggcagatcgccaacacctccggcctcctgggcgcgatcagcgaccggtccaaggagctgtacttcaacaagcagaccgtcgggcagtacctctgggccagcctggaggagaacccccacatctccatcaagaacaagccgttctaccgccaggactacctggacgagttcgagaagatctgggagacccaggccacgttccacaagcagctcacccccgagctgaagcaggagatccgggacatcatcatcttctaccagcgccccctcaagagcaagaagtccctcatcagcgtgtgcgagctggagcagcggaaggtgaaggccaccatcgacggcaaggagaaggagatcaccatcgggcccaaggtcgcccccaagagctcccccgtgttccaggagttccgcatctggcagaacctgaacaacgtgctcctgatcgacaacgacacgaacgagaagcgccccctggacgaggacgagcggtacctcctgtacaaggagctgagcatcaaggcgaagctgtccaagaccgaggccctcaagatcctgaacaagaagggcaagcagtgggacctgaactacaaggagctcgaggggaaccgcacccaggccatcctgttcgactgctacaaccggatcatcaccctgacgggccacgaggagtgcgacttcaagaagatcaaggccagcgagatccgccactacgtctccaccatcttcaagaacctcggcttcagcaccgagatcctggacttcgacccctccctggagaagcacgagctcgagaagcagccgatgtaccagctgtggcacctcctctacagctacgagtccgacaacagccggaccgggaacgagtccctgctgcgcaagctcgagacgaccttcggcttccccgaggagtacgccaccgtgctgtgcgacgtggtcttcgaggaggactacgggaacctgagcgtgaaggcgatgcggaagatcctcccctacctgcaggccggcaacgactactcccaggcctgcgcctacgcggggtacaaccacagccgccactccctgaccaaggaggagctcgaccagaaggtgtacaaggagcggctggagctgctccccaagaacagcctgcgcaacccggtcgtggagaagatcctgaaccagatgatcaacgtgatcaacgccatcatcgacgagtacggcaagcccgacgagatccggatcgagatggcccgcgagctcaagtccagcgccgccgaccggaagaagacgacccacgcgatcaaccagggcaacgacgagaaccagtgcatccgcgagatcctggagaaggagttcgccctgtcctacatcagccggaacgacatcatcaagtacaagctctacgaggagctgaagcccaacgggttcaagaccctgtacagcgacacctacatccccaaggacaagctgttctccaaggacttcgacatcgagcacatcatcccgaaggcccgcctgttcgacgacagctactccaacaagacgctggaggcccgggacatcaacctcgccaagagcaacaagaccgcgttcgacttcgtcaaggagaagtacggcgagcagggggccgaggcctacaagaagaagctggacatgctgctcggcaacaacgtgatctccaagcccaagtacaacaagctgctgatgaccgaggccgacatccccagcgacttcatcaaccgcgacctccggaacacccagtacatcgcccgcaaggcgtgcgagatcctgggggagctggtccgcaccgtgacgcccaccaccggcaagatcaccaaccggctccgcgaggactggcagctggtggacgtcatgaaggagctgaacttcgagaagtacgagaagctcggcctgacggagatcgtggaggaccgggacgggcgcaagatcaagcggatcaaggactggaccaagcgcaacgaccaccggcaccacgccatggacgccctggccatcgcgttcaccaagccgtcctacatccagtacctcaacaacctgaacgcccgcagcaacaagggcgactccatctacgccatcgagaacaaggagctgcactacgaggaggggaagctccggttcaacgcccccatccccgtgaacgtcttccgcgccgaggcgaagcggcacctgagcgccatcctggtgtccatcaaggccaagaacaaggtgatgacccagaacgtcaacaagatcaagacgaagcacggcatcatcaagaagatccagctcaccccgcgcggcccgctgcacaacgagaccatctacgggaccaagatgcggcccatcatcaagaaggtgaaggtgggcgccgccctggacgaggcgacgatcaacaaggtcagctcccccgccatccgcgaggtgctcctgaagcggctgaacgagtacagcgggaacgccaagaaggccttcaccggcaagaacaccctcgacaagaacccgatctacctgaacgccgagcgcaccaagacggtgcccgcgtccgtcaagaccgtggagtgggagaactaccaccccatccggaagcccatcaccccggacctgaaggtggacaaggtcatcgacaaggggatcggcgagatcctcaaggcccgcctggaggagttcaacggcgacgccaagaaggccttcagcaacctggaggagaaccccatctacctcgaccagaccaagaagatcgcgctgaagcgggtgtccatcgagggggtgctgagcacgatccccctccacaccctgaagaaccaggccggcaagcccatcatggggaaggacggcaagccggtcctggggaactacgtgcagaccagcaacaaccaccacatcgccttctactacgacgaggacggcaacctccaggacaacgccgtgtccttcttcgaggccgcggagcgcaagagccagggcatctccgtcatcgacaaggactacaaccgggacaaggggtggcgcttcctgttcaccatgaagcagaacgagtacttcgtgttccccaacgaggccacgggcttcatccccagcgaggtggacctgaccgacgaggccaactacgggatcatctcccccaacctctaccgcgtccagaagatgagccggatcgagaagggcacctccgtgagccgcgactactggttccggcaccacctggagaccatcctgaacgacgactcccgcctcaagaacagcgccttcaagcggatcaactccctgaagccgctggaggggatcatcaaggtgcgcatcaacagcatcggcaagatcgtcgccgtgggcgagtacgactga

SEQ ID NO: 2047 - RNA, 4143 nt, synthetic construct
  misc_feature 1..4143: note = Cas9 variant
  source 1..4143: mol_type = other RNA
atgaagaagggctacagcatcgggctggacatcggcaccaactccgtggggttcgccgtcatcaccgacgactacaaggtgcccagcaagaagatgaaggtgctcggcaacacggacaagcgcttcatcaagaagaacctgatcggggccctgctgttcgacgagggcaccaccgcggaggcccggcgcctgaagcggaccgcccgccggcgctacacgcggcgcaagaaccggctgcgctacctccaggagatcttctccgaggagatgagcaaggtcgactccagcttcttccaccggctggacgactccttcctgatcccggaggacaagcgcgagagcaagtaccccatcttcgccaccctcgaggaggagaaggagtaccacaagaagttccccaccatctaccacctccggaagcacctggccgactccaaggagaaggcggacctccgcctgatctacctggccctcgcccacatgatcaagtaccggggccacttcctgtacgaggacaccttcgacatcaagaacaacgacatccagaagatcttcaacgagttcatcagcatctacgacaacgccttcgaggggtccagcctgtccggccagaacgcccaggtggaggccatcttcacggacaagatcagcaagtccgccaagcgcgagcgggtgctcaagctgttccccgacgagaagtccaccgggctgttcagcgagttcctcaagctgatcgtcggcaaccaggccgacttcaagaagcacttcgacctggaggacaaggccccgctccagttcagcaaggacacctacgacgaggacctggagaacctgctcgggcagatcggcgacgacttcgcggacctgttcgtggccgccaagaagctgtacgacgccatcctcctgtccggcatcctgaccgtgacggaccccagcaccaaggcgcccctcagcgcgtccatgatcgagcgctacgagaaccaccagaacgacctggtcgtgctgaagcagttcatcaagaacaacctccccgagaactacgtggaggtcttcagcgacgactccaagaacgggtacgccggctacgtgggggtggacagcaagatccggaagcgcaacgccaagctggccaccgaggaggagttctacaagtacctgaagaacatcctcaacaacgtcaagggcgccgactacttcctggacaagatcgagcgggaggacttcctgcgcaagcagcgcaccttcgacaacggctccatcccgcaccagatccacctccaggagatgaacgcgatcctgcggcgccagggggagcactaccccttcctgaaggagaaccgggagaagatcgagaagatcctcacgttccgcatcccctactacgtgggccccctggcccgggggaaccgcgacttcgcctggctgacccggaacagcgaccaggccatccgcccgtggaacttcgaggagatcgtggacaaggcctccagcgcggaggacttcatcaacaagatgaccaactacgacctctacctgcccgaggagaaggtcctgcccaagcactccctgctctacgagaagttcgccgtgtacaacgagctgaccaaggtgaagttcatcgccgagggcctgcgggactaccagttcctcgacagcgggcagaagaagcagatcgtcaaccagctgttcaaggagaagcgcaaggtgacggagaaggacatcatccactacctgcacaccgtggacggctacgacggcatcgagctcaaggggatcgagaagcagttcaacgcctccctgagcacctaccacgacctgctcaagatcatcaaggacaaggagttcatggacgaccccaagaacgaggagatcctggagaacatcgtccacaccctgacgatcttcgaggaccgggagatgatcaagcagcgcctcgcgcagtacgactccctgttcgacgagaaggtgatcaagagcctgacccggcgccactacaccggctgggggaagctctccgccatgctgatcaacggcatccgggacaagcagaccgggaagacgatcctggactacctcatcgacgacgcctactacaaccgcaacttcatgcagctgatcaacgacgacggcctgagcttcaaggagatcatccagaaggcccaggtcgtgggcaagaccgacgacgtgaagcaggtcgtgcaggagctcccggggtcccccgccatcaagaagggcatcctgcagagcatcaagatcgtggacgagctggtcaagatcatgcggcacaaccccgagtccatcgtgatcgagatggcgcgcgagaaccagaccaccgcccgggggaagaagaacagccagcagcgctacaagcgcatcgaggacgccctcaagaacctggcccccggcctggacagcaacatcctcaaggagcacccgacggacaacgtgcagctgcagaacgaccggctgttcctctactacctgcagaacgggaaggacatgtacaccggcgaggccctggacatcaaccagctctccagctacgacatcgaccacatcatcccccaggcgttcatcaaggacgactccttcgacaaccgcgtcctgaccagctccaaggacaaccggggcaagagcgacaacgtgccctccatcgaggtggtccagaagcgcaaggccttctggcagcagctgctcgacagcaagctgatctccgagcggaagttcaacaacctgaccaaggccgagcgcgggggcctcgacgagcgggacaaggtggggttcatcaagcgccagctggtggagacgcggcagatcaccaagcacgtcgcccagatcctggacgcccgctacaacaccgaggtgaacgagaaggacaagaagaaccggaccgtgaagatcatcaccctcaagagcaacctggtctccaacttccgcaaggagttccggctgtacaaggtgcgcgagatcaacgactaccaccacgcgcacgacgcctacctcaacgccgtggtcgccaaggcgatcctgaagaagtaccccaagctggagccggagttcgtgtacggcgagtaccagaagtacgacctcaagcggtacatcagccgctccaaggaccccaaggaggtggagaaggccacggagaagtacttcttctacagcaacctgctgaacttcttcaaggaggaggtccactacgccgacggcaccatcgtgaagcgggagaacatcgagtactccaaggacaccggggagatcgcctggaacaaggagaaggacttcgccatcatcaagaaggtgctcagcctgccccaggtcaacatcgtgaagaagcgcgaggtgcagaccggcgggttctccaaggagagcatcctgcccaagggcaacagcgacaagctcatcccgcggaagacgaaggacatcctgtgggacaccaccaagtacgggggcttcgactcccccgtcatcgcgtacagcatcctgctcatcgccgacatcgagaagggcaaggccaagaagctgaagaccgtgaagacgctggtggggatcaccatcatggagaaggccgccttcgaggacaaccccatcaccttcctcgagaacaagggctaccacaacgtccgcaaggagaacatcctgtgcctgccgaagtactccctcttcgagctggagaacgggcggcgccgcctgctcgcgagcgccaaggagctgcagaagggcaacgagatcgtgctgcccgtgtacctcaccacgctgctgtaccactccaagaacgtccacaagctcgacgagcccgggcacctggagtacatccagaagcaccggaacgagttcaaggacctgctcaacctggtgagcgagttctcccagaagtacgtgctggccgacgccaacctcgagaagatcaagagcctgtacgccgacaacgagcaggcggacatcgagatcctggccaactccttcatcaacctcctgaccttcaccgccctgggcgcccccgcggccttcaagttcttcggcaaggacatcgaccgcaagcggtacaccacggtcagcgagatcctcaacgccaccctgatccaccagtccatcaccgggctgtacgagacccgcatcgacctcagcaagctgggcgaggactga

SEQ ID NO: 2048 - RNA, 4143 nt, synthetic construct
  misc_feature 1..4143: note = Cas9 variant
  source 1..4143: mol_type = other RNA
atgaacctgcgccacgtgggcaactacaacatcgggctcgacatgggcaccgccagcgtcgggtgggccgcgatcgacgagcagggcgagctgctgcacttcaaggggaagcccacctggggctcccgcctcttcgacagcgccaacacggccgccaccgcccggatgccgcggggccagcgccggcgctacatccggcgccggtggcgcctggacctgctccagaagttcttctccgaggagatggcggagaaggaccccgagttcttcatccggctgcgccagagctccctgtggcccgaggaccgggagggcgggcacaccgcctaccactggcccctcttcaacgacagcgacttcaacgagaaggagtactacgagaagttcccgaccatcttccacctccgccagtggctgatggagacggacgagaaggccgacatccggctcatctacctggccttccacaacatcgtgaagcaccgcgggaacttcctgcaggagaacaacgactccctcagcgcgcagaacgccaacatgcgggagtccctggagagcttctgcatcgccctggaggagtggtgcgacgagaaggagctgacctgctcctgcgacccccagaagctggagcacctgttcaaggaggtgaagtaccgcagcgacatccgggacggcttcgccgccctcctggggctggcgtgctccggcgagaacgaggtcgacgtgaaggccatggccaaggagatgggcaaggccatcgtggggtacaaggccgacttcagcaagatcttcaccgagtgcgacaaggagggctccagcttccgcctctccgacgacgaggggcccgaggcgttcctggacatctgccccgacgacggcatcgccctgttcgaggccatccagatggtctacagctccttcatcctcaccggcatgctgacggagaaggggctgagcctcagcaagatctccgcctacaaccagtacggccaggacctggagagcctgaaggccctcgtgaaggagtacgtgccgaacgagtactccagcttcttccgggggcccacctactccggcagcaccgagtacgacccctccaaggcgcaggggtacacccgctacaacctgggccccagcaagaagggctccggggccaagccgatggcctacgaggacttcaagaagtccgtcgagcagctgttcgccaacacgaacgccatcaacgacgagcgctacaaggagatgatgggccggttcgcggaggagaagttcctccgccggctgcgcaccagcgacaacgggcggatccccttccagctgaacctcgaggagatgaccgccatcatcatcaaccagggcaagtactaccccttcctgctggagcagcaggagaagctcgagagcctggtgcgcttccggatcccctactacgtggggccgctgacccgcatcaacgcccggctcgactccaagggcaacgcctgcttcgcgtggagcaagcgcaaggacggcatggactccgccagcatcaagccctggaactgggacgaggtcatcgacaagcacgcctccgcccaggccttcatcgagcggatgacggggacctgcacctacctgcgcggcgagcccgtgctgccccggtgcagcctcctgtacgaggagtactgcgtgctgaacgagctgaacggggcgcgctggacccaggacggcgacaagttcatccggttcgactacaaggaccgctccgacatcatcgaggagctgttcaagaagcggcgcgggcggatccagtacgccgccgtcgccgactggatgaagcaggagcgcagccacgccaacgtgcacgtgagcggcggccagggggagaacgcgttcgagtcccgcctcagctcctaccacttcttctgcaacgacgtcttcggcgtggacgagctgccggggagctacgtggacatggtcgaggagatcatcctctggtccacgctgttcgaggaccggagcatcctgcgcgaggagatccagcggaagtacggcgacgtgctcaacgaggagcagatcaagaccatctgcaagaagcgcttctccggctgggggcggctgagccgcaagctgctctgctccctgaaggcccagaccgacaacggccccaagagcatcatggacatcctgcaggagggggaccagaacaacggccgggtggggcgcgccatggtcttccaggagatcctccacgacgagcagctgggcttcgagcagaagatcgaggaggagaacacccagtccatgctggagggcgagaacctcctgatcgaggacctgcccgggagccccgccatccggcgctccatcaaccaggccgtgcggatcgtcgacgagatcgtgggcatcgcggggcacgccccggacaacatcttcatcgaggtgacgcgcgaggacgacaccaagaagaagggcaagcggaccaccacgcgctacagcaacatccagaaggccctcgaggccctgaaggaggagggggcggaggccctgcgggagctcaagacctacaagcacaacgagctggacaagcgcctgtccctctacttcatgcagaacggcaagagcctgtactccggcatccccctggacatccggcgcctcagcgagtaccagatcgaccacatcatcccccagagctacatcaaggacgactcctacgagaacatggccctggtcctgcccggggagaaccagagcaaggccgacaacctcctgatctcccaggacatccggatcaagatgaaggccacctggaccgcgctgcacaaggccggcctcatgggggacaagaagtacaacaacctgatgaacagctccatcagcgacgccaagatgaagggcttcatcaaccgccagctggtggagacgtcccagagcgtgaagctcacccagatgatgctgtcccagaagtacccgggggccaaggtccggcccatcaaggccagcatctccagccagctgcgcgacgcgtgcgacctcgtgaagtgccgcgaggccaacgactaccaccacgcccacgacgcctacctggcctgccaggtgggccggttcgtcctgaagcgccactccagcatgttcgacaaccccatcggcatgaccaaggtgatccgggacttcgtgaagcgccaggggcaggagttcaagcggaacggcaagctcccggcgtacgcctcccgcagcgggttcatcgtccagtccttcatgcggagcggcttcgacgccgagaccggggagctgctgcgcgacgactggaacgcccccttcgagatcgcgcggatcaagcgctgcctcaactaccgggactgctacatctcccgcatgcccatggaggacagcggcgccttctgggacgccacgatctacagccccaaggccggcaagaagggggccctgccggtgaagcagggcctgcccgtggagaagtacgggtcctacagccgggagcagttcgcgtacttcttcgtctacaaggcctacaaccccaagaagaaggcctaccgcctcgagttcgaggccgtgcccgtgcgggtcgcctccgcggtggagacccgcgagaacgccctggaggagtacgccaagagcgtggccaagcaggccggcctggagttcgtcgaggtggcgcggccgaaggtgtacaagtaccagctcatcgagctgggcgaggaccgcctgtacatcaccgggaagcgggaggtccgcaacgcctcccagctcgccttcagcctggacgagatcgacctgctcaagcgcctggccgagggcgaggagacctccagcgaggagcgggagcgcctgttcgacgtgctcatcgagaagtacgcccggtacgcgccccgcctggcccggcagctgtccgtggacagcatgtccgccaccttcgagacgctcaacgccgaggagcagctggggatcctgctcagcctggtcgagatcgcgaacggcaagcgcaacatgatcgacctgtccagcgccgggggctccaagaacgccggctgcatgaaccccaccttcagctccgagctcagctcccccgggagcaacttcaccttcatcgaccagagcgtgaccggcatgttcgagcggcgccagcggctggagctgtga

SEQ ID NO: 2049 - RNA, 4146 nt, synthetic construct
  misc_feature 1..4146: note = Cas9 variant
  source 1..4146: mol_type = other RNA
atggtgaagaagaagtacgccatcggcatcgacatcgggaccaacagcgtcggctggtccatcgtgaccgacgactacaaggtgcccagcaagaagatgaaggtcttcgggaacacggagaagcgctacatcaagaagaacctgctgggcaccctgctgttcgacgaggggaacaccgccgagaaccggcgcctcaagcggaccgcgcgccggcgctacacgcggcgccggaaccgcatcctgtacctgcaggagatcttcgccgaggagatcaacaagatcgacgactccttcttccagcggctcgacgacagcttcctgatcgtggaggacaagcagggctccaagcacccgatcttcggcaccctgcaggaggagaaggagtaccacaagcagttccccaccatctaccacctccgcaagcagctggccgacagctcccagaaggccgacatccggctgatctacctcgccctggcgcacatcatcaagtaccgcgggcacttcctgttcgagggcgacctcaagagcgagaacaaggacgtgcagcacctgttcaacgacttcgtcgagatgttcgacaagaccgtggaggggtcctacctgagcgagaacctccccaacgtggccgacgtcctggtggagaaggtgtccaagagccggcgcctggagaacatcctccactacttccccaacgagaagaagaacggcctgttcgggaacttcctggccctcgccctgggcctgcagccgaacttcaagacgaacttcgagctcgcggaggacgccaagatccagttctccaaggagacctacgaggaggacctggaggagctgctcggcaagatcggggacgactacgccgacctgttcatcgccaccaagagcctgtacgacggcatcctcctggccgggatcctgtccaccacggacagcaccaccaaggcgcccctctccagctccatggtcaaccggtacgaggagcaccagaaggacctggccctgctcaagaacttcatccaccagaacctgagcgacagctacaaggaggtgttcaacgacaagctgaaggacggctacgccggctacatcgaggggaagaccacgcaggagaacttctaccgcttcatcaagaaggccatcgagaagatcgagggctccaactacttcatcgacaagatcgaccgggaggacttcctccgcaagcagcggaccttcgacaacgggagcatcccccaccagatccacctccaggagatgcacgccatcatccgccgccaggcggagttctaccccttcctggtggagaaccaggacaagatcgagaagatcctcaccttccggatcccgtactacgtcggccccctggcccgcgggaagtccgagttcgcctggctgaaccgcaagagcgacgagaagatccggccctggaacttcgacgagatggtggacaaggagacctccgccgagaacttcatcacgcggatgaccaactacgaccgctacctccccgaccagaaggtgctgccgaagcacagcctgctgtacgagaagttcgccgtctacaacgagctcaccaaggtgaagttcatcgcggagggcatgcgggactaccagttcctggactccggccagaagaaggacatcgtgaagaccctgttcaagacgaagcgcaaggtcaccgccaaggacatcaaggcctacctcgagaacagcaacgggtacgccggcgtggagctgaaggggctggaggagcagttcaacgcctccctccccacctaccacgacctgctgaagatcctccgggacaaggcgttcatcgacgccgaggagaaccaggagatcctggaggacatcgtgctgaccctcacgctgttcgaggaccgcgagatgatccggaagcgcctggagaagtacaaggacatcctcaccgaggagcagcggaagaagctggagcgccggcactacaccggctgggggcgcctgagcgccaagctcatcaacggcatcctggacaaggtcacccggaagacgatcctgggctacctcatcgacgacgggacctccaaccgcaacttcatgcagctgatcaacgacgacaccctgagcttcgtggacgagatccggctcgcccagggctccggggaggcggaggactaccgcgccgaggtccagaacctggccggcagccccgccatcaagaaggggatcctgcagtccctcaagatcgtggacgagctgatcgaggtgatgggctacgagcccgagcacatcgtcgtggagatggcccgcgagaaccagttcaccaaccagggccggcgcaacagccagcagcggatcaaccgcctggagaacgcgctcaaggacttcgggtccaagatcctggaggagcagaagccgtacggcgtgagcaaggtcaacaacatccacctccagtccgaccggctgttcctgtactacctgcagaacgggaaggacatgtacacggacgaggagctcgacatcgaccacctgagcgagtacgacatcgaccacatcatcccccaggccttcatcaaggacgacagcctggacaacaaggtgctcaccaagtccgccaagaaccgcggcaagagcgacgacgtgccctccatggagatcgtccacaaccggaagaacttctggcgccagctgctcaagagcaagctgatctcccagcggaagttcgacaacctgaccaaggccgagcgcggcgggctgaccaacgaggacaaggcccggttcatccagcgccagctcgtggagacccggcagatcacgaagcacgtggcgcgcatgctggacacccggttcaacaccaagctggacgaggccggcaaccgcatccgggaccccaaggtcaacatcatcaccctcaagagcaacctggtgtcccagttccgcaaggactaccagctgtacaagatccgggagatcaacaactaccaccacgcccacgacgcctacatcaacgccgtggtcgcgacggccctcctgaagaagtacccgcagctggcccccgagttcgtgtacggggagtaccccacctacaacagctacaactcccgcaagagcgccaccgagaaggtgctgttctactccaacatcatgaacttcttcaagcggatcgtcgtgcacagcaagaccggcgaggtgcgcatccgccccgtcatcgaggtgaacaaggagacgggggagatcgtgtgggacaagaagtccgacttccggaccgtccgcaaggtgctgagctacccccaggtgaacgtcgtgaagaagaccgaggtgcagaaccacggcctggaccggggcaagcccaaggggttctacaacgcgaacctctccccgcgccccaaggagggcagcgtcgagaacctggtgccggccaagcagtccttcgacaccaagcggtacgggggctacgccgggatcagcaacagctacgccgtgctggtcaacggcatcatcgagaagggcaagaagaagtccaaggccgaggtgacggagttccaggggatcagcatcctcgcgcgcaaggacttcgacaagaaccccaagcagtacctgctgaacctcggctacaaggacatcaagtccatcatcaagctgcccaagtacagcctgttcgagctcgagaacgggtcccggcgcatgctggccagcatcctgtccaccaacaacaagcggggcgagatccacaaggggaacgagatgtacctcccggacaagttcgtgaccctgctgtaccacgccatgcgcgtcaaccggaccctcgagcccggccacaagaagtacgtggagacgcaccgccacgtgttcgacgagctgctgatctacatcctcgagtacaacgagaagatcgtcggcgccaaggccaacgggaagcggatcgtggaggcgtacagcgcccgcaaggacaccgacaacctggaggagctgtgcaactccttcatcaacctcctgaacctgaccgccctcggcagcgccgtggacttcgagttcctggggaccaagatcccccggtaccgcgactacacgccctccagcctgctcaaggccaccctgatccaccagtccgtcaccggcctgtacgagacccggatcgacctcagcaagctcgggggcgactga

SEQ ID NO: 2050 - RNA, 4146 nt, synthetic construct
  misc_feature 1..4146: note = Cas9 variant
  source 1..4146: mol_type = other RNA
atgaactacgtgaaggagtaccacatcggcctggacatcgggaccagctccatcggctgggccgtcaccgacagccagttcaagctcatgcgcatcaaggggaagacggccatcggcgtgcggctgttcgaggaggggaagaccgcggccgagcgccggaccttccgcaccacgcggcgccggctgaagcgccggaagtggcgcctccactacctggacgagatcttcgcgccccacctccaggaggtggacgagaacttcctccggcgcctgaagcagtccaacatccacccggaggaccccgccaagaaccaggccttcatcggcaagctgctgttccccgacctgctgaagaagaacgagcggggctaccccaccctcatcaagatgcgcgacgagctgccggtcgagcagcgggcccactaccccgtgaccaacatctacaagctgcgcgaggccatgatcaacgaggaccggcagttcgacctccgcgaggtgtacctggccgtccaccacatcgtgaagtaccgggggcacttcctgaacaacgccagcgtggacaagttcaaggtcggccgcatcgacttcgacaagtccttcaacgtgctcaacgaggcgtacgaggagctgcagaacggggagggcagcttcaccatcgagccctccaaggtggagaagatcgggcagctgctcctggacacgaagatgcggaagctggaccgccagaaggccgtcgccaagttcctcgaggtgaaggtggccgacaaggaggagaccaagcgcaacaagcagatcgccaccgcgatcagcaagctggtcctgggctacaaggccgacttcgccaccgtggccatggccaacggcaacgagtggaagatcgacctctccagcgagacgtccgaggacgagatcgagaagttccgggaggagctgagcgacgcgcagaacgacatcctgaccgagatcacctccctcttcagccagatcatgctgaacgagatcgtgcccaacgggatgtccatcagcgagtccatgatggaccgctactggacccacgagcggcagctggccgaggtcaaggagtacctcgccacgcagccggccagcgcccgcaaggagttcgaccaggtgtacaacaagtacatcggccaggcgcccaaggagaaggggttcgacctggagaagggcctgaagaagatcctctccaagaaggagaactggaaggagatcgacgagctgctgaaggccggcgacttcctccccaagcagcggaccagcgccaacgtggtcatcccccaccagatgcaccagcaggagctggaccgcatcatcgagaagcaggccaagtactacccgtggctggccaccgagaaccccgcgaccggggagcgggaccgccaccaggccaagtacgagctcgaccagctggtgagcttccggatcccctactacgtgggccccctggtcacgccggaggtgcagaaggccacctccggggccaagttcgcgtgggccaagcgcaaggaggacggcgagatcaccccctggaacctctgggacaagatcgaccgggccgagagcgccgaggccttcatcaagcgcatgaccgtcaaggacacgtacctgctgaacgaggacgtgctccccgcgaactccctgctgtaccagaagtacaacgtgctgaacgagctcaacaacgtccgggtgaacgggcgccggctgagcgtgggcatcaagcaggacatctactccgagctgttcaagaagaagaagaccgtcaaggccagcgacgtggcctccctcgtgatggccaagacccgcggcgtcaacaagcccagcgtggaggggctgtccgacccgaagaagttcaacagcaacctggccacctacctcgacctgaagtccatcgtgggcgacaaggtcgacgacaactgctaccagacggacctggagaacatcatcgagtggcggagcgtgttcgaggacggggagatcttcgcggacaagctcaccgaggtggagtggctgaccgacgagcagcgctccgccctggtcaagaagcggtacaagggctgggggcgcctcagcaagaagctgctgaccggcatcgtggacgagaacggccagcgcatcatcgacctcatgtggaacacggaccagaacttcatgcagatcgtgaaccagcccgtcttcaaggagcagatcgaccagctgaaccagaacgccatcaccaacgacgggatgaccctgcgggagcgcgtggagtccgtgctcgacgacgcctacaccagcccccagaacaagaaggccatctggcaggtcgtgcgggtggtcgaggacatcgtgaaggcggtgggcaacgcccccaagtccatcagcatcgagttcgcccgcaacgaggggaacaagggcgagatcacgcggtcccgccggacccagctgcagaagctgttcgaggaccaggcccacgagctcgtcaaggacaccagcctgaccgaggagctggagaaggcgctcgacctgagcgaccgctactacctgtacttcacccagggcgggaaggacatgtacacgggcgacccgatcaacttcgacgagatctccaccaagtacgacatcgaccacatcctcccccagagcttcgtgaaggacgactccctggacaaccgggtgctggtcagccgcgccgagaacaacaagaagtccgaccgggtgcccgccaagctctacgccgccaagatgaagccctactggaaccagctgctgaagcaggggctcatcacccagcgcaagttcgagaacctgaccatggacgtggaccagaacatcaagtaccggagcctgggcttcgtcaagcgccagctcgtggagacgcgccaggtgatcaagctgaccgcgaacatcctggggtccatgtaccaggaggccggcaccgacatcatcgagacccgggccggcctcacgaagcagctgcgggaggagttcgacctgccgaaggtccgcgaggtgaacgactaccaccacgccgtggacgcctacctcaccaccttcgcggggcagtacctgaaccggcgctaccccaagctgcggagcttcttcgtctacggcgagtacatgaagttcaagcgcgggtccgacctcaagctgcgcaacttcaacttcttccacgagctgatggagggcgacaagagccaggggaaggtggtggaccagcagaccggcgagctcatcacgacccgggacgaggtcgccaagtccttcgaccgcctgctgaacatgaagtacatgctcgtgagcaaggaggtgcacgaccggtccgaccagctgtacggcgccaccatcgtcaccgccaaggagagcgggaagctgacgtcccccatcgagatcaagaagaaccgcccggtggacctctacggcgcctacaccaacgggaccagcgcgttcatgaccatcatcaagttcacgggcaacaagcccaagtacaaggtgatcggggtccccaccacctccgccgtgggcctgaagcgggtgggcaagcccgggagcgagagctacaaccaggagctgcaccgcatcatcaagtccaacccgaaggtcaagaaggacttcgagatcgtggtcccccacgtgagctactcccagctcatcgtggacggcgactgcaagttcaccctggccagcgacacgtaccagcaccccgccacccagctggtcctctccaaggagagcatggagatcatcgcggacgacttcaagttcgtgaaggagaaccccgccaccgccgacgagcagctggtgcgggtcttcgacgagatcgtgaaccagatgaaccactacttcaccatcttcgaccagcgctccaaccggcagaaggtgacgaaggcccgcgacaagttcgtcagcctgccgaccgagtccgagtacgagggggccaagaagacccaggtgggcaagaccgaggtgatcacgaacctcctgatggggctgcacgcgaacgccgcccagggcgacctcaaggtcctgggcctgagcaccttcgggttcttccagtccagcggcgggctcaacctgtccgaggacgccatgatcgtgtaccagagccccaccggcctgttcgagcggcgcatctgcctcaaggacatctga

SEQ ID NO: 2051 - RNA, 4146 nt, synthetic construct
  misc_feature 1..4146: note = Cas9 variant
  source 1..4146: mol_type = other RNA
atgaagcagatcctgaagaaggtgcagggctacaacatcgggctcgacatcggcaccaacagcgtcgggtgggtggtgaccgacgagaacgccaacctgctgcagttccgcaagaagaacatgtggggcgcccgcctcttcgagaagggggacacggcgcagggccggcggctgtcccgcagcacccggcgccggtacgaccgccggcgccagcggatccactacctgcaggagatgctcgccaccatggtcctgcccatcgacgagtccttcttcatccgcctgaacgaggccttcctctggaaggaggacaagagcgtgcagcgggactacatcctgttcgccgacaagcagttcaccgaccgcgacttctacaagcagttcaagacgatctaccacctccggaagttcctcctggacaccaaggagaaggccgacccgcgcttcatctacctggcgctccaccacatgatcaagtaccggggcaacttcctgtaccaggggcagtccttcgacgtggtcgagaacgtgcaggagagcttccgcgtgctgctcgaggagatgtacgagcagctgggcaaggagtgggagtacggggagcacttcgacgacatccagcggatcctggagaacaccaccatcggcaagaagtccaagcaggagcagatcgccgccatcctcacggagcagtacgggaacaagaagctggccaacgaggtcacccgcgcgtgcctgggctacagcttcgacctcaccgtggtgatggagaacgagaacctgctggacgagtccggcaagaagatcaagatcagcttctccgacagcaagtacgaggagcaggagctcgagctgcagaaccggctggaggagaagttcgccgtcatcgaggccctcaagcgcatctacaactggctggtgctgaaggacaccctccgcgggaagaagtacatctccgaggccatggtgaacaagtacgaggcccaccacgaggacctggtcaagctgaagcgcctcttccggacgtacctgagcaccgaggagtactcctgcttcttccggaaggagaagcagaaggacaagtacatcagcaactacgtgaactaccgcaagggcgcggagcggtgctccaaggagaagctgtacaaggccatccacgagctgttcgacaccgtggccaaggacgacgtcgtgtaccaggagatcgtggagaagatggaccagggggagttcctgaccaagcagaacgaggtcagcaacgcctacatcccctaccagtgcaacgaggtggagatgaagcgcatcctgaagcagcagggcgagttctaccccgagctcaaggagaacgccgacaagatcctgcagctgctcctgttccggatcccctactacgtgggcccgctggtcgacgagaagcagtccaagttcgcgtggatgaagcgccggacggggatggagcaggtcaagatctacccctggaacttcgagcaggtcgtggacatcgaccagaccgccgaggccttcatcacccgcatgaccaactactgcacgtacctccccgaggagaaggtgctgcccaagcagagcctgctgtacagcgagtacgagctcctgcaggagctgaacaagatcaagatcaacggcaagttctccctcgagacccggaacaagatcatcgagcagctgttcaagaagcagaagaaggtgaccgagaagcagctgaagaagtggctcgtgcgcgagcagtactgcaccacgaaggtgaccgagaagatggtcaagctggacgagaacgcctactacatcaccgggttccagaaggagaacgagttcgccagctccctgaccagctacatcgacttcacgaagatcctcggcgagatcaccgagcggaaccgcaagatgatcgaggagatcatctactggctgaccgtgttcgaggagaagtccatcgtgaagcggaagatccagaagaagtacgggaacgagatcaacgacaagcagctggcgcagatcctcaagctgaactacagcggctggggccgcttctccgagaagttcctgaacgggatcaagggcttcgaccggcaggggcagaagaagaccatcatggagctcctgcgcgaggacagccggctgctcaacatcatgcagatcatcaacaacgaggagatgggcttctgcaagatcatcgaggccaaccagaagaagctgtacgggaacgagaacctgctcgacgtcgtgcaggagctgcacggctccccggccatcaagcgcggcatctggcagagcctgaagatcgtggaggagatcatctccatcatgggcggggtcccccagaacatcttcatcgagttcgcccgcgaggacgacgaccgggtgcgcacgaacagccgggtgaagcagatcgagcgcctctacaagaagttcaaggaggaggtcaacgacttcaacgagcacgccgcgaacgagctgaaggagaagcggtaccagaaccgcatcgacgaggagaaggtgttcctgtacttcatgcagaacgggaagtccctctacagcggcgtgaccctggacatcgaccggctgaacgagtacgaggtcgaccacatcatcccccgcaccctcgtgaaggacgactccctggagaacaaggccctggtgctcaagggggagaaccagcggaagggcgagggcctgatcccccacgagtggcagaaccgccagaaggaggtctggaagaagctgctcagctgcgggctgatgggcaagaagaagtacgccaacctgtgcaaggagtccttcgggaacgagaaggagcagaagcacttcatcgcccggcagatcgtggagacccgccagatcatcaagcaggtcgcgaacatcctcgcccagtactaccagggcgtgaacgtggccgccgtgaaggccagcctgggctccgagctgcgggagaactacacgatcgagaagaaggacgacaacgggttcttcatggagaacaagagctacaccatgctcaagagccgcaagatcaacgacttccaccacgcgcaggacgcctacctggcctgcgccgtcggcctgtacatcaaggccgcgttcccgaagtacgagaaggagatcgactacgaggggtaccggaagtactaccagaagaagaaccagcagaaggacggcgtgcgcaacgagaagcggcagttcttctcctacgtgatgagccgcttctccgagcagatcgtcgacaaggagaccggggagatcctctgggacggcacccagaagctggcctacatcaagaagatcttcggctaccgggactgcctgatcaccaagaagctcgaggagaacacgggggagttctacaagcagaccatcaacgccaagcccgagaagggcaaggagaacaacaccaagctgctgcccatcaagaaggggctcagcgtggagaagtacggcgggtaccagggcggcgaggccgcctactcctgcctggtgcgctaccagcaggggcggaagaccaagctgagcctcgagaagatctccgtcatcatcgcgaagaagatcgccgagaaggaggtgagcctggaccgctacctgaaggagaagctcggcgtggaggagatcgtcatcctgcgcaagaaggtgatgaagaaccagctgatcgaggactccgacgggaaccggttctacctcacggccgccaccgaggtggtcaacgcgaagcagttcatcctggacggcaagcaccagcacctcctgcgcaccatcgccatcatggagaagggggagtactacggctaccggctggacgagctggagaacagcatggacgagctctacgcctactaccgcatgaagatccagcagcagtaccccgcctacgagtccatcgtgaagaagatcgtggagagccacgtctacgagtccctgcacgtggaggagaagatcaaggccgtgcaggagaagggcaagttcctgatccagctcctgcggctgaccgaggcgaacgccgagtgcatcgacctcaagacgatcagcgacgggcgcctggccgaccggatcggccgcaagaaccactacaccatcaaggaggggatcaagttcatcgaccagtccatcaccggcctgtacgagcggtacatgaccgtctga

SEQ ID NO: 2052 - RNA, 4146 nt, synthetic construct
  misc_feature 1..4146: note = Cas9 variant
  source 1..4146: mol_type = other RNA
atggactacgtgaaggagtaccacatcggcctggacatcgggaccagctccatcggctgggccgtcaccgacagccagttcaagctcatgcgcatcaaggggaagacggccatcggcgtgcggctgttcgaggaggggaagaccgcggccgagcgccggaccttccgcaccacgcggcgccggctgaagcgccggaagtggcgcctccactacctggacaagatcttcgcgccccacctccaggaggtggacgagaacttcctccggcgcctgaagcagtccaacatccacccggaggaccccgccaagaaccaggccttcatcggcaagctcctcttccccgacctgctgaagaagaacgagcggggctaccccaccctcatcaagatgcgcgacgagctgccggtcgagcagcgggcccactaccccgtgaccaacatctacaagctgcgcgaggccatgatcaacgaggaccggcagttcgacctccgcgaggtgtacctggccgtccaccacatcgtgaagtaccgggggcacttcctgaacaacgccagcgtggacaagttcaaggtcggccgcatcgacttcgacaagtccttcaacgtgctcaacgaggcgtacgaggagctgcagaacggggagggcagcttcaccatcgagccctccaaggtggagaagatcgggcagctgctcctggacacgaagatgcggaagctggaccgccagaaggccgtcgccaagctcctggaggtgaaggtggccgacaaggaggagaccaagcgcaacaagcagatcgccaccgcgatgagcaagctggtcctcggctacaaggccgacttcgccaccgtggccatggccaacggcaacgagtggaagatcgacctgtccagcgagacgtccgaggacgagatcgagaagttccgggaggagctgagcgacgcgcagaacgacatcctcaccgagatcacctccctgttcagccagatcatgctgaacgccatcgtgcccaacgggatgtccatcagcgagtccatgatggaccgctactggacccacgagcggcagctcgccgaggtcaaggagtacctggccacgcagccggccagcgcgcgcaaggagttcgaccaggtgtacaacaagtacatcggccaggtgcccaaggagaaggggttcgacctggagaagggcctcaagaagatcctgtccaagaaggagaactggaaggagatcgacgagctgctcaaggccggcgacttcctgcccaagcagcggaccagcgccaacggggtcatcccccaccagatgcaccagcaggagctggaccgcatcatcgagaagcaggccaagtactacccgtggctcgccaccgagaaccccgcgaccggcgagcgggaccgccaccaggccaagtacgagctggaccagctggtgagcttccggatcccctactacgtggggcccctcgtcacgccggaggtgcagaaggccacctccggcgccaagttcgcgtgggccaagcgcaaggaggacggggagatcaccccctggaacctgtgggacaagatcgaccgggccgagagcgccgaggccttcatcaagcgcatgaccgtcaaggacacgtacctgctcaacgaggacgtgctgcccgcgaactccctgctgtaccagaagtacaacgtgctcaacgagctgaacaacgtccgggtgaacggccgccggctgagcgtgggcatcaagcaggacatctacaccgagctgttcaagaagaagaagaccgtcaaggccggggacgtggcctccctggtgatggccaagacccgcggcgtcaacaagcccagcgtggaggggctgtccgacccgaagaagttcaacagcaacctcgccacgtacctggacctgaagtccatcatgggcgacaaggtggacgacaaccggtaccagatggacctcgagaacatcatcgagtggcgcagcgtcttcgaggacggggagatcttcgcggacaagctgaccgaggtggagtggctgaccgacgagcagcggtccgccctcgtgaagaagcgctacaagggctggggccgcctgagcaagaagctgctcaccgggatcgtcgacgagaacggccagcggatcatcgacctgatgtggaacacggaccagaacttcatgcagatcgtgaaccagcccgtgttcaaggagcagatcgaccagctgaaccagaaggccatcaccaacgacgggatgaccctccgcgagcgggtcgagtccgtgctggacgacgcctacaccagcccccagaacaagaaggccatctggcaggtcgtgcgcgtggtggaggacatcgtcaaggcggtgggcaacgcccccaagtccatcagcatcgagttcgcccggaacgaggggaacaagggcgagatcacgcgctcccggcgcacccagctgcagaagctgttcgaggaccaggcccacgagctggtgaaggacaccagcctgaccgaggagctcgagaaggcgccggacctgtccgaccggtactacttctacttcacccagggcgggaaggacatgtacacgggcgaccccatcaacttcgacgagatcagcaccaagtacgacatcgaccacatcctgccccagagcttcgtcaaggacgactccctcgacaaccgcgtgctggtgagccgggccgagaacaacaagaagtccgaccgcgtccccgccaagctgtacgccgccaagatgaagccgtactggaaccagctcctgaagcaggggctgatcacccagcggaagttcgagaacctcaccatggacgtggaccagaacatcaagtaccgcagcctgggcttcgtgaagcggcagctggtcgagacgcgccaggtgatcaagctcaccgcgaacatcctgggctccatgtaccaggaggccgggaccgacatcatcgagacccgggccggcctgacgaagcagctccgcgaggagttcgacctgcccaaggtgcgggaggtcaacgactaccaccacgccgtggacgcctacctgaccaccttcgcggggcagtacctcaaccgccggtaccccaagctgcgcagcttcttcgtgtacggcgagtacatgaagttcaagcacgggtccgacctgaagctccgcaacttcaacttcttccacgagctgatggagggcgacaagagccagggcaaggtcgtggaccagcagaccggggagctgatcacgacccgggacgaggtggccaagtccttcgaccgcctcctgaacatgaagtacatgctggtcagcaaggaggtgcacgaccggtccgaccagctctacggcgccaccatcgtgaccgccaaggagagcgggaagctgacgtccccgatcgagatcaagaagaaccgccccgtcgacctgtacggcgcctacaccaacgggaccagcgcgttcatgaccatcatcaagttcacgggcaacaagcccaagtacaaggtgatcggcgtgcccaccacctccgccgtcgggctcaagcgggtgggcaagccggggagcgagtcctacaaccaggagctgcaccgcatcatcaagagcaaccccaaggtgaagaaggacttcgagatcgtcgtgccccacgtcagctactcccagctgatcgtggacggcgactgcaagttcaccctcgccagcgacacgtaccagcaccccgccacccagctggtgctgtccaaggagagcatggagatcatcgcggacgacttcaagttcgtcaaggagaacccggccaccgccgacgagcagctcgtgcgggtgttcgacgagatcgtcaaccagatgaaccactacttcaccatcttcgaccagcgctccaaccggcagaaggtgacgaaggcccgcgacaagttcgtgagcctgcccaccgagtccgagtacgagggggccaagaagacccaggtcggcaagaccgaggtgatcacgaacctgctcatgggcctgcacgcgaacgccgcccagggggacctgaaggtgctcggcctgagcaccttcgggttcttccagtccagcggcgggctgaacctctccgaggacgccatgatcgtctaccagagccccaccggcctgttcgagcggcgcatctgcctgaaggacatctga

SEQ ID NO: 2053 - RNA, 4146 nt, synthetic construct
  misc_feature 1..4146: note = Cas9 variant
  source 1..4146: mol_type = other RNA
atgaagaagtcctacgccatcggcatcgacatcgggaccaacagcgtgggccactgcgtcatgtacaccgagaactacaaggtgcccagcaagaagatgaaggtgttcgggaacacggagaagcgctacatcaagaagaacctgctcggcaccctgctgttcgacgaggggaacaccgccgagaaccggcgcctcaagcggaccgcgcgccggcgctacacgcggcgccggaaccgcatcctgtacctgcaggagatcttcgccgaggagatcaacaagatcgacgactccttcttccagcggctcgacgacagcttcctgatcgtcgaggacaagcagggctccaagcacccgatcttcggcaccctgcaggaggagaaggagtaccacaagcagttccccaccatctaccacctccgcaagcagctggccgacagctcccagaaggccgacatccggctgatctacctcgccctggcgcacatcatcaagtaccgcgggcacttcctgttcgagggcgacctcaagagcgagaacaaggacgtgcagcacctgttcaacgacttcgtggagatgttcgacaagaccgtcgaggggtcctacctgagcgagaacctccccaacgtggccgacgtgctggtcgagaaggtgtccaagagccggcgcctggagaacatcctccactacttccccaacgagaagaagaacggcctgttcgggaacttcctggccctcgccctgggcctgcagccgaacttcaagacgaacttcgagctcgcggaggacgccaagatccagttctccaaggagacctacgaggaggacctggaggagctgctcggcaagatcggggacgactacgccgacctgttcatcgccaccaagagcctgtacgacggcatcctcctggccgggatcctgtccaccacggacagcaccaccaaggcgcccctctccagctccatggtgaaccggtacgaggagcaccagaaggacctggccctgctcaaggacttcatccgccagaacctgagcgacagctacaaggagttcttcaacgacaccctgaaggacggctacgccggctacatcgaggggaagacgacccaggagaacttctaccggttcatcaagaaggccatcgagaagatcgagggctccaactacttcatcgacaagatcgaccgcgaggacttcctccggaagcagcgcaccttcgacaacgggagcatcccccaccagatccacctccaggagatgcacgccatcatccgccggcaggcggagttctaccccttcctggtcgagaaccaggacaagatcgagaagatcctcaccttccgcatcccgtactacgtgggccccctggcccgggggaagtccgagttcgcctggctgaagcgcaagagcgacgagaagatccggccctggaacttcgacgagatggtggacaaggagacgtccgccgagaacttcatcacccgcatgaccaactacgaccagtacctccccgaccagaaggtcctgccgaagcacagcctgctgtacgagaagttcgccgtgtacaacgagctcaccaaggtgcggtacgtcacggagcagggcaagtccttcttcttcgacgcgaacatgaagcaggagatcttcgacggcgtgttcaaggtgtaccgcaaggtcaccaaggagaagctgatggacttcctggggaaggagttcgacgagttccggatcgtggacctcatgggcctggacaaggacaacaagagcttcaacgcctccctggggacctaccacgacctcaagaagatcgtgagcaaggacctgctggacaaccccgagaacgaggacatcctcgagaacgtcgtgctgaccctgacgctgttcgaggaccgcgagatgatccggaagcgcctggagaagtacaaggacgtcctgaccgaggagcagcggaagaagctcgagcgccggcactacaccggctgggggcgcctgtccgccaagctgatcaacggcatccggaacaagaccacgcgcaagaccatcctcgactacctgatcgacgacggcaccagcaaccggaacttcatgcagctgatccacgacgacaccctctccttcgtggacgagatccgcctggcccaggggagcggcgaggccgaggactaccgcacggaggtgcagaacctggcggggtcccccgccatcaagaagggcatcctccagagcctgaagatcgtcgacgagctgatcggggtgatgggctacaaccccgagcacgtggtcgtggagatggcccgggagaaccagttcaccaaccagggccgccggtccagccagcagcgctacaagaagatcgagaacgccatcaagaacctcgactccaacctgaacagcaagatcctgaaggagtacccgaccaacaaccaggcgctccagaacgaccggctgttcctgtactacctccagaacgggaaggacatgtacaccgacgaggagctggacatcgaccagctgagccagtacgacatcgaccacatcatcccccaggccttcatcaaggacgactccctcgacaacaaggtgctgaccaagagcgccaagaaccgcggcaagtccgacgacgtccccagcctggagatcgtgcacaagaagaagaacttctggaagcagctcctggactcccagctgatcagccagcggaagttcgacaacctcacgaaggccgagcgcgggggcctgaccaacgaggacaaggcccggttcatccagcgccagctggtggagacccggcagatcaccaagcacgtcgcgcgcatcctcgacacgcggttcaacaccaagctggacgacgccggcaaccgcatccgggaccccaaggtgaacatcatcaccctgaagtccagcctcgtgtcccagttccgcaaggactaccagctgtacaaggtccgggagatcaacaactaccaccacgcccacgacgcctacctgaacgccgtggtggcgaccgccctcctgaagaagtacccgcagctggcccccgagttcgtctacggggactaccccaagtacaacagctacaagtcccgcaagagcgccacggagcgggtgctgttctactccaacatcatgaacttcttcaagcgcgtggtcaagagctccaagaccggcaccgtgaagatccggcccatcatcgaggtgaacaaggagaccggggagatcgtctgggacaagaagtccgacttccgcacggtgcgcaaggtgctgagctacccgcaggtcaacgtggtgaagaagaccgaggtccagaaccacggcctggaccgggggaagcccaagggcttctacaacgccaacctcagcccccgccccaaggagggcagcgtggagaacctggtgccggcgaagcagtccttcgacaccaagcggtacgggggctacgccgggatcagcaactcctacgccgtcctggtgaacggcatcatcgagaaggggaagaagaagtccaaggccgaggtgaccgagttccagggcatcagcatcctcgcgcgcaaggacttcgagaagaaccccaagcagtacctgctgaacctcggctacaaggacatcaagagcatcatcaagctgcccaagtactccctgttcgagctcgagaacgggagccggcgcatgctggcctccatcctgagcacgaacaacaagcggggcgagatccacaaggggaacgagatgtacctcccggacaagttcgtcaccctgctgtaccacgccatgcgcgtgaaccggaccctcgagcccggccacaagaagtacgtggagacccaccgccacgtcttcgacgagctgctgacgtacatcctcgagtacaacgagaagatcgtgggggccaaggccaacggcaagcggatcgtggaggcgtactccgcccgcaaggacaccgacaacctggaggagctgtgcaacagcttcatcaacctcctgaacctgaccgccctcggctccgccgtcgacttcgagttcctggggaccaagatcccccggtaccgcgactacacgcccagctccctgctcaaggccaccctgatccaccagagcgtgaccggcctgtacgagacccggatcgacctctccaagctcgggggcgactga

SEQ ID NO: 2054 - RNA, 4146 nt, synthetic construct
  misc_feature 1..4146: note = Cas9 variant
  source 1..4146: mol_type = other RNA
atgaagaagatcatcggcctggacctcgggaccaccagcatcggctgggcctacgtgcacgaggccgagtccgcgcaggagcgcagcgagatcgtccggctgggggcccgcgtggtgcccctgacgaccgacgagcaggacgagttcaagaagggcaagtccatcaccaccaacgccgcccggctcagcaagcgctccctgcggcgcaacgccgaccggttccagctgcgccgggacgagctcgcgggggtcatgaaggaggccggctggatcgacgagacgaccgtgctggccgagcagggcccgcgcagcaccttcgagaccctgcggctccgcgccaaggcggcctccgaggaggtgacgctggccgagttcgcccggatcctgctccagatcaaccgcaagcgggggtacaagagcaaccgcaagaccgacggcgacgaggagggggccctgatcgacggcatggacgtctccaagcagctgaacgcgagcgggcagacccccggcgagtgggtgctcgcccggatgcaggagggcaacgccgtgatccccgccttctactgctccgacctgagcgaggagctggaccgcatctggcggaagcagcaggcctcccaccaggcgtggatgaccgaggagctccacacggtcctgcgccacgccgacgggcggagcgccatccgcctgatggacaaggccggcgtggtgcccgactccgtcaacgtgaaggagcgccggcgcgtgatgtacgagtggcgggccgcggccgtccgcgactgcctcccggccgggcgggtggccgccgcgctgatgcaggtcagcaaggagatcggccgcgccgactcctacctgggccggatcggggaccgcagcaaggagctctacttccaccggcagaccgtgggccagtacctgtggcgcctgatctgcgacaaccccaaccagtccctcaagaacctggtgttctaccggcaggactaccagcacgagttcgagaccctgtggagcatccagaccaagtaccacgtggagctcacggaggacctgcgcaagcgggtcgggcgcatcatcttcttccagcggcccctcaagagcaagaagggcctcgtgaaccgctgcgagctggtgcactactccgtctgcgagaacagcggggacgacctgaccgagaaggtggacgtcggccccaaggtgtgcccgaagtccagccccctcttccaggagttcaaggtgtggcaggtcctgaacaacgtggaggtgatccacccctccacccaggaggcccggcgcctggagatggaggagaaggagctcctggccagcgagctgctgttccgggaccgcatgaagaagatcgacgtcctgaagctcctgttctccaactggcgcgacctggacctgaactacaaggagctcgagggcaaccggaccatggcggccttctaccgcgtgtacgagcaggtcatcgcccagacggggcacggcgactacgacttcgccaagatgcgggccgcgaaggtgaaggagctggccgagggggtgttcgccggcctggggttcgaggtgggcctgctcaccttcgacgccgagctggacagccccgcctacgagcagcagccgtgctaccgcctgtggcacctcctgtactcctacgagggcgacaagagcgcgaccgggaacaagtgcctgctcaagaagctgtgccggctgaccggcatgaacgccgagctcgtcgggctgttcatgcagatccgcttctccggcgactacgggagcctgtccacgaaggccatgcggcgcatcctcccctacctgaaggccggcaacacctacgacgtggcctgcgagtacgcgggcttccggcacagcgcccgctccctgacccgggaggagctcgcccagaaggagtacaaggactacctggacctgctcccccgcaacagcctgcggaaccccgtggtcgagaagatcctgaaccagatgatccacgtggtgaacgggctctccagcacctacggcaagccggacgagatccgcgtcgagatggcccgggagctgaagaagtccgcgcgcgagcgggaggagatgacgagcgccatcagcaagaccaccaaggagaacgccgagatcaccgccatcctgcagcgcgacttcgggctccggtacgtgtcccgcaacgacatcctgcggtacaagctgtactgcgagctccgcatcaagggcaacggctgccgcacgctgtacagcaacacctacatcaaccccaacgagctgttctcccgggagttcgacatcgagcacatcatcccccagagccgcctcttcgacgactccttcagcaacaagaccctggagtcccggaccgccaacctggagaagggggaccgcacggcgtgggactacgtgaacgagaagtacggcgccgagcgggccgacgagtaccgcgcccaggtcgaggccctctaccgggacgggaccatcagcaaggcgaagcgcgacaagctgctgatgcccggcgacaagatcccggaggacttcatcgaccgggacatccgcaacacccagtacatcgccaagaaggccctcgagatcttcgaggacttcgtgccctccgtggtcgccaccagcgggaacgtgaccgcccggctgcgcgaggactggggcctggtggacgtcatgaaggagctcaactggtccaagtacgagagccagggcatggtgcacatcgagtacgaccgggacgggcgccccatccggcgcatcgtggactggacgaagcggaacgaccaccgccaccacgcgatggacgccctggccgtcgccttcaccaagcggtcctacatccagtacctgaaccacctcaacgcgcgcaaggaggccaccagcgtggcctacgccatccagcacaaggagatggagctggacggctccaaccgctggcggttcaagtgccccttcggggaccgcagcgccttccggcgcgaggcgaaggcccagctggagcggatcctcgtgtccatcaagagcaagaacaaggtcctgaccccgagcgtgaaccgcacgaagaagcggggcgggttcaacaagaaggtggagtggacgccccgcggcgccctgcacaacgagaccgtctacggccggatccgccggtacgacgtgaaggagctccgcgtggggtccagcttcaccgccgaggtcatcggcaaggtggccgactcccggtaccgcgcggccctgatgcaccggctggccgagttcgggggcgaccccaagaaggccttcaccgggaagaacagcctcgagaagaaccccctgtacaccgacgaggcccacaccgcgtgcgtgccgtccagcgtcaaggtggtgtccttcgtcgagatcggcaccatccgcaagggcgtggaccccaacctgaacgtggacaaggtcgtggacacgcacatcaagaacatcctcctggcccggctgagcgcctacgggggcgacgccaagaaggccttctccaacctcgacgcggaccccatctggctgaacaaggagaaggggatcgccatcaagcgcgtgaccatcagcgacgactccgaggtccggccgatccacgtgaagcgcgacatgcggggccgcctggtctgcgacgagcacgggcgccccgtgcccagcgactacgtgcagctccggaacaaccaccacgtcgccatcttccgcgacgccaacggcgagctgaaggagcgggtggtgaccttcttcgaggcggtcgagcgcgtgcggcagctgcgctccgagggccgggccgtggaggtcatcgacaagaactacaagtgcgaggaggggtggaccttcctcttcagcatgaagatcaacgagtacttcgtgttccccgacgccgcctccggcttcgacccgcgcgagatcgacctgacggaccccgccaactacgcgctgatcagcccccacctcttccgggtgcagaagctgtccagcaaggactactacttccgccaccacctggagaccaccgtcaacgacgtgaagcagctccgggacatcacctggaagcgcatctccagcctgcaggacctggccgggacggtgaaggtccgggtgaaccacatcggccagatcgtggccgtcggcgagtactga

SEQ ID NO: 2055 - RNA, 4146 nt, synthetic construct
  misc_feature 1..4146: note = Cas9 variant
  source 1..4146: mol_type = other RNA
atggtgaagaagaagtacgccatcggcatcgacatcgggaccaacagcgtcggctggtccatcgtgaccgacgactacaaggtgcccagcaagaagatgaaggtcttcgggaacacggagaagcgctacatcaagaagaacctgctcggcaccctgctgttcgacgaggggaacaccgccgagaaccggcgcctcaagcggaccgcgcgccggcgctacacgcggcgccggaaccgcatcctgtacctgcaggagatcttcgccgaggagatcaacaagatcgacgactccttcttccagcggctcgacgacagcttcctgatcgtggaggacaagcagggctccaagcacccgatcttcggcaccctgcaggaggagaaggagtaccacaagcagttccccaccatctaccacctccgcaagcagctggccgacagctcccagaaggccgacatccggctgatctacctcgccctggcgcacatcatcaagtaccgcgggcacttcctgttcgagggcgacctcaagagcgagaacaaggacgtgcagcacctgttcaacgacttcgtcgagatgttcgacaagaccgtggaggggtcctacctgagcgagaacctccccaacgtggccgacgtcctggtggagaaggtgtccaagagccggcgcctggagaacatcctccactacttccccaacgagaagaagaacggcctgttcgggaacttcctggccctcgccctgggcctgcagccgaacttcaagacgaacttcgagctcgcggaggacgccaagatccagttctccaaggagacctacgaggaggacctggaggagctgctcggcaagatcggggacgactacgccgacctgttcatcgccaccaagagcctgtacgacggcatcctcctggccgggatcctgtccaccacggacagcaccaccaaggcgcccctctccagctccatggtcaaccggtacgaggagcaccagaaggacctggccctgctcaagaacttcatccaccagaacctgagcgacagctacaaggaggtgttcaacgacaagctgaaggacggctacgccggctacatcgaggggaagaccacgcaggagaacttctaccgcttcatcaagaaggccatcgagaagatcgagggctccaactacttcatcgacaagatcgaccgggaggacttcctccgcaagcagcggaccttcgacaacgggagcatcccccaccagatccacctccaggagatgcacgccatcatccgccgccaggcggagttctaccccttcctggtggagaaccaggacaagatcgagaagatcctcaccttccggatcccgtactacgtcggccccctggcccgcgggaagtccgagttcgcctggctgaaccggaagtccgacgagaagatccgcccctggaacttcgacgagatggtggacaaggagacctccgccgagaacttcatcacgcggatgaccaactacgaccagtacctccccgaccagaaggtgctgccgaagcacagcctgctgtacgagaagttcgccgtctacaacgagctcaccaaggtgcgctacgtgaccgagcagggcaagtccttcttcttcgacgcgaacatgaagcaggagatcttcgaccggacgttcaaggtctaccgcaaggtgaccaaggagaagctgatggacttcctgagcaaggagttcgacgagttccggatcgtggacctcctgggcctggacaaggacaacaagtccttcaacgccagcctcgggacctaccacgacctgaagaagatcgtctccgaggacttcctggacaacagcgagaacgaggacatcctcgagaacgtggtcctgaccctgacgctgttcgaggaccgcgagatgatccggaagcgcctggagaagtacaaggacgtgctgaccgaggagcagcggaagaagctcgagcgccggcactacaccggctgggggcgcctgtccgccaagctgatcaacggcatccgggacaaggtgacccgcaagacgatcctcgactacctgatcgacgacgggaccagcaaccggaacttcatgcagctgatcaacgacgacaccctctccttcgtcgacgagatccgcctggcccagggcagcggcaaggccgaggactaccgcgcggaggtgcagaacctggccgggtcccccgccatcaagaagggcatcctccagagcctgaagatcgtggacgagctgatcgaggtcatggggtacgaccccgagcacatcgtggtggagatggcccgggagaaccagttcaccaaccagggccgccggaactcccagcagcgctacaagaagatcgagaacgcgatcaagaacctcgacagcaacctgaacagcaagatcctgaaggagtaccccacgaacaaccaggccctccagaacgaccggctgttcctgtactacctccagaacgggaaggacatgtacaccgacgaggagctggacatcgaccagctgtcccagtacgacatcgaccacatcatcccgcaggccttcatcaaggacgacagcctcgacaacaaggtcctgaccaagtccgccaagaaccgcggcaagagcgacgacgtgccctccctggagatcgtgtacaagaagaagaacttctggcagcagctcctggacagccagctgatctcccagcggaagttcgacaacctcaccaaggccgagcgcggcgggctgaccaacgaggacaaggcgcggttcatccagcgccagctggtcgagacgcggcagatcaccaagcacgtggcccgcatcctcgacacccggttcaacaccaagctggacgaggccggcaaccgcatccgggaccccaaggtgaacatcatcatcctcaagagcaacctcgtctcccagttccgcaaggactaccagctgtacaaggtgcgggagatcaacaactaccaccacgcccacgacgcctacctgaacgcggtggtcgccacggccctcctgaagaagtacccccagctggccccggagttcgtgtacggggagtaccccacctacaacagctacaactcccgcaagagcgccaccgagaaggtgctgttctactccaacatcatgaacttcttcaagcggatcgtcgtgcacagcaagaccggcgaggtgcgcatccggcccgtcatcgaggtgaacaaggagacgggcgagatcgtgtgggacaagaagtccaacttccgcaccgtccgcaaggtgctgagctacccccaggtgaacgtcgtgaagaagaccgaggtgcagaaccacgggctggaccggggcaagccgaaggggttctacaacgcgaacctcagcccccgccccaaggagggcagcgtcgagaacctggtgcccgccaagcagagcttcgacaccaagcggtacgggggctacgccggcatctccaacagctacgccgtgctggtcaacgggatcatcgagaagggcaagaagaagtccaaggcggaggtgacggagttccaggggatcagcatcctcgcccgcaaggacttcgacaagaacccgaagcagtacctgctgaacctcggctacaaggacatcaagtccatcatcaagctgcccaagtacagcctgttcgagctcgagaacgggtcccggcgcatgctggccagcatcctgtccaccaacaacaagcggggcgagatccacaagggcaacgagatgtacctccccgacaagttcgtgaccctgctgtaccacgccatgcgcgtcaaccggaccctcgagccggggcacaagaagtacgtggaggcccaccgccacgtgttcgacgagctgctgacgtacatcctcgagtacaacgagaagatcgtcggcgcgaaggccaacgggaagcggatcgtggaggcctacagcgcccgcaaggacaccgacaacctggaggagctgtgcaactccttcatcaacctcctgaacctgaccgccctcggcagcgcggtggacttcgagttcctggggaccaagatcccccggtaccgcgactacacgccctccagcctgctcaaggccaccctgatccaccagtccgtcaccggcctgtacgagacccggatcgacctcagcaagctgggcggggactga

SEQ ID NO: 2056 - RNA, 4146 nt, synthetic construct
  misc_feature 1..4146: note = Cas9 variant
  source 1..4146: mol_type = other RNA
atggtgaagaagaagtacgccatcggcatcgacatcgggaccaacagcgtcggctggtccgtggtgaccgacgactacaaggtccccagcaagaagatgaaggtgttcgggaacacggagaagcgctacatcaagaagaacctgctcggcaccctgctgttcgacgaggggaacaccgccgagaaccggcgcctcaagcggaccgcgcgccggcgctacacgcggcgccggaaccgcatcctgtacctgcaggagatcttcgccgaggagatcaacaagatcgacgactccttcttccagcggctcgacgacagcttcctgatcgtggaggacaagcagggctccaagcacccgatcttcggcaccctgcaggaggagaaggagtaccacaagcagttccccaccatctaccacctccgcaagcagctggccgacagctcccagaaggccgacatccggctgatctacctcgccctggcgcacatcatcaagtaccgcgggcacttcctgttcgagggcgacctcaagagcgacaacaaggacgtccagcacctgttcaacgagttcgtggagatgttcgacaagaccgtggaggggtcctacctgagcgagaacatccccgacgtcgccgacatcctcgtggagaaggtgtccaagagccggcgcctggagaacgtcctgcagtacttccccaacgagaagaagaacggcctcctggggaacttcctgtccctcgccctgggcctgcagccgaacttcaagacgaacttcgagctcgccgaggacgcgaagatccagttcagcaaggagacctacgaggaggacctggaggagctgctcggcaagatcggggacgactacgccgacctgttcatcgccaccaagtccctgtacgacggcatcctcctggccgggatcctgagcaccacggactccaccaccaaggccccgctcagctccagcatggtgaaccggtacgaggagcaccagaaggacctggcgctgctcaaggacttcatccgccagaacctgagcgactcctacaaggaggtgttcaacgacgccctgaaggacggctacgccggctacatcgaggggaagaccacgcaggaggacttctacaagttcgtcaagaagaccatcgagaagatcgagggcagcgactacttcatcgacaagatcgaccgggaggacttcctccgcaagcagcggaccttcgacaacgggtccatcccccaccagatccacctgaaggagatgcaggccatcatcatccgccaggccaagttctaccccttcctggaggagaaccaggacaagatcgagaagatcctcaccttccgcatcccgtactacgtgggccccctggcgcgggggaacagcgagttcgcctggctgaaccgcaagtccgacgagaagatccggccctggaacttcgacgagatcgtggacaaggagacgagcgccgagaacttcatcacccgcatgaccaactacgaccagtacctccccgaccagaaggtcctgccgaagcactccctgctgtacgagaagttcgccgtgtacaacgagctcaccaaggtgcggtacgtcacggagcagggcaagagcttcttcttcgacgccaacatgaagcaggagatcttcgacggcgtgttcaaggtgtaccgcaaggtcaccaaggagaagctgatggacttcctggggaaggagttcgacgagttccggatcgtggacctcctgggcctggacaaggacaacaagtccttcaacgcgagcctcgggacctaccacgacctgaagaagatcgtctccaaggacctgctcgacaaccccgagaacgaggacatcctggagaacgtggtgctgaccctcacgctgttcgaggaccgcgagatgatccggaagcgcctggagaagtacaaggaggtcctcaccgaggagcagcggaagaagctggagcgccggcactacaccggctgggggcgcctgagcgccaagctcatcaacggcatccgggacaaggtgacccgcaagacgatcctggactacctgatcgacgacggcacctccaaccggaacttcatgcagctcatcaacgacgacaccctgagcttcgtggacgagatccgcctggcccaggggtccggcgaggccgaggactaccgggccgaggtccagaacctcgcggggagccccgccatcaagaagggcatcctgcagtccctgaagatcgtggacgagctcatcgaggtgatggggtacgagcccgagcacatcgtcgtggagatggcccgcgagaaccagttcaccaaccagggccgccggaacagccagcagcgctacaagaagatcgagaacgccatcaagaacctggactccaacctgaacagcaagatcctcaaggagtacccgacgaacaaccaggcgctgcagaacgaccggctgttcctctactacctgcagaacggcaaggacatgtacaccgacgaggagctggacatcgaccagctcagccagtacgacatcgaccacatcatcccccaggccttcatcaaggacgactccctggacaacaaggtgctgaccaagagcgccaagaaccgcgggaagtccgacgacgtccccagcctcgagatcgtgtacaagaagaagtccttctggaagcagctgctggacagccagctcatctcccagcggaagttcgacaacctgaccaaggccgagcgcggcgggctgaccaacgaggacaaggcccggttcatccagcgccagctcgtggagacgcggcagatcaccaagcacgtcgcgcgcatgctggacacccggttcaacaccaagctggacgaggccggcaaccgcatccgggaccccaaggtgaacatcatcacgctcaagagcaacctggtgtcccagttccgcaaggactaccagctgtacaaggtccgggagatcaacaactaccaccacgcccacgacgcctacctcaacgccgtggtggcgaccgccctgctgaagaagtacccgcagctcgcccccgagttcgtctacggcgagtaccccacctacaacagctacaactcccgcaagagcgccaccgagaaggtgctgttctactccaacatcatgaacttcttcaagcggatcgtggtccacagcaagacgggggaggtgcgcatccggcccgtgatcgaggtcaacaaggagaccggcgagatcgtgtgggacaagaagtccgacttccgcaccgtgcggaaggtcctgagctacccccaggtgaacgtggtcaagaagaccgaggtgcagaaccacgggctcgaccgcggcaagcacaaggggttctacaacgccaacctgagcccccgccccaaggagggctccgtggagaacctggtccccgcgaagcagagcttcgacacgaagcggtacggcgggtacgccggcatctccaacagctacgccgtgctcgtgaacgggatcatcgagaagggcaagaagaagtccaaggccgaggtcaccgagttccaggggatcagcatcctggcgcgcaaggacttcgacaagaacccgaagcagtacctgctcaacctgggctacaaggacatcaagtccatcatcaagctgcccaagtacagcctcttcgagctggagaacggctcccggcgcatgctggccagcatcctctccaccaacaacaagcgcggggagatccacaagggcaacgagatgtacctgcccgacaagttcgtgaccctgctctaccacgccatgcgggtgaaccggacgctggagccggggcacaagaagtacgtcgagacccaccgccacgtgttcgacgagctgctcatctacatcctggagtacaacgagaagatcgtgggcgccaaggccaacgggaagcggatcgtcgaggcgtacagcgcccgcaaggacaccgacaacctggaggagctctgcaactccttcatcaacctgctgaacctcaccgccctgggcagcgccgtggacttcgagttcctgggcacgaagatcccccggtaccgcgactacaccccctccagcctcctgaaggccaccctgatccaccagtccgtgaccgggctctacgagacgcggatcgacctgagcaagctgggcggggactga

SEQ ID NO: 2057 - RNA, 4146 nt, synthetic construct
  misc_feature 1..4146: note = Cas9 variant
  source 1..4146: mol_type = other RNA
atggtgaagaagaagtacgccatcggcatcgacatcgggaccaacagcgtcggctggtccgtggtgaccgacgactacaaggtccccagcaagaagatgaaggtgttcgggaacacggagaagcgctacatcaagaagaacctgctcggcaccctgctgttcgacgaggggaacaccgccgagaaccggcgcctcaagcggaccgcgcgccggcgctacacgcggcgccggaaccgcatcctgtacctgcaggagatcttcgccgaggagatcaacaagatcgacgactccttcttccagcggctcgacgacagcttcctgatcgtggaggacaagcagggctccaagcacccgatcttcggcaccctgcaggaggagaaggagtaccacaagcagttccccaccatctaccacctccgcaagcagctggccgacagctcccagaaggccgacatccggctgatctacctcgccctggcgcacatcatcaagtaccgcgggcacttcctgttcgagggcgacctcaagagcgagaacaaggacgtccagcacctgttcaacgacttcgtggagatgttcgacaagaccgtggaggggtcctacctgagcgagaacctccccaacgtcgccgacgtgctggtggagaaggtctccaagagccggcacctggagaacatcctccactacttccccaacgagaagaagaacggcctgttcgggaacttcctggccctcgccctgggcctgcagccgaacttcaagacgaacttcgagctcgcggaggacgccaagatccagttctccaaggagacctacgaggaggacctggaggagctgctcggcaagatcggggacgactacgccgacctgttcatcgccaccaagagcctgtacgacggcatcctcctggccgggatcctgtccaccacgaacagcaccaccaaggcgcccctctccagctccatggtgaaccgctacgaggagcaccagaaggacctggccctgctcaagaacttcatccaccagaacctgagcgacagctacaaggaggtgttcaacgacaagctgaaggacggctacgccggctacatcgaggggaagaccacgcaggagaacttctaccggttcatcaagaaggccatcgagaagatcgacggctccaactacttcatcgagaagatcgagcgcgaggacttcctccggaagcagcgcaccttcgacaacgggagcatcccccaccagatccacctccaggagatgcaggccatcatccggcgccaggcgaagttctaccccttcctggaggagaaccaggacaagatcgagaagatcctcaccttccgcatcccgtactacgtcggccccctggcccgggggaagtccgagttcgcctggctgaaccgcaagagcgacgagaagatccggccctggaacttcgacgagatggtggacaaggagacctccgccaagaacttcatcacgcgcatgaccaactacgaccagtacctccccgaccagaaggtgctgccgaagcacagcctgctgtacgagaagttcgccgtctacaacgagctcaccaaggtgcggtacgtgaccgagcagggcaagtccttcttcttcgacgcgaacatgaagcaggagatcttcgacggcgtcttcaaggtgtaccgcaaggtgacgaaggagaagctgatggacttcctggggaaggagttcgacgagttccggatcgtcgacctcctgggcctggacaaggagaacaagagcttcaacgcctccctcgggacctaccacgacctgaagaagatcgtgagcaaggacttcctggacaactccgagaacgaggacatcctcgagaacgtcgtgctgaccctgaccctcttcgaggaccgcgagatgatccggaagcgcctggagaagtacaaggacatcctgacggaggagcagcggaagaagctcgagcgccggcactacaccggctgggggcgcctgagcgccaagctgatcaacggcatccgggacaaggtgacccgcaagaccatcctcgactacctgatcgacgacggcacgtccaactgcaacttcatgcagctgatcaacgacgacaccctcagcttcgtcgacgagatccggctggcccaggggtccggcgaggccgaggactaccgcgcggaggtgcagaacctggccgggagccccgccatcaagaagggcatcctccagtccctgaagatcgtggacgagctgatcgaggtcatggggtacgaccccgagcacatcgtggtggagatggcccgggagaaccagttcaccaaccagggccgccgcaacagccagcagcggtacaagaagatcgagaacgcgatcaagaacctcgactccaacctgaacagcaagatcctgaaggagtaccccaccaacaaccaggccctccagaacgaccgcctgttcctgtactacctccagaacggcaaggacatgtacacggacgaggagctggacatcgaccagctgagccagtacgacatcgaccacatcatcccgcaggccttcatcaaggacgactccctcgacaacaaggtcctgaccaagagcgccaagaaccgggggaagtccgacgacgtgcccagcctggagatcgtgtacaagaagaagtccttctggaagcagctcctggacagccagctgatctcccagcgcaagttcgacaacctcaccaaggccgagcggggcgggctgaccaacgaggacaaggcgcgcttcatccagcggcagctggtcgagacccgccagatcacgaagcacgtggcccggatgctcgacacccgcttcaacaccaagctggacgaggccggcaaccggatccgcgaccccaaggtgaacatcatcaccctgaagtccaacctcgtctcccagttccggaaggactaccagctgtacaaggtgcgcgagatcaacaactaccaccacgcccacgacgcctacctgaacgcggtggtcgccacggccctcctgaagaagtacccccagctggccccggagttcgtgtacggcgagtaccccacctacaacagctacaactcccgcaagagcgccaccgagaaggtgctgttctactccaacatcatgaacttcttcaagcggatcgtcgtgcacagcaagaccggggaggtgcggatccgccccgtcatcgaggtgaacaaggagacgggcgagatcgtgtgggacaagaagtccgacttccggaccgtccgcaaggtgctgagctacccccaggtgaacgtcgtgaagaagaccgaggtgcagaaccacgggctggaccggggcaagccgaaggggttctacaacgcgaacctcagcccccgccccaaggagggcagcgtcgagaacctggtgcccgccaagcagagcttcgacaccaagcgctacggcgggtacgccggcatctccaacagctacgccgtgctggtcaacgggatcatcgagaagggcaagaagaagtccaaggcggaggtgacggagttccaggggatcagcatcctcgcccggaaggacttcgacaagaacccgaagcagtacctgctgaacctcggctacaaggacatcaagtccatcatcaagctgcccaagtacagcctgttcgagctcgagaacggctcccgccggatgctggccagcatcctgtccaccaacaacaagcgcggggagatccacaagggcaacgagatgtacctccccgacaagttcgtgaccctgctgtaccacgccatgcgggtcaaccgcaccctcgagccggggcacaagaagtacgtggagacgcaccggcacgtgttcgacgagctgctgatctacatcctcgagtacaacgagaagatcgtcggcgccaaggcgaacgggaagcgcatcgtggaggcctacagcgcccggaaggacaccgacaacctggaggagctgtgcaactccttcatcaacctcctgaacctgaccgccctcggcagcgccgtggacttcgagttcctgggcaccaagatcccccgctaccgggactacacgccctccagcctgctcaaggcgaccctgatccaccagtccgtcaccgggctgtacgagacccgcatcgacctcagcaagctgggcggggactga

SEQ ID NO: 2058 - RNA, 4149 nt, synthetic construct
  misc_feature 1..4149: note = Cas9 variant
  source 1..4149: mol_type = other RNA
atgaagaagatcgtgaactacaacctgggcctcgacatcgggaccagctccatcggctacgccgccatcgacgaccaggggcgccccgtccggcaccagaacaagaccgtgatgggcgtgcgcctgttcaaggaggggaagacggcggagagcacccggatcttccgcggcacccggcgccggctgtcccaccgccactggcggctcggctacctggaccgcatcttcgacaacgagatcgccaaggtcgacgagaacttcctgccgcggctcaaggccagcaagcgcgcccggtccgacgagaagcgcagcttccgggggtccctgctgttccccgagaccggcgacgacgcctactaccagaagtaccccacgatctaccacctccgctacgcgctgatcacccagaagaagcagttcgacatccggctgatctacctcgccctgcaccacatgatcaagtaccgcgggaacttcctggacaccacccccgtgagcgccttcaacatccacgacatcgacctcacggaccagttcgcctccctgaacgactgctaccagctgctcgacatggacttcgagttccagttcgacctgaacaacatcgagcaggtccagaagctgctcctggacgagaccctgagcaagaccaagcggcaggcggccgtgtccaaggtgctcgtgatgagcaccggcaacaaggccttcgacgaccagcagaacgggatcgcctccgagttcatcaaggccctgctgggcggcccgttcgacctcagcaagatcctgaacctgtccgtcgcggacgtcaagagctggaagctccacatgacggacaaggacgtggacgacaccctgaactccctggtggaggagctcgacgagaaccacaagcagatcgtgaacctgctgcagatgatctacagccaggtgatgatgctcgggctgctgaacggccagcagtccatcagcgccagcatgatcgagcgctacgacgaccacgccaagcactgggccgccctcaagaagctgctgcccgcgctcggggagcaggagcagtccaccatcatccacgcctacaccgcctacacgggccacagccggaccaagcagctgtcccgcgccgagttctacaccaaggtcaacagcatcctgaagaagcacgagaacatcgccgaggcgaccggcctcatcgagctgatcgaccgcaacgagttcatgcccaagcagcgggacgccgtgaacggggtgatcccccaccagctgcaccagcgcgagctccagctgatcatccagaaccagcagaagtactacccgttcctggccgccaaggcctaccccgacgcggacgagacgatgatcgagcagctgctctccttccgggtcccctactacgccggccccctggtggaccgcgacttcatcaacgagagctccgaccaggagcaggccatgcagaacaccaagttcagctggctgaagcggcgcgaggccggggagatcaccccgtggaacttcgagcagaaggtggacgtccaggagaccgcgaaccggttcatcaagcgcctcacgaccaaggacacctacctgatgaccgaggacgtgctgcccaaggagtccctcatctaccagcggttcgaggtgctgaacgagctgaacgccatccgcatcaacgaccggcgcctcacggccgagaacaagcagctggccttccagcagctgttcatggccggcaacaccaagaacgtcagcatcaagaagttccggaacttcgtgttcgactccctcaagttccccgagaaggtcaagatcaccgggttcgcgggccagcacaacttcctggccaagctgagcacctaccacgacttcaagaagatcttcggcgagcgcgtggaccacacggacctccagcccgacttcgagcggatcgtggagtggtgcaccatcttcgaggaccgccacatctaccgggagaagctgaaggagatccagtggctgtcccagagcgagatcgaccagctcgtcctgatccgcaaccacgggtggggccggctgtccaagcgcctcctgaccgggatccgcgacagcgacggccggaccgtgatggaccagctgtggttcgggacggacaacttcatgcgcatcatctcccagagcgacttcgccgccgccatcgcgaacgagaaccggacccagctcaaccagcacggcctggaggacgtgctggactccgccttcatgagcccgcagaacaagaaggccatccgccaggtcctcaaggtggtggacgacatcgagcagaccctgggctgcccgcccaagaaggtcatgatcgagttcacccggagccccgacaagaagaagcagcgcaccgtgacgcggctggagaaggtgcagcaggcctacaaggccgtcgcggaccagctcgccgggcagtccatcgtgagcgagctggaccagtacgccaacacccactccaagctgagcgacacctactacctctacttcatgcagctgggccgcgacctgtactccgggaagcccatcgacatcgacagccccatgctcgacgacgaccacatcctgccccgggccttcatgaaggacaactccctggacaaccgcgcgctcaccgagaagcccatcaacaacacgaaggccgccaagttcccgagcaaggtgttcggccagcagaaggaggtcaccgacttctggaagctgctgcggcgctgcgggctcatgtccaacatcaaggagaagcacctgtacctggaccccgacaacgtggacaagtggacccggcgcggcttcatccaccggcagctcgtggagaccagccaggtcatcaagatcgtggccaacatcctgaacgaccgctaccagcagtcccagacggaggtgctggaggtccccgcccggctcggcaccgagctgcgcgagtgcttcgggtggtacaaggtgcgggaggtgaacgactaccaccacgtcttcgacgcgtacctggccgccttcatcggcaactacctctaccgccggtaccccaagctgcagccgtacttcgtgtacgggaacttcgccgagctgaacaaggcccagctcaagaacatcaagagcttcaacttcctgtacaacatcaccgacaacaagcgcgtggtcaaggacatcgagaccggccagacgctgtgggacgaccagatccgccagcagatccagcacatctacgagtacaagtacatgctcacctcccacgaggcgttcacccagcacaaggagctgtacggccagaccatctacccccggcgcgagttcaagcccgggacgctgaaggccatcaagcaggaccagccgcaggagctctacggcgggtacaagaacctgaccgccgcctacatgtgcatcgtgaagatccaggcccggaagcgccgggcggccgagtaccgcgtggtccgggtggccaccgagagcctgtccgccctccagcaggcgaagcgcctgggcgtgcaggcctacgagcggtgcctgcgccaggagctcgtccggaacaacgagatcctgcgcaccaacgccgaccccaacagcgcgccccgggagttcgaggtgctgctcgaccgcgtgctgtgccaccagatgatcatctccgacgggcagaagtacctgctcggcagccacgcctacaagatcaactgcatgcagctggtcctgagcaacaactccatgaagatcctcagcacgtccatcgtgaagctgaagcagatgaccaacgagcccctggtgcaggtctaccgggagatcctcgacgtggtgaacaagtacttcaccctgtacgacgtcaacagcttccgcgagaacctgaaccagttcttcgacaagttccggaccctcccgatcacgaacgagtacgagtccagcaagtccggcaagaagctgatccaccgcgggcagctggagaccctcaccctgatcctgcggggcctccacgccaacagcgacaaggtgcagtacggggaccagtccaccctgctgggcgggttccagacgaaggacggcatcaagctcagcaaggactccgtgatccagtacaccagccccgccggcctgaacgtccgcaccgtgaagctgcgcgacctcgagcagaaggaggcccagaagtga

SEQ ID NO: 2059 - RNA, 4149 nt, synthetic construct
  misc_feature 1..4149: note = Cas9 variant
  source 1..4149: mol_type = other RNA
atggtggacgagaagatcttctggggcctggacatcgggaccgacagcgtcggctgggccgtgaccaactccgagtacaagctcaagaagtacaagaacaacctgatgtggggcgtgcacctgttcgacgaggccaagcagagcgcggagcgccggtccttccgcacggcccggcgccggctcgaccgccggaagcagcgcatcatcctgctgcaggagttcttcgtccgggccgtgtgcgagaaggacgagaacttcttccgccggctcaaggagagcgccctgctgcccgaggacgccgagcaccgcaccaacaacatcttcttcgacgacccggactacaccgacaaggactacttcgaggagtaccccaccatccaccacctcatctgcgagctgatggagtccaaggagccccacgacgtgcggctggtctacctcgcgtgcgtgtacctgctggcccaccgcgggcacttcctcctgcccgtgagcgaggacgacatctccaaggtcacggagttcgagccgctgtacgagagcttctacaaggccctcgaggagaagctggacgacgagccgcccttcgaccggtccgccgacgacttcgcggagatcctcaagagccacaagaccgtgtccgccaagaacaaggacttcgacaagctcctgttcgggggcaaggtgaagacctacgacaacgagaacatcagctactccgccctgatcaagctcctgagcggcgggaccgagaagctgtccaagttcttcgccaacgaggagtacacggacctcgagaaggacagcgtctgcgtgcgcaacgccgacttcggcgacaccctggagatgctggaggggcagatcgacgagctcgacttcgcgctgctgaagtccgtcaagagcctctacgactggtccctgctggtggacatcctcgagggcaagagcctgatcagcgaggccaagaaggacaagtacgacgagcacgggtacgacctggacgccctcaagtacctgttccgggagtacctgaccaaggacgactacaacgagatgttcaaggaggtgtccggcaagcagaactacgccagctacgtgtacaacgcctccagcgacaagacccgcgactccaagtacaagaagtgcagccagaaggacttctgcaagttcacgaagaagttcctctccaagatcaagcccaacgagaaggacaagccctgcctggacaagctgctcgagaagtgcgagcagaacagcctgtgccccaagcaggtcaccaccgacaaccgggtgatcccctaccagctgtactacgtggagctcaagaagatcctggagaacgcgtgcggctacctgcccttcctgaacgagcgcgacgagtacgggaccgtcgccgacaagatcctctccatcatgaagttccgggtgccgtactacgtgggccccctggtcgacagcaagaagtcccccaacgcctggctggtgcgcaagctcgacgggaagatcacgccctggaacttcaccgacatggtcaacgaggacgagagcgagaacgccttcatccgccggatgacctgcaagtgcacctacgtggccggccaggacgtgctgccgaagtactccctgctctacagcaagttctccgtcctgaacgagatcaacaacatcaagctgaacggcgagcccatcagcgtgcagacgaagcaggagatctacaccgagctgttcgagcgcaacaagtcccgggtgagcaagaagaagatccgcgactgcctgatctcccacgggtacgcggccgacagcgacgaggtcaccggcatcgacgacatcgccaagagcgccctgcggtcctaccacgacttcaagaagatgctcagcaacgggatcctgaccgagcagcaggtcgaggagatcatcgagcacatcacggtgaccaccgacaacatccgcctgaagaagtggctcaagacccagttccccatgctggccgacgaggacgtgaagtacatcacgaagctgaagtacaaggactacggccggctctcccgctgcttcctggaggacgtgctgcccgtggacaccaagaccggggaggcggagagcgacaagaacatcatcaccatgctctgggagacgaacgagaacatcatgcagctgctgtccagcaagtaccggtactccgagaacatcgagcacatgaaccgccagtactacgccctcccggagaaccacaagagcatgtccgagcggctgaaggacatgtacgtccccaccgccgtgcgccgggccgtgacccgcaccttcgacatcgtcaaggagctgaagaagatccagggccgggaccccgacaagatcttcatcgagatggcgcgcggcacgggggagacccccaagggcaagcggaccaacagccgcaaggaccagatcctcgagcactggcacgggctggacaacaaggacatcaacgacctgaagaagtccggcatctgggagcacctcgacaccatcgacgacgccaagctgcggagcgacaagtacttcctgtacttcatgcagctcgggcgctgcatgtacaccgagaagccgatccccttcgaggaggtggagaacgagcacaagtggaacatcgaccacatctggccccaggccaagatcaaggacgactccctggacaacaaggtgctggtcagctccaacgagaacggcaagaagtccgacagctaccccatcagcgacgacatccgccacagcatggccggcctctggcactccctgtacaagaaggggctgatcagcgagaagaagtaccagcggctcacgcgctccaccccgttcaccgacgacgagctgagcggcttcatcgcccggcagctggtggagacccgccagtccacgaaggcggtggccaccctcctgaaggagcagttccccaacaccgagatcgtctacgtgaaggccgggctggtgagcgacttccggcaggagatgggcatgctcaagtgccgcgaggtcaacgacctgcaccacgccaaggacgcctacctgaacatcgtgctcgggaacgtgtacaacacccggttcacgaaggaccccctgaacttcgtcaagaacaacgagaagtactccatcaagatcttccagaagaacagcgacggcaagaagaccggcgtgatcacccgcaaggtggagcgcgggggcgaggtcgcgtgggacccggagacctccttcgccatcgtgcggaagatgatgagcaagaactccatccggtacgtgcgctacgcctacatgcgcaagagcgggcagaacggcggcttcttcgaccagaaccccctgcggaaggggaagggcatggtctccatcaagcacaacctcagcatcgagaagtacgggggctacgacaacgccacgatctccttcttcagcctggtgtccatcaaggacttcggggtgatcctgctcgccgtcgagctgctgagcgcgaacaagttcctcaagaacatctccgaggccaaggagtacgccgccgacaagctgagcaaggagctgaacgtgaagatcgtgcccaacgacgtcgcgttccccctcaacaaccggtacaacgtggtgaagatcaacgccgtcctggagctggacggctaccgcgtgatgatcgccgccaagcagaacagctccatcaagttcgtgagcaacgagtccctcatcctgagctcccagcacatggcctacgtcaagaagatcaccaagttcatcgagaagcggaagcaggacaaggtgtgcatgatcaacgcgttcagcggcatctccatcgaggacaacatcgagctgtacgacgtgctcgtcagcaagtgcaacatcaagccgttcaacatcatgtacgagaacctggggatcaagctgtccgacaaccgcgacaacttcatcaagaagtccgtggagaaccaggtgctcatcctgagcgagatggtccggctgttcaagaccggccgcaaggccggggtgaacctcgaggaggtcggcgggcggaagaacagcggcgtgaagaccctgaacacgtgcctgtacaaggtgaaggactactccaacatcttcctcgtcgaccagagccccaccggcctgatcgagcacaagtcccccaacctgctcgacctgtga

SEQ ID NO: 2060 - RNA, 4155 nt, synthetic construct
  misc_feature 1..4155: note = Cas9 variant
  source 1..4155: mol_type = other RNA
atgaacaagccctacagcatcggcctggacatcgggaccaactccgtgggctggagcatcatcaccgacgactacaaggtcccggccaagaagatgcgcgtgctcgggaacacggacaaggagtacatcaagaagaacctgatcggcgccctcctcttcgacgggggcaacaccgcggccgaccggcgcctgaagcggaccgcccgccggcgctacacccggcgccggaaccgcatcctgtacctccaggagatcttcgccgaggagatgtccaaggtggacgacagcttcttccaccggctggaggactccttcctggtcgaggaggacaagcgcggcagcaagtaccccatcttcgccacgctccaggaggagaaggactaccacgagaagttctccaccatctaccacctccggaaggagctggcggacaagaaggagaaggccgacctgcgcctgatctacatcgccctggcccacatcatcaagttccgggggcacttcctcatcgaggacgacagcttcgacgtgcgcaacaccgacatctccaagcagtaccaggacttcctggagatcttcaacaccacgttcgagaacaacgacctgctcagccagaacgtggacgtcgaggcgatcctgaccgacaagatctccaagagcgccaagaaggaccggatcctggcccagtaccccaaccagaagtccaccggcatcttcgccgagttcctcaagctgatcgtggggaaccaggccgacttcaagaagtacttcaacctggaggacaagacgcccctccagttcgcgaaggacagctacgacgaggacctggagaacctgctcggccagatcggggacgagttcgccgacctgttctccgccgccaagaagctgtacgacagcgtgctcctgtccggcatcctgaccgtcatcgacctcagcaccaaggccccgctgtccgcgagcatgatccagcgctacgacgagcaccgggaggacctgaagcagctcaagcagttcgtgaaggccagcctgcccgagaagtaccaggagatcttcgccgactccagcaaggacggctacgccgggtacatcgagggcaagaccaaccaggaggccttctacaagtacctgtccaagctcctgaccaagcaggaggacagcgagaacttcctggagaagatcaagaacgaggacttcctccgcaagcagcggacgttcgacaacgggtccatcccccaccaggtgcacctgaccgagctgaaggcgatcatccgccgccagagcgagtactaccccttcctcaaggagaaccaggaccggatcgagaagatcctgaccttccgcatcccgtactacatcggccccctggcccgggagaagtccgacttcgcctggatgacccgcaagacggacgacagcatccggccctggaacttcgaggacctcgtcgacaaggagaagtccgccgaggccttcatccaccgcatgaccaacaacgacttctacctgcccgaggagaaggtgctgccgaagcacagcctgatctacgagaagttcaccgtgtacaacgagctcaccaaggtccggtacaagaacgagcagggcgagacgtacttcttcgactccaacatcaagcaggagatcttcgacggggtgttcaaggagcaccgcaaggtgagcaagaagaagctgctggacttcctcgcgaaggagtacgaggagttccggatcgtcgacgtgatcggcctggacaaggagaacaaggccttcaacgcctccctggggacctaccacgacctcgagaagatcctggacaaggacttcctggacaaccccgacaacgagagcatcctcgaggacatcgtgcagaccctgaccctgttcgaggaccgcgagatgatcaagaagcggctcgagaactacaaggacctgttcacggagtcccagctgaagaagctctaccgccggcactacaccggctgggggcgcctgagcgccaagctgatcaacggcatccgggacaaggagtcccagaagaccatcctcgactacctgatcgacgacggccgcagcaaccggaacttcatgcagctgatcaacgacgacgggcgctccaaccggaacttcatgcagctcatcaacgacgacggcctgagcttcaagagcatcatctccaaggcgcaggccgggagccactccgacaacctgaaggaggtcgtgggcgagctcgccgggagccccgccatcaagaagggcatcctgcagtccctgaagatcgtggacgagctcgtcaaggtgatgggctacgagcccgagcagatcgtcgtggagatggcccgcgagaaccagaccacgaaccaggggcgccggaacagccgccagcggtacaagctgctggacgacggcgtgaagaacctcgcgtccgacctgaacgggaacatcctgaaggagtacccgaccgacaaccaggccctccagaacgagcgcctgttcctgtactacctccagaacggccgggacatgtacaccggggaggccctggacatcgacaacctgagccagtacgacatcgaccacatcatcccccaggccttcatcaaggacgactccatcgacaaccgcgtcctcgtgagctccgccaagaaccggggcaagagcgacgacgtgccctccctggagatcgtcaaggactgcaaggtgttctggaagaagctgctcgacgcgaagctgatgagccagcgcaagtacgacaacctgaccaaggccgagcggggcgggctcacgtccgacgacaaggcccgcttcatccagcggcagctggtggagacccgccagatcaccaagcacgtcgcccggatcctggacgagcgcttcaacaacgagctcgacagcaagggccggcgcatccggaaggtgaagatcgtgaccctgaagtccaacctggtcagcaacttccgcaaggagttcgggttctacaagatccgggaggtgaacaactaccaccacgcccacgacgcgtacctcaacgccgtggtcgccaaggccatcctgaccaagtacccccagctggagccggagttcgtgtacggcgactaccccaagtacaacagctacaagacgcgcaagtccgcgaccgagaagctgttcttctacagcaacatcatgaacttcttcaagaccaaggtgaccctggccgacggcacggtcgtggtgaaggacgacatcgaggtcaacaacgacaccggggagatcgtgtgggacaagaagaagcacttcgccaccgtgcggaaggtcctgtcctacccccagaacaacatcgtgaagaagaccgagatccagacgggcgggttcagcaaggagtccatcctcgcccacggcaacagcgacaagctgatcccccgcaagaccaaggacatctacctggacccgaagaagtacgggggcttcgactcccccatcgtggcctacagcgtcctcgtggtggcggacatcaagaagggcaaggcccagaagctgaagaccgtcaccgagctgctcgggatcacgatcatggagcgctcccggttcgagaagaaccccagcgccttcctggagtccaagggctacctgaacatccgcgccgacaagctcatcatcctgcccaagtacagcctgttcgagctcgagaacgggcggcgccggctgctggcctccgcgggcgagctccagaaggggaacgagctggccctgccgacccagttcatgaagttcctctacctggccagccgctacaacgagtccaagggcaagcccgaggagatcgagaagaagcaggagttcgtgaaccagcacgtgagctacttcgacgacatcctgcagctcatcaacgacttctccaagcgggtcatcctggccgacgccaacctggagaagatcaacaagctctaccaggacaacaaggagaacatcagcgtggacgagctggcgaacaacatcatcaacctgttcaccttcacctccctcggcgcccccgccgccttcaagttcttcgacaagatcgtggaccgcaagcggtacacgagcaccaaggaggtcctgaacagcaccctgatccaccagtccatcaccgggctctacgagacgcgcatcgacctgggcaagctgggggaggactga

SEQ ID NO: 2061 - RNA, 4155 nt, synthetic construct
  misc_feature 1..4155: note = Cas9 variant
  source 1..4155: mol_type = other RNA
atgaagctgcgcggcatcgaggacgactacagcatcgggctcgacatgggcacctccagcgtggggtgggccgtcaccgacgagcggggcacgctggcccacttcaagcgcaagcccacctgggggtcccggctgttccgcgaggcgcagaccgccgccgtggcccggatgccgcgcggccagcggcgccggtacgtgcgccggcgctggcggctcgacctgctgcagaagctgttcgagcagcagatggagcaggccgaccccgacttcttcatccgcctccggcagagccgcctgctccgggacgaccgcgcggaggagcacgccgactaccggtggcccctgttcaacgactgcaagttcaccgagcgcgactactaccagcggttccccacgatctaccacgtccgctcctggctgatggagaccgacgagcaggccgacatccgcctcatctacctggccctgcacaacatcgtgaagcaccggggcaacttcctccgcgaggggcagagcctgtccgccaagagcgcgcggccggacgaggccctgaaccacctccgcgagaccctgcgggtgtggtccagcgagcgcggcttcgagtgctccatcgccgacaacgggagcatcctggccatgctcacccaccccgacctgtcccccagcgaccggcgcaagaagatcgcgcccctgttcgacgtcaagtccgacgacgccgccgccgacaagaagctcggcatcgccctggcgggggccgtgatcggcctgaagacggagttcaagaacatcttcggcgacttcccgtgcgaggacagctccatctacctcagcaacgacgaggccgtggacgccgtccggtccgcctgccccgacgactgcgcggagctgttcgaccgcctgtgcgaggtgtacagcgcctacgtgctccaggggctgctgagctacgcccccggccagaccatctccgccaacatggtcgagaagtaccggcgctacggggaggacctcgccctgctgaagaagctcgtgaagatctacgcgcccgaccagtaccggatgttcttcagcggcgccacctacccgggcaccgggatctacgacgccgcccaggcgcgcggctacacgaagtacaacctggggcccaagaagtccgagtacaagcccagcgagtccatgcagtacgacgacttccggaaggccgtggagaagctgttcgccaagaccgacgcccgcgccgacgagcggtaccgcatgatgatggaccggttcgacaagcagcagttcctccgccgcctgaagaccagcgacaacggctccatctaccaccagctgcacctcgaggagctgaaggcgatcgtcgagaaccaggggcggttctaccccttcctgaagcgcgacgccgacaagctcgtgagcctggtgtccttccggatcccgtactacgtcggccccctgagcacccgcaacgcccggacggaccagcacggcgagaaccgcttcgcctggtccgagcggaagcccgggatgcaggacgagcccatcttcccgtggaactgggagagcatcatcgaccgctccaagagcgccgagaagttcatcctccggatgaccggcatgtgcacctacctgcagcaggagcccgtgctgcccaagtccagcctgctctacgaggagttctgcgtgctgaacgagctgaacggggcgcactggtccatcgacggcgacgacgagcaccgcttcgacgccgccgaccgggaggggatcatcgaggagctgttccgccggaagcgcaccgtcagctacggcgacgtggccggctggatggagcgggagcgcaaccagatcggggcccacgtgtgcggcgggcagggcgagaaggggttcgagtccaagctcggcagctacatcttcttctgcaaggacgtcttcaaggtggagcggctggagcagagcgactaccccatgatcgagcgcatcatcctctggaacacgctgttcgaggaccggaagatcctgtcccagcgcctcaaggaggagtacggcagccggctgtccgcggagcagatcaagaccatctgcaagaagcgcttcaccgggtggggccgcctgagcgagaagttcctcaccgggatcacggtccaggtggacgaggactccgtgagcatcatggacgtcctgcgggagggctgcccggtgtccggcaagcgcgggcgggccatggtgatgatggagatcctgcgcgacgaggagctcggcttccagaagaaggtcgacgacttcaaccgggccttcttcgccgagaacgcgcaggccctgggggtgaacgagctgcccggcagccccgccgtgcgccggtccctcaaccagagcatccgcatcgtcgacgagatcgcctccatcgccgggaaggcgcccgccaacatcttcatcgaggtgacccgggacgaggacccgaagaagaagggccgccggaccaagcgccggtacaacgacctgaaggacgccctggaggccttcaagaaggaggaccccgagctctggcgcgagctgtgcgagaccgcccccaacgacatggacgagcggctgagcctctacttcatgcagcgcggcaagtgcctgtactccgggcgggcgatcgacatccaccagctgagcaacgccggcatctacgaggtggaccacatcatcccgcgcacgtacgtcaaggacgactccctcgagaacaaggccctggtgtaccgggaggagaaccagcgcaagaccgacatgctgctcatcgaccccgagatccgccggcgcatgagcgggtactggcggatgctgcacgaggccaagctgatcggcgacaagaagttccgcaacctcctgcggtcccgcatcgacgacaaggccctgaaggggttcatcgcgcggcagctcgtggagaccggccagatggtcaagctggtgcgcagcctgctcgaggcccggtaccccgagaccaacatcatcagcgtgaaggcctccatcagccacgacctgcgcacggccgcggagctggtcaagtgccgggaggccaacgacttccaccacgcccacgacgccttcctcgcctgccgcgtgggcctgttcatccagaagcggcacccctgcgtgtacgagaacccgatcgggctgtcccaggtcgtgcgcaactacgtgcggcagcaggcggacatcttcaagcgctgccggaccatccccggcagctccgggttcatcgtcaacagcttcatgacctccggcttcgacaaggagaccggggagatcttcaaggacgactgggacgccgaggccgaggtggagggcatccgccggagcctcaacttccgccagtgcttcatctcccggatgcccttcgaggaccacggcgtgttctgggacgccacgatctacagcccccgcgccaagaagaccgcggccctgccgctgaagcaggggctcaacccctcccgctacggcagcttctcccgggagcagttcgcctacttcttcatctacaaggcccgcaacccccggaaggagcagaccctgttcgagttcgcccaggtccccgtgcgcctgagcgcgcagatccggcaggacgagaacgccctcgagcgctacgcccgggagctggccaaggaccaggggctggagttcatccgcatcgagcggtccaagatcctcaagaaccagctgatcgagatcgacggcgaccgcctgtgcatcaccgggaaggaggaggtgcggaacgcctgcgagctcgcgttcgcccaggacgagatgcgcgtcatccggatgctggtgagcgagaagccggtgtcccgcgagtgcgtcatcagcctgttcaaccggatcctcctgcacggcgaccaggcctcccgccggctgagcaagcagctcaagctggccctgctcagcgaggcgttctccgaggccagcgacaacgtgcagcgcaacgtggtcctgggcctgatcgccatcttcaacgggtccaccaacatggtgaacctcagcgacatcggcgggtccaagttcgccggcaacgtgcggatcaagtacaagaaggagctggccagccccaaggtcaacgtgcacctgatcgaccagtccgtgacgggcatgttcgagcgccgcaccaagatcgggctctga

SEQ ID NO: 2062 - RNA, 4158 nt, synthetic construct
  misc_feature 1..4158: note = Cas9 variant
  source 1..4158: mol_type = other RNA
atgaccaagccctacagcatcggcctggacatcgggaccaactccgtgggctgggccgtcatcacggacgactacaaggtgccgagcaagaagatgaaggtgctcgggaacacctccaagaagtacatcaagaagaacctgctgggcgccctcctgttcgacagcgggatcaccgcggagggccgccggctgaagcgcaccgcccggcgccggtacacgcgccggcgcaaccggatcctctacctgcaggagatcttctccaccgagatggccaccctggacgacgccttcttccagcgcctcgacgacagcttcctggtccccgacgacaagcgggactccaagtaccccatcttcggcaacctggtggaggagaaggtgtaccacgacgagttccccaccatctaccacctccgcaagcacctggccgacagctccaagaaggcggacctgcggctcgtctacctggccctggcccacatgatcaagtaccgcgggcacttcctcatcgagggcgacttcaacagcaagaacaacgacctgcagaagaacttccaggacttcctggacacgtacaacgccatcttcgagtccgacctcagcctggagaactccaagcagctggaggagatcgtgaaggacaagatcagcaagtccgcgaagaaggaccggatcctcaagctgttcccgggggagaagaacagcggcatcttctccgagttcctgaagctcatcgtggggaaccaggccgacttccgcaagtacttcaacctggacgagaagaccagcctgcagttctccaaggagagctacgacgaggacctcgagaccctgctgggccacatcggcgacgactacagcgacgtcttcctcaaggccaagaagctgtacgacgccatcctgctctccgggatcctgaccgtgacggacaacggcaccgaggcgcccctgagctccgccatgatcatgcggtacaaggagcacgaggaggacctcgccctgctgaaggcctacatccgcaacatcagcctcgagacctacaacgaggtgttcaaggacaacaccaagaacgggtacgccggctacatcgacggcaagacgtcccaggaggacttctacgtctacctgaagcggctgctcgccgggctggagggcgcggactacttcctggagaagatcgaccgcgaggacttcctccggaagcagcgcaccttcgacaacgggagcatcccctaccagatctacctgcaggagatgcgcgccatcctggacaagcaggccaagttctaccccttcctggccaagaacaaggagcggatcgagaagatcctcaccttccgcatcccgtactacgtgggccccctggcccgggggaactccgacttcgcgtggagcatccgcaagcggaacgagaagatcaccccctggaacttcgaggacgtgatcgacaaggagtccagcgccgaggccttcatcaaccgcatgacgtccttcgacctgtacctccccgaggagaaggtcctgccgaagcacagcctgctctacgagaacttcaccgtgtacaacgagctgaccaaggtgcggttcatcgccgagggcatgcgcgactaccagttcctggactccaagcagaagaaggacatcgtccggctctacttcaagggcaagcgcaaggtgaccgacaaggacatcatcgagtacctgcacgccatcgacgggtacgacggcatcgagctgaaggggatcgagaagcagttcaacagctccctcagcacgtaccacgacctgctgaacatcatcaacgacaaggagttcctcgacgactccagcaacgagaccatcatcgaggagatcatccacaccctgaccatgttcgaggaccgggagatgatcaagcagcgcctgtccaagttcgacaacatcttcgacaagagcgtgctcaagaagctgagccggcgccactacacgggctgggggaagctgtccgcgaagctcatcaacggcatccgggacgagaagtccggcaacaccatcctggactacctgatcgacgacggggtcagcaaccgcaacttcatgcagctcatccacgacgacgccctgagcttcaagaagaagatcaagaaggcccagatcatcggcgacaaggacaacatcaagcaggtcgtgaagtccctgcccgggagccccgccatcaagaagggcatcctccagtccatcaagatcgtggacgagctggtgaaggtcatggggcgggagcccgagagcatcgtggtggagatggcgcgcgagaaccagtacaccaaccagggcaagtccaacagccagcagcggctgaagcgcctcgaggagtccctgaagggcctggggagcaagatcctcaaggagaacgtcccgacccgcctgtccaagatcgacaacaacgccctgcagaacgaccggctctacctgtactacctgcagaacggcaaggacatgtacacgggggaggagctcgacatcgaccgcctgagcaactacgacatcgaccacatcatcccccaggccttcctgaaggacgactccatcgacaacaaggtgctcgtgagctccgccagcaaccggggcaagagcgacgacgtcccctccctggaggtggtgaagaagcgcaagaccctgtggtaccagctcctcaagagcaagctgatctcccagcggaagttcgacaacctcaccaaggccgagcgcggcgggctgagccaggaggagaaggcgggcttcatccagcggcagctggtcgagacccgccagatcacgaagcacgtggcccggctcctggacgagcgcttcaacaacaagaaggacgagaacaaccggaccctgcgcaccgtgaagatcatcaccctcaagtccagcctggtctcccagttccggaaggacttcgagctgtacaaggtgcgcgagatcaacgacttccaccacgcccacgacgcctacctcaacgccgtggtcgcgagcgccctgctgaagaagtaccccaagctcgagccggagttcgtgtacggggactaccccaagtacaactccttccgggagcgcaagagcgccaccgagaaggtgtacttctactccaacatcatgaacatcttcaagaagtccatccccctggccgacggcacggtcatcgaccggcccctgatcgaggtgaacgaggagaccggggagagcgtgtggaacaaggtcgccgacctcaacaccgtgcgcaaggtgctgagctactcccaggtcaacatcgtgaagaaggtggaggagcagaaccacggcctggaccggggcaagccgaagggcctcttcaacgcgaacctgagctccaagcccaagcccaacagcaaggagaacctggtcggggccaaggagtacctcgaccccaagaagtacgggggctacgccgggatctccaacagcttcgccatcctggtgaagggcaccatcgagaagggcgcgaagaagaagatcacgaacgtgctggagttccaggggatcagcatcctcgaccgcatctactaccggaaggacaagctgaacttcctgctcgagaagggctacaaggacatcgagctgatcatcgagctgccgaagtactccctcttcgagctgagcgacgggtcccgccgcatgctggccagcatcctctccaccaacaacaagcggggcgagatccacaaggggaaccagatcttcatcagccagaagttcgtcaagctgctgtaccacgccaagcgcatctccagcaccttcaacgagaaccaccggaagtacgtggagaaccacaagaaggagttcgaggagctgttctactacatcctggagttcaacgagaactacgtgggcgccaagaagaacggcgagctgctcaagtccgccttccagagctggcagaaccactccatcgacgagctgtgcagctccttcatcgggcccaccggcagcgagcgcaaggggctgttcgagctcacgtcccggggcggggcggccgacttcgagttcctgggcgtcaagatcccccgctaccgggactacaccccgagctccctgctcaaggacgccaccctgatccaccagagcgtgaccggcctgtacgagacgcgcatcgacctggggaagctcggcgaggactga

SEQ ID NO: 2063 - RNA, 4158 nt, synthetic construct
  misc_feature 1..4158: note = Cas9 variant
  source 1..4158: mol_type = other RNA
atgcagacctacttcggcatgaagaagatcctggggctcgacctgggcaccaacagcatcgggtgggccctggtgaacgaggccaacgacgacaacgagaagtccagcatcatcaagctcggcgtccgcgtgaaccccctgacggtggacgagcagtccaacttcgagaagggcaagagcatcaccaccaacgcggagcggaccatcaagcgctccatccggcgcagcctgcagcggtacaagctccgccgggagaacctgatcgagatcctgaaggagcacaacttcatcacggacgacaccatcctctccgaggacgggaacgccagcaccttcgagacctaccgcctgcgggccaaggccgcctccgagaagatcagcctggaggagctcggccgcgtcctgctgatgatcaacaagaagcgggggtacaagtccagccgcaaggcgaagaaccaggaggagggccagctcatcgacgggatggaggtggccaaggagctgtacgagaagaacatcacgcccggccagttcgtgttccagctgctcaagcagggcgggaagttcatccccgacttctaccggtccgacctgcaggccgagttcgacaagatctgggagttccagaagctgttccacgccgagatcctcgtcgacgacttcaagaagcagctggagcgcaagggcaagctgaacagctccaagatcttcctcgggcggttcggcatctacaccgcggagaacaaggggaacgacaagcgcctgcaggcctaccagtggcgggtggacgccctgaccaaggagctcaccaaggaggagctggcctacgtgatcagcgacctgaacggcatcatctccagctccagcggctacctcgggagcatctccgaccgcagcaaggagctgtacttcaacaaccagacggtcggccagttcctgatggcccagctcgaccacagcccccacaccagcctgaagaaccaggtgttctaccggcaggactacctggacgagttcaacaccctctgggagaaccaggcgcactaccacaaggtgctgacctccgacctcaagagcgagatccgcgacgtcatcatcttctaccagcggcgcctgaagacgcagaaggggctgatctccttctgcgagttcgagagccgcaagatcgaggtggagatcgacggcaagaagaagatcaagaacgtggggtcccgggtctgccccaagagctccccgatcttccaggagttcaagatctggcagatcctgaacaacatcgagctcctggagaagtcctccaaggccaagcgcttcctggaccaggaggagaaggagctcctgttcaaggagctgagcatcaagtccaagatcagcaagtccgacgccctcaagctgctgttcaagaacagccgggagctggacctcaactacaaggagatcgagggcaaccgcacccagtccgccctgttcgacgcctacagcaagatcatcgagctgagcggccacggggagtacgacttctccaagatggaggcgagcaacatcatcgagctcgtgcaggaggtgttcaccggcctgaactacaacaccgagatcctgtacttcgactccagcctcgaggggaaggacttcgagaaccagcccatgtaccggctgtggcacctcctgtactccttcgagggcgacgacagcaagacggggaacgagaagctgatcaacaagctgtccgagctctacggcttcgagaagaagtacagcatcgtcctggccaacgtgtccttccaggaggactacggcagcctgtccaccaaggccatccgcaagatccacccctacctcaaggaggggatccagtacgacgtggcctgcgagttcgccggctaccggcacagcaagtccagcctgaccaaggaggagatcgagaacaagatcctgaaggaccagctcgagatcctgcccaagaactccctgcgcaacccggtcgtggagaagatcctcaaccagatgatcaacgtggtcaacgcgctgaacgagagctacgggaagcccgacgagatccggatcgagctggcccgcgagctcaagaagtccgccaaggagcgggaggagctgaccgccagcatcggcgagacgaccatcaagcacgagaagtaccgcgccatcctggagaacgagttcgggatcagccacgtgtcccggaacgacatcatccgctacaagctctacctggagctggagaaccggggctacaagaccctctacagcaacacctacgtctcccaggagaagctgttcagcaaggagttcgacatcgaccacatcatcccccagtcctgcctgttcgacgacagcttctccaacaagacgctcgagagcaagtccgtgaacatcgagaagggcaacgacaccgcgttcgactacgtgttcgccaagtacggggaggccggcctgagcgactacatcatccacatcgaggagctgttcaaggacgggaagatctccaagaccaagctcaacaagctgaagatgaagggcaacgagatccccagcgacttcatcgcccgcgacatccgggacacccagtacatcgcgcgcatcgccaagaacatcctggaggagacggtccggaacgtggtgtccaccagcggctccatcaccgaccgcctccgcgaggactggcagctgatcgacgtcatgcaggagctgaactgggagaagtacagcgccctcgggctgaccgagatctacgagaaccgggagggccacacgatccgccggatcaaggactggaccaagcgcaacgaccaccggcaccacgccatggacgccctgaccatcgcgttcaccaagcgctcccacatccagtacctcaacaacctgaacgcccggagcgacaagtccgggagcatctacggcatcgagaccaaggagctgtaccgcgacgaccacgggaagctcaagttcaagccgcccatccccctgaacgagttccgggccgaggccaagaagcacctggagaacacgctcatcagcatcaaggccaagaacaaggtggcgaccatcaacatcaacaccacctccacgaaggagggcaagaacaagaagcgccagctgacgccccggggccagctgcacctcgagaccatctacgggagcatccagcagtacgtgaccaagcaggagaaggtcggcgcctccttcaacgaggagcagatcagcaaggtggccaagcagaagtaccgccaggccctgctgaaccggctccgcgagttcgacaacgacccgaagaaggccttcaccgggaacaactccttcgagaagaaccccatctacctggacgtgctgcagacccagaaggtccccgacaaggtggagaccgtgagcaaggagatcatctacaccatccggaaggacatcacgcccgagctcaagatcgagaaggtcatcgacaagaagatcaagaccatcctgcagtcccgcctgaacgagtacagcggcgactccaagcgggcgttcagcaacctcaaggagaacccgatctggctgaaccaggagaaggggatcgagatcaagcgcgtgaccatctccggcatcagcaacgccgtggccatccacgacaagaaggacaagaacggcaacctgatcctcgacaacgaggggtccacccaggccgtcgacttcgtgaacacgggcaacaaccaccacgtggcgatctacaaggacgagcgggggaacctgcacgagagcgtcgtgtccttcttcgaggcctgcacccgcgtgaacctgggcgggcccgtcatcttcaagaactacaacaagagcgacggctgggagttcctcttctccatgaagcagaacgagtacttcgtgttccccaacgagaagaccggcttcaaccccaacgagatcgacctgctggacccggacaactaccggctcatcagccccaacctgttccgcgtgcagaagatctccagcaagaactacgtcttcaaccaccacctggagaccagcgccatcacgggggagaccctcaagaacaagaagcagctgtccagcgtgacctaccacttcatccagtccctgccgcccatcaaggacatcgtgaaggtccgcatcaacaacatcggccagatcgtgtgggtgggggagtactga

SEQ ID NO: 2064 - RNA, 4158 nt, synthetic construct
  misc_feature 1..4158: note = Cas9 variant
  source 1..4158: mol_type = other RNA
atggacgagctgcagaacttcgagaagggcaagagcatcaccaccaacgccgaccgcacggccgggcggtccatgcgccggaacctccagcgctacaagctgcggcgcgagaacctgatcgaggtgctcaaggagtacaacttcatcaccgacgagatgatcctgagcgagaacggcaaccggaccaccttcgagacgtaccgcctgcgggcgaaggccgccgtcgaggagatctccctcgagcagttcgcccgcgtgctgctgatgatcaacaagaagcgggggtacaagagctcccgcaaggccaagggcgcggagaacgggaccctcatcgacggcatggaggtggccaagaagatgtacgacgagggcatcacccccggggagctgtgcctgcagctcctgaccgccggcaagcggtacttcccggacttctaccgcagcgacctgcaggccgagttcgaccggatctggaacttccagaagcagttctaccccgactccctcatcgacaaggtcaaggacgaggtgcgcgggaagaacaagagccagacgtgggcgatcctggccaagtacttcgtgtggaaggaggtcgagaactcctggaacgaggaggaggcccagacccggcgcgtggagaaggagtaccggctggtgggcatcaagcgcggggtcaagcgggaggagctcaagctggagaacttccagtggcgcgtgaaggccctgagcgagcgcatgaaccccgaggagctcgccatcgtgctgcaggagatcaacgagcagatctccaacagctccggctacctgggcgcgatcagcgaccggtccaaggagctctacttcaaccgccagaccgtcgggcagtaccagatggccgtgctggacaacaaccccaacatcggcctgcggaacatggtgttctaccgccaggggtacctcggcgagttcaacaccatctgggagaagcaggccgagttccacaaggagctgacggaggacctgaagaaggagatccgggacatcgtcatcttctaccagcgccggctcaagagccagaagggcctgatcaacatctgcgagttcgagcgccggcagatcgaggtggagatcgacgggaagaagaagatcaagaccatcggctcccgcgtgatcccgcggagcagccccctgttccaggagttcaagatctggcagaccctcaacgacatcgaggtcagcgtgctgggggtgaagaacaagcgcaagaagcaggacgacaacagcaccacgctgctcgactccgccgagaacatcgacagcctgaagctgaacgtctcccggcccctcgacgccgacgagaagtccctgctggcgaaggagctgttcatccgcgacaagctcaccaagtccgacgtgctgaagctcctgttcaacaacccccagaacctgaacctcaacttcaagaacatcgacggcaaccggaccgggagcgccctgtaccaggccttctccaagatcctggagatcagcggccacgagtccatcaacttcaagaagtccgccgacgagatcgtggagcaggtcaagaccatcttcagcgccctgggctggaacacggaggtgctctgcttcgacagcgagaaggagctggacaagcagccgtacttcaagctgtggcacctcctgtactccttcgagggggacagcacccccaccggcgacgggaacctgatccagaagatcgcggacctctgcggcttcgagaaggactacgcctccatcctggccaacatcaccttccaggaggactacgggagcctgtccacgaaggccatccgcaagatcctcccccacctgaaggacggcaaccagtacgacgtcgcctgcgagtacgcgggctacaagcacagcaagtccagcctgaagaaggaggagatcaagaacaaggtgctcaaggacaagctggagctgctccccaagaacagcctgcggaacccggtggtcgagaagatcctgaaccagatggtgaacgtgatcaacgccatcatcaccacctacgggaagcccgacgagatccgcatcgagctcgcccgggagctgaagaagaaggccaagaagcgcgaggagctgaccaagacgatcgtcgacaccaccaagacccacgagggcatccgcgcgatcctccagaacgacttcgggatgtcccacgtgagccggaacgccatcatccgctacaagctgtacgaggagctgaaggacaacggctacaagacgctctactccaacacctacatccccaaggagaagctgttcagcaaggacttcgacatcgagcacatcatcccccaggcccggctgttcgacgactccttcagcaacaagaccctcgaggtgaagtccatcaacatcgagaaggggagcaagaccgcctacgacttcgtcgaggagaagtacggcgagcagggcctgcaggagtacctgaaccgctgcgaggtcctcttccgggacaagaagacgaagctgcgcaagctgaagatgcaggagtccgagatcccggaggggttcatcgaccgggacctccgcaacacccagtacatcgccaagaaggcgctgagcatgctgaacgagatctgccggcgcgtggtggccaccaccggcgccatcaccgacgagctccgggaggactggcagctggtggacgtgatgaaggagctgaactgggagaagtacaaggtcctcgggctggtggagtacttcgaggacaacgacggccgcctgatcggccggatcaaggactggacgaagcgcaacgaccaccggcaccacgccatggacgccctcaccgtggcgttcaccaaggacgtcttcatccagtacttcaacaacaagaacgcctccctgaagcccgacaccaacgaggccgccatccgcaacaagtacttccagaacgggaaggccatcccgcccatgagcctggacgagttccgggcggaggccaagaagcacctcaacgacacgctgatctccatcaagaccaagaacaaggtggtgaccatcaacctgaaccgcaccaagaagaagaacggcatcaacaagaagcagcagcagacgccccgggggcagctccacctggagaccgtctacggcagccacaagcagtacgtggtgaaggaggagaaggtcaacgcctccttcgacgccgcgaagatcgccaccgtgaacaagcccgcctaccgcgacgccctgctccggcgcctgcaggagaacgggaacgacagcaagaaggccttcaccggcaagaactccctggacaagcagcccgtgtggctcgacgcgaagcagaacgagtgcgtccccgagaaggtgaagacggtgatgctggagaccgtctacaccgtgcgcaagccgatcgacgagaagctgaacgtggacaaggtcgtggacgcccggatccgcaagctcctgcaggaccggatcaaggagtacggcaacgccaagagcgccttcgccaacctggacgagaaccccatctggctcaacaaggagaaggggatcaccatcaagcgcgtgagcgtctccggcatcagcaaggcgcagtccctgcacgagaagaaggacaaggacgggaacttcatcctggacaaggacagccggcgcatccccgtggacttcgtgaacacgggcaacaaccaccacgtcgccatctaccggaagcccgtgctcgacaagaaggggcaggccgtgttcgacgagaacggcgagctgaagttcgagctggaggaggtcgtggtgtccttcttcgacgccgtcacccgcgtgaacctcagccagccgatcatcgacaaggactacaagcggtccgagggctggaagttcctgttcagcatgaagcagaacgagtacttcgtgttccccaacgagaagaccgggttcgaccccaaggagatcgacctgctcaacccggagaactacgccctgatctcccccaacctgttccgcgtccagaagatcgcgagcaaggactacgtgttccggcaccacctcgagaccgtggtcgccgaccgcaaggagctgcaggagatcacgtggaagcggatctccagcctgtccatcctcaaccgcatcatcaaggtgcgggtcaaccacatcggccagatcgtgatgatcggggagtactga

SEQ ID NO: 2065 - RNA, 4158 nt, synthetic construct
  misc_feature 1..4158: note = Cas9 variant
  source 1..4158: mol_type = other RNA
atgaccaagccctacagcatcggcctggacatcgggaccaactccgtgggctgggccgtcatcacggacgactacaaggtgccgagcaagaagatgaaggtgctcgggaacacctccaagaagtacatcaagaagaacctgctgggcgccctcctgttcgacagcgggatcaccgcggagggccgccggctgaagcgcaccgcccggcgccggtacacgcgccggcgcaaccggatcctctacctgcaggagatcttctccaccgagatggccaccctggacgacgccttcttccagcgcctcgacgacagcttcctggtccccgacgacaagcgggactccaagtaccccatcttcggcaacctggtggaggagaaggcctaccacgacgagttccccaccatctaccacctccgcaagtacctggcggacagcacgaagaaggccgacctgcggctcgtgtacctggccctggcccacatgatcaagtaccgcgggcacttcctcatcgagggcgagttcaactccaagaacaacgacatccagaagaacttccaggacttcctggacacctacaacgcgatcttcgagagcgacctgtccctcgagaacagcaagcagctggaggagatcgtcaaggacaagatctccaagagcgccaagaaggaccggatcctgaagctgttcccgggggagaagaactccggcatcttcagcgagttcctgaagctgatcgtggggaaccaggccgacttcaagaagtacttcaacctcgacgagaaggcgcccctgcacttctccaaggagagctacgacgaggacctggagaccctcctgggctacatcggcgacgactactccgacgtgttcctgaaggccaagaagctctacgacgccatcctgctgagcgggatcctcaccgtcacggacaacggcaccgaggcgcccctgagctccgccatgatcatgcgctacaaggagcacgaggaggacctggccctcctgaaggcctacatccggaacatcagcctggagacctacaacgaggtgttcaaggacgacaccaagaacgggtacgccggctacatcgacggcaagacgtcccaggaggacttctacgtgcacctcaagaagctgctggtcgggctcgagggcgccgactacttcctggagaagatcgaccgcgaggacttcctgcggaagcagcgcaccttcgacaacgggagcatcccctaccagatccacctccaggagatgcgggccatcctggacaagcaggccaagttctacccgttcctggccaagaacaaggagcgcatcgagaagatcctgaccttccgcatcccctactacgtgggccccctcgcgcgggggaactccgacttcgcctggagcatccgcaagcggaacgagaagatcaccccctggaacttcgaggacgtgatcgacaaggagtccagcgccgaggccttcatcaaccgcatgacgtccttcgacctgtacctgccggaggagaaggtcctccccaagcacagcctgctgtacgagaccttcaacgtgtacaacgagctcaccaaggtgcggttcatcgccgagtccatgcgcgactaccagttcctggacagcaagcagaagaaggacatcgtccggctgtacttcaagaacaagcgccgggtgaccgacaaggacatcatcgagtacctccacgcgatcgacggctacgacggcatcgagctgaaggggatcgagaagcagttcaactccagcctgtccacgtaccacgacctcctgaacatcatcaacgacaaggagttcctggacgacagctccaacgaggccatcatcgaggagatcatccacaccctcaccatcttcgaggaccgcgagatgatcaagcagcggctgagcaagttcgagaacatcttcgacaagtccgtgctgaagaagctcagccgccggcactacaccggctgggggaagctgagcgccaagctgatcaacggcatccgcgacgagaagtccgggaacacgatcctcgactacctgatcgacgacggcgtcagcaaccggaacttcatgcagctgatccacgacgacgccctctccttcaagaagaagatcaagaaggcgcagatcatcggcgacaaggacaacatcaagcaggtcgtgcaggccctgcccgggcgccccgccatcaagaagggcatcctgcagagcatcaagatcgtggacgagctcgtgaaggtcatggggcggcgcccggagtccatcgtggtggagatggcccgggagaaccagtacaccaaccagggcaagagcaactcccagcagcgcctgaagcgcctggaggagagcctcaaggagctggggtccaagatcctgaaggagaacatccccgccaagctcagcaagatcgacaacaacgcgctgcagaacgaccggctgtacctctactacctgcagaacggcaaggacatgtacaccggcgaggagctggacatcgaccgcctctccaactacgacatcgaccacatcatcccccaggccttcctgaaggacaacagcatcgacaacaaggtcctggtgtccagcgcctccaaccgggggaagtccgacgacgtgcccagcctcgaggtcgtgaagaagcgcaagaccctgtggtaccagctgctcaagagcaagctgatcagccagcggaagttcgacaacctgacgaaggccgagcgcggcgggctctccccggaggccaaggcgggcttcatccagcggcagctggtggagacccgccagatcaccaagcacgtcgcccggctgctcgacgagcgcttcaacaacaagaaggacgaggacaacaagaccctgcggacggtgaagatcatcaccctcaagagctccctcgtgagccagttccgcaaggacttcgagctgtacaaggtccgggagatcaacgacttccaccacgcccacgacgcctacctgaacgccgtggtggcgtccgccctcctgaagaagtaccccaagctggagcccgagttcgtctacggcgactaccccaagtacaacagcttccgcgagcggaagtccgccaccgagaaggtgtacttctacagcaacatcatgaacatcttcaagaagtccatcagcctcgccgacgggaccgtgatcgagcgcccgctgatcgaggtcaacgaggagaccggcgagtccgtgtggaacaaggtggcggacctgaacacggtccggaaggtgctcagctactcccaggtgaacatcgtcaagaaggtggaggagcagaaccacgggctggaccgcggcaagcccaaggggctgttcaacgccaacctcagctccaagcccaagcccaacagcaaggagaacctggtgggcgccaaggagtacctggacccgaagaagtacggcgggtacgccggcatctccaacagcttcgccgtcctcgtgaaggggaccatcgagaagggcgcgaagaagaagatcaccaacatcctggagttccaggggatctccatcctggaccggatcacctaccgcaaggacaagttcaacttcctcctggagaagggctacaaggacatcgacctgatcatcgagctccccaagtacagcctgttcgagctgagcgacggctcccggcgcatgctcgccagcatcctgtccacgaacaacaagcgcggggagatccacaagggcaaccagatcttcatcagccagaagtacgtgaagctgctctaccacgccaagcggatctccaacaccttcaacgacaaccaccgcaagtacgtcgagaaccacaagaaggagttcgaggagctgttctactacatcctggagttcaacgagaactacgtgggggccaagaagaacggcgagctcctcaagagcgccttccagtcctggcagaaccacagcatcgacgagctgtgctccagcttcatcgggcccaccggctccgagcggaagggcctgttcgagctgaccagccgcgggggcgcggccgacttcgacttcctgggggtgaagatcccgcggtaccgcgactacacgccctccagcctcctgaaggacgccaccctgatccaccagtccgtcaccggcctctacgagacccggatcgacctggggaagctgggcgaggactga

SEQ ID NO: 2066 - RNA, 4158 nt, synthetic construct
  misc_feature 1..4158: note = Cas9 variant
  source 1..4158: mol_type = other RNA
atgaagaacaagacctggtacctgggcctcggggtgggccccaccagcatcgggtgggccgccacggactccaactacaagctgctgcgcaagaacaagaagcggctctggggcgtccgcctgttcgaggaggcgaagaccgccgtggaccggcgcaccttccgggccgagcgccggcgcctggcccggcgcaagtggcggatcagcctcctggaggagctgttcgccaaggaggtgtccaagaacgacccgaacttcttcctccgcctgaaggagagcaagtaccacttcgaggacaagtccctgatgaacgagtacatcctcttcaacgacaaggactacaccgacaaggactactacaaggagtaccccacgatctaccacctccggctgagcctgaccaccgaggagaaccccgacatccgcaaggtctacctggcggtgcactccatgctgaagaaccgggggcacttcctcctgcagggccagagcttcaacgactccaacatcgacagcgtgatcaaggagctgctcgagctggagaccgtcaagatcaacttcgaggtgacggacgaggtgatccactccctgaagaagatcgccctcgagaagaagaacctgagcgacaagaacaacgacgtcaagaagctgtaccccaaggagaagcagctccaggagatcttcaagctggtgttcggcgggaagacctccctggacaagctctacgacatcgaggagtacaaggagctggacaacagcgtgaagtccatcagcttcaaggagaaggtctacgaggaggtgcgcccggactacgagcagatcctgtccaactacatcgagctcctggacctggccaagctcgtgtacgacagcatcgtcctggccgacatcaagaaggagggcaagaccatctccgagagcaaggtggagctgtacaacaagcacaaggacgacctcgcgaacctgaagaagctggtgaagatcgacagcaagctctccgaggacaagaagaaggaggtctacttcaccatcttcaaggaggacaaggagaaggggacgaactacgtgaactacacccaccggagccaggagggcaagtcctgcagctacgaggacttcaagaagttcctgaagaaggagctggagaagctcgaggactcccccaccaagaccacgatcctggaggagctggacctcgagaccttcctgcccctgcagcgcaccaaggacaacagcgtggtcccctaccagatccacaaggaggagctggtgaagatcctcgacaacgccgccaagtaccactccttcctggccgagaaggacgacagcgggtactccacccgggagaaggtggtccagctgttcgagttccgcatcccgtactacatcggccccctcaacgcccaccacaacacggagaacggcgggtacagctgggcgatccggaagaagggcatggagtccgtgcccgtcaccccctggaacttcaaggacgtgatcgacgagagcgcctccgccgaggccttcgtgaacaacctgaagaacaagtgcgcctacctgagcggggaggacgtcctcccgaagaactccctgctgtacagcgagtacgcgctcctgaacgagctgaacgccctccgctacgagggcaaccgcatctccgtggaggcccgggacgtgatcgtcaccaagctgttcaaggagcagggcaagaaggtgaccaagaagacgatcaaggagctgctcaagaccgaggggttcatcgacggcaagggggagatcgtgggcatcgacaacatcgtcaagaacgacctcaagagctaccgcgacttcaagaagatcctggccgacaagttcgacaaggagcgggtggagaacatcatcctgtggatcaccctgtacggggagtcccgcaagctgatcaaggagaagatcaccaaggtgtacggcgacttctacacggtcgacgagatcgagaagatgagccggctcacctacaaggactggggcatcctgagccgcaagctgctcaccgagctggtgtccgagaagctgtacaacgaggagaccggggagtgcctcaacatcatcggcgccatgcggcaggggacgatcctgttcatggagctgctcgcggacaagttcgactacatgagccagatcaagaaccacaacaaggagaacaaggacgacatcaccgagatcacccccgacatcctggagaacctgcacgcctcccccgccgtgaagcgcagcatctggcagaccgtccggatcgtggaggagctcaagacgatcatcggctgcgtgcccaccaagatcttcatcgagaccaccaagcgcaacaacgccccgtacaaggtccccaccctgaaccggaacgacctggtgacgaagtacaagaccatccgcgagcacgagatcttcgagctcgagaaggagctgaagaacaccctggacttcaccctcaacaagaaccggctgatcaacgaggagccctccaagctgaaggccacgaagctctacctgtactacacccagctggggcgctgcatgtacaccggcaagaagatcgacctcggcgagctgttcgacaacaacaacaagtacgacatcgaccacatctacccccagagcaaggtgaaggacgggtccttcaacaacatcgtcctggtgaccaaggcgagcaacgacatgaaggccgacgtgttcccgctcaagtccaagttccagacgaaggagaacaagatcttctggcggttcctgaaggagaagaagctgatcaccgaggagaagtacaaccgcctcgtccggaccgaggagttcagcaacggcgagctgaccgggttcatcacgcgccagctggtggagacctcccaggccatcaaggtgatcagcaacgtcctccgggagctgaaccccgagaccaccatctgctactccaaggccgagaacgtgagctccttccgccagagcttcggcaagatcaaggaggcgaaccgcaaggccgagaacaacgagaagctgatccgggtgcaggagatcaacgactactacaacgccaaggacgcctacctctccatcgtcgtggggaacgtgtacgacgtcaagttcacgcgcaacgtgcacaacttcatcaagaacaacaaggacgcccggcgctacagcctgaacggcctgttctacaccgacgtgaagaacgcgaacaccatcgcctgggagatggacaagaccgtccacgtggtggagaagacgatgaacaacaacaacatcctcatcacccggcgcaccagcgagcagaagggcgccctgtacgacgccaccctgtacaaggccaaggtcgcggagaaggccaaggaggggacgtactaccccctcaagaccaccgactccaagatcaaggacgtgggcaagtacgggggcttcaccaagatcaagatcgcctactacagcatcttcgagtacacgctggacggcaagaaggggaagcagaagatcacccggatcgtgcccatcccgatctacatctcccagaacatcaaggacgacaaggccctgctcgagtacgcccagacccgcctgcccggcaaggacctgaagatcaagtaccggaagctctgcatcgggagcctggtcaagatcaacaacttcaactactacatcggcgggaagaccaacaacaacttcacgttcgactccgcggtccaggtgatcctggacaaggacagcgagtcctacatcaaggagctcgccaagtacctgaactggaagaaggagaacaaggacggcaagctgtgggagagcatcaccgaggacaagaacatccagctctacgactccctggtgaagaagatgaacaccggcatcttcatccgcaagacccccaacaagtacacggagctgctcaccctggaggtgaagaacaagttcatcaacatcgacatcgacgagcaggtcaagctgctcctggagatcctgaacctcctgaccaacaagaagttcaccagcaagctgaacgagatcgggatcaccgcctcccggggcgtgtgcagcttcaacctctccaaccagagccagttctccatcatcgagcagagcgtgacgggggtgtacgagaaggagaagctgatcatcgagaagaagaaggagggcatcctgtga

SEQ ID NO: 2067 - RNA, 4161 nt, synthetic construct
  misc_feature 1..4161: note = Cas9 variant
  source 1..4161: mol_type = other RNA
atgaaccagaagtacagcatcggcctggacatcgggaccaactccgtgggctgggccgtcatcaccgacgactacaaggtgcccgccaagaagatgaaggtgctcgggaacacggacaagcagagcatcaagaagaacctgctgggcgcgctcctgttcgactccggggagaccgccgaggccacccgcctgaagcggaccgcccgccggcgctacacgcggcgccggaaccgcctccggtacctgcaggagatcttcgccgaggagatgatgcaggtcgacgagagcttcttccagcgcctggacgactccttcctcgtggacgaggacaagcggggcgagcgccacccgatcttcggcaacatcgcggccgaggtgaagtaccacgacgagttccccaccatctaccacctccggaagcacctggccgacatcagccagaaggccgacctccgcctggtctacctggcgctcgcccacatgatcaagttccgggggcacttcctgatcgagggccagctgaaggccgagaacaccaacgtgcaggccctcttcaaggacttcgtggaggtctacgacaagaccgtggaggagtcccacctgagcgagatcacggtggacgccctgtccatcctcaccgagaaggtcagcaagtcccgccggctggagaacctgatcgcgcactaccccgccgagaagaagaacaccctcttcgggaacctgatcgccctgttcctcggcctgcagcccaacttcaagaccaacttccagctgagcgaggacgccaagctccagttctccaaggacacgtacgaggaggacctggaggggctgctcggcgaggtgggcgacgagtacgccgacctgttcgcgagcgccaagaacctgtacgacgccatcctcctgtccgggatcctgaccgtggacgacaacagcaccaaggccccgctctccgccagcatggtcaagcgctacgaggagcaccagaaggacctgaagaagttcgaggacttcatcaaggtgaacgcgctggaccagtacaacgccatcttcaaggacaagaacaagaagggctacgccgggtacatcgagtccggcgtgaagcaggacgagttctacaagtacctcaagggcatcctgctgcagatcaacgggagcggcgacttcctcgacaagatcgaccgggaggacttcctgcgcaagcagcggaccttcgacaacgggagcatcccccaccagatccacctccaggagatgcacgccatcctgcgccgccagggcgagcactaccccttcctgaaggagaaccaggacaagatcgagaagatcctgacgttccggatcccctactacgtcgggccgctggcccgcaagggctcccggttcgcgtgggccgagtacaaggccgacgagaagatcaccccctggaacttcgacgacatcctcgacaaggagaagtccgccgagaagttcatcacccgcatgaccctgaacgacctgtacctccccgaggagaaggtgctgcccaagcacagcctgctctacgagacgttcaccgtgtacaacgagctgaccaaggtcaagtacgtgaacgagcagggcgaggcgaagttcttcgacgccaacatgaagcaggagatcttcgaccacgtgttcaaggagaaccggaaggtcaccaaggacaagctgctcaactacctgaacaaggagttcgaggagttccgcatcgtgaacctgacggggctcgacaaggagaacaaggtcttcaacagctccctgggcacctaccacgacctgcggaagatcctcaacaagagcttcctggacaacaaggagaacgcccagatcatcgaggacatcatccagaccctgaccctcttcgaggaccgcgagatgatccggcagcgcctgcagaagtactccgacatcttcacgaaggcccagctgaagaagctcgagcggcgccactacaccgggtggggccggctgagctacaagctgatcaacgggatccgcaacaaggagaacaagaagaccatcctcgactacctgatcgacgacggctacgccaaccggaacttcatgcagctgatcaacgacgacgcgctctccttcaaggaggagatcgccaaggcccagatcatcggcgacgtggacgacatcgccaacgtggtccacgacctgccggggagccccgccatcaagaagggcatcctgcagtccgtgaagatcgtggacgagctcgtcaaggtgatggggcacaaccccgcgaacatcatcatcgagatggcccgcgagaaccagaccacggaccggggccgccggaacagccagcagcgcctgaagctgctccaggactccctgaagaacctggacaaccccgtgaacatcaagaacgtcgagaaccagcagctccagaacgaccgcctgttcctgtactacatccagaacgggaaggacatgtacaccggcgagaccctcgacatcaacaacctgagccagtacgacatcgaccacatcatcccgcaggcctacatcaaggacgactccttcgacaaccgggtgctgaccagctccagcgagaaccgcggcaagtccgacaacgtgcccagcatcgaggtcgtgtgcgcccggaaggccgactggatgcgcctccggaaggcggggctgatcagccagcgcaagttcgacaacctgacgaaggccgagcggggcgggctcaccgagaacgacaaggccggcttcatcaagcgccagctggtggagacccggcagatcaccaagcacgtcgcccaggtgctggacgcgcgcttcaacgccaagcacgacgagaacaagaaggtgatccgggacgtcaagatcatcaccctcaagtccaacctggtgagccagttccgcaaggacttcaagttctacaaggtgcgggagatcaacgactaccaccacgcccacgacgcctacctgaacgccgtcatcggcacggcgctcctgaagaagtaccccaagctggcctccgagttcgtgtacggggagttcaagaagtacgacgtgcgcaagttcatcgccaagagcgacaaggagatcggcaaggccaccgccaagtacttcttctactccaacctcatgaacttcttcaagaaggaggtcaagttcgcggacgggaccgtggtggagcggcccgacatcgagaccagcgaggacggcgagatcgcctggaacaagcagacggacttcaagatcgtccgcaaggtgctgtcctacccccaggtgaacatcgtcaagaagaccgaggtgcagacccacgggctggaccggggcaagccgcgcggcctcttcaacgccaaccccagccccaagccgaagcccgactccagcgagaacctggtgggggtcaagcggaacctggaccccaagaagtacggcgggtacgccggcatctccaacagctacgccgtgctcgtgaaggcgatcatcgagaagggggtcaagaagaaggagaccatggtgctggagttccagggcatctccatcctggaccgcatcacgttcgagaaggacaagcgggccttcctcctgggcaaggggtacaaggacatcaagaagatcatcgagctgcccaagtacagcctcttcgagctgaaggacggctcccgccgcatgctggccagcatcctctccaccaacaacaagcgcggggagatccacaagggcaacgagctgttcgtgccgcagaagttcaccaccctgctctaccacgccaagcggatcaacaaccccatcaacaaggaccacatcgagtacgtcaagaagcaccgggacgacttcaaggagctgctgaactacgtgctcgagttcaacgagaagtacgtgggggcgacgaagaacggcgagcgcctgaaggaggccgtcgccgacttcgacagcaagagcaacgaggagatctgcacctccttcctgggcgccgtgaacagcaagaacgccgggctgttcgagctgacctccctgggcagcgcgtccgacttcgagttcctcggggtgaagatcccccggtaccgcgactacaccccgagctccctgctgaaggacagcacgctcatccaccagtccatcaccggcctgtacgagacccggatcgacctgagcaagctcggggaggactga

SEQ ID NO: 2068 - RNA, 4161 nt, synthetic construct
  misc_feature 1..4161: note = Cas9 variant
  source 1..4161: mol_type = other RNA
atgaccaagatcaccgaggactacatcgtgggcctggacatcgggacgaacagctgcggctgggtcgccatggactccaagaacaccatcctccgcatgcacgggaagaccgccatcggcagccacctgttcgacgcggggaactccgccgccgaccggcgcgccttccggaccacgcgccggcgcatcaagcggcgcaagtggcggctgaagctcctggaggagatcttcgacagccacctggccaaggtggacccctacttcttcgcgcgcctcaaggagtccggcctgagcccgctggacacccggaagaacgtgtccagcatcatctaccccacctccctcgaggacaagaagttctacgtcgacaaccccaccatctaccacctccgctacaagctgatgacggaggaccggaagttcgacctgcgcgaggtgtacctggccatccaccacatcgtgaagtaccggggcaacttcctgtacaacacccccgtcaaggccttcgaggccagcaagatcgacgtgaaggggtccctcaagaagctgaacgagctgtacgagggcctcgacagcgagttcaacgtggagctggactccaacaacgcgctggagatcgagaacatcatccgcgacaagaagatcttcaagatcaacaaggtcaaggagatcaaccagctcctgagcctgaagaccgaggacaaggagcggaccaagctcatgaaggacgtgtccaagcagatcgtgaacgccatcctggggtacaagacgaagttcgagaccatcctgctcaaggacgtcagcaaggacgaggccgacgactgggagttcaagctgaccgacgtggacgccgacaacaagttcgagaacctgatcggcgacctcaacgagaacgagcaggagatcctgctggtgatccgcaagctcgccaacgcgatcaccctgtccaacatcgtcgaggaggggaagacgctgagcgagtccatgaaggacaagtacaagaagcacagcgacgacctcaagctgctgaagcaggtcatcagcgaccacccggaccgggacaaggccaagaagctcgccctggcctacgacctgtacgtgaacaaccgccacggcaagatcctccaggccaaggacatcctggagaagaagaagaccctgtccaaggaggacttctacaaggagatcaagaagaacctcgacgacagcaaggagtcccaggagatcctggacgcgatcagcctggactccttcatgcccaagcagcggaccaacgagaacggcgtgatcccctaccagctccaccagctggagctggacaagatcatcgagaaccaggggaagtactaccccttcctgaaggaggtgaacccggtgagctcccacctcaagcaggccccctacaagctggacgagctgatccgcttccgcgtcccctactacgtgggccccctcatcagcccgaacgagtccaccaagaacaagcagacgaagaagaaccagaacttcgcctggatgatccggaaggagcaggggcagatcaccccctggaacttcgaccagaaggtggaccgcatggccagcgccaacaagttcatcaagcggatgaccaccatcgacacgtacctgctgggcgaggacgtcctccccgcgaactccctgctgtaccagaagttcaccgtgctcaacgagctgaacaacgtcaagatcaacggcaagcgcatcagcgtgcccctgaagcaggagctctacaacaacctgttcaagaagaactccaccgtgaccacgaacaagctcaagagctacctgaaggagaactacaagctgatcaaggtcgagatcaaggggctgtccgacgagaagaagttcaacagcggcctcaccacctacaacaagctgaagaacctgaagatcttcgaccagcagatcgacgacccgaactacaacaaggacttcgagcggatcatcgagtggtccaccatcttcgaggacaaggccatctacaaggagaagctcaagacgatcgactggctgagcgaccgccagatcgacaagctgtccaagatccggatgcaggggtggggccagctcagcaagaagctgctgagccagctcaccgacaacaacgggcagaccatcatcgagcagctgtgggactcccagaacaacttcatgcagatcgtgaaccaggccgacttcaaggacgccatcgccgtggcgaaccagaacctgctcgtcgacaccagcgtggaggacatcctgaacgaggcctacacgtcccccgccaacaagaaggccatccgccaggtggtcaaggtggtggacgacatcgtcaaggcgaccagcggcaaggtgcccaagcagatcgccatcgagttcacccgggacgccgacgacaacgccaagatctcccagagccgcgccaacaagctgcggaaggtgtacaaggagatgtccaacgagctcgcgagcgagaccatccgcaacgagctggagcgggtcgccaaggaccagaagctgctcaaggacaagcactacctgtacttcatgcagctgggccgcgacgcctacaccggggagctcatcgacatcgacaacctggagcagtacgacatcgaccacgtgctgccccagtccttcatcaaggacgacagcctcgagaaccgggtgctggtcaagaaggccgtgaacaacggcaagtccgacaacgtgccggtcaagctgtacgggaaccgcatggccacggacctcggcatgaccatccggcacatgtgggagaagtggaaggagcaggggctgatcaccaagaccaagtacaacaacctgatcatcgaccccgacaagatcaacaagtacgagagctccggcttcatccaccgccagctcgtggagacgagccagatcatcaagctggtgtccaccatcctgcagagcaagtaccccgacaccgagatcatcgtcgtgaaggcgcggtacaaccactacctccgcaagcgcctgaacctgtacaagtcccgggaggtgaacgactaccaccacgccatcgacgcctacctcagcgccatctgcggcaacctgctgtaccaggtctacccctacctccgcccgttcttcgtgtacgggcagtacaagaagttcagctccgagcccgagaaggagaagatcatctacgacaagacccggcgctacaacttcatcagccagatcttcgagaacaaggacaacgacatcatctcccgggagacgaagaagaaggtgttcgacaagaaggacatcatcgagaagctgaagcgcgcctacaactacaagtacatgctggtcagccgggagaccgagacccacgaccaggagatgttcaagatgaccgtgtacccccgcctctcccgggacacgaagaagtcccgcaacctgatccccaagaagaaggacatgccgaccgagatctacggcgggtacaccaacaacagcgacgcgtacatgatcatcgcccggatcaacaagaagaagggccccgagtaccgcgtgttcggggtccccatgcgggagctggtgaacctccgcaaggccgagaagaacggccactacaaggcctacctgaagcaggtcctggagccggagatcatgtacagcaagaacggcaagaagaacaagaccatctccagcttcgagatcgtgaaggcgaaggtgccctacaagcaggtcatcctcgacggggacaagaagttcatgctggcctccagcacgtacgtgcagaacgccaagcagctgaccctctcccagtacagcatgcaggccatcaccgacaactgcgagaacgacaccgaggaggagaaggccctggtggaggcgtacgacgagatcctgacgaacatcgacaagtacctccccctgttcgacatcaacaagttccgggagaagctgcacgccggccgcgagaagttcgtggacctccccctggccgagaagaaggagaccatcctgcaggtcctcaacgggctgcacgacaacgccgtgatgccgaagatcaagtccctgggcctcagcacgcccctgggcttcatgcagttccacaccggggtgtccctgagcgagaacgccaagctcatctaccagtcccccaccggcctgttcgagaagcggctgaagatcagcgacctctga

SEQ ID NO: 2069 - RNA, 4164 nt, synthetic construct
  misc_feature 1..4164: note = Cas9 variant
  source 1..4164: mol_type = other RNA
atgagcgactccaagaagttcgagggcgagaacgtcaagagcggggacaagaagaccaacaagaaccacggcaaggtgctgaagtccagccccaaggagatccgcaagaacaccgagtacttcatcgggctcgacatcggcacgtccagcgtggggtgggccgtgaccaacaccgactacgagatcctgaagttcaacggcaagcggatgtggggctcccgcctgttcaacgaggccagcaccgcggaggagcggcgcgggcaccgggtcaaccgccggcgcatccagcggcgccgggaccgcctcaacctgctggaggagatcttctccgaggagatggccaaggtggacccggagttcttcatgcggctcaaggagagcaagttccacctggaggacaaggacgagcgcatcctgggcgagtccaacatcatcttcaaggggagcgaggacggcgacaagaagtactacgagaagtaccccacgatctaccacctccggcacaagctgatgcagtcctgcgaggacgtggacatccgcgagctgtacatggccctccaccacatcatcaagtaccgggggcacttcctgttcaagggcgacttcgaggagaccggcaccagcatcgagaacatcatcatcgagctgctcgagctgatcaacaacaacctgggggtcaagaagttcgagtacaacgagtccctcatcaacgagctgaagaacatcgtgagcaacacctccaacacgatcaccaacaagaagaagctgctcggcgagttcttcaacaagaaggagtacaaggcccacaagagcctgttcatcctgtccatcggggccagcgtgaagcccgtcgacctcttcctggaggaggagtacaaggacatcgacgacatcaagaacatcagcttcaagaacctggagtacgaccaggtgcgcgacacctacgagtccatcttcctcgacaagatcgagttcatcgacgtggcgaagcggctgtacgacgccaccatcctgctcagcatcaagcccgagggcaagacgctgtccgaggccaaggtcgacatctacaacaagcaccacaacgacctggagctcctgaagaaggtgctgaagaccgacaaggagaagtacgacagcatcctcaagctggacatcaagaagggcaacaactacgtgaactacgtcaagaagtccaagaacgggatcagctgctccaaggaggagttccacaacgccctgaagaaggtgctcgtgaagatcgagaagaccgacgacatcaagtacatcctgaacgagatcgagctggagcgcttcctcccgctgcagcgggtcaaggacaacagcgtgatcccctaccagatccaccgctacgagctgaagaagatcctcgagaacgcgtccaagaagttcaccttcctgaacgaggagagcgacggccacacgaacatcgagaagatcatcaagatcatggagtaccgcatcccctactacgtggggcccctgaacgaccaccactccgtctacaacaacggcttcgcctgggtgagccggaagcgctccgggcggatcaccccgtggaacttcgacgagatggtggacaaggaggagagcgccgagcgcttcatcgagaacctcaccaacaagtgctcctacctgatcggcgaggacgtcctgcccaaggagagcctgctctactccgagttcagcctgctgaacgagctcaacaacatcaagtacgacggcatctccctgcccatcgacatcaagaagtccatcgtggagaagatcttccgggtcgagaagaagcgcgtgaccaagaagtacatcaaggagttcctgaagcaggaggggtacagcgacggcaagggggaggtgagcggcatcgacatcgacatcaagagcgacctcaagtcctaccgggacatggtcaagatcttcgggacggagatcgactaccgcatggccgagaacatcatcaagtgggtgaccctgttcggcgacagcaaggacctgctcaagaccaagatcaacaaggagtacggcgagaaggtgtccaaggaccagctgaagaaggtctgcaagctgaagtaccgggactgggggcgcctcagcaagaagttcctgaccggcatccggtccagcgtgctggtgaacgacgccacgggggagggctacaccatcatcgaggcgatgcgcaacaccgacaacaacctcatgcagctgctgcggaacgagtacgactacctcaagaagatcgaccagatcaacatgctgtcccgcaaggacatcgacgagatcagccacgacatcctggacgacctctactgctcccccgccgtcaagcggagcctgtggcagaccatcaagatcgtggaggagatcaagaagatcatggggcacgagccgaagaaggtgttcgtcgaggtgacgcgcaccaacaaggccgacaagaagaccaccatcacgcggaagaaccgcctgctcgagctgtactccgccatcaacgccgagagccgggactgggtgaacgagctgaactccaccgaggtcagcaagttcaactccaagaagctctacctgtactacacccagatgggcaagtgcatgtacaccggcaagaacatcgacatcgagagcctgttcacggacatgtacgacatcgaccacatcttcccccgcagcaagaccaaggacaactccttcgagaacctcgtgctggtgacccgcaaggcgaacgccgacaagcgggacgtctaccccatcgaccccaagatccagaccgagcgcaagagcctgtgggacatgctccacgacaagaagctgatcggggacaagaagtacgaccggctgacccgcacgaccggcttcaccgacgacgagatgtccgggttcatcgcccggcagctcgtggagaccagccaggcctccaaggccgcggccgagatgctgaagctgatcaacaacgacagcgagatcgtgtacgtcaaggccgagaacgtgtccgacttccgccacgagaacgagttcatcaaggtgcgggagatcaacgaccaccaccacgccaaggacgcctacctcaacatcgtcgtgggcaacgtgtacaacgagaagttcacgaagaacccggcgaactacatcaagaagggcgggggcaacaactacagcctgaactgcatcttcaaccgcaacctggaccggaacgggaagcgcatctgggacgagaagaagtccatcgacaccgtcaaccggatgatgaagtccaacgacgtgcgcgtgaccttcaagaaccgggtcgacaagggccccatcctcaacaaggtgaccatccacaaggccagcgagttcatggacgacgggaagaagaacaagaagggcttccccatcaagagctccgagaagaacggcaacaaccgcctgtgcaacctgtacaagtacgggggctacaaggacctcaactacagccactacacgatcgtgcggtacaacgtctacgagaagaaggggctggacatcaagtactacatgatccccatcccgtactacctgtgcctctgcaacatcaaccagcacgactacgtgtacgactacatctccaaccgcagcaagaaggacgtgaacaacatcgagatcatcgtcaacgagctgaagatgggctccctgatcaacatcgacgggtacaactactacctcggcggcagcaagcccaagaccttctacgtggaccccgcctaccagatcatcctggacaaggagatcgagcggtgcatcaaggagatcgtgaaggccaagaacaacgagtaccgcttcatcaacaccgacaagatcaacaagaacctgaacatgaagatctacaagtacatcgtcaacaagaagatcatcggggtgttccggaaccgcaagtgggacaagggcgagtacctcaactccagcgagaccatcgagaagttcagcgggctgtccgtggagagccagtgcaacgtcatcctgcggctcatcaacgacatgcgcggctccaacaagggcggggcgaacagcaagttcgacgagctggagatgacgatctcccgcgccgagatcccccagaccctgagcaacgtgtccagcttcaagatcatcaaccagtccatcaccggcctcttcgagaacgaggtgaccatcgtctga

SEQ ID NO: 2070 - RNA, 4167 nt, synthetic construct
  misc_feature 1..4167: note = Cas9 variant
  source 1..4167: mol_type = other RNA
atgaccaagccctacagcatcggcctggacatcgggaccaactccgtgggctgggccgtcatcacggacgactacaaggtgccgagcaagaagatgaaggtgctcgggaacacctccaagaagtacatcaagaagaacctgctgggcgccctcctgttcgacagcgggatcaccgcggagggccgccggctgaagcgcaccgcccggcgccggtacacgcgccggcgcaaccggatcctctacctgcaggagatcttctccaccgagatggccaccctggacgacgccttcttccagcgcctcgacgacagcttcctggtccccgacgacaagcgggactccaagtaccccatcttcggcaacctggtggaggagaaggcctaccacgacgagttccccaccatctaccacctccgcaagtacctggcggacagcacgaagaaggccgacctgcggctcgtgtacctggccctggcccacatgatcaagtaccgcgggcacttcctcatcgagggcgagttcaactccaagaacaacgacatccagaagaacttccaggacttcctggacacctacaacgcgatcttcgagagcgacctgtccctcgagaacagcaagcagctggaggagatcgtcaaggacaagatctccaagctggagaagaaggaccggatcctcaagctgttcccgggggagaagaacagcggcatcttctccgagttcctgaagctcatcgtggggaaccaggccgacttcaagaagtacttcaacctggacgagaaggccagcctgcacttctccaaggagagctacgacgaggacctcgagaccctgctgggctacatcggcgacgactactccgacgtgttcctcaaggccaagaagctgtacgacgccatcctgctcagcgggatcctgaccgtcacggacaacggcaccgaggcgcccctgagctccgccatgatcatgcgctacaaggagcacgaggaggacctcgggctgctgaaggcctacatccggaacatcagcctcgagacctacaacgaggtgttcaaggacaactccaagaacggctacgccggctacatcgacgggaagaccaaccaggaggacttctacgtgtacctgaagaacctgctcagcaacttcgagggcgccgactacttcctggagaagatcgaccgcgaggacttcctgcggaagcagcgcacgttcgacaacgggtccatcccctaccagatccacctccaggagatgcgggcgatcatcgacaagcaggccaagttctaccccttcctggccaacaacaaggagcgcatcgagaagatcctgaccttccgcatcccgtactacgtcggccccctggcccgggggaacagcgacttcgcctggtccatccgcaagcggaacgagaagatcaccccctggaacttcgaggacgtgatcgacaaggagagctccgcggaggccttcatcaaccgcatgaccagcttcgacctctacctgcccgaggagaaggtgctgccgaagcactccctcctgtacgagacgttcaacgtctacaacgagctgaccaaggtgcggttcatcgccgagagcatgtccaagtaccagttcctcgacagcaagcagaagaaggacatcgtgcgcctgtacttcaaggacaagcggaaggtcaccgacaaggacatcatcgagtacctgcacgccatcgacggctacgacggcatcgagctcaaggggatcgagaagcagttcaactccagcctgtccacctaccacgacctgctcaacatcatcaacgacaaggagttcctggacgacagctccaacgaggccatcatcgaggagatcatccacacgctgaccatcttcgaggaccgcgagatgatcaagcagcggctcagcaagttcgagaacatcttcgacaagagcgtgctgaagaagctgtcccgccggcactacaccggctgggggaagctcagcgcgaagctgatcaacggcatccgcgacgagaagtccgggaacaccatcctggactacctcatcgacgacggcatcagcaaccggaacttcatgcagctgatccacgacgacgccctgtccttcaagaagaagatccagaaggcccagatcatcggcgacgaggacaaggggaacatcaaggaggtggtcaagagcctccccggctcccccgccatcaagaaggggatcctgcagagcatcaagatcgtggacgagctggtgaaggtcatgggcgggcgcaagcccgagtccatcgtggtcgagatggcgcgggagaaccagtacacgaaccagggcaagagcaactcccagcagcgcctcaagcggctggagaagtccctgaaggagctcggcagcaagatcctgaaggagaacatcccggccaagctgagcaagatcgacaacaacgccctccagaacgaccgcctgtacctgtactacctccagaacgggaaggacatgtacaccggcgacgacctggacatcgaccggctgtccaactacgacatcgaccacatcatcccccaggccttcctcaaggacaacagcatcgacaacaaggtgctggtgtccagcgccagcaaccgcgggaagtccgacgacgtccccagcctggaggtggtgaagaagcgcaagaccctctggtaccagctgctgaagtccaagctcatcagccagcggaagttcgacaacctgaccaaggcggagcgcggcggcctgtcccgggaggacaaggccagcttcatccagcgccagctcgtcgagacgcggcagatcaccaagcacgtggcccgcctgctggacgagaagttcaacaacaagaaggacgagaacaaccgggccgtgcgcaccgtcaagatcatcaccctcaagtccacgctggtgagccagttccggaaggacttcgagctgtacaaggtgcgcgagatcaacgacctccaccacgcccacgacgcgtacctgaacgccgtcgtggcctccgccctgctcaagaagtaccccaagctggagccggagttcgtgtacggggactaccccaagtacaacagcttccgggagcgcaagtccgccaccgagaaggtctacttctacagcaacatcatgaacatcttcaagaagtccatcagcctggcggacggcaccgtgatcgagaagcccctcatcgaggtgaacgaggagaccggggagtccgtctggaacaaggagagcgacctggccaccgtgcggcgcgtgctgtcctacccccaggtcaacgtggtgaagaaggtcgagaagcagaaccacggcctcgaccgggggaagccgaagggcctgttcaacgccaacctgagctccaagcccaagcccaacagcaacgagaacctcgtgggcgccaaggagtacctggaccccaagaagtacgggggctacgcggggatcagcaactccttcgccgtgctggtcaagggcacgatcgagaagggggccaagaagaagatcaccaacgtgctcgagttccagggcatcagcatcctggaccgcatcaactaccggaaggacaagctgaacttcctcctggagaagggctacaaggacatcgagctgatcatcgagctcccgaagtactccctgttcgagctgagcgacgggtcccgccggatgctcgccagcatcctgtccaccaacaacaagcgcggcgagatccacaaggggaaccagatcttcctgagccagaagttcgtgaagctcctgtaccacgccaagcggatctccaacaccatcaacgagaaccaccgcaagtacgtcgagaaccacaagaaggagttcgaggagctgttctactacatcctcgagttcaacgagaactacgtgggcgcgaagaagaacgggaagctgctgaacagcgccttccagtcctggcagaaccacagcatcgacgagctctgctccagcttcatcggccccacgggctccgagcgcaaggggctgttcgagctgaccagccggggctccgccgccgacttcgagttcctcggggtgaagatcccccgctaccgggactacaccccgagctccctgctgaaggacgccaccctcatccaccagagcgtcacgggcctgtacgagacccgcatcgacctggcgaagctgggggagggctga

SEQ ID NO: 2071 - RNA, 4167 nt, synthetic construct
  misc_feature 1..4167: note = Cas9 variant
  source 1..4167: mol_type = other RNA
atgaccaagccctacagcatcggcctggacatcgggaccaactccgtgggctgggccgtcatcacggacaactacaaggtgccgagcaagaagatgaaggtgctcgggaacacctccaagaagtacatcaagaagaacctgctgggcgtcctcctgttcgacagcgggatcaccgccgagggccgccggctgaagcgcaccgcgcggcgccggtacacgcgccggcgcaaccggatcctctacctgcaggagatcttctccaccgagatggccaccctggacgacgccttcttccagcgcctcgacgacagcttcctggtgcccgacgacaagcgggactccaagtaccccatcttcggcaacctggtggaggagaaggtctaccacgacgagttccccaccatctaccacctccgcaagtacctggccgacagcacgaagaaggccgacctgcggctcgtgtacctggcgctggcccacatgatcaagtaccgcgggcacttcctcatcgagggcgagttcaactccaagaacaacgacatccagaagaacttccaggacttcctggacacctacaacgccatcttcgagagcgacctgtccctcgagaacagcaagcagctggaggagatcgtgaaggacaagatctccaagctggagaagaaggaccggatcctcaagctgttcccgggggagaagaacagcggcatcttctccgagttcctgaagctcatcgtcgggaaccaggccgacttccgcaagtgcttcaacctggacgagaaggcgagcctgcacttctccaaggagagctacgacgaggacctcgagaccctgctgggctacatcggcgacgactactccgacgtgttcctcaaggccaagaagctgtacgacgccatcctgctcagcgggttcctgaccgtgacggacaacgagaccgaggcgcccctgagctccgccatgatcaagcggtacaacgagcacaaggaggacctcgccctgctgaaggagtacatccgcaacatcagcctcaagacctacaacgaggtcttcaaggacgacaccaagaacggctacgccgggtacatcgacggcaagacgaaccaggaggacttctacgtgtacctgaagaacctgctcgccgagttcgagggcgccgactacttcctggagaagatcgaccgggaggacttcctgcgcaagcagcggaccttcgacaacgggtccatcccctaccagatccacctccaggagatgcgcgccatcctggacaagcaggcgaagttctaccccttcctggccaagaacaaggagcgcatcgagaagatcctgaccttccggatcccgtactacgtgggccccctcgcccgcgggaacagcgacttcgcctggtccatccggaagcgcaacgagaagatcaccccctggaacttcgaggacgtcatcgacaaggagagctccgccgaggcgttcatcaaccggatgacgagcttcgacctgtacctgcccgaggagaaggtgctcccgaagcactccctgctgtacgagaccttcaacgtgtacaacgagctcaccaaggtccgcttcatcgccgagagcatgcgggactaccagttcctggactccaagcagaagaaggacatcgtgcgcctgtacttcaaggacaagcggaaggtgaccgacaaggacatcatcgagtacctccacgccatctacggctacgacgggatcgagctgaagggcatcgagaagcagttcaacagctccctgagcacgtaccacgacctcctgaacatcatcaacgacaaggagttcctggacgactccagcaacgaggccatcatcgaggagatcatccacaccctcaccatcttcgaggaccgcgagatgatcaagcagcggctgtccaagttcgagaacatcttcgacaagagcgtcctgaagaagctctcccgccggcactacaccggctgggggaagctgagcgccaagctgatcaacggcatccgcgacgagaagtccgggaacacgatcctcgactacctgatcgacgacggcatcagcaaccggaacttcatgcagctgatccacgacgacgcgctcagcttcaagaagaagatccagaaggcccagatcatcggggacgaggacaagggcaacatcaaggaggtggtgaagtccctgcccggcagccccgccatcaagaaggggatcctgcagtccatcaagatcgtcgacgagctcgtgaaggtcatgggcgggcgcaagcccgagagcatcgtggtggagatggcccgggagaaccagtacaccaaccagggcaagtccaacagccagcagcgcctgaagcggctggagaagtccctcaaggagctggggagcaagatcctgaaggagaacatcccggcgaagctctccaagatcgacaacaacgccctgcagaacgaccgcctgtacctctactacctgcagaacggcaaggacatgtacaccggcgacgacctggacatcgaccgcctcagcaactacgacatcgaccacatcatcccccaggccttcctgaaggacaactccatcgacaacaaggtcctggtgagctccgccagcaaccgggggaagtccgacgacttccccagcctcgaggtggtcaagaagcgcaagaccttctggtaccagctgctcaagagcaagctgatctcccagcggaagttcgacaacctgacgaaggccgagcgcggcgggctgctccccgaggacaaggcgggcttcatccagcggcagctggtggagacccgccagatcaccaagcacgtggcccggctgctcgacgagaagttcaacaacaagaaggacgagaacaaccgcgccgtccggaccgtgaagatcatcacgctcaagagcaccctggtgtcccagttccgcaaggacttcgagctgtacaaggtccgggagatcaacgacttccaccacgcccacgacgcctacctgaacgcggtgatcgccagcgccctgctcaagaagtacccgaagctggagcccgagttcgtgtacggcgactaccccaagtacaactccttccgcgagcgcaagagcgccaccgagaaggtctacttctactccaacatcatgaacatcttcaagaagtccatcagcctggccgacgggcgggtgatcgagcggcccctcatcgaggtgaacgaggagaccggcgagagcgtctggaacaaggagtccgacctggcgaccgtgcgccgggtgctgagctacccgcaggtcaacgtggtgaagaaggtcgaggagcagaaccacgggctcgaccgcggcaagcccaaggggctgttcaacgccaacctgtccagcaagcccaagcccaactccaacgagaacctcgtgggcgccaaggagtacctggacccgaagaagtacggcgggtacgccggcatcagcaactccttcgcggtgctggtcaaggggacgatcgagaagggcgccaagaagaagatcaccaacgtgctcgagttccaggggatcagcatcctggaccggatcaactaccgcaaggacaagctgaacttcctcctggagaagggctacaaggacatcgagctgatcatcgagctccccaagtactccctgttcgagctgagcgacggcagccggcgcatgctcgcctccatcctgagcaccaacaacaagcgcggggagatccacaagggcaaccagatcttcctgtcccagaagttcgtgaagctcctgtaccacgccaagcggatcagcaacaccatcaacgagaaccaccgcaagtacgtcgagaaccacaagaaggagttcgaggagctgttctactacatcctcgagttcaacgagaactacgtgggggccaagaagaacggcaagctgctgaactccgcgttccagagctggcagaaccactccatcgacgagctctgcagctccttcatcgggcccacgggcagcgagcggaagggcctgttcgagctgacctcccgcgggagcgccgccgacttcgagttcctcggcgtgaagatcccgcggtaccgcgactacaccccctccagcctgctgaaggacgccaccctcatccaccagtccgtcacggggctgtacgagacccggatcgacctggccaagctgggcgaggggtga

SEQ ID NO: 2072 - RNA, 4167 nt, synthetic construct
  misc_feature 1..4167: note = Cas9 variant
  source 1..4167: mol_type = other RNA
atgaccaagccctacagcatcggcctggacatcgggaccaactccgtgggctgggccgtcatcacggacaactacaaggtgccgagcaagaagatgaaggtgctcgggaacacctccaagaagtacatcaagaagaacctgctgggcgtcctcctgttcgacagcgggatcaccgccgagggccgccggctgaagcgcaccgcgcggcgccggtacacgcgccggcgcaaccggatcctctacctgcaggagatcttctccaccgagatggccaccctggacgacgccttcttccagcgcctcgacgacagcttcctggtgcccgacgacaagcgggactccaagtaccccatcttcggcaacctggtggaggagaaggcctaccacgacgagttccccaccatctaccacctccgcaagtacctggccgacagcacgaagaaggcggacctgcggctcgtctacctggccctggcccacatgatcaagtaccgcgggcacttcctcatcgagggcgagttcaactccaagaacaacgacatccagaagaacttccaggacttcctggacacctacaacgccatcttcgagagcgacctgtccctcgagaacagcaagcagctggaggagatcgtgaaggacaagatctccaagctggagaagaaggaccggatcctcaagctgttcccgggggagaagaacagcggcatcttctccgagttcctgaagctcatcgtggggaaccaggcggacttccgcaagtgcttcaacctggacgagaaggccagcctgcacttctccaaggagagctacgacgaggacctcgagaccctgctgggctacatcggcgacgactactccgacgtcttcatcaaggccaagaagctctacgacgccatcctgctgagcgggttcctcaccgtgacggacaacgagaccgaggccccgctgagctccgcgatgatcaagcggtacaacgagcacaaggaggacctggccctcctgaaggagtacatccgcaacatcagcctgaagacctacaacgaggtgttcaaggacgacaccaagaacggctacgccgggtacatcgacggcaagacgaaccaggaggacttctacgtctacctcaagaacctgctggccgagttcgagggcgccgactacttcctcgagaagatcgaccgggaggacttcctgcgcaagcagcggaccttcgacaacgggtccatcccctaccagatccacctccaggagatgcgcgcgatcctcgacaagcaggccaagttctaccccttcctggccaagaacaaggagcgcatcgagaagatcctgaccttccggatcccgtactacgtgggccccctggcccgcgggaacagcgacttcgcctggtccatccggaagcgcaacgagaagatcaccccctggaacttcgaggacgtgatcgacaaggagagctccgcggaggccttcatcaaccggatgacgagcttcgacctctacctgcccgaggagaaggtcctgccgaagcactccctcctgtacgagaccttcaacgtgtacaacgagctgaccaaggtgcgcttcatcgccgagagcatgcgggactaccagttcctcgactccaagcagaagaaggacatcgtccgcctgtacttcaaggacaagcggaaggtgaccgacaaggacatcatcgagtacctgcacgccatctacggctacgacgggatcgagctcaagggcatcgagaagcagttcaacagctccctgagcacgtaccacgacctgctcaacatcatcaacgacaaggagttcctggacgactccagcaacgaggccatcatcgaggagatcatccacaccctgaccatcttcgaggaccgcgagatgatcaagcagcggctctccaagttcgagaacatcttcgacaagagcgtgctgaagaagctgtcccgccggcactacaccggctgggggaagctcagcgcgaagctgatcaacggcatccgcgacgagaagtccgggaacacgatcctggactacctcatcgacgacggcatcagcaaccggaacttcatgcagctgatccacgacgacgccctgagcttcaagaagaagatccagaaggcccagatcatcggggacgaggacaagggcaacatcaaggaggtcgtgaagtccctccccggcagccccgccatcaagaaggggatcctgcagtccatcaagatcgtggacgagctggtcaaggtgatgggcgggcgcaagcccgagagcatcgtcgtggagatggcgcgggagaaccagtacaccaaccagggcaagtccaacagccagcagcgcctcaagcggctggagaagtccctgaaggagctcgggagcaagatcctgaaggagaacatcccggccaagctgtccaagatcgacaacaacgccctccagaacgaccgcctgtacctgtactacctccagaacggcaaggacatgtacaccggcgacgacctggacatcgaccgcctgagcaactacgacatcgaccacatcatcccccaggccttcctcaaggacaactccatcgacaacaaggtgctggtcagctccgccagcaaccgggggaagtccgacgacttccccagcctggaggtggtgaagaagcgcaagaccttctggtaccagctcctcaagagcaagctgatctcccagcggaagttcgacaacctgacgaaggcggagcgcggcgggctgctgcccgaggacaaggccggcttcatccagcggcagctcgtcgagacccgccagatcaccaagcacgtggcccggctgctggacgagaagttcaacaacaagaaggacgagaacaaccgcgccgtgcggaccgtcaagatcatcacgctcaagagcaccctggtgtcccagttccgcaaggacttcgagctgtacaaggtgcgggagatcaacgacttccaccacgcccacgacgcgtacctcaacgccgtcatcgccagcgccctgctgaagaagtacccgaagctcgagcccgagttcgtgtacggcgactaccccaagtacaactccttccgcgagcgcaagagcgccaccgagaaggtgtacttctactccaacatcatgaacatcttcaagaagtccatcagcctggcggacgggcgggtcatcgagcggcccctgatcgaggtgaacgaggagaccggcgagagcgtgtggaacaaggagtccgacctcgccaccgtccgccgggtgctgagctacccccaggtgaacgtcgtgaagaaggtggaggagcagaaccacgggctggaccgcggcaagcccaaggggctgttcaacgccaacctgtccagcaagcccaagcccaactccaacgagaacctggtcggcgccaaggagtacctcgacccgaagaagtacggcgggtacgcgggcatcagcaactccttcgccgtgctggtgaaggggacgatcgagaagggcgccaagaagaagatcaccaacgtcctggagttccaggggatcagcatcctcgaccggatcaactaccgcaaggacaagctgaacttcctgctcgagaagggctacaaggacatcgagctgatcatcgagctgcccaagtactccctcttcgagctgagcgacggcagccggcgcatgctggcctccatcctcagcaccaacaacaagcgcggggagatccacaagggcaaccagatcttcctgtcccagaagttcgtgaagctgctctaccacgccaagcggatcagcaacaccatcaacgagaaccaccgcaagtacgtggagaaccacaagaaggagttcgaggagctgttctactacatcctggagttcaacgagaactacgtcggggcgaagaagaacggcaagctcctgaactccgccttccagagctggcagaaccactccatcgacgagctgtgcagctccttcatcgggcccacgggcagcgagcggaagggcctcttcgagctgacctcccgcgggagcgccgccgacttcgagttcctgggcgtgaagatccagcggtaccgcgactacaccccgtccagcctcctgaaggacgccaccctgatccaccagtccgtgacggggctctacgagacccggatcgacctggcgaagctgggcgaggggtga

SEQ ID NO: 2073 - RNA, 4167 nt, synthetic construct
  misc_feature 1..4167: note = Cas9 variant
  source 1..4167: mol_type = other RNA
atgaagcgcatcctgggcctcgacctggggaccaacagcatcggctgggccctggtgaacgaggccgagaacgagaaggagatctccaagatcatcaagctcggggtccgggtgaaccccctgaccatcgacgagaagacgaacttcgagaagggccgcccgctgagcaccaacgcggaccggaccctcaagcgcggggcccggcgcaacctgcagcggtacaagctgcgccgggagaacctcatcgagatcctgatcgacaaccacatcatcaccaaggagacgcccctgaccgagatcggcaagggcaccacctaccagacgctctccctgcgcgccaaggccgtgcgggagcgcatcgacctggaggacttcgccaaggtcctcctggcgatcaacaagaagcgggggtacaagagctcccgcaaggccagcaacgacgaggagggccaggccatcgacgggatggccatcgcgaaggagctgtacgagcggggcatcacccccgggcagtacgtgctcgagctgctggagaacgaccgcaagtacatccccgacttctaccggtccgacctcaagcaggagttcaacaagatctggaacaaccagaagaccttctacccggagatcctgaccgacgagctgttcaaggagctcgacggcaagaacaagagccagacgtgggccatctgccagaagcccttcaacatcaagggcatcaagcgcatcaccaaggggcgggagaagaccatcgagaactaccactggcgcgtgaagggcctgtccgggaagctgaacctcgagaagctggccatcatcctgcaggagatcaacaacgacatcaaccagagctccggctacctcggcgggatcagcgacaagtccaagaagctgtacctgaacaaggagaccgtcggcgagttcctctacaagcagatcgccaagaacccccacacgagcctgaagaaccaggtgttctaccggcacgactacctggacgagttcgagcagatctggaagacccagtccaacttcaacgccaacctcaccgacgagctgaagcaggagatccgcgacgtgatcatcttctaccagcgcaagatcaagagccagaagtccctgatcagcttctgccagttcgagtcctgggagcaggagtacttcgacaaggagaccgggaagacgaagacccggaccgtcggccgccgggtgatccccaagagcagccccctcttccaggagttcaagatctggcagaacctgaaccacctggtgttcaccaactccgagacggacgagaagatcgagatcaaggaggtcgagcaggagatccgcaaggagctgttcgaggagctgaacctgcgcggggacctcaaccccaacgacctgctgaagatcctccggagccagttcaagatcggcaagctgtccaactggaagtgcaacttcgagaagatcgagggcaaccggaccaacgcggccctgttcaacatctaccagaagatcagcgacttcgaggggtacggcatcgactggaacaagtccaacgccaagaagatccgcaaggagctgaaggccaccttccccgagatcgggatcgacgccagcatcctcgagttcgacgcgtacaagaagcagctgaccaaccagtccagctacgagctgtggcacctcctgtactccgccgaggaggacttcaagatcagcgagcaggacaagctgatctacggcaactccagcgtgtccctcaagaagaagctgcacctgaagttcgggttcaaccccgagtacgccaagatgctcgccaacctgagcctgatgtccgactacggcaacctcagcgccaaggcgatcaagaagatcctgccgtacctggaggacggccacctctactccgaggcctgccggctggccgggtacaaccacagcaagtccctgacggccgaggagctcgagaagttcgagcccaaggccaagctggacctgctcaagaagaacagcctgcgcaaccccgtggtcgagaagatcctgaaccagatggtgaacgtggtcaaccaggtgatcgacacctacggcaagcccgacggggtgcggatcgagctcgcgcgcgagctgaagaagtccgccaaggagcgggccgagatgaccaagggcatcgccgacgggacccgccggaacgaggagatcaagaagatcatcacgcagaagttcggcatcccgaaccccaccaagtccgacctggtccgctaccggctctggcaggagctggagagccgcggctacaaggacatcttcaccgacaagtacatctcccccgacaagatcttcagctccgagatcgacatcgagcacatcatccccaaggcgctcctcttcgacgacagcttctccaacaagaccctgagcttccggaacgtgaacctgaagaaggccaaccgcacggccctcgacttcatcacccaggactaccagtccaacgtggaggcctacaaggagcgcgtcgagacctggaacaaggacaaccacatcagcaaggggaagcggaacaagctgctgatgtccctcaaggacatcccggacggcttcatcgagcgcgacctgcggaacagccagtacatcgcccgcaaggcgaagcggatgctgtacgaggtgttccccaacgaggtcctcgccacctccgggagcatcaccgacaagctgcgctccgactgggacctgatcaacgtgatgaaggagctcaacctgcccaagtacaaggccctgggcctcacggagtacgaggagcggctggacaagggcaccgaggagctgttcaagcacgaggtgatcaaggactggaccaagcgcaacgaccaccggcaccacgccatggacgccctcgcggtcgccttcaccacgcacaaccacatccagtacatcaacaacctgaacgcccgcaaggacatcacccaggacaaccaccccatcatcaagaacatcgagaacctgatcaccgaggtgaacagcaaggggaagcgggtgttcaaggccccgatgtccagcttccgcgagagcgccaaggagcagatcgaggcgatcctcgtctccttcaagaacaagaacaaggtggtgaccaagaacatcaaccagacgaagaaggagggcgggttcaactaccagaacgccaagaccccgcggggccagctgcacaaggagaccatctacggcaagagcaagcagcccctggagaagcccgtcaagatcaacaaccgcttctgcaagaagcaggtcgggctcatcatcaacttcaaggagcaggaggccgtgctgcaccacctgaagaagtacgacaacaacgagaagatcgccttctccaacaagaccctcaagagcgacccgatccaggtgaacggcagccccctgcgggaggtgaagatcttcgaggagatcttcacgatccgcaaggacatcaaccccgacaacttcaagacccagaagcacctggacaagatcatcgacaaggggatcaaggaggtgatgaagaagcggctcgaggagtacaacggcgacttcaagaccgcgttcagcgacctggacaagaacccgatctggctgaaccagtccaaggggatcaccatcaagcgcgccacgatcagcggcgtcaccaacgccgagcccctccaccaggccaaggaccacctggggaacatcatcctggacgacaacggcaaggagatccccatcgactacgtgtccaccggcaacaaccaccacgtggccatctaccaggacgagagcgggaacctccaggaggaggtcgtgtccttctacgaggcggtgatccggaagaaccaggaccagcccatcatcaagaagcgccacccgaagggctggaagttcctgttcaccatgaagcagaacgagatgttcgtcttcagctccgagaacttcaaccccagcgagatcgacctgctcgacgagaagaacgccgccatcatctcccccaacctgttccgggtgcagaagatcgccacgaagaactacatgttccgccaccacctggagaccgaggtgaccaacaacctcgacttcacctaccgccacttccaggccacggagtggctgcggaacctgtgcaaggtccgcatcgaccacatcgggcggatcgtgcagatcggcgagtactga

SEQ ID NO: 2074 - RNA, 4170 nt, synthetic construct
  misc_feature 1..4170: note = Cas9 variant
  source 1..4170: mol_type = other RNA
atgatcatccgcacctacgagctgaagaccatcacgaccatcgccatcctcaagatgttccagctgctgaccggcgggctcagcatgaccaagctgggcaagccctacgggatcggcgtggacatcgggtccaacagcatcggcttcgccgcggtcgacgagaactcccacctgatccggctcaagggcaagacggtgatcggggcccgcctgttcgaggagggcaaggccgccgccgaccggcgcgcgagccggaccacccgccggcgcctgtcccggaaccgctggcggctcagcttcctgcgcgacttcttcgagtcccacatcaccccgacggggcccaacttcttcatgcggcagaagtacagcgagatctcccccaaggacaaggcccgctacaagtacgagaagcggctgttcaacgaccgcaccgacgccgagttctaccagcagtaccccaccatgtaccacctccggaaccgcctgctgaccgacccgagcaaggccgacgtgcgggagatctacttcgcgatccaccacatcctcaagtcccgcggccacttcctgacgagcgggtacgccaaggacttcaacaccaacaaggtcgccctgaacgagatcttccccgccctccaggacgcctacgcccaggtgtaccccgacctggacatcaccttcgacgagaacaaggtgaacgagttcaagaccgtcctgctcaacgagaaggcgacgccctccgacacccagcgggccctggtgaacctgctcctggccgaggacggcgacaaggacatcctgaagcagcagaagcaggtcctcaccgagttcgccaaggcggtggtgggcctgaagaccaagctgaacgtggccctcgggacggaggtcgacagctccgaggccaccgtgtggaacttcagcctgggccagctggacgacaagtgggccgggatcgagtccgccatgaccgacgagggcaccgagatcctcgaccagatccgcgacctgtaccgcgcgcggctgctcaacggcatcgtgccggccgggaagacgctgagccaggccaaggtcgacgactacgcccagcaccacgaggacctggagctgttcaaggactacctgaagcagctggaggacgacggcaccgccaaggcgatccgccagctctacgaccggtacatcgacggggacgacgccaagcccttcgtgcgcgaggacttcgtgaaggccctgaccaaggaggtcaccgcccaccccaacgcgaagtcccccgagctgctcgagcggctggcccagccggacttcatgctgaagcagcgcaacaaggccaacggcgccatccccgtgcagatgcagcagcgggagctcgaccagatcatcaagaaccagagcgtgtactacgactggctggccgcgcccaaccccgtcgagaagcaccgcaagagcatgccgtaccagctggacgagctgctcaacttccggatcccctactacgtggggcccctggtgacggccaaggagcagaaggccgcccagggcggcgtcttcgcctggatggtgcgcaaggaccccgacgggaacatcaccccgtacaacttcgacgagaaggtcgaccgggaggcgtccgccaacaccttcatccagcgcatgaagaccacggacacctacctgatcggcgaggacgtgctccccaagcagagcctgctgtaccagcggtacgaggtgctcaacgagctgaacaacgtccgcgtgaacaacgagaagctgtccatcgagcagaagcagcaggtcatccgggagctgttcgagcgccacaacagcgtgaccatcaagcagttcgccgagaacctccgggcccacggggactacgcccacatccccgagatccgcggcctggcggacgagaagcggttcctctccagcctgtccacctaccgccagctcaagagcctcctgcccgacgccatcgacgacccggccaagcaggccgacatcgagaacatcatcgcgtggtccacggtgttcgaggacgccgccatcttcaagaccaagctgaaggagatcaactggctcgacagccagaccatcaccaagctgtccaacatccgctaccgggggtggggccagttcagccacaagttcctgaacggcctcaccctggggaacggccacacgatcatccaggagctgttcctctccaacaacaacctgatgcagatcctgaccgacgagaccctccagaagaagatgaccgagctgaacgccgacaagctgaaggccgcgaacatcaacgacgccatcgacgacgcctacacgagcccctccaacaagaaggccctccgccaggtgctgcgggtcatcgaggacatcaagcgcgccgcggacgggcaggaccccagctggctgtacgtggagaccgccgacggcgggggcacccccggcaagcggacccgcgcccggcagcaccagctccaggagatctacgccaacgccgcgcacgagctgatcgactccgccgtgcgcggggagctggaggacaagatcgccgacaaggccgacttcaacgaccggctcgtcctgtacttcatgcagggcgggcgcgacatctacacgggcaccccgctgaacatcgaccagctcagctcctacgacatcgaccacatcctgccccagagcctgatcaaggacaacagcctcgacaaccgggtgctggtgcacgcgatcatcaaccgcgagaagaacgccaccttcgcctccaccatctacgcccagaagatgaacgccacgtggcggcagtggcacgaggcgggcctgatcagcgggcgcaagctccggaacctgcagatgcgccccgaccagatcgacaagtacgcctccggcttcgtcgcccggcagctggtggagacccgccagatcatcaagctcaccgagcagatcgtggccgcccagtacccggagaccaagatcatcgcggtcaaggccgggctgagccaccagctgcgggaggagctcgagttccccaagaaccgcgacgtgaaccactaccaccacgccttcgacgccttcctggccgcgcggatcggcacgtacctgctcaagcgcttccccaacctgcaggccttcttcacctacgggaagttcaagaaggccgacgtgaagaagctgcgcggcttcaacttcatccgggacatcacccacgccgaggacaagatcgtcgtgaaggacaccggcgaggtgatctgggacaagaagcgcgacgtcgacgagctcgaccggatctacaacttcaagcgcatgctgatcacgcacgaggtgcacttcgagaaggccgacctgttcaagcagaccgtgtacggggcgaaggactccaaggaggccggcgggaagaagcagctcatcagcaagaagaagggctaccccgtcgacatctacgggggctacacccaggagaccggctcctacctgagcgtggtgcggctgacgaagaaggccatgtacgccgtcgtgaaggtgtccacccgcgacgcggccaagctcgccgtcgccaagagcatctccgagcagaaggagaacgagaccctgaacgacatcatcgacgagaagctgagcaagatctccaagaacgggaagatcacccacgagctgttcgaggtggtgctcccgcgggtcggccagaagacgctgttcaagaacagcaagtacaacctcttcctggtgaactccgacacctacatgcacaactaccaggagctgtggatgccccgcgagtaccagaagatgtggaaggacatcagcctctccaagtacggggacgcccagaccgaggaccagctggaccagatcttcggcttcatcgtgagccaggtcaacagctacttcaacctgtacgacatcaaccagttccggaagaagctcaacgacgcggccgacaagttcgccaccctgcccatgcgcgacacggacgacatgcaggggaagatcgccaccatcggccagctgctcatcggcctgcaggccaacgcggcccggtccgacctgcgcaacctcgacatcaagacgcccctggggctgctccagatcccgaacggcatcagcctggactccgacaccagcgtggtgtaccagtcccccaccgggctgctcgagcgggaggtccacctgagcgacctgtga

SEQ ID NO: 2075 - RNA, 4170 nt, synthetic construct
  misc_feature 1..4170: note = Cas9 variant
  source 1..4170: mol_type = other RNA
atggcccgcgactacagcgtgggcctggacatcgggacctccagcgtcggctgggccgcgatcgacaacaagtaccacctcatccgggccaagtccaagaacctgatcggggtgcgcctgttcgacagcgccgtgaccgccgagaagcggcgcggctaccggacgacccgccggcgcctctcccggcgccactggcggctgcgcctgctcaacgacatcttcgccgggcccctgaccgacttcggcgacgagaacttcctggcgcggctcaagtacagctgggtccacccgcaggaccagtccaaccaggcccacttcgccgccggcctgctgttcgacagcaaggagcaggacaaggacttctaccgcaagtaccccaccatctaccacctccggctggcgctgatgaacgacgaccagaagcacgacctccgcgaggtgtacctggccatccaccacctggtgaagtaccgggggcacttcctcatcgagggcgacgtcaaggccgactccgccttcgacgtgcacacgttcgccgacgcgatccagcgctacgccgagagcaacaactccgacgagaacctgctggggaagatcgacgagaagaagctcagcgccgccctgaccgacaagcacggctccaagagccagcgggccgagaccgcggagaccgccttcgacatcctggacctccagtccaagaagcagatccaggccatcctcaagagcgtggtcgggaaccaggccaacctgatggccatcttcggcctggactccagcgcgatctccaaggacgagcagaagaactacaagttcagcttcgacgacgccgacatcgacgagaagatcgccgacagcgaggccctgctgtccgacacggagttcgagttcctctgcgacctgaaggccgcgttcgacggcctgaccctcaagatgctgctgggggacgacaagaccgtgagcgccgccatggtgcgccggttcaacgagcaccagaaggactgggagtacatcaagtcccacatccgcaacgccaagaacgcgggcaacgggctctacgagaagtccaagaagttcgacggcatcaacgccgcctacctggccctgcagagcgacaacgaggacgaccgcaagaaggccaagaagatcttccaggacgagatcagctccgcggacatccccgacgacgtcaaggccgacttcctcaagaagatcgacgacgaccagttcctgcccatccagcggaccaagaacaacggcacgatcccgcaccagctgcaccgcaacgagctcgagcagatcatcgagaagcaggggatctactaccccttcctgaaggacacctaccaggagaacagccacgagctgaacaagatcaccgccctcatcaacttccgggtgccctactacgtgggccccctggtcgaggaggagcagaagatcgccgacgacgggaagaacatcccggaccccaccaaccactggatggtgcgcaagtccaacgacacgatcaccccctggaacctgagccaggtggtcgacctcgacaagtccggccggcgcttcatcgagcggctgaccgggaccgacacgtacctgatcggcgagcccaccctgccgaagaacagcctcctgtaccagaagttcgacgtgctgcaggagctcaacaacatccgcgtgtccggccggcgcctggacatccgggccaagcaggacgcgttcgagcacctgttcaaggtccagaagaccgtgagcgccaccaacctcaaggacttcctggtgcaggccgggtacatctccgaggacacgcagatcgagggcctggccgacgtcaacgggaagaacttcaacaacgccctcaccacctacaactacctggtgagcgtcctgggccgcgagttcgtggagaacccctccaacgaggagctcctggaggagatcaccgagctgcagacggtgttcgaggacaagaaggtcctccggcgccagctggaccagctggacgggctcagcgaccacaaccgggagaagctgtcccgcaagcactacaccggctggggccggatcagcaagaagctgctcaccaccaagatcgtgcagaacgcggacaagatcgacaaccagacgttcgacgtgccccgcatgaaccagagcatcatcgacaccctgtacaacaccaagatgaacctgatggagatcatcaacaacgccgaggacgacttcggggtccgggcctggatcgacaagcagaacaccacggacggcgacgagcaggacgtgtactccctcatcgacgagctggccgggcccaaggagatcaagcgcggcatcgtgcagagcttccgcatcctggacgacatcaccaaggcggtcgggtacgccccgaagcgggtgtacctcgagttcgcccgcaagacccaggagtcccacctgaccaacagccggaagaaccagctgtccaccctcctgaagaacgccggcctgagcgagctcgtgacgcaggtctcccagtacgacgccgcggccctgcagaacgaccgcctgtacctctacttcctgcagcagggcaaggacatgtacagcggggagaagctgaacctcgacaacctgtccaactacgacatcgaccacatcatcccccaggcctacaccaaggacaacagcctggacaaccgggtgctcgtgtccaacatcaccaaccgccgcaagagcgactccagcaactacctgcccgccctgatcgacaagatgcggcccttctggtccgtcctcagcaagcagggcctgctgtccaagcacaagttcgccaacctcacccggacgcgcgacttcgacgacatggagaaggagcggttcatcgcgcgcagcctggtggagacccggcagatcatcaagaacgtggccagcctgatcgactcccacttcgggggcgagaccaaggccgtcgccatccgcagctccctcaccgccgacatgcggcgctacgtggacatcccgaagaaccgggacatcaacgactaccaccacgcgttcgacgccctgctgttcagcacggtgggccagtacaccgagaactccgggctcatgaagaagggccagctgagcgactccgccgggaaccagtacaaccgctacatcaaggagtggatccacgccgcgcggctgaacgcccagagccagcgcgtcaaccccttcggcttcgtggtggggtccatgcggaacgccgcccccggcaagctcaaccccgagaccggcgagatcaccccggaggagaacgccgactggagcatcgcggacctggactacctgcacaaggtcatgaacttccgcaagatcacggtgacccgccggctcaaggaccagaaggggcagctgtacgacgagtcccgctaccccagcgtgctgcacgacgccaagtccaaggccagcatcaacttcgacaagcacaagcccgtcgacctctacggcgggttctccagcgccaagcccgcctacgcggccctgatcaagttcaagaacaagttccggctggtgaacgtgctccgccagtggacctactccgacaagaacagcgaggactacatcctggagcagatccggggcaagtacccgaaggccgagatggtcctgtcccacatcccctacgggcagctcgtgaagaaggacggcgccctggtgaccatcagcagcgccacggagctgcacaacttcgagcagctctggctgcccctggcggactacaagctcatcaacaccctgctgaagaccaaggaggacaacctcgtcgacatcctgcacaaccgcctggacctcccggagatgaccatcgagtccgccttctacaaggccttcgacagcatcctgtccttcgccttcaaccggtacgccctgcaccagaacgcgctcgtgaagctgcaggcccaccgcgacgacttcaacgccctgaactacgaggacaagcagcagacgctcgagcggatcctggacgccctgcacgcgagccccgcctccagcgacctcaagaagatcaacctgtccagcggcttcgggcgcctgttctcccccagccacttcaccctcgccgacaccgacgagttcatcttccagtccgtgaccggcctgttcagcacgcagaagaccgtcgcccagctgtaccaggagaccaagtga

SEQ ID NO: 2076 - RNA, 4170 nt, synthetic construct
  misc_feature 1..4170: note = Cas9 variant
  source 1..4170: mol_type = other RNA
atgaagaactacaacatcagcctggtgccctccccgagcggcgtcgggtacgccgtgaccgacgacaacctcaacatcatcaagcccgtgcaccacgtctccggcatcgggagccgcctgttcaacgagggctccagcaagcaggaccggcgcaactcccggagcgcccgccggtcccgccaccggcagcaggggcgcatcaaggcgctgaacagcatcatgaaggacgagatcatcaaggtggaccccaccttcttcgaccggctctaccagtccgagctgagccccctggacaagaacaagaagtaccgcaacatcatcttcgacaagccgtccgtggagagctactactacaagaagttccccacgatctaccacctcgagaagtacctgatcaacaccgacggcaaggccgacatccggctgatctactgggccctccactccctgctgacccaccgcggccacttctacaacaccacgcccgtcagccagttcaagcccggggccctcaacatcaaggacaagttcatcgagctgaaccagctgaaccaggtgaagaccttcgagttctccgtggccaacaccccggagatcgagcacatcctcaaggaccggtacatcagcaagcagaacaagatcaaccagctggcggagctcctcttcgagcaggagcccgagaaggacatccagaaggccaacaccaaggtcgccaagacgatcgccaaggcgatcctgggcaacaagttccagctggacgagatcatcgggctcgacgtgaacaagtccgagaagaaggagtggagcctgcagctgagcgacctcaacctggactccaagatcgacgagctgagcgactccctcaccgaccagcagctgcgcatcctggagatcctccaggagatgtacgccgccaccaccctgctggacatcctccagggcagcgactccctgctggacgccaagatcaagagctacaacgagtacaagcagaaccggctcctgttcttcgacctgctcaagacgctgcccgacaagaaggcccacctcctgcgccaggggtacaccctgtacctgaacaaccaccaccgggacctcgcgtccgcccgcaaggacctgggcatcgtggccgccaccaacttcagcaagaccgacctgtacgccctcatcaagaagacgctgaaggacgagcccgagaccccggagtccaagaaggtcctgggcctgatcgacaagggggagttcctcaacaagcagcggaccgacctgaacacctacatcccctaccagctgaacgcgctcatcctgaacaagatcctgaagaaccagggcaagcactaccccttcctcatcaaggagaaccccgccgagccggaccgcaaggaggccccctacgagatcagccagctgatgcagttcacgatcccctactactgcgggcccctggccaccccggaggagcagaagaacctccccgagtccagccggttcggctggctggtgcgcaaggaggagggccgcatcaccccctggaacttctacaacaagatcaacgtgatcgagaccgccaacgcgttcatcaagcggtccatcgggaaggacacgtacctgctcagcgagcccgtcctgccggacaactccctgctctaccagaagtacaaggtgctgaacgagctgagctccatcagcctcgtggacgccaacaccaagaaggagaagaagctgaccgccaagatcaagcagctgctctacaaggagggcttcaagaagcacgtcaccgtgtccaagacgatggccctgaagatcctgaacgacaacaacgtgcccaccagcgacatcctcgggctgagcaccggcaagaagttcgacaactccctgagcacctacaactcctggaagaaggccttccccgagcagatcgacaacccccactaccgccaggacctcgagtacatgatcgagtggagcacggtcttcaccgaccggaagatcctggtggagaagctgaaggagatcgagtggctccgcccggagcagatcaagttcgtgctggagcaccggctgaccgggtggggcaagctctccaagcgcctgctggtcgagctcaaggacaacaagggcaagagcaacatcgacaacctgttcaacaccaagaagaacttcatgcagatcgtgtcccagcaggtctacaacacgcagatcgaggcgatcgccctgaagaccaccaagaaccagagcctcgacaacatcctggaggccgcctacacctcccccgcgaaccggaaggccatccgccagaccatgaaggtggtgaacgagatcgtcacgctggccgggaagggcacccaccccgacaagatcttcctcaccttccagcggagcaaggagcaggaggggaagctgaccacggaccgcgcctccagcctgctcaagatctaccggggcatcaaggacccgctgtgcaccaaggagctggtggacgagctctccaagaacgtgcgcgccaacctgatcaagaccaaggagtacctgtactaccagcagctcgggcgggacgcgctgaccggcgagatcatcgacaagacggacctgcgcaactacgccgtcctccacatcatcccccggagcgtggtggtcgacgactccatcaacaacctggtgctgaccaaggtgaagaacgccaaggagagcatcgtcgtgcagtacggctccaagaacatcagcgacatcagcatgtccgtgaaggacttctggaaccgcctccagaagctggggctgttcagcaagggcaagctccggaacctgaccaccgacctgacggagctcaaccagtacgagaagcaggggttcatcgcccgccagctggtcgagaccaaccagatcgtgaagctgctcgccaccatcctgcagggccagttcccccacaccaagatcatcgaggtgcggcaggagcagatcgcgaacatccgctaccagctggacatctaccgcctccgggacctgaacgtctactaccgcgggatggacgcctacctggccgccgtggtgggcacgtacctctacaccgtctaccccaaggcccggcgcttcttcgtgtacggcaagtacctgaagcaggacaagaacaaccgggaggaggggcagttcaagacctccggccacagcttcaacttcctgtggaagctgttctacgggggcgaggacgagatctacgtgcagggcaccaacaacatcgcgttcaacaagaaggacctgctgcagaagatcaaggaggtcaacaactacaagttccagaacgtgtccctcgccacggggacccgccggagcgacctgttcaagcagaccatctacccgcgccaggagcgggacgtgaagaagtcccgcaccctgatcacgaagaagaacggcctcttcaccgacatctacgggggctacaccgggaacgtcaacagctacttcgtgctggtgcagaccaagtacaagaaggaccccgacaagttcaacctgtacggcgtccccaaccggtacgtggccatgctcgagcagtccaagagcaagggcaactacgagacgaagctgaaggaggtgatggagcccatcatcaagaactccaacaagcgcatgatcgggtacaagatcctgaaggaccggatcctctacaaccagatcatcgaggacaacggctacaagttcttcatcaccagctcccagtaccgccacaacttccggcagatgatcctgagcgaccagtccaagaagatcctgatggactacgtcttcgacccgaacttctaccgccacaagaagaccgaggacgtgaacaacgacaaggacgccaagctcatcaaggtgtacgacgagatcctgtaccagatcgaccactacctgcagatcttcaccatcgggcaccacatcgacaagctcaagaaggcgcggcccctgttcgagaagtgcacgctggccgagaaggcccaggtcctgaacgacatcctcatcatcgccggcagcaaccagaccgagctggccctgaagcccctcaagaccaccaagctgacgttctccaagcagaactgccccctgaccaaggacgcgatcttctactaccagagcccgaccgggatgatcacccgcaaggagtccatcaaggacatcctcaagcagaacatctga

SEQ ID NO: 2077 - RNA, 4173 nt, synthetic construct
  misc_feature 1..4173: note = Cas9 variant
  source 1..4173: mol_type = other RNA
atgagccgcaagaacatcgtggaggactacgccatctccctggacatcggcaacgccagcgtcgggtgggtggcgttcacccccaactaccggctcgtgcgcgccaagggccacgagctgatcggggcccggctgttcgagccggcctccaccgccgaggagcgccggatggcgcgcacgacccggcgccggtacagccgccggcgctggcggctccgcatgctggactccatgttcgaccaggccctgagcgaggtcgacccctccttcctcatgcggcgcaagtacagctgggtgcaccccgaggacaagaacaacgaggcccactggttcggcggggtgctgttcgactccaacgagcaggacaagcggttctacgagaagtaccccaccatctaccacctccgcaagagcctgatggaggacgacgagcggcacgacatccgcgaggtctacctggccatccaccacatgatgaagtaccggggcaacttcctgaccgagggcgagctcgcgccgtccagcgtgttcgacgtggaggacttcctgaagctgctcacggagatcctgcagtacgccgacgagggggagaccgacgaggacctggagctccaggccgacgccaacggcctgaccgaggccctgtgcaccacgaaggggtcccgcagcatccgcgcgaagaacgccatctccatcctcaaggagggcgccgccctgagcaagcggcaggaggccatcatctccgcggtcttcgccgggctggagggcaacaagctcgacctgaccaaggtgttccccaacaaggagtacacccccgaggacaagaagaccctggccctctacttcaacaaggccgactacgacgagaagcgcgtggccatcggcgacagcgggctgctggaggacaacgagtgcgacttcctcgactgcatccggcgccagtactccgcgatcgccctgaagcagctgctcggcgacttcacgagcatcagcgagtccatgtgcgcccggtacgagcagcaccagcgcaactgggacctgatcaagcggtactgccgcgaggagagcaacgccgagaacatcaacaagaactacggggccctggtcggctgggagatcgtgggcgggcagcggcgctccatccggggcgcgaaggactacgagaacaagcgcaaggccgccaacaagttcttcgaggagctcatcaaggggagcgccctgcccgaccaggagaaggagcggctgctccacgacatcgagaacgacgagctgttcccggtgcagcgcgactccggcaacggggtcatcccctaccagctgcacctcaacgagctgaagaagatcatccagaagcagggccggtactaccccttcctgctcgagacctacatcaaggacggcaaggaggtgaacaagctggaggggctgctcgcgttccgcgtgccctactacgtcggcccgctggtgagccgggacgacatgcagtccagcgacaaccgcgagaaccactggatgatccggcgcaagaagggggtgatcaccccctggaacttcgacgagatggtcgacaaggacaagtccggccacgagttcatcaagagcctggtggggaccgactcctacctgctcggcgagacgaccctgcccaagaacagcctgctctaccaggagttcgaggtgctgaacgagctgaacaacgtccgcctctccatccggaccggcaaccactgggccgacaagcgccgggtgcgcctggggcacaacgagaagaagctgctcctggaggagctgttcgccaagcaggccaccgtcacgaagaaggccgcggagaacctcctgcggcgcacctacggcaacacctacgagatcagcgggctggccgacgagaagaagttcgtgtccagcctctccagctacggcaagatgtgccggaccctgaaggcctcctacgtgaacagccacaaggacgtcgtggagaagatcatcgagctgcagacggtgttcgaggacaagaagaccctcaagcaccagctgcagctgctcggggagctggccgagaccaactgcgagctgctcagcaacacccactacacgggctggggcaagctgtcccgcaagctgctcaccagcaaggtcgtggtgtgcaagatcgggaacgacttcgcccccgcgaagcactccatcatcgagatcatgcgggagaccgaccgcaacttcatggagatcatcaccgacaaggacctgggcgtcggggagtggatcaaccagcagaacgtgggcgccgaggacggcaacagctaccaggacatcatcgacgacctgcgggtgtccccgaaggtcaagcgcgggatcaaccaggccatccgggtgatcgacgacatcagcaaggccgtgggcaaggagccctcccgcatcttcctcgagctggccggggacgtccagcagagcgcgcggacggtgtcccgcaagagccggctgcagggcctctacaagtccgccgggctgcagaaggagttccgcgacctggccgagagcctcaacgagtgctccgacaacgacctgcgggacgaccgcctgttcctctactacacccagctgggcaaggacatgtacaccggcgagcccctgaacctcgaccggctgagctccgactacgacatcgaccacatcatcccccaggccgtgacccagaacgacagcctggacaaccgcgtcctcgtggcgcgcgtggccaacgcccggaagacggactccttccagtacctgccggagatcgccaaccgcatgcggaacttctggcaggagctgctcgacgccgggctgatcagccgcgtcaagttcgaccggctgaaccgccagaacgacttcagctcccacgagaaggagcggttcgtgcagcgcagcctcgtggagacccggcagatcatgaagaacgtcgcgaccatcatgcgcaagcggtacggcaactccgccgccgtgatcgggctgaacagcgagctgaccaaggagatgcgccagtacctcggcttctcccacaagaaccgggacatcaacgactaccaccacgcccaggacgccctgtgcctggggatcgcgggccagttcgccgtgaaccgcggcttcttcgccaacgggatggtcagcgacggcgccgtgaactcctacaacctctacctgcaggactacctgcgggggtaccgcgagaagatgagcgccggcgagcggcgccggaacaaggcgttcgggttcatcgtgggctccatgaacagccaggactccgacaagcgcatcaaccccaagaccggcgagatcgcctgggacgacgaggacaaggtctacctccgcaaggtgatgaactaccggaagatgctgatcacgcagaaggtgggggacagcttcggcgccctgtacaacgagacccgctacgggacctccgccaaggagggcgtcaacgggatccccttcgacaagcacaagcaggacaccgcgctctacggcggcttcagctccgccaagacggtgtacgtggtcctgatcgaggccaagaagaagacccggctggtgaacatcaccatgcaggagtacgccgagctcggggaccaccccagcgacgacgccctgcgcgcggtgctggccaagaagaagccggagtacggcaaggcccggatcctcctgcgccacatcccgcccatgcagctgatccggtacgggggcgccctcgtcaccgtgaagtccgccacggagctgaacaacgcgcagcagctgtggctcccctacaaggagtactgcctgttcgacgacgtgatcagctccgccatcgacgtcgacgaggcccgcctgtgccagatgctcgacgtgatcctggacgccatccagaagtactaccccaagcagcggttcgacgagaccggcctgagcgccttccacaacgcgttcaacgaggtgagcgccgaggacaagaagcgcatcgtcggggagatggtgggcatgctccacgccgacgccaagaacgccaacctgaaggcgctggggatgtccggccggtgggggcgcatgagcaaccagtccggctacaccttcgccgacagcgacgagttcatcttccagtcccccagcggcctcttcgagaagcggatctccgtgggggagctgaagaagcgccgggcccgctga

SEQ ID NO: 2078 - RNA, 4173 nt, synthetic construct
  misc_feature 1..4173: note = Cas9 variant
  source 1..4173: mol_type = other RNA
atgaaggaggtgaaggactacatcatcggcctggacatcgggaccaacagctgcggctacgtcgtgaccgacaagcagaacaacatcctcaagctgaaggggaagacggccatcggcgcccgcctgttcaaggagggggaggcggccgccgaccggcgcgccttccggaccacccgccggcgcctcgcccggcgccggtggcgcctgggcctgctcgaggagatcttcgacgaggagatggcgaaggtggactccagcttcttccggcgcctgaaggagtccgactacagccccaaggactcccggaagcagttcaacagcatcgtcttcgagtccagcgaggccgacaaggacttctacgacaagtacccgaccatctaccacctccgcaacgccctcatgcacgacgaccagaagcacgacctgcgggagatcttcctggccgtgcaccacatcgtgaagtaccgcggcaacttcctccgggaggactccgtcaaggcgttcaaggccgccaagttcacgctgcagggggaggacggcatcgggcccgtggacaagctgaacgacctcctgaaggagatctacatcgaggccgcccccgagctggcgaccgacaacctcagcaagatcgaggagatcatcaaggacaagaagctgtacaagcaggacaagctgaagcaggtcgccaccctcctgaccaaggaggccgacacgaaggacaaggccaagctgaacaaggacgtggccaagcaggtcgcgaacgccttcatgggctacatgatcatcttcgacaccatcttcaacctctccgacgtggacagcaaggactacaaggtgaagttctccgacgccaacatcgacgagaagctggacaccctgaccagcctcctgacggacaagcagaccgagttcgtgctggagctccagaacatctacaacaccatcgtgctgaacgagatcgtccccgacgggaagtccctgagcgagtccatggtgaagaagtacgacgaccacaaggaggacctcaagctgttcaaggcctacctgaacagcctcaccgacgtgaagaaggtcaaggagctgaaggccgcgtacgtgctgtacgtgaacaaccgcaaggccaacctcctggccgccaagaagctgctcggcaagaaggccgacaacatgaacaacttcgagatcttctccaagttcgtcgcggacaacctggacgacagcgagctggccaacaagatccgggcccgcctcgacctgggcgagttcctgccgaagcagcggacgaaccagaacggggtgatcccctaccagctccaccaggtggagctgacccagatcctggagaagcagggcaagtactaccccttcctgatcgcccccaacccggtcgagagccaccgcaacaacgcgccctaccgcatctccgagctcgtgagcttccgggtcccctactacgtggggcccctgatcgacccgaacaacgccgagtccgagcaggacaaggccaacagctccttcgcctggatggtgcgccagaagcagggccagatcaccccctggaacttcgaggagatggtcgacaccacggagagcgccaacaagttcatcaagcggatgaccaccaaggacacctacctgctcggcgaggacgtgctgcccgcgtccagcctgatctaccagaagttcgtgatcctcaacgagctgaacaacatcaaggtcaacgggatcaagctgacgtccgaggagaagcaccagatcttcgacgagctgttcaaggtgcagaagtccgtgagcctgaagaacctggtcaacttcctcaccgcccacggctgcgtggcccccaacgtgaccgggctgagcgacggcaccaagttcaactccagctactccacgtacatcgactaccgcaagatcttcggggccgagatcgacaacaaggacaagcaggccgacttcgagaagatgatcgagtggagcaccgtcttcgaggaccggaagatcttcaagcgcaagctggaggagatcacctggctcaccccggaccagatcaagcaggtctccagcaagcggtactccggctggggccgcctgagcaagaagctgctcacgcagatcaccgacgagaacggggtgaacatcctgcagcggctgtggaacgagagcgagaacctcatgcagatcctgtccgaccccgtgatcaaggagaagatcgtggcggccaacagctccttcaccaaggccaccgacatggaggacatcctggccgaggcctacacgagcccccagaacaagaaggcgatccgccaggtgatgcgggtcgtggacgacatcatcgccgccgcccacggcaagaagccctcccagatcgcgatcgagttcgcccgcgaggaccaggacaacccgcagatgaccaagagccggaaggcccagctcgaccagatctacgccaagatctccgacgagttcctggacaacgccgtgaagaacgagctgaagaacatgaaggacaacaagcccctcgcgaaggacaaggtcttcctgtacttcaagcagatggggcgcgacgcctacaccggcgagaagctgagcctcgacaacctgcaggactacgacatcgaccacatctacccccagtccttcatcaaggacgacagcttcgacaaccgggtgctggtgcagcgcgccgtcaacaacgggaagtccgacaacgtgcccgtgctcctgttcggcaacaagcaggccgccgacctgggcatgaccatccggcagatgtggaagaagtggctcgagctggggctgatcagcaagcgcaagttcaacaacctcatcaccgacccggagaagatctccagctacatggcgtccggcttcgtcaaccggcagctggtggagacgagccaggtgatcaagctggtcgccaacatcctccaggccaagctgcccgacaccgagatcatcgaggtgaaggcctcctacaacagcatcctgcgcaaggagttcaacctctacaagagccgcgaggtgaacgactaccaccacgccatcgacgcgtacctgaccaccatcgtcgggaactacctgtaccaggtgtaccccaagctccggccctacttcgtgtacggccagttcaagaagttcgggaaggccgagtccaaggaggacgacccggtcaagaagatcaagcagttcaacttcatctaccagctgctgtggggcaaggacgacgccatctgcatcagccacacggaccagcaggtcttctcccgcagcgacatcatcaacaagctcaccaccgcctacaacttcaagtacatgaacgtgtcccaggaggtgtacaccaacagcaacaacgtgttcaagcagacggtgttccccatcatcgagcgggacaccgcgaagtcccgcagcctgatccccaagaagctggaccggccgaccgacatctacggcgggtactccaacaacaacgacgcctacctcgccctggtcaaggtggacaagaagaagggcagcgagtaccgcgtggtcgggatccccatgcgggccgccgcgatgctgaaggcctccaagaactacgacgaggacctccgcaaggtgatcgagcccatggtgatgctggacaagaacggcaaggccaagcggggcatcgaggggttccgcgtcctggtgggcaagatgcccttcaagcaggccgtgctcgacggggacaagaagttcatgctgaccggcacgaacgacatgccgaacctgaagcagctcgtcctgagccagcagaacatgaagtacatcctggactacatcgacgacatcgactgccggaagcacaagttcgggaacaagacccaggacggcaacaagtgcctcctggaggtgttcgacgagatcatccagatcgtcgacaagcacttcgagctgttcgacaaccgctccttccgggagaagctccgcaacagccgggtgaacttcatcaacctggccctgtccaagaaggcggaggccctcctggccatcctgaacggcctccacgccaacagcatgcgcaccaccatcaaggagctgaagatctccgacctggggcggatccagagctccgtgatcagccccgaggcccagctcatctaccagagccccacgggcctgttcgagcgccgggtcaaggtgaaggacctgtga

SEQ ID NO: 2079 - RNA, 4176 nt, synthetic construct
  misc_feature 1..4176: note = Cas9 variant
  source 1..4176: mol_type = other RNA
atggagaacaagcagtactacatcggcctggacgtggggaccaacagcgtcggctgggccgtgaccgacacgtcctacaacctcctgcgcgccaaggggaaggacatgtggggcgcgcggctgttcgagaaggccaacaccgccgccgagcgccggaccaagcgcaccagccggcgccggtccgagcgcgagaaggcccggaaggcgatgctcaaggagctgttcgccgacgagatcaaccgcgtggaccccagcttcttcatccggctggaggagtccaagttcttcctcgacgaccgcagcgagaacaaccggcagcgctacacgctgttcaacgacgccaccttcaccgacaaggactactacgagaagtacaagaccatcttccacctccggtccgccctgatcaacagcgacgagaagttcgacgtccgcctggtgttcctggcgatcctcaacctgttctcccaccgggggcacttcctgaacgccagcctcaagggcgacggcgacatccaggggatggacgtgttctacaacgacctggtcgagtcctgcgagtacttcgagatcgagctgccgcgcatcacgaacatcgacaacttcgagaagatcctcagccagaagggcaagtcccggaccaagatcctggaggagctgagcgaggagctctccatcagcaagaaggacaagtccaagtacaacctgatcaagctgatcagcgggctcgaggcctccgtggtggagctgtacaacatcgaggacatccaggacgagaacaagaagatcaagatcggcttccgcgagagcgactacgaggagagctccctgaaggtcaaggagatcatcggggacgagtacttcgacctcgtggagcgggccaagagcgtgcacgacatgggcctgctgtccaacatcatcggcaacagcaagtacctctgcgaggcccgcgtcgaggcgtacgagaaccaccacaaggacctgctgaagatcaaggagctcctgaagaagtacgacaagaaggcctacaacgacatgttccgcaagatgaccgacaagaactactccgcctacgtggggagcgtgaactccaacatcgccaaggagcggcgcagcgtcgacaagcggaagatcgaggacctgtacaagtacatcgaggacaccgccctcaagaacatccccgacgacaacaaggacaagatcgagatcctggagaagatcaagctgggcgagttcctcaagaagcagctgacggcgtccaacggggtgatccccaaccagctgcagagccgcgagctccgggccatcctgaagaaggccgagaactacctgcccttcctcaaggagaagggcgagaagaacctgaccgtgtccgagatgatcatccagctgttcgagttccagatcccgtactacgtcggccccctcgacaagaaccccaagaaggacaacaaggccaacagctgggccaagatcaagcagggcgggcgcatcctgccctggaacttcgaggacaaggtggacgtgaaggggtcccggaaggagttcatcgagaagatggtccgcaagtgcacctacatcagcgacgagcacaccctgccgaagcagtccctgctctacgagaagttcatggtgctgaacgagatcaacaacatcaagatcgacggcgagaagatcagcgtggaggcgaagcagaagatctacaacgacctgttcgtcaaggggaagaaggtgtcccagaaggacatcaagaaggagctcatcagcctgaacatcatggacaaggactccgtcctgagcggcacggacaccgtgtgcaacgcctacctcagctccatcggcaagttcaccggggtgttcaaggaggagatcaacaagcagagcatcgtcgacatgatcgaggacatcatcttcctgaagaccgtgtacggcgacgagaagcggttcgtgaaggaggagatcgtcgagaagtacggggacgagatcgacaaggacaagatcaagcgcatcctgggcttcaagttctccaactgggggaacctcagcaagtccttcctggagctggagggcgccgacgtgggcacgggggaggtgcggagcatcatccagtccctctgggagaccaacttcaacctgatggagctgctcagctcccgcttcacctacatggacgagctggagaagcgggtcaagaagctggagaagcccctcagcgagtggaccatcgaggacctggacgacatgtacctgtccagccccgtgaagcgcatgatctggcagtccatgaagatcgtggacgagatccagacggtcatcggctacgcccccaagcggatcttcgtggagatgacccgcagcgagggggagaaggtgcggaccaagtcccgcaaggaccggctcaaggagctgtacaacggcatcaaggaggacagcaagcagtgggtcaaggagctggactccaaggacgagagctacttccgcagcaagaagatgtacctctactacctgcagaaggggcgctgcatgtactccggcgaggtgatcgagctggacaagctcatggacgacaacctgtacgacatcgaccacatctacccgcggagcttcgtgaaggacgactccctggacaacctcgtcctggtgaagaaggagatcaacaaccgcaagcagaacgaccccatcacgccccagatccaggccagctgccagggcttctggaagatcctgcacgaccaggggttcatgtccaacgagaagtacagccggctcacccgcaagacccaggagttctccgacgaggagaagctgagcttcatcaaccggcagatcgtggagaccggccaggcgaccaagtgcatggcccagatcctgcagaagtccatgggggaggacgtcgacgtggtgttcagcaaggcccgcctcgtctccgagttccggcacaagttcgagctgttcaagagccgcctgatcaacgacttccaccacgccaacgacgcgtacctcaacatcgtggtgggcaactcctacttcgtcaagttcacgcggaaccccgccaacttcatcaaggacgcccgcaagaacccggacaaccccgtgtacaagtaccacatggaccggttcttcgagcgcgacgtcaagagcaagtccgaggtggcctggatcggccagagcgaggggaactccggcaccatcgtgatcgtgaagaagaccatggccaagaacagccccctgatcaccaagaaggtcgaggaggggcacggctccatcacgaaggagaccatcgtgggggtgaaggagatcaagttcggccggaacaaggtcgagaaggcggacaagacccccaagaagccgaacctgcaggcctaccgccccatcaagaccagcgacgagcggctctgcaacatcctgcgctacggcgggcggaccagcatctccatcagcggctactgcctggtggagtacgtgaagaagcgcaagacgatccggtccctcgaggccatccccgtctacctggggcgcaaggacagcctgtccgaggagaagctcctgaactacttccggtacaacctgaacgacggcgggaaggacagcgtgtccgacatccgcctctgcctgcccttcatcagcaccaactccctggtgaagatcgacggctacctctactacctgggcgggaagaacgacgaccgcatccagctgtacaacgcctaccagctcaagatgaagaaggaggaggtcgagtacatccggaagatcgagaaggccgtgagcatgtccaagttcgacgagatcgaccgcgagaagaacccggtgctgaccgaggagaagaacatcgagctgtacaacaagatccaggacaagttcgagaacaccgtcttcagcaagcggatgtccctcgtgaagtacaacaagaaggacctgagcttcggcgacttcctgaagaacaagaagtccaagttcgaggagatcgacctcgagaagcagtgcaaggtgctgtacaacatcatcttcaacctgagcaacctcaaggaggtcgacctgtccgacatcgggggcagcaagtccacggggaagtgccgctgcaagaagaacatcaccaactacaaggagttcaagctgatccagcagagcatcaccggcctctacagctgcgagaaggacctgatgaccatctga

SEQ ID NO: 2080 - RNA, 4176 nt, synthetic construct
  misc_feature 1..4176: note = Cas9 variant
  source 1..4176: mol_type = other RNA
atgaaggagatcaaggactacatcatcggcctggacatcgggaccaacagctgcggctacgtggtcaccgacaagcagaacaacatcctcaagctgaaggggaagacggccatcggcgcccgcctgttcaaggagggggaggcggccgccgaccggcgcgccttccggaccacccgccggcgcctcgcccggcgccggtggcgcctgtccctgctcgaggagatcttcgacgaggagatgaacaaggtggaccccagcttcttccggcgcctgaaggagtccgactacagcccgaaggaccggcgcaagcagttcaactccatcgtgttcgagagctccgaggcggacaaggccttctacgagaagtaccccaccatctaccacctccggaacgccctgatgcacgacaaccagaagcacgacctgcgcgagatcttcctggccgtccaccacatcgtgaagtaccggggcaacttcctccgcgaggacagcgtgaaggcgttcaaggccgccaagttcacgctgcagggcgaggacgggatcggccccgtcgacaagctgaacgacctcctgaaggagatctacatcgaggccgcccccgagctggcgaccgacaacctctccaagatcgaggacatcatcaaggacaagaagctgtacaagcaggacaagctgaagcagatcgccaacctcctgccgaaggccgtggacagcaaggacaaggccaagctgaacaaggacatcgccaagcaggtcgcgaacgccctcatggggtacatgttccggctggacaccctgttctccttcaccgacgtggacgtgaaggactacaagctcaagttcagcgacgccaacatcgacgagtccctggacgccctgacgagcctcctgaccgacgcccagatcgagttcgtgctggagctccagtccatctacaacaccatcgtcctgaacgagatcgtgcccgacggcatgagcctgtccgagagcatggtgaagaagtacgacgaccacaagaaggacctcaagctgtacaaggagtacatcgactccctgagcgaccagaagaaggcgaagcagctcgaggccgcctacgccctgtacgtcaactaccgcaaggccgacctgctcgcggccaagaagctgttcgagaagaagaagatcggggacaagaagttcgtggacgtgatcagcaacttcgaggtcttcggcaagttcgtgtccgacaacctggacgacagcgagctcgccaacaagatcaaggcccggctggacctgggcgagttcctccccaagcagcgcaccaaccagaacggggtgatcccctaccagctgcaccaggtcgagctgacgcagatcctggagaagcagggcaagtactacccgttcctcatcacccccaaccccgtggagtcccaccgcaacaacgcgccctacgagatcagcgagctggtgtccttccgggtcccgtactacgtggggcccctgatcgacaaccagagcatcaaggacaagcagaacaagaacaagttcgcctggatggtccgccagaagcagggccagatcaccccctggaacttcgaggagatggtggacaccacggagtccgccaaccagttcatcaagcggatgacccgcaaggacacctacctcctggccgaggacgtgctgcccaagagctccctcatctaccagaagttcatgatcctggacgagctgaaccggatcaagatcgacggcaagaagctcaccagcaagctgaagcacgacatcttcgagaagctgttcaagaagcagaagtccatcaacctcgacaacctgaagaactacctgctcgccgaggggaacatcccgggcctgatcgaggggctgagcgacggcatcaacttcaacaactccttcagcacgtacatcgactaccgcaacatcttcggggacgagatcgacaaccccaacaagcaggcggacttcgagaagatgatcgagtggtccaccgtcttcgaggaccggaagatcttcaagcgcaagctcaaggagatcacctggctgacccccgagcagatcaagcaggtcagctccaagcggtacagcggctggggccgcctgtccaagaagctcctgacgcagatcaccgacgagaacggggtgaacatcctgcagcggctctggaacgagcccgagaccctgaccgaggtgctggccaacccggtgatcaagcgcaagatcagcgaggccaacagcctcttcgtgcagatcaacaaggtcgagaacatcctggacgacgcctacacgagcccccagaacaagaaggccatccgccaggtgatccgggtggtcgacgacatcatcgcggccgcccacggcaagaagcccagccagatcgccatcgagttcgcccggtccagccagaacaaggcgaaggtgcccgacacccgcaagaagcagctggacaagatctacaacaagatctccagcgagatcctcgactccagcatcaagaacgagctgaagaacctgaagtccaacaagtacctcagcaaggacaagctgttcctgtacttcaagcagatggggcgggacgcctacaccggcgacaagctctccctggaccagctgcagaactacgacatcgaccacatcttcccgcgcagcttcatcaaggacgactccctcgacaaccgggtgctgacccagaagcccatcaacgccaagaagtccgactacgggatccccgccctggagttcggcaacaagtacgtccccgacctcggcatcacggtgaaggagatgtggaagctgtggcaggagaacgggctgatctccaagagcaagctcatcaacctgtgcaccaacccgaagaagatcggctccaagcgcgcgagcgggttcatcaaccgccagctggtggagaccagccaggtcatcaagctcgtggccatcatcctgcaggccgagttccccgacaccgagatcatcgaggtgaaggccctgcagaacacgaccctccgggagtccttccacctgtacaagaaccgcagcgtcaacgactaccaccacgccatcgacgcgtacctgaccaccatcgtgggcaactacctctaccaggtgtaccccaagctgcggccgtacttcgtctacgggcagttcaagaagttcaaccaggagaagaacatcgacatcctgaagcgcctcaagaacttcaacttcctgcggcagctgatcttcaacaccgacgacaacatctacatctccggcacgaaggagatcgtgttcaacaagaaggacatcatccacaagctcgagaccgcctacggctacaagtacatgaacatcagccgcgagtgctaccaggagacctccagcctgttcaaccagaccctgtacgcccacaactccagcgtgaagaactccctcatccccaagaagaaggggctgcccacggagatctacggcgggtacagcggcaacaaggactccttcttcgtcctggtgaagatcgtgaagaagcggaccaacctctaccgcatcgtcggcatccccacccgggagctggccaagctgaacagctccaacaactacaaccaggccctcaacaagatcgtggagagcaagctgtgcctgaaggagaccgagtccttcaagatcctcatcaagcgcctgctgtacgggacgctcatcgtggacaacggccagaagttccggatcgggagcttcaaggagaagcacaacgtccagcagctggtgctgcagctcaagtccatgaagtacatcaagttctacatcgacggcgggcagaactacttcaccgacgtggagcgcaagaagctggagaagcaggaccgggacaagtgcctgctctacgtcttcgacgacatcatgaacgtggtgaacaagcgcttcaccctgttcgacatgagcaagtacgagaaggacggcgactccctgcgggagaagttcaactgcctcgacttcaacgacaaggtcagcatcctgagcgacctgctcaaggcgttccacgccaactccgaccgcaccagcatcacgaagctgaagatcaccaacctgggccggcaccaggccgggaagaacggcatcaccctcaccacgaacgcccagatcatctaccagtccccgaccgggctgttcgagcgccggatcaagatcaaggacctgtga

SEQ ID NO: 2081 - RNA, 4176 nt, synthetic construct
  misc_feature 1..4176: note = Cas9 variant
  source 1..4176: mol_type = other RNA
atgaagaagatcctgggcctcgacctggggaccaacagcatcggctgggccctggtgaacgaggccgagcacgagcacgagcagtccagcatcgtcaagctcggggtgcgcgtgaaccccctgtccgtcgacgagaagaccaacttcgagaagggccggccgctgagcatcaacgcggaccgcacgtccaagcggagcgcccgccggaacctccagcgcttcaagctgcggcgcaagaacctgatcaacctcctgctgaagcaccacatcatctccaacgagaccatcctcaccgaggtggggaagaacaccacgcaccagaccctgaagctgcggagcaaggccacccaggagaagatctccctcgaggagttcgcccgcatcctgctgagcatcaacaagaagcggggctacaagtccagccgcaaggagaagaacgaggacgagggcttcaccatcgacgggatggccatcgcgaaggagctctacgacaaccagctgacgcccggccagtacgtgtacaacatcctgcaggacgggaagaactacatccccgacttctaccggtccgacctccaggccgagttcgacgacgtctggcagttccagaagaagttctacagctccatcctgaccgacgagttctacctgaagctcaagggccaggggaaggagaacacccgcaagctgttcctggccatccaccaggtgtacaccgccgagaacaagggcaagcgggacgcggtgaagctccagtactacaagtggcgcagcgaggccgtcaagaagcagctgtccatcgaggaggtggcctacgtgctggtcgagatcaacaacaacatcaacaagagctccggctacctcggggccatcagcgaccggagcaaggccctgtacttcaacaacgagacggtgggcgagtacctgtacgggcagctcgtgaagaaccgccacaactccctgcggaaccaggtcttctaccgccaggactacctggacgagttcgagaagatctgggagacccaggcgaagttctacgacgagctcaccaacgagctgaagcaggagatccgggacgtggtgatcttctaccagcgcaagctcaagagccagaagcacctcatctccgactgcctgttcgagaagcaccacaaggccatccccaagagctccccgctgttccaggagttcaagatctggcagaacctcaactacctggagttcgtccacacccagagcaaggagaagatcttcttctccgagctggacgacgagacgcgccagttcgtgttcgccgagctcaacatccggggcaccctgaagatcaaggagatcaagaagctgatcggcctcgagacccccgtgtactggaagtccaacttcgacgagatcgaggggaaccgcaccaaccaggtcctgtacaacgtgtaccagaacatcgccgacgacctgggctacgggttcgactggagcaagaagcacgccttcgagatcaacgcggagctgcaggccatcttcaaggacgtgggcatcgacacggccatcctcaacttcgacgccagcatcgaggagaacgacttcgacaagcagaagtcctaccagctgtggcacctcctgtacagcgccgaggacaccgacaaggcgaccgaggaggacaagctgatctacgggaacatcaacaccaagctgaagaagcagctccaccagaagtacggcttcgaggccaagtacggcaacctgctggccaacatctccctccagcaggactacgggaacctgagcgccaaggccatcaagaagatcctgccctacctcgagtccggcaacagcttctacgaggcgtgcacgatcgtcgggtacaacccctccaacagcctgaccaaggagcagcagcagaaccggaagctgaaggacaagctcgagctgctgccgaagaactccctccgcaaccccgtggtcgagaagatcctgaaccagaaggtgaacctgatcaaccagctcatcgacgagtacggcaagcccgacgaggtgcggatcgagctggcccgcgagctgaagaagtccgccaagcagcgggccgacctcagcaagcacatcaacgacgcgaccctgaagaaccagaacatccgcaagaccctgcagaaggacttcgggatccagaaccccagcaagaacgacgtcatccggtacaagctctacgacgagctgaaggacaacggctacaagacgctgttcaccaacaagtacatcccgaaggagcagctgttcagcaaggacgtggacatcgagcacatcatccccaaggccatcctgttcgacgactccttcagcaacaagaccctggcctaccgcaacgtgaacctcgccaaggccgacgcgaccgccttcgacttcatctccagcaagcacctggacgacctggacaactacaaggcccgggtcgagaccctcttccagtccaagcgcatcagcaagggcaagtacaagaagctgctgatgacccggcagaacctccccgaggacttcatcgagcgcgacctgcggaactcccagtacatcgccaagaaggccaccgcgatgctgaaggaggtgttccgcagcgtggtccccacctccgggcggatcacggacaagctccgcgaggactgggacctggtgaacgtgatgaaggagctgaacctcccgaagtaccggaccctgggcctgaccgagttcatcgagcgcaagaacgggaacaagatcgagcagatcatcgactggaccaagcgcaacgaccaccggcaccacgccatggacgccctcaccgtcgccttcacgacccacaaccacatccagtacctgaacaacctgaacgtgacccacggcctcaacggggtggacaccgaccacgagaagtcccgcctgtacgccatcaagcaggcgatcacgaaggtctacatcgtgggcaagaccaagaagcggaagttcatcccgcccatggagaacttccgcagccacgccaagaaccacctggagggcatcctcatcagcttcaagaacaagaacaaggtggtcaccaagaacaagaaccggaccaagacgaagaccaagggggtgttcaacgagaagatccagctgacgccccgcggccagctgcacaaggagaccatctacgggcacgccaagaaggtgatcgtcacgaaggagaaggtgtccagcaagttcacccacgagaagatcctccaggtgaccaagcccgcctaccgggaggcgctgctgaagcgcctcgcctccttcaagaacgaccccaagaaggccttcagcggcaagaacgccctgagcaagaaccccctgtacttcgacatcacctccggcaagaaggtccccgacacggtgaagctcagctacttcgagaactcctacgtgatccggaaggaggtcaacagcgacaacttcaagaacgagaagtccctgcagaaggtgctggacgtggggatccgccggatcctcgagaagcgcctggccgactacaacggcaacgcgaaggaggccttcagcaacctggagaagaacccgatctggaaggacaaggagaagggggtctgcatcaagaaggtgcggatcgaggccctcaagaacgccgagcccctgcacgtgaagaaggaccacctgggcaagatcatcctcgacgacgagaacaagtccacccccgtcgacttcatcagcaccgggaacaaccaccacgtggccatctacgaggacaaggacggcaagctgcacgacaaggtggtctccttctacgaggtggtgagccgcgtcaacctgggcctccccatcatcgacaagtccttcaacagccacctggactggaagttcctgttctccatgaagcagaacgagatgttcgtgttcccgagcgaggacttcaaccccaaggagatcgacatcgggaaccccaagaacaacgagctcatctccaagtacctgttccgggtgcagaagttcagcaaggtcacctacggcaactccgcggtgcgcgactacgtgttccggcaccacctggagacggagctcatcgacaagaaggagctgaaggggatcacctactaccagctcaagagcatcggcatgctggagaagctggtcaaggtgcgcatcaaccacatcgggaagatcgtgcacatcggcgagtactga

SEQ ID NO: 2082 - RNA, 4176 nt, synthetic construct
  misc_feature 1..4176: note = Cas9 variant
  source 1..4176: mol_type = other RNA
atgaagaccatcctgggcctcgacctggggaccaacagcatcggctgggccctggtgaaggaggccgagaacgagaacgaggtctccgacatcatcaagctcggggtgcgcgtgaaccccctgacggtcgacgagctgaccaacttcgagggcgggaaggcgtacagcaacaacgccgagcggaccctcaagcgcggcgcccggcgcaacctgcagcggtacaagctgcgccgggagaacctcatcgagatcctgctgaagaacggcctcatcaacaaggacaccgccctgacggaggtggggaaggagaccacccaccagaccctgaagctccgctccaagagcgccaacgagaaggtgtccctggaggacctggcgaagatcctcctgagcatcaacaagaagcggggctacaagtccagccgcaaggtcaacgccgaggacgacggggtggccatcgacggcatggaggtggccaagctgctctacgacgagaacatgacgccgggggagtacgtcctgcggctgctcgagtccggcaagaagcacctccccgacttctaccgcagcgacctgcaggaggagttcaacctcgtgtggaagaagcagtccgagttctaccccctgatcctgaccaaggagctgttcttcgagctgcacggcaagaacaagagccagacctgggcgatctgcaaggagcccctggggatcgtgggcgtcaagctcaaggggtccgccaaggagcagaagttcgcccggtaccgcctgcggaaggaggccctgacccagcagatcgagctcgagcacctggccatcgtgctgcaggacatcaacaacgacagcaacaagtccagcggctacctcggcgcgatctccgaccgcagcaaggagctgttcttcaacaaggagacggtggggcagtaccagtacaagcagctgcagaaggacccgaacacctccctcaagaaccaggtcttctaccggcaggactacctggacgagttcgaggtgatctggcgcaaccaggccaagttctacccccagctgaccaacgagctcaagcaggagatccgggacgtggtcatcttctaccagcgcaagctgaagtcccagaagaacctgatcagcttctgccagttcgagtccacccagcagaactacgtggagaaggagacgggcaagaccaagatccggaccatcgggcgccgcgtgatcccccggagcagccccctcttccaggagttcaagatctggcagagcctgaacaacctgaagttcgtcaactccgagagcaaccagatcatccagttcatcgagctggaggacgacgtgaagaaggtggtcttcgacgagctcaacctgcgcggcgacctgaagccgaaccaggtgctcaagatcctgtccaagtacatgaagatcgggaagctgacccagtggaagtgcaacctcgaggagatcgagggcaaccggacgaacagcgccctgtacaacgtcttccagatgatcgccgaggaggagggctacgggttcaactggggcaagaagtccgccctggagatcaagagcgagctcaaggcgatcttctccagcatcgggatcaacgactccatcctggacttcgacttcagcaagaagctggaccagcagctctcctaccagctgtggcacctcctgtacagcgccgaggagggcaactccaagatcaccgaggaggacaagttcacctacgggaacaccggcgtggccctgaagaagaagctgcacctcaagttcggcttcaagcccgagtacagcacgctgatctccaacctgcgcttcaccagcgactacgggaacctcagctccaaggccatcagcaagatcctgcccttcctgcgggacggctccgactacagcaaggcctgccagtacgcggggtacaaccactccaacagcctctccgccgacgagctggacaaccgcgagctgaagcccaagctcgagctgctgaagaagaacagcctccggaacccggtggtcgagaagatcctgaaccagatggtgaacgtggtcaaccaggtgatcgacaactacggcaagcccgacgaggtgcgcatcgagctggcccgggagctcaagaagtccgccaaggagcgcagccagatgaccaagaacatctccgacgccacccggcgcaacgcggagatcaagaagtacctgagcaaggagttcgggatccccaaccccacgaagggcgacgtcatccggtaccgcctgtgggaggagctcgcctccaacggctacaaggacctgttccgggacaagtacatcccgaaggagaagctgttcagcaacgagatcgacatcgagcacatcatccccaaggccctcctgttcgacgactccttcagcaacaagaccctggccttcaaggtggacaacctcaagaaggcggaccgcaccgccttcgacttcatgtccaccgacttcagcaaggacgtggacagctacatcgggcggatcgagacgctgcacaaggacggcaagatctccagctccaagtacaagaagctgatgatccccaagagcaagctcgtcgacgggttcatcgagcgcgacctgcggaacacccagtacatcgccaagcaggcccgcaagatgctgctcgaggtgttcaagaccgtggtccccaccacgggcaagatcaccgacaagctgcgcgaggactgggacctgatcaacgtgatgaaggagctcaacttcccgaagtacaaggccctgggcctgaccaagaagatcgagcggttcgacgtggggtccgagaagatcaagagcatcaacgtcatcgagggctggtccaagcgcaacgaccaccggcaccacgcgatggacgccctcgccgtggccttcaccacccacaaccacatccagtacctgaactacctgaacgcccgcaaggacatccaccacgagatgcacgggacgatcaagagcatcgagaaccagatcatcggcaaggacgtgatggggaagcggcgcttcatcccgcccatctccgacctccggatgaaggcgaagctgcagatcgagagcatcctgatctccttcaagaacaagaacaaggtcgtgacctggagcgtgaacaagaccaagctcaagggcaaggacaactacaacaagcgccggcagctgacgccccgcggccagctgcacaaggagaccgtctacgggaagatcaagctcatcgaccccaagcccctgaagctgaacaacaagttcaccctcgtgcgggcctccatgatcgtggacaaggtccaccgcgagatcgtgctgcagcacctgagcaagtacgacaacaactccgaggtggccttcgacagcaagaccatcaagatcgaccccatcctcatcgagggcatcgggctgaaggaggtcgtgtgctacgaggacgtgttcaagatccggaagaagatctccggcgacaacttcaagaacgagaagcacctggagaaggtcatcgacgagaaggtgaagcagatcctcaaggaccgcgtgatcaagttccaggggaacttcaaggaggccttcagcaacctggaggagaaccccatctggctgaacaagtccaagggcatcgccgtcaagagcgtggcgatcaagggcgtgaacaacgccgagagcctccacgaggggaaggaccacttcggcgaccagatcctggacaagaacaagaagcagatcccggtcgacttcgtgtccaccgggaacaaccaccacgtgggcatctacgaggacaaggacgggaacctgcaggagcgggtcgtgagcttcttcgaggccgtgacgcgcgtcaacgagggcctccccatcatcgacaagacctacaactccgacatcggctggaagttcaagttcaccatgaagcagaacgagatgttcgtgttccccagcgacgacttcgacccgaacgagttcgacctgaccgacgggaagaacgccgcgaagatctcccccaacctgtaccgggtgcagaagatcgccacgaagaactacatgttccgccaccacctcgagaccgtcgtgaccaacgacctggagttcacctacaagagcatccggtccacgggctggctgcgcaacctcgtgaaggtccggatcaaccacctgggggagatcgtgtacgtcggcgagtactga

SEQ ID NO: 2083 - RNA, 4176 nt, synthetic construct
  misc_feature 1..4176: note = Cas9 variant
  source 1..4176: mol_type = other RNA
atgaagaagatcctgggcctcgacctggggaccaccagcatcggctgggccctggtgaacgagaaggagaacaacgaggagctctccagcatcatccgcctgggggtccgggtgaaccccctgacggtggacgagaagtccaacttcgagaagggcaaggacatcaccaccaacgccgaccgcaccaagtgccggagcgcgcgccggaacctccagcgcttcaagctgcggcgcgaggccctggccgactgcctcaagcggcacgggctgatgacggacgagaccccgctgtgcgagaccaacaactccatcatcttcaagacctacagcaaccgcgccaaggccgtctgcgagaagatcgcgctcgacgacttcgtgcgggtgctgttcatgatcaacaagaagcgcggctacaagtccagccggaagctgaacacggacgacgagggcaccctcgtcgacgggatggacgtggccaagctgctgtacaacgagcagatcacccccggcgagtacctcctgcgcctgttcaagaaggggaagaagacccggcccgacttctacctctccgacctgaaggccgagctggagcgcatctgggacttccagcggacgttctaccccgagatcctctgcaacgccctgaaggaggacctgaagggcaagagccgcacccagtccagcgcgatcttctacgccaagtacaaggtgtccaccgccaagatcgccgggaaggacaagcggctccaggagctgacctggcgcacggacgccctgcggaagcagctcaccatcgacgaggtcgcgtacgtgatctgcagcatcaacggcgaggtgaacggctccagccagcgcctgtccatgatcagcgaccgctccaagctgctctacttcaaccaccagaccatcgggcagtacctgatgcagcggctggaggagaacccgaacgccggcctcaagaacatcatcttctaccgccaggactacgaggacgagttcaacgacatctggaacagccaggccacctaccacaaggagctgacgcccgagctgaagaaggaggtcaaggacatcatcttctaccagcgggggctcaagagctgcaagtggctgatcaactactgcgagctggagcacgaggagatcgaggtgaagacccccgagggcaagctccgcaagatcaccatcggctccaagacctgccccaagagctccccgctgttccaggagttcaagatctggcaggtcctgaacaacctccaggtgagccccctgaactcccggcgcaaggccaagcggaagaaggacgaggagcccagcctgttctccgacgaggacatgaacacggcctgccgctacctcaacgaggaggagaagctgaccctgttcaaggagctgagcatcaagaaggagctcaagaagaaggacgcgctgaagctcctgttcgagaactacaaggagctggacctgaactacaaggtgatctccgggaacgtgaccatggccaacctctaccgggccttccaggacatcatcagcctgaccggcaacggggagttcgacttccaggccatgcccgccgaggaggcggagaagacggtcgaggagatcttcggcgggctgggctacaagaccgccttcctccacttcgacgcctccctgcacgacaaggagttcgagcgccagccggcctaccggctgtggcacctcctgtacagctacgccggcgaccagtccaagaccgggatcgaggcgctggtgaagcgcatccaggagctctgcggcttcgagcccgagtacgcccggatcctggccaacatcagcttcatccccgactacgggaacctgtccagcaaggccatgcgcaagatcctcccctacatgcaggacggctacgagtactccgaggcgtgcagcaaggccgggtaccggcactccgccagcagcctgaccaaggaggagatcaacaagaagaactacaagacgcacctggacgagatcaagcgcaactccctccggaacccgatcgtggagaagatcctgaaccagatggtcaacgtggtgaacagcgtcatcgacacctactccaacatcgacgagatccgcatcgagatggcccgggagctgaagaagtccaagcccgagcgcgaggacatgagcttcgccatcagcaaggcgaccaaggagaccgagcgcatcaagggcatcctcgagcaggagttcaagatccagcacgtgacgcggaacgacatcatccgctaccggctgtacgaggagctgaagcccaacggctacaagaccctctactccaacacctacatcccccgcgaggacctgttcagcaagaagttcgacatcgagcacatcatcccgaaggcccggctgttcgacgactcctacagcaacaagaccctcgagctgcgcgacatcaacatcgagaaggggaaccagaccgcctacgacttcgtcctgtccaagtacggcgaggaggggctctacaagtacgagcagcgggtggaggagttcaagaagaacaacgagcaggccggcacgaagtgccgcaagctgctgatgcgggaggccgacatccccagcgacttcctcaaccgcgacctgaacgactcccagtacatcgcgaagaaggcccacgagctgctccgggagatcgtgcccaccgtcaccgccaccacggggagcatcaccaaccgcctgcgggaggactggaagctggtgaacgtgatgaaggagctcaactgggagaagtacgacaagctgggcctgaccgaggagtacaaggacaaggacggcaacaccgtccgccacatcaaggactggacgaagcggaacgaccaccgccaccacgccatggacgccctcaccatcgcgttcaccaagccctccttcatccagtacctgaacaacctgaacgcccggagcaaccgcgggggctccatctacgggatcgagcagaaggagctcgagcgggagaacaacaagctggtgttcatcccgcccatcgaccccaagatcttccgcaagcaggccaaggagcacctgagcaacatcctcatcagcatcaaggccaagaacaaggtggtcaccaagaacgtgaacaagacgaagtccaagagcggcaccaaccggaaggtgcagctgacgccccgcggccagctgcacctcgagaccgtctacgggaagatccgcacctacaagaccgaggagatcaaggtgggcaccaagctgaccgaggagctgatcgcgaaggtggccgacaagaagatccgggaggccctcatgcagcgcctgtccgagtacgggggcaacatcaagaaggccttccagaacatcagcaagcacccgatctggctgaacgggtcccacacgaagcacgtccccgagaaggtgaagatcgtgttcttcgaggacgtcttcaccatccggaaggccatcacccccgacatcaagatcgacaaggtgatcgacagcaagatccgccggatcctccaggagcgcctgaacgagttcggcggcgaggcgtccaaggccttcagcaacctggacgagaacccgatctggttcaaccgggacaaggggatcgccatcaagtccgtgaagatccgcggcatcgccaaggggaccgccatccgggtcaagaaggacatccacggcaagacgatcatcgggaacaacggctaccccgtggcgaacgactacgtgaacaccggcaacaaccaccacgtcgccatcttccgcgacaaggacgggaacctccaggagcacatcgtgagcttctacgaggccaccgcccgggccatccagaacctgcccatcgtggaccgcaactacaactccgagaaggactggaagttcctgttcagcatgaagcagaacgagtacttcgtcttccccaacccgaacaccggcttcaacccctccgagatcagcctcaaggacgagaagaactacgcgctgatctcccccaacctgttccgggtgcagaagctcagccactactactacgtgttccgccaccacctggagacgaacgtcgacaccaacctgcagctcaaggacatcacctggaagcggatcaccgccgtgaacaacctgacgggggccgtgaaggtccgcatcgaccacctgggccggatcgtggacgtgggggagtacaagtga

SEQ ID NO: 2084 - RNA, 4176 nt, synthetic construct
  misc_feature 1..4176: note = Cas9 variant
  source 1..4176: mol_type = other RNA
atgaagaactaccacatcggcctggacatcgggaccagctccgtgggcttcgccgcccgcgacgacgacaacaacctcatccgggtcaaggggaagaacgtgatcggcgcgcgcctgttcagcgaggggcagaccgcccaggagcggcgcatggcccggacctcccgccggcgctacaaccggcgcaagtggcggctgcgcctcctggacgagatcttccacgacgagatcatccacaaggacgccgagttcttcaaccggctgaagcagagcttcctctcccccaaggacgagcgcaagcagtacttcggcagcctgctgttcccggagaccggcgactccgagtactaccacaacgggaaccagaccatctaccacctccggcaccgcctgatcacccaggacgagaaggccgacatccgggagatctacctggcgctccgccacatcatcaagtaccggggcaacttcctggacgacacgcccgtgagctccttcgaggccagcgacctgaagctcgcctccttcgtccccaccatcaacgacctgttcgagaccatcgacgtgaactacgagttcagcatggacaacatcaacgagatcgaggacatcctgctcaacaacaagctgcgcaactccgacaagagcaagcagctgaccgacctcctgacggagcccatcgtgaacatcgacgacaagtccctggagaagcagttcaacaaggagcggaccgacatcagcaaggagatcgccaagtccgtcgtggggagcaagatgaacgtgaacaagctcctgtccttcgagagcagcgagggctccaagatcgcgttcagcttctccgacgccagctccgaggacaagatgatggagctgagcgacatcctcgacgactcccgcatgaacatcctgaacatcctgaaggtcatctacagccgcgtgcggctcaaccagatcatcccgtccgggatgggcctgagcgagtccatggtggccgcctacgacagccacaagcagcagctgaaggacctcaagaccctgctgaacgtcctccccttcaacgagcgctacgccgtgaagatcgcgtacgccgcctacatcggcaacatcgacaagcagaagttcaccaagtccgagatcaaggccatcgacaagctgaaggagaagtccgccatcatgaacgtgctggacttcaagtccgggcacatcacgaacgaggagctcagcaacgtcatcaaggcggtgatcgtggacaagtacctgaacgacgaggacttcgagtaccacggcatcgtcgagaagatcaaccaggacatctccaacgggagctacctgctcaagcagcggaacaaccagaacggcaacatcccccaccagctgcaccagatggagctggaccagatcatcgagaaccagtccaagtactaccacttcctcggcgagctgaaccccaacagcaaccgcaaccacatcgccaagtacaagatcagcgagctggtggccttccgggtgccgtactacgtcgggcccctcatcacccccgaggagcaggagaagacctccggcgccagcttcgcctggatgaagcgcaagaaggacggggcgatcaccccctggaacttcgaggagaaggtggacaaggaggagacggcctcccggttcatcaagcgcctgaccgtgaaggacacctacctgctgaacgaggacgtcctcccggacaacagcctgctgtacgagaagttcaaggtgctcaacgagctgaacgtcgtgaaggccaacaacaagcggctgaccgtggaggagaagcagggcgccttcgacaacctcttcaagaagatgaagacggtcaccgccaagcgcctgaagaactacctggtgtccaaccacaaccacatcaacagcgtggagatcaccgggctctccgacggcgacaagttcaacaacagcctgtccacctacatcgacttcaagaagatcttcggcgacaagatcgacaaccccgggctgctcgacgacttcgaggacatcatcgagtggagcacggtcttcgaggaccggaagatcttcgaggagaaggtgcgcaaggacatctcctggatcagcgagtccgagatcaagagcgtggtctccaagcggtacagcggctgggggcgcctgtccaagaagctgctcaactgcatcaccaacaacgagggccggaacatcatcgacgagctgtgggaggagagcgagaccttcatggaggcggtgagcaagcccgaggtgaaggagcagatcgacgggatcaactccgacttcatcaagaacaccgacatcgagagcgtcctggccgacgcctacacgagcccccagaacaagaaggccatccgcgagacccacaagctcgtgaaggacatccagaaggcgatgggcggccaggccccggccagcatctccatcgagttcacccggaacccccaggacaaggggcagctgacccgcagccggcactccgaggtgagccgcaagtacaaggagatctccaaggagatcagcaagacgctgaacgacgagctcaagtccaagaagaacagcatggacgtcgacaagtactacctgtacttcatgcagatgggcatcgacctgtacgacgggtccagcatcgacatcgacgacctcaacaactaccagatcgaccacatcatcccccagtccttctacaaggacgacagcttcgacaaccgcgtgctgacccactactccaacaaccagaagaagggcaacaacacgcccctgaacgggctcaacatcaacgacaagacccgggccatctggaaccacctccgcgacctgggcctgatcaccaagaagaagtacaacggcctgaccctgaaggggatggaccagctcagcaagtacaccaagcacggcttcatccggcgccagctggtggagacctcccaggtcatcaagctggtggccaacatcctcagcgacgagttcagcaccgacgacacgaagatcatcgaggtgaaggcgaagatgaactcccagatccggcaggtcttcaacctgtacaaggtgcgcgagctgaacgactaccaccacgccgtggacgcctacctcaccaccttcatcgggggctacctgtacaaccggtacccgaacctgcgcaacatgttcgtctacggcgacttcaagaagttcagcgccgacgtggacaacctcaagaccttcaacttcctgcacgagatcacgaacccctccgacaagttcgaggaccggatcttcgacgagaagtccggggagctgatcctcgaccgcaagcacgccatcgagaccatcaagaagatctaccagtacaagtacatgctgatcacccgggaggtgagcaccaagaacggccagctgagcgaccagacggtctactccgcgaagcgcatcaacaacgtgaaggcccccatccccgtgaagaaggacttcaacccggagctctacgggttccggaccggcaacgtcgaccaccacatggtgatcgtgaagtaccccaagaaggacagctacgactacaaggtcgtggggatccccctgcgcttcgtgcagaagctgaaggagaccaaggacaacaaggactacgagaacctcctgaaccagatcgtccagatgaagctgaaccggaagaagcaggacttcatcgtggtggtcgacaacgtgatgtacggccagctcatccaggacggcgggcagaagttcaccctgggctccagcacgtaccgctacaacgccaagcagctggtgatcgacaacgggtacctcaagctgatcgccgacgagcggtacaagaactccctgaccgacgaggagaagtccaaccagtacatcaccctctacaacgagatcctgaaggtcgtgaacggccgcttcgacgtgttcgacgtcaacagcttccggaagaagctgaacaacggggtggacaagttcatcaagctcaacaccgtggacaagcgcatcatcatcatgaagatcctgagcggcctgcactgcggcccctccatcgtcccgctcaaggagctggggctgacgacgcccctcggccagctgcagagcacctccgggatcagcctgtccgagaacaccatcatcatctaccagagccccagcggcctcttcgagcggaaggtgcgcctgggggacctgtga

SEQ ID NO: 2085 - RNA, 4176 nt, synthetic construct
  misc_feature 1..4176: note = Cas9 variant
  source 1..4176: mol_type = other RNA
atgaagaactaccacatcggcctggacatcgggaccagctccgtgggcttcgccgcccgcgacgacgacaacaacctcatccgggtcaaggggaagaacgtgatcggcgcgcgcctgttcagcgaggggaagaccgcccaggagcggcgcatctcccggaccagccgccggcgctacaaccggcgcaagtggcggctgcgcctcctggacgagatcttccacgacgccatcgtgcacaaggacgccgagttcttcaaccggctgaagcagtccagcctctcccccaaggacgagcgcaagcagtacttcggcagcctgctgttcccggaggtcggcgacggggactacttccgggacggcaaccagaccatctaccacctccgccaccggctgatgacccaggacgagaaggccgacatccgcgaggtgtacctggcgctccggcacatcatcaagtaccgcgggaacttcctggacgacacccccgtgtccagcttcgaggcctccgacctgaagctcgccagcttcgtccccacgctgaacgacctgttcgagaccatcaacgtgaactacgagctctccatcgacaacgtgaaccagatcgagaacatcctgctgaacaacaagctccggaacagcgacaagtccaagcagctgaccgacctgatcgccgagcccgtcaccaacatcgacgacaagagcctcaagaagcagttcgacaaggagcgcaaggacatctccaaggagatcgcgaaggccgtggtgggcagcaagatgaacgtcaacaagctgctgtccttcgagagcagcgacgggtccaagatcagcttctccttcagcgacgcctccagcgaggacaagatgctcgagctgtccgacatcctggacgacagccgcatgaacatcctcaacgtgctgaaggtgatctactcccgggtccgcctgaaccagatcatcccgagcggcatgggcctctccgagagcatgatcgccgcctacgacctgcacaagcagcagctgaaggacctcaagacgctgctggacgtggtgcccttcaacgagaagtacgcggtcaagatcgcctacgccgcctacatcgggaacatcgacaagcagcggttcaccaaggccgaggtgaagaccatcgacaagctccgcgacaagaagtccatcaccagcgtgctggacttcaagtccggccacatcacgaacgaggagctgaacaacgtcatcaaggaggtgatcgtggacaagtacctcaacgacgagaccttcgagtaccacgacatcgtcgagaagatcaaccaggacatcagcaacgggaactacctgctgaagcagcggaacaaccagaacggcaacatcccccaccagctccaccagatggagctggaccagatcatcgagaagcagtccaagtactaccccttcctgggcaagctcaacccgaacagcaagcgctcccacatcgcgaagtacaagatcagcgagctggtggccttccgggtcccctactacgtggggcccctgatcacccccgaggagcaggagaagaccagcggcgcctccttcgcctggatgaagcgcaaggaggacggggccatcacgccgtggaacttcgagaagatggtggacaaggagagcaccgcgtcccggttcatcaagcgcctgaccgtcaaggacacctacctcctgaacgaggacgtgctgcccgacaacagcctcctgtacgagaagttcaaggtgctgaacgagctcaacgtcgtgaaggccaacaacaagcggctgacggtggaggagaagcagggcgccttcgacaacctgttcaagcagatgaagaccgtcaccgccaagcgcctcaagaactacctggtgtccaaccacaaccacatcaacagcgtgaagatcaccgggctgtccgacggcgagaagttcaacaacagcctctccgtctacatcgacttcaagaagatcttcggcgacaagatcgacgacagcaagctgttcgacgacttcgagaacatcatcgagtggtccacggtgttcgaggaccgggacatcttcgaggagaaggtgcgcaaggacatcagctggatctccgagagcgagatcaacgccgtcgtgtccaagcggtacagcgggtggggccgcctgtccaagaagctcctgaacgggatcaccaacgacgagggccggaacatcatcgacgagctgtgggaggagagcgagaccttcatggaggcggtgagcaagcccgaggtcaaggagaagatcgacgagatcaactccaacttcatcaagaacaccgacatcgagagcgtgctcgccgacgcctacacgagcccccagaacaagaaggccatccgcgagacctacaagctggtgaaggacatccagaaggcgatgggcgggcaggccccgagctccatcagcatcgagttcacccggaacccccaggacaagggcgagctgacccgctcccgccacagcgagatcgccaagaagtacaaggagctctccaaggaggtcagcaagaagctgaacgacgagctgaagtccaagaagaacagcatggacgtggacaagtactacctctacttcatgcagatggggatcgacctgtacgacggcacgtccatcgacatcgacgacctgaacaactaccagatcgaccacatcgtgccccagagcttctacaaggacgactccttcgacaaccgggtcctcacccactacagcaacaaccagaagaaggggaacaacacgcccctgaacggcctgaacatcgactccaacacccgcgaggtgtggaaccacctcatcgggctgggcctgatcaccaagcggaagtacaacaacctcaccctgaagggcatggaccagctgagcaagtacaccaagcacgggttcatccgccggcagctcgtggagacctcccaggtcatcaagctggtggccaacatcctgagcgacgagtacagcaaggacgacaccaagatcatcgaggtgaaggccaagctcaactcccagatccgccaggtcttcaacctgtacaagatccgggagctgaacgactaccaccacgcgctcgacgcctacctgacgaccttcatcggcgggtacctgtacaaccgctacccgaacctccggaacatgttcgtgtacggcgacttcaagaagttcagcgccaagatcgacaacctggagaccttcaacttcctgcacgacatcaccaacccctccgacaagttcgaggaccgcatcatcgacgagaagtccggcgaggtgatcctcgaccggcgccacgccatcgagacgatcaagaagatctaccagtacaactacatgctgatcacccgggaggtctccaccaagaacgggcagctgagcgaccagaccgtgtactccgcccgccggatcaacaaggtgaacagccccatccccgtcaagaaggactccaacccggagctctacggcttccgcacggggaacgtggaccaccacatggtgatcgtcaagtacctgaacaaggacaagtacgactacaagatcatcggcatccccctgcggttcgtccaggtgctcaagaacagcaacgacaacaccgagtacaagaacatcctgaacaagatcgtgcagtccaagctgaagggcaagagcaccgacttccgcgtgatcctcgacaacgtgatgtacgggcagctgatccaggacggcgggcagaagttcaccctgggctccagcacgtacaagtacaacgcgaagcagctcgtcatcaacatggacgacatccggatcctggtggacaaccgctacttcaactccctgagcgacgacgacgcctccggggagttcatcaagatctacaacgagatcctcaaggtgatcaacgcccggttcgacctgttcgacatcaacaagttccgcgagaagctgaacaacggcaaggagtacttcgagaacctcagcatcgacgagaagaaccaggtcctgctgaagatgctctccgggctgcactgcggcagcgccaacgtgcccatcaaggagctgggcctcaccacgcccctggggaagctgcagatcccgagcggcatcgtgctctccgaggacgccatcgtcatctaccagagcccctccgggctgttcgagcgcaagatccggctgaaggacatctga

SEQ ID NO: 2086 - RNA, 4176 nt, synthetic construct
  misc_feature 1..4176: note = Cas9 variant
  source 1..4176: mol_type = other RNA
atgaacctgcgcaactaccccggcgagtacagcatcgggctcgacatgggcaccgggtccgtgggctggagcgtcgtggacgagaaggggaacctgctgcacttcaagaagaagccgacctggggctcccggctgttcgacagcgtgatgcccgcctccgaggcccgcgtccaccggggccagcgccggcgctacgagcggcgccggtggcgcctggacctgctccaggggctgttcaagaacgagatgaacaaggtggaccccgagttcttcatgcggctgaaccagagccgcacgatcgagggcgaccccatcttcaccaagtccttcaccaaggcggactactacgaccggttcccgaccatctaccacctccgcgcctacctgatggagagcaacgagcccgccgacctgcggctcatctacctggccatgcacaacatcatcaagcaccgcgggaacttcctgcgggaggaggagaagtccctcagcgccaagcacgcggactccaagaaggccgtgacgcagttcgtcgacgccctgaaggagtggtgcttcagccgcggctacgagttcgggaaggaccccgccaagtccatcgagaagtgcctgagcgactccaagagctcccggagccagctcgcgtccgagatcgccaaggccctggccgtgagcaccgacgccgcggccgccgacaagaagctggccgacaacctcgccaaggcgatggtgggcctgcagtgcgagttcaagtacgtcttcggcgagttcgactgcgagagcaccaagctggccctctccgacgacgagaagctggagctgctccgcgccgcctgccccgacgacagcgtggagctgctggacgccctctgcgcggtgtactccgcctacgtcctgcaggggctgctcagctacgccccgggccagaccatctcccacaacatgatcgccaagtacgacctgtacaagacggacctgaagaccctccgggccctggtgcgcgagtacgcgcccggggcctacgacgagttcttccgcggcgccacctaccacgacgccaaccccgacgacagctccaaggactacagctacgcggacgccgagggctacaccgcctacaacctgcacaagctctcctacgacgacttcgccaaggccgtgaagaagctgctcgggggcacggacgcggtcaccgacgagcggtacctcaacatgatggagcgcttcgagaagcagcagttcctgcggcgcctgaagaccagcgacaacggggccatctactaccagctccacctggaggagctgaccgccatcatcaagaaccagggccggttctactccttcctcaaggagtacgaggggaagttcgagagcctggtgtccttccgcatcccctactacgtgggcccgctgacgagcgtcaacgccgcccaggactcccacaaccacaaccggttccagtggagcgagcgcaagcccggcatggagcgggaggtgatcaccccctggaactgggacaccatcatcgacaagaacaagtccgcggagaacttcatcatgcgcatgaccggggactgcacgtacctggccggcgagaaggtgctccccaagcagagcctgctgtacgaggagttctgcgtcctcaacgagctgaacggggtgcggtggtccgacgacggcgacgactggcagcgcttcgacgccgcccagcgggaggggatcgtgcgcgagctgttccacaagtaccggcgcgtcacctacaagatgctcgaggactggctggtgcgggagggcgacgccaaccacccgatcgtcaagggcgggcagggcgagaccgggctggagagcaagatgggcagctacctcttcttcgcgaaggggatcttcggcctgggcgagctgtcccccgccgagtaccccgccatcgagaagatgatcaagtggaacaccctcttcgaggaccgcagcatcctgaaggagaagctggaggacgagttcggggagcggggcaacgggatgctcgacgcctcccagatcaaggcgatctgcaagaagcgcttcacgggctggggccgcctgagcgagcagttcctgaccgggctcaaggtggagtcccccgccggccgggccgtgagcatcatggacgtcctgcgcgaggggaacccgtgctccgagcggcgccagggcgagaccgtggtgatgatggaggccctgcgggacgaggggctcggcttccagaagaagatcgacgagcacaaccgcaactactacggccagcacgggaaggacctgggcgtcaacgagctgcccgggagccccgccatccggcgctccctcaaccaggcgatccggatcgtggaggagatcgccagcatcgccggccacgcccccgccaacatcttcatcgaggtgacccgcggggaggacgcgggcaagaagggcaagcggacggtcaagcgctgggacaagatcggggaggccctgaagaagctgaaggaggagggcgtggccgtggaggtcatggacgacttcaaggagcagaaggccatcaacgccaacctcgacgagcggctgtccctgtacctcatgcagaacgggaagtgcctgtacagcggcaaggcgatcaacctggagaagctcctggccgggtccggcgagtacgaggtggaccacatcatcccgcgcgcctacatcaaggacgacagcatcgagaacaaggccctggtgctccgggaggagaaccagcacaagaccgaccagctgctgatcgacaagtccatccgctggaagatgcgggagacctggagccagctccacgacgcgggcctgatcggggacaagaagtaccacaacctgctccgctccaacatcaacgagaaccagctgcggggcttcatcgcccgccagctggtcgagaccagccagatggtgaagctcgcccaggccctgctggaggcccggttcgcgaacgaggagacgcgcatcgtgcccgtcaaggccagcatgtcccacaacctccgcgaggccgccgacctggccaagtgccgggaggcgaacgacttccaccacgcccacgacgccttcctggccagccgcatcggcctcttcgtgcagatgcggcaccccgggatctacgagaaccccatcgggtactcccacgtgatcaagaagtacgtccaggagcagagcgaggtgttcaagaagacccaccgcatgccgggctccgccggcttcgtgatcaacagcttcatgtccagcgggttcgacaaggacaccggcgaggtcttcaaggactcctgggacgcggaggccgaggtggacgggatccggaaggccctgaactaccgccagtgctacatcagccggatgccccagcaggacaccggcgccttctggaacgccacggtgtacagcccccgcgacccgaagatgggccccaagctggcgctctccaccaagcaggggctggaccccaagctgtacggcgggttctccagccagcagttcgcctacttcttcatctacgaggccaagaagaagggcaagcccaccttccggttctcccaggtcccggtgtggctcgccgcgcgcatcgaggccaaccccctggccctggaggagtacgcccgggggctcgccaagggcgagggcctggagttcgtgagcatccagcgccccaagatctacaagaagcagctgatcgaggtcaacggggacaagctcatcatcaccggcgcgaaggaggtgcggtccggggccgagctggccttcaaccaggacgagatcagcgccatctccatgtgcagcaagctgcgcgccgcggaggccggcctcgacggggccttcagcgaggaggtgtccgccatctggaaccggatcagcaacgcccccgtccagtcctgcggccgcctgctgcggcagctcaccctgccgaagtaccagagcaacttcgactccagctccaacgaggagaaggcggccgtggtgctgggcctcatcgccctgctgaacgggaacaaccgcatcgtcgacctcagcggcgtcgggggctccagccacgccggggcgatgatgatgtcctaccccaagctgctggacgaccccaaggtgcccttcttcatcatcgaccagagcgtgacgggcatgttcgagcggaagacccgcgtgggcctctga

SEQ ID NO: 2087 - RNA, 4176 nt, synthetic construct
  misc_feature 1..4176: note = Cas9 variant
  source 1..4176: mol_type = other RNA
atgaagaagatcctgggcctcgacctggggaccaccagcatcggctgggccctggtgaacgagaaggagaacaacgaggagcagtccagcatcatccgcctcggggtccgggtgaaccccctgacggtggacgagaagtccaacttcgagaagggcaaggacatcaccaccaacgccgaccgcaccaagtgccggagcgcgcgccggaacctgcagcgcttcaagctccggcgcgaggccctggccgactgcctgaagcggcacgggctcatgacggacgagaccccgctgtgcgagaccaacaactccatcatcttcaagacctacagcaaccgcgccaaggccgtctgcgagaagatcgcgctggacgacttcgtgcgggtgctgttcatgatcaacaagaagcgcggctacaagtccagccggaagctgaacacggacgacgagggcaccctggtcgacgggatggacgtggccaagctcctgtacaacgagcagatcacccccggcgagtacctgctccgcctgttcaagaaggggaagaagacccggcccgacttctacctgtccgacctcaaggccgagctggagcgcatctgggacttccagcggacgttctaccccgagatcctgtgcgacgccctcaaggaggacctgaagggcaagagccgcacccagtccagcgcgatcttctacgccaagtacaaggtgtccaccgccaagatcgccgggaaggacaagcggctgcaggagctcacctggcgcacggacgccctgcggaagcagctgaccatcgacgaggtcgcgtacgtgatctgcagcatcaacggcgagatcaacggctccagccagcgcctctccatgatcagcgaccgctccaagctgctgtacttcaaccaccagaccatcgggcagtacctcatgcagcggctggaggagaacccgaacgccggcctgaagaacatcatcttctaccgccaggactacgaggacgagttcaacgacatctggaacagccaggccacctaccacaaggagctcacgcccgagctgaagaaggagctgaaggacatcatcttctaccagcgggggctcaagagctgcaagtggctgatcaactactgcgagctggagcacgaggagatcgaggtgaagacccccgagggcaagctccgcaagatcaccatcggctccaagacctgccccaagagctccccgctgttccaggagttcaagatctggcaggtcctgaacaacctccaggtgagccccctgaactcccggcgcaaggccaagcggaagaaggacgaggagcccagcctgttctccgacgaggacatgaacacggcctgccgctacctcaacgaggaggagaagctgaccctgttcaaggagctgagcatcaagaaggagctcaagaagaaggacgcgctgaagctcctcttcgagaactacaaggagctggacctgaactacaaggtgatctccgggaacgtcaccatggccagcctctaccgggccttccaggacatcatctccctgaccggcaacggggagttcgacttccaggccatgcccgccgaggaggcggagaagacggtggaggagatcttcggcgggctgggctacaagaccgccttcctccacttcgacgccagcctgcacggcaaggagttcgagcgccagccggcctaccggctgtggcacctcctgtactcctacgccggggaccagagcaagaccggcatcgaggcgctggtgaagcgcatccaggagctctgcgggttcgagcccgagtacgcccggatcctggccaacatctccttcatccccgactacggcaacctgagctccaaggccatgcgcaagatcctcccctacatgcaggacgggtacgagtacagcgaggcgtgctccaaggccggctaccggcacagcgccagctccctgaccaaggaggagatcaacaagaagacgtacaagacccacctggacgagatcaagcgcaacagcctccggaacccgatcgtcgagaagatcctgaaccagatggtgaacgtggtcaactccgtgatcgacacctacggcagcatcgacgagatccgcatcgagatggcccgggagctgaagaagtccaagcccgagcgcgaggacatgagcttcgccatcaacaaggcgaccaaggagacggagcgcatcaaggggatcctcgagcaggagttcaagatccagcacgtgacccggaacgacatcatccgctaccggctgtacgaggagctgaagcccaacggctacaagaccctctactccaacacctacatcccccgcgaggacctgttcagcaagaagttcgacatcgagcacatcatcccgaaggcccggctgttcgacgactcctacagcaacaagaccctcgagctgcgcgacatcaacatcgagaaggggaaccagacggcctacgacttcgtcctgtccaagtacggcgaggaggggctctacaagtacgagcagcgggtggaggagttcaagaagaacaacgagcaggccggcagcaagtgccgcaagctgctgatgcgggaggccgacatcccctccgacttcctcaaccgcgacctgaacgacagccagtacatcgcgaagaaggcccacgagctgctccgggagatcgtccccaccgtgaccgccaccacgggctccatcaccaaccgcctgcgggaggactggaagctggtgaacgtcatgaaggagctcaactgggagaagtacgacaagctggggctgaccgaggagtacaaggacaaggacggcaacaccgtgcgccacatcaaggactggacgaagcggaacgaccaccgccaccacgccatggacgccctcaccatcgcgttcaccaagcccagcttcatccagtacctgaacaacctgaacgcccggtccaacaagggcgggagcatctacggcatcgagcagaaggagctcgagcgcgagaacaacaagctggtgttcatcccgcccatcgaccccaagatcttccggaagcaggccaaggagcacctgagcaacatcctcatctccatcaaggccaagaacaaggtcgtgaccaagaacgtgaacaagaccaagagcaagtccgggaccaaccgcaaggtccagctgacgccccggggccagctgcacctcgagaccgtgtacgggaagatccgcacgtacaagaccgaggagatcaaggtgggcaccaagctgaccgaggagctgatcgcgaaggtcgccgacaagaagatccgcgaggccctcatgcagcggctgagcgagtacgggggcaacatcaagaaggccttccagaacatctccaagcacccgatctggctgaacagctcccacacgaagcacgtgcccgagaaggtgaagatcgtcttcttcgaggacgtgttcaccatccgcaaggccatcacccccgacatcaagatcgacaaggtgatcaacagcaagatccggaacatcctccaggagcgcctgaacgagttcggcggggaggcggccaaggccttctccaacctggaccagaacccgatctggttcaacaaggacaagggcatcgccatcaagagcgtcaagatccgggggatcgccaacggcaccgcgatccgcgtgaagaaggacatccacgggaacacgatcatcggcaacaacggctaccccatccccaacgactacgtgaacaccgggaacaaccaccacgtcgccatcttccgggaccgcgacggcaacctccaggagcacatcgtgtccttctacgaggccaccgcccgggccatccagaacctgcccatcgtggaccgcaactacaacagcgagaaggactgggagttcctgttctccatgaagcagaacgagtacttcgtcttcccgaaccccaacaccgggttcaaccccctcgagatcgacctgcggaacgaggagaactacgcgctgatcagccccaacctcttccgcgtgcagaagctgtcccactactactacgtgttccggcaccacctggagacgaacgtcgacaccaacctccagctgaaggacatcacctggaagcgcatcaaggccatcaacaacctgaccggcgtggtgaaggtccggatcgaccacctcgggcgcatcgtggacgtgggcgagtacaagtga

SEQ ID NO: 2088 - RNA, 4176 nt, synthetic construct
  misc_feature 1..4176: note = Cas9 variant
  source 1..4176: mol_type = other RNA
atgaagaagcgcatcgacgactacatcctgggcctcgacatcgggaccaacagctgcggctgggccgtgaccgacaagaagaacaacctgctgaagctccgggggaagacggccatcggctcccacctgttcgaggaggggcacaccgcggccgaccgccggggcttccgcaccacccggcgccggctgaagcgccggaagtggcgcctccggctgctggaggagatcttcgccgagcccatggccgaggtcgacccgggcttcttcgtgcgcctccaccagagctgggtgagccccctggacaagagccggaagaagtaccaggccatcgtcttccccacggcgaaggaggaccaggagtactaccagaagtaccccaccatctaccacctccgcgacgccctgatgacccaggaccggcagttcgacctgcgcgagatcttcctggccatccaccacatcgtgaagtaccgggggaacttcctccaggacaccgccgtgaaggacttcgaggcgtccaagatcgaggtcggcccgatcctgacgaacatcaacaacgccttcgccgacaagatcgtggaggggcaggacctgatcgagctcaacgtggccaacgccgcggagatcgaggccgtcatccgcggcaaggacgccgacaagaccctgtacaagatggacaaggtgaagaagatcgccaagctgctcaccgacagcaccgccaaggagcagaagaacgtggcgaagcagatcgccaacgccatcatggggtacaagacgcagctggagaccatcctgggcaaggagatcgacaagaacgacaaggcccagtgggagttcaagctctccgacgccgacgacaagctggacgcgctgctccccgacctggacgagagcgaccagaccgtcgtggccgagatcgagaagctgttctccgccatcaccctcagcacgatcgtggacgagaacaagtccctgagccagtccatggtcgagaagtacaacaagcaccaccaggactacaagctgctcaaggcctacatcgagagcctgcccgaccgggcccaggcgaagaagctgctcctggcctacgacctgtacgtgaacaaccgccacggccacctcctggaggccaagaccgagttcaagcaggactccaccctgaccaaggaggacttctacaagacggtgaaggacaacctcgacgacagcgagctggcccacaagatcgcgcaggagatcgccgccgacaacttcatgcccaagcagcggaccaactccaacggggtcatcccgttccagctgcaccagatcgagctcgacaagatcatcgccaaccagagcaagtactaccccttcctggccgcggagaaccccgtggaggaccaccgcaagcaggccccctacaagctggacgagctcgtgcgcttccgggtcccgtactacgtgggccccatgatcaccgccgacgagcaggagaagacctccggcaagagcttcgcctggatggtgcgcaaggagcaggggcagatcacgccctggaacttcgagcagaaggtcgaccggcaggagagcgccaacaagttcatcaagcgcatgaccatcaaggacacctacctgctgggcgaggacgtgctgcccgcgaactccctcctgtaccagcggttcgaggtcctgaacgagctcaacaacatccgcgtgaacgggagccggatctccgtggacctgaagcagcagatcttcaacgacctgttcgaggagaagaagaccgtcacggagaaggccctcatcagctacctgaagcagaacctgcacctcccgaccgtggagatcaagggcctggccgaccccaccaagttcaactccagcctggcctcctactaccacctcaagaacctgcacgtgttcgacaaggagctggccgacccccagtaccagaaggagttcgagaagatcatcgagtacagctccatcttcgaggacaagaagatcttccaggacaagctccacgcggagttcaagtggctgacccccgcccagttcaaggccatcagcacgtggcgcctgcaggggtggggccggctctcccgcaagctgctggtcgagctccacgacaccaacgggcagaacatcatcgagcagctgtgggacagccagaagaacttcatgcagatcgtgaccgagccggacttcaaggaggccatcgcgaaggagaaccagaacatcacccaggagaacggcgtggaggagatcctggccgacgcctacacgtcccccgccaacaagaaggccatccggcaggtcgtgaaggtggtcgcggacgtggtgaaggccgccagcggcaaggcccccgcccagttcgcgatcgagttcacccgcgaccccgacaagaacccgcagctctcccacatccgggggaccaagctgctgaaggcctaccaggagaccgccggcgagctcgtcgaccagaacctgaccaacagcctgaaggaggccatgacgtcccgcaagctcctgaaggacaagtacttcctgtacttcatgcagaccgggcgggacgcctacaccggcaagaagatcaacatcgacgaggtgagcaccaactaccagatcgaccacatcctcccccagtccttcatcaaggacgacagcttcgacaaccgcgtgctgacggcgacgcccctgaacgccgagaagtccgacgacgtcccctacaagcggttcgccaacaactacgtgtccgacctcaagatgaccgtgggggagatgtggaagcactggcagaaggccggcatcatcaacaagcacaagctgggcaacctgctcctggacccggaccgcctgagcaagttccagaagtccgggttcatcaaccggcagctcgtcgagaccagccagatcgtgaagctggtgtccgtcatcctgcagaacaagtaccccgacgcggagatcatcaccgtgaaggccggcgacaacagcgccctccgccagcgcctggacctgtacaagtcccgggacgtgaacgactaccaccacgccatcgacgcctacctcagcatcgtctgcgggaacttcctgtaccaggtgtaccccaagtaccgcccgtacttcgtgtacggccagttcaagaagttctcccaggaccccgacctgcagaaggacctcatcaagcacttcaaggggttcaccttcatgtggcccctgctgcagaaggacaacagcgagcggaaggcgctcgaggagatcaaggagaacaactccgaccgcatcgtcttctacaagcaccccgacatcttcgacaagctgcggaaggcctacaactacaagtacatgctggtgagccgcgagacctccaccgagagctccagcatgttcaacatgacgatctacccgcggggcgagcgcgaccggaagaagacccgcaagctcatccccaagggcaacgggctggaccccaagatctacggcgggtactccggcaacaccgacgcctacatggtgatcgtcaagatcgagaaggccaaggagagcatctacaaggtgatcggcatccccatgcgggccctggcggggctcaagcaggccaagaaccagggcaactacaaggaggagctgcacaaggtggtcgagccgcagatcatgctggacaagaacgggaagcccaagcgcggcgtggaggggttccgggtggtcaaggaccacgtgcccttcaagcaggtcgtgctcgacggcgacaagaagttcatgctgtacagcgccaagtacgagaccaacgccaagcagctgacgctctcccaggagaccatgcgcatcgtgaccgacaacctgaagaagtccgaggaccaggacaagctgctcgtgaaggcctacgacgagatcctgcagaaggtcgaccagtacctgcccctcttcgacgtgaacaagttccggaacagcctgcacctgggccgcgcgaagttcctcgacctggccgtgaacgacaagaagatcaccctgagcaacatcctcaacgggctgcacgacaacctggtcgtgccgaacctcaagaacatcggcatcaagacgcccttcgggctgatgcagtcccccagcggcatcaccctgtccagcaacgccatcctcatcttccagtcccccaccgggctgttcgagaagcgggtgcgcatcgccgacctgtga

SEQ ID NO: 2089 - RNA, 4176 nt, synthetic construct
  misc_feature 1..4176: note = Cas9 variant
  source 1..4176: mol_type = other RNA
atggagaacaagcagtactacatcggcctggacgtggggaccaacagcgtcggctgggccgtgaccgacacgtcctacaacctcctgcgcgccaaggggaaggacatgtggggcgcgcggctgttcgacgaggccaagaccgccgtggagcgccggaccaagcgcaccagccggcgccggtccgagcgcgagaaggcccggaaggccatgctcaaggagctgttcgcggacgagatcaacaaggtcgaccccaacttcttcatccgcctggaggagagcaagttcttcctcgacgaccggtccgagaacaaccgccagcggtacacgctgttcaacgacgccaagttcaccgacaaggactactacgagaagtacaagaccatcttccacctccgcagcgccctcatcaactccgacgagaagttcgacgtgcggctggtgttcctggccatcctcaacctgttcagccaccgcgggcacttcctgaacgcgtccctcaagggcgacggcgagatccagggggtcgacatcttctacaacgacctgtacgaggtgtgcgaggagttcgagatcgacctgccgcagatcagcaacatcgacaacttcgagaagatcctctcccagaagggcaagagccggaccaagatcctggaggagctgtccgaggagctcagcatctccaagaaggagaagatcaagtacagcctgctgaagctcatctgcgggatgaagatcaaggtggtcgacatctacgccgacgaggacatccaggaggacgacaagaagaaggacctgggcttccgcgagtccgactacgagaagtcctccctggaggtgaaggagatcatcggggacgaccacttcgagctcatcgagcgggccaaggccgtgcacgacatcggcctgctggccaacatcatcggcaacagcaagtacctctgcgaggcgcgcgtcgaggcctacgacaaccaccacaaggacctgcagaagatcaaggagctgctcaagaagtacgacatcaaggcctacacggacatgttccggaagatgaccgacaagaactacagcgcctacgtggggtccgtgaacagcaacatcgccaaggagcgccgctccgtcgacaaccggaagatcgaggacctgtacgagtacatcaagaagatcgcgctgaagaacatcagcgacgacaacgaggacaagatcgagatcctcaagaagatcgagaccggcgagttcctgaagaagcagctgaccgcctccaacggggtgatccccaaccagctccagagccgcgagctgcgggccatcctgaagaaggccgagaactacctccccttcctgaaggagaagggcgagaagaacctgacggtgtccgagatgatcatccagctgttcgagttccagatcccctactacgtcggcccgctggacaagaaccccaagaaggacaagaacgccaacagctgggcggtgatcccctccgggggccgcatcctgccctggaacttcgaggacaaggtggacgtcaaggggagccggaaggagttcatcgagaagatggtgcgcaagtgcacctacctctccgaggagcacaccctgccgaagcagagcctgctgtacgagaagttcatggtgctcaacgagatcaacaacatcaagatcgacggcgagaagatctccgtcgaggccaagcagaagatctacaacgacctgttcatgaaggggaagaaggtgagccagaaggccatcaagcaggagctgatctccctcaacatcatgagcaaggactccgtcctgagcggcatcgacaccgtgtgcaacgcctacctgtccagcatcgccaagttccggggcgtgttcgacgagaacgtcaacaaccagagcacgatcgacatgatcgaggacatcatcttcctcaagaccgtgtactccgacgagaagcgcttcgtgaaggaggagatcgtcgagaagtacggggacgagatcgacaaggacaagatcaagcggatcctgggcttcaagttcagcaactgggggaacatctccaagagcttcctggagctcgagggcgcggacgtggggaccggcgagatccgctccatcatccagagcctgtgggagaccaacttcaacctgatggagctcctgtccagccggttcacgtacatggacgagctggagaagcgcgtgaagaagctcgagaagcccctgtccgagtggaccatcgaggacctggacgacatgtacctcagctcccccgtcaagcggatgatctggcagagcatgaagatcgtggacgagatccagaccgtgatcggctacgcccccaagcgcatcttcgtcgagatgacccggtccgagggggagaaggtgcgcaccaagagccggaaggaccgcctgaaggagctgtactccgccatcaaggaggacagcaagcagtgggtgaaggagctcgacgccaaggacgagtcctacttccggagcaagaagatgtacctgtactacctgcagaagggccgctgcatgtacagcggggaggtcatcgagctcgacaagctgatggacgacaacctgtacgacatcgaccacatctacccgcgctccttcgtgaaggacgacagcctcgacaacctggtgctggtcaagaaggagatcaacaaccggaagcagaacgaccccatcacgccccagatccaggcgtcctgccagggcttctggaaggtgctccacgagcaggggttcatcagcaacgagaagtactcccgcctgacccggaagacccaggagttcagcgacgaggagaagctgtccttcatcaaccgccagatcgtggagacgggccaggccaccaagtgcatggcccagatcctccagaagtccatgggcgaggacgtcgacgtggtgttcagcaaggcccggctggtcagcgagttccgccacaagttcgagctgttcaagtcccggctcatcaacgacttccaccacgccaacgacgcgtacctgaacatcgtggtggggaacagctacttcgtcaagttcacccgcaaccccgccaacttcatcaaggacgcccggaagaacccggacaaccccgcctacaagtaccacatggaccgcttcttcgagcgggacgtgaagtccaagagcgaggtggcctggatcggccagtccgaggggaacgcgggcaccatcgccatcgtcaagaagacgatgagcaagaacagccccctgatcaccaagaaggtggaggagggccacgggagcatcaccaaggagaccatcgtgggcgtcaaggagatcaagttcgggcgcaacaaggtggagaaggccgacaagacgcccaagaaggccaacctccaggcctaccggccgatcaagacctccgacgagcgcctgtgcaacatcctgcggtacggcgggcgcaccagcatcagcatctccggctactgcctcgtggagtacgtcaagaagcggaagaccatccgcagcctggaggcgatccccgtgtacctgggccggaaggactccctcagcgaggagaagctgctgaactacttccgctacaacctcaacgacgggggcaaggactccgtgagcgacatccggctgtgcctgcccttcatctccaccaacagcctcgtcaagatcgacgggtacctgtactacctgggcgggaagaacgacgaccgcatccagctctacaacgcctaccagctgaagatgaagaaggaggaggtggagtacatccgcaagatcgagaaggccgtgtccatgagcaagttcgacgagatcgaccgggagaagaaccccgtcctgacggaggagaagaacatcgagctctacaacaagatccaggacaagttcgagaacaccgtgttctccaagcgcatgagcctggtgaagtacaacaagaaggacctgtccttcggcgacttcctcaagaacaagaagtccaagttcgaggagatcgacctggagaagcagtgcaaggtcctgtacaacatcatcttcaacctcagcaacctgaaggaggtggacctgagcgacatcggcgggtccaagagcaccggcaagtgccggtgcaagaagaacatcaccaactacaaggagttcaagctcatccagcagtccatcacggggctgtacagctgcgagaaggacctgatgaccatctga

SEQ ID NO: 2090 - RNA, 4176 nt, synthetic construct
  misc_feature 1..4176: note = Cas9 variant
  source 1..4176: mol_type = other RNA
atgaagcgcaacaacgactactacatcggcctggacatggggaccaacagcgtgggctgggccaccacgaacccccaggggcggctcctgcgcttcaacaagaaggacatgtggggctcccggctgttcgaggaggccaagaccgcggccaagacccgcaccttccggacgagccgccggcgctacgaccgggtccgccagcggatcgagttcctccaggacatcttcgccccgatcatcgccaagaaggacttcgagttcttcatgcgcctgaaggagtccaagttccacctggaggacaagaagaccgacgggaagttcgccctcttcaacgacgcggacttcaccgacgtggagtacttcgaccggtaccccaccatctaccacctccgcgccgccctgatcaagcccaaccacatcacggacccccggctgctgtacctggccatccaccacatcatcaagaaccgcggccacttcctcttcgcgggcaccgacatggagagcatccggtccttccagatcgtgtacacccagctgagcgagcacctgaagtccatcaacctcgacttcgagctgccggtcgacgcccaggacaagttcgccgccatcctgctcaacgagaagctgaacaagcgcgacaagaagaagcagctgaaggagctctgcccccacaaggacaagcggctggagtacgccttcaacgcgatcatcgggggcaagaccaagctgaaggacatcttcggggtggaggagtacgacgagggcacgaagaaggccgtggacttcgagaaggccgactacgacgaggacaaggacgagatcgagagcgtcatcaaggagaacatccacgtgctcaacgccctgaaggccgtgtacgactggaccatcctgaccaacatcctcggggactacgcgtacatctccgagagccaggtcgccctgtacgaggcccacaagaaggacctgcgcatcctcaagtccctgatcaagaagtacgccaagagccagtacgccgacgcgttccggcacgagaacgtgaagggcaactacgccaactacgtgggctccaccaactacgacaacaagcagcccgtcatcgacaaccccagcgtgacgcaggaggacatcaacaagtacttcgccgacatcctgctctccatcaccccggacgagagcgaccgcgagtcctaccagtacatcaccgagcgcctgcacaagggggaggccctgcccaagctccggaccaaggccaacagcgtgctgccccaccagatccacaagatcgagctggagaagatcctcgcgaacgccgccaagaacttccccttcctgcaggagaaggactccagcggctacacggccgcgcagaagatcgtcaagatcatgatgttccgcatcgagtactacgtggggccgctgaacacctaccaccacgtggaccagggcggccacgcctggatggtccggaaggccgaggggaagatcaccccctggaacttcgacgagaaggtggacaaggaggccagcgccgagaagttcatccgcaacatgaccaacaagtgcacgtacctcatcggcaaggacgtgatccccaagcagtccctgctgtacagccggtacaaggtcctcaacgagctgaacaacctgaaggtgaacggggcgcccatctccgtggccctcaagcagaagatctacgaggagctgttcaagaagcaggtcaacgtgaccttcaaccagctgaagaccttcctgaagacccagggcgaggacgccgacgagatcatcctcagcggggtcgacgaggccgcccacaagttcacgaacaacctgcagacctaccacaagttccgcgcgatcctgcgggacaagatcgagttcgagccgcagcgctccatggtggaggacatcatccggtggaagtgcctcatgggcgacgacatcaccatgtggaagcacaagatcgagaaggagtacggcgaccagctgagcgaggagcagctgaagaagatcacccgcctcaacttcaacgggtggtcccggctgagccaggagttcctgacggacgtgcccggcgtcgacatcgagtccggggaggtgtacagcggcatcatggacgccctctggcgcaccaacgagaacatcatgcagctgctgtccagccggttcaccttcgccgccgaggtgaagaagcagaaccaggggaccggccgcatcgagaagatcacgtacgacgaggtcatgaaggacacctacctctcccccgccgtgaagcggagcgtgtggcaggcgatcaccctggtcgaggagatccgcaagatccggaaggccgaccccaagcgcatcttcgtggagatgacccggcagccggacgccaagaaggagcgcaagctgtcccgccggacccagctcctgaacgcctaccgcgcgatcggcaacgacatcgccgagtacgagaaggagcacgtgagcacgctgatcacccagctcgagtccaagaaggacgaggacctgcggcgcaagaagctgtacctctacttcacccagatggggcggtgcatgtacaccggcgagcgcatcgacctgagctccctgctccgggacacgaacagcaacatctacgacatcgaccacatctacccccgcagcctgaccaaggacgactccctggacaacaccgtcctctgcaagaaggagatcaacctgaagaaggggaacaagtacatccaccgggtgttcaccgacaaggagctgaagaagcagtacggctactggaaggccctcaaggagaagaagctgatcagcgagcgcaagttctcccggctgatgcgcacgaccgacctcaccgccgacgagctggccgggttcatcagccggcagctggtggagacctcccagatggtcaaggcgacggccgacatcctcgagaagatctaccccaacgtgaccatcgtgtacgtcaaggcccgcaccgtgagcgacttccggcacgactacgagctgcccaaggtgcgcgccctgaacgactgccaccacgcccacgacgcgtacctcaacatcgtcgtgggcaacgtgtactacgagaagttcaccaagtccccgttccggttcatcgccaaccagaagggcaagggggacatcaagtacaacctgtaccgcctgttcgacaaggacgtcaaggtgggcgaccggatcatctggaacgccaaggaggacctcgcccgcgtgaaggccacgctggagcgggacaccgtcaacgtggtgcgcatgcccgtcgagcagcgcgggcagttcttcgacgcgaccatccagaagaagggcaccacgaagaacatgctggtgctccccctgaagggcagcgacgagcggctgcaggacacctccaagtacgggtactacgtgcgccccagcggcatgtccttcatggtcgtgcagcacgaggtgaagggcaagagccgggtcaccatcgagccggccctcctggtgtacaagaacaagctgaagtccgaggacgactacgccaagtactgcgaggacgtgctcaagctgcagaagcccaaggtcctgttcaagaacatcaagttcgggagcaagatcctcttcgacgggtaccccttcctgctgaagggccgcaccgagaaccggatcatcatggccgacgcgcagtccctcttcctgggcaaccaggagctgaagatcctcaagcgcgtgacgaagatcagcgacgacatcgaccacaaggtggagtcccggatcaagatcaccgacgaggagtggaccaccctgtggaagtccgtcgtggagcagatcgtgacggggaagttccgcaaccggctgggcaccctcaacgggatcctgcagggccgcaagatcaagctgagcaaggacgaggaggcccggctcaacgagctggacagcaaggaccaggagaccttcctgagccagatcctcctggagcgcttcctgcagttctccaccgaggagaagacgcggctcctgctgcaggtcatcagcttctccgggaacaccaccggcgtggacctccgcctgatcggcgggagctccggcaccgggacgatcaagaccaacaagaacatcaccgaccacagcgtgatcctgatcaacgagtccccgaccggcctcttcaccaaccggacggtcctgaaccagccctga

SEQ ID NO: 2091 - RNA, 4176 nt, synthetic construct
  misc_feature 1..4176: note = Cas9 variant
  source 1..4176: mol_type = other RNA
atgaagcgcaacaacgactactacatcggcctggacatggggaccaacagcgtgggctgggccaccacgaacccccaggggcggctcctgcgcttcaacaagaaggacatgtggggctcccggctgttcgaggaggccaagaccgcggccaagacccgcaccttccggacgagccgccggcgctacgaccgggtccgccagcggatcgagttcctccaggacatcttcgccccgatcatcgccaagaaggacttcgagttcttcatgcgcctgaaggagtccaagttccacctggaggacaagaagaccgacgggaagttcgccctcttcaacgacgcggacttcaccgacgtggagtacttcgaccggtaccccaccatctaccacctccgcgccgccctgatcaagcccaaccacatcacggacccccggctgctgtacctggccatccaccacatcatcaagaaccgcggccacttcctcttcgcgggcaccgacatggagagcatccggtccttccagatcgtgtacacccagctgagcgagcacctgaagtccatcaacctcgacttcgagctgccggtcgacgcccaggacaagttcgccgccatcctgctcaacgagaagctgaacaagcgcgacaagaagaagcagctgaaggagctctgcccccacaaggacaagcggctggagtacgccttcaacgcgatcatcgggggcaagaccaagctgaaggacatcttcggggtggaggagtacgacgagggcacgaagaaggccgtggacttcgagaaggccgactacgacgaggacaaggacgagatcgagagcgtcatcaaggagaacatccacgtgctcaacgccctgaaggccgtgtacgactggaccatcctgaccaacatcctcggggactacgcgtacatctccgagagccaggtcgccctgtacgaggcccacaagaaggacctgcgcatcctcaagtccctgatcaagaagtacgccaagagccagtacgccgacgcgttccggcacgagaacgtgaagggcaactacgccaactacgtgggctccaccaactacgacaacaagcagcccgtcatcgacaaccccagcgtgacgcaggaggacatcaacaagtacttcgccgacatcctgctctccatcaccccggacgagagcgaccgcgagtcctaccagtacatcaccgagcgcctgcacaagggggaggccctgcccaagctccggaccaaggccaacagcgtgctgccccaccagatccacaagatcgagctggagaagatcctcgcgaacgccgccaagaacttccccttcctgcaggagaaggactccagcggctacacggccgcgcagaagatcgtcaagatcatgatgttccgcatcgagtactacgtggggccgctgaacacctaccaccacgtggaccagggcggccacgcctggatggtccggaaggccgaggggaagatcaccccctggaacttcgacgagaaggtggacaaggaggccagcgccgagaagttcatccgcaacatgaccaacaagtgcacgtacctcatcggcaaggacgtgatccccaagcagtccctgctgtacagccggtacaaggtcctcaacgagctgaacaacctgaaggtgaacggggtgcccatctccgtcgcgctcaagcagaagatctacgaggagctgttcaagaagcaggtcaacgtgaccttcaaccagctgaagaccttcctgaagacccagggcgaggacgccgacgagatcatcctcagcggggtggacgaggccgcccacaagttcacgaacaacctgcagacctaccacaagttccgcgccatcctgcgggacaagatcgagttcgagccgcagcgctccatggtggaggacatcatccggtggaagtgcctcatgggcgacgacatcaccatgtggaagcacaagatcgagaaggagtacggcgaccagctgagcgaggagcagctgaagaagatcacccgcctcaacttcaacgggtggtcccggctgagccaggagttcctgacggacgtccccggcgtggacatcgagtccggggaggtgtacagcggcatcatggacgcgctctggcgcaccaacgagaacatcatgcagctgctgtccagccggttcaccttcgccgccgaggtcaagaagcagaaccaggggaccggccgcatcgagaagatcacgtacgacgaggtgatgaaggacacctacctctcccccgccgtgaagcggagcgtctggcaggccatcaccctggtggaggagatccgcaagatccggaaggcggaccccaagcgcatcttcgtggagatgacccggcagccggacgccaagaaggagcgcaagctgtcccgccggacccagctcctgaacgcctaccgcgccatcggcaacgacatcgcggagtacgagaaggagcacgtcagcacgctgatcacccagctcgagtccaagaaggacgaggacctgcggcgcaagaagctgtacctctacttcacccagatggggcggtgcatgtacaccggcgagcgcatcgacctgagctccctgctccgggacacgaacagcaacatctacgacatcgaccacatctacccccgcagcctgaccaaggacgactccctggacaacaccgtgctctgcaagaaggagatcaacctgaagaaggggaacaagtacatccaccgggtgttcaccgacaaggagctgaagaagcagtacggctactggaaggccctcaaggagaagaagctgatcagcgagcgcaagttctcccggctgatgcgcacgaccgacctcaccgccgacgagctggccgggttcatcagccggcagctggtcgagacctcccagatggtgaaggccacggcggacatcctcgagaagatctaccccaacgtgaccatcgtctacgtgaaggcccgcaccgtgagcgacttccggcacgactacgagctgcccaaggtccgcgccctgaacgactgccaccacgcccacgacgcctacctcaacatcgtggtgggcaacgtctactacgagaagttcaccaagtccccgttccggttcatcgcgaaccagaagggcaagggggacatcaagtacaacctgtaccgcctgttcgacaaggacgtgaaggtgggcgaccggatcatctggaacgccaaggaggacctcgcccgcgtcaaggccacgctggagcgggacaccgtgaacgtggtccgcatgcccgtggagcagcgcgggcagttcttcgacgccaccatccagaagaagggcaccacgaagaacatgctggtgctccccctgaagggcagcgacgagcggctgcaggacacctccaagtacgggtactacgtccgccccagcggcatgtccttcatggtggtgcagcacgaggtcaagggcaagagccgggtgaccatcgagccggcgctcctggtgtacaagaacaagctgaagtccgaggacgactacgccaagtactgcgaggacgtcctcaagctgcagaagcccaaggtgctgttcaagaacatcaagttcgggagcaagatcctcttcgacgggtaccccttcctgctgaagggccgcaccgagaaccggatcatcatggccgacgcccagtccctcttcctgggcaaccaggagctgaagatcctcaagcgcgtgacgaagatcagcgacgacatcgaccacaaggtcgagtcccggatcaagatcaccgacgaggagtggaccaccctgtggaagtccgtggtggagcagatcgtcacggggaagttccgcaaccggctgggcaccctcaacgggatcctgcagggccgcaagatcaagctgagcaaggacgaggaggcgcggctcaacgagctggacagcaaggaccaggagaccttcctgagccagatcctcctggagcgcttcctgcagttctccaccgaggagaagacgcggctcctgctccaggtgatcagcttctccgggaacaccaccggcgtggacctgcgcctgatcggcgggagctccggcaccgggacgatcaagaccaacaagaacatcaccgaccacagcgtcatcctgatcaacgagtccccgaccggcctcttcaccaaccggacggtgctgaaccagccctga

SEQ ID NO: 2092 - RNA, 4179 nt, synthetic construct
  misc_feature 1..4179: note = Cas9 variant
  source 1..4179: mol_type = other RNA
atgaagtccatcctgggcctcgacctggggaccaccagcatcggctgggccctggtgaaggagagcgagaacgacaacgagaagtccgagatcgtcaagctcggggtgcgcctggtgcccctgacgaccgacgagcggaccgacttcgagaagggcaagagcatcaccacgaacgccgaccgcacctccaagcggagcatgcgccggaacctccagcgctacaagctgcggcgcgaggcgctggtctccgagctcaagaaggagcactggatcgacgaggggtaccggttcagcgaggacggcccgggctccaccttcagcaccctgcgcctgcgggccaaggccgccgaggaggagatctccctccaggacctggccaaggtgctgctccagatcaacaagaagcgcgggtacaagagctcccggaagctgaacagcgcggaggacggccaggccatcgacgggatgtccgtggccaaggtcctgtacgaccgcggcctcacgcccggggagtacgtgtaccagcggatgctggacggccagtacgccatccccgagttctacaagagcgacctgcaggcggagttcgacaagatctggaacctccagaagtcctactaccccgagctgaccgccgagctgtacgacaagctcaccgacaagaacaagagccagacctgggccatctgccgcgacgagctgggcgtgcaggggttcaagtccagcttcacgggcaaggagcggctgaaggaggcctacttcaaccgccagcaggccagcaagcagaaggtcgacctcgaggtgctgacctgcgtgctgcaggacatcaacgggcagaaggcgtccctcagcggcctgctgtccgccatcagcgaccggtccaaggagctctacttcaaccgcatgaccgtcggccagatgctggtgcggcagatccaggaggacccgaaccgcagcctgcgcaacaccgtgttctaccggcaggactacatcgacgagttcgagaagatctggtccgtccagagccgcttccaccccgagctcacgcaggagcggaagaagaagctgaaggacatcatcatcttctaccagcgccccctgaagtcccagaaggggctcatcagcctgtgcgagttcgagtcccgggaggtggacatcagcgtggacggcgtcatcaagaagaagaagatcgggccccgcgtgtgcccgcggtccagccccctgttccaggagttcaaggtgtaccagaccgtcaacaacatcctcgtgaacggcgagcccctggacgacaacgaccgcgagaagctggtgggggagctcgccttccgggagaagatgaagggccaggacgtcctgaagctgctctacaagacctccaagggcatgcgcatcaacttcgaggaggtggaggggaaccggaccatggccacgatcctgaaggcctgcgagaagatcgtcgagggcctggggtacgacacccgcgacctgagcaagatcaccgcgtccgagaaggtgagccggatcgaggagatcttcgccaaggagggcttcaagtccgacttcctccacttcgacagcagcctgccctccccggagttcgagagccaggcctcctacagcctgtggcacctcctgtactcctacgagaacgacaagagcgtgtccgggaacgagagcctggtcgagaagatcaagaagctctgctccatggacgaggccagcgccaagatcctgtccggctgcaccttcctgagcgactacggctccctcagcgcgcgcgccatgcggaagatcctgccctacatgaaggacgggctggagtactccgccgcctgcgccatggcgggctaccgccacagcaagcggtccctcacgaaggaggagctggacagccgcgtgtacgtggaccggctggagctcctgcccaagaacagcctgcgcaaccccgtcgtggagaagatcctcaaccagatgatcaacgtggtcaactccgtggtggacacctacgggaagccggacgagatccgcatcgagatggcccgggagctgaagaagtccgccagcgagcgcgagaaggcccagaaggacatcgcggccgccagcaaggtcaacgagtccatcgtggccaccctgaagggcagccccttcttcatcgactcccccagccggaacgacatcatccgctaccggctctgggaggagctgaagcccaacgggtacaagaccctgtactccggcacgtacatcccgaaggagcgcctcttcagcaaggacttcgacatcgagcacatcatcccccaggccctgctgttcgacgactccttcgcgaacaagaccatcgagagccggcagtgcaacatcgagaagtccaaccgcaccgccatggactacgtcaagagcaagtacgactccttcggcgtgcaggcctacatcgaccgggtgaaggggctcaccggcgtgagcaagacgaagatcacccgcctgctgatggagtccaaggacatccccgaggacttcatcaaccgggagctccgcgacagccagtacatcgcccggaaggcccgcgagatcctggagtccatggtcaagttcgtggtgcccaccaccgggagcgtcacggcgcggctgcgcgaggactggcagctcgtgaacgtgatgcgggagctgaactgggacaagtacgagaagctgggcctcaccagcttccgcgaggaccgggacggccgcgagatcccggtcatcgaggactggaccaagcggaacgaccaccgccaccacgccatggacgccctgaccatcgccttcacccgccggcagttcatccagtacctgaaccacctcaacgccaagatcgacacggtggacaagaccgacatcgacctgcgcgactacaacctggaggacatctccttcgacgggctccgggacggcgacaagttcgggatcgtgaaggcgctgcagaagaagtacctgtacaaggacgacaagcagaagtaccgcttcgtcccgcccatgcccctcgacgagttccggatcgaggccaagcgccagatcgaggacgtgctggtgagcttcaaggccaagaacaaggtctgcaccaagaacgtgaacaccacgaaggtgcggggcgggcagcagcgcaagatccagctgacgccccggggccccctccacgaggacaccatctacggcaagcgcctgcagtacgtcaccaaggaggagaaggtcgggggctccttcgacgaggccaagatcgcgagcgtgtgcaagaagtcctaccgggaggccctgatgcgccggctcatggagtgcgggggcgaccccaagaaggccttcaccgggaagaacagcctggagaagaacccggtgtgggtggacgagttccactccggcgaggtgcccctgcgcgtccggaccgtgagcatggcctccgtgtacaccgtccgcaagagcgtgggccagtccctcaacatcgagaaggtgctggacaagcacatcaaggagatcctgcgggcccgcctcgaggagtacgggggcaacgcgagcaaggccttctccaacctggacgagaaccccatctggctgaacaaggagaaggggatcgccgtcaagcgggtgaccatcgacagcggcaagaaccccatcccgctccgctccaagctggacaaggacgggcagatcatctacggcgagggccagaacccccaggagagcgacttcgtggtccccgggggcaaccaccacgccgccatctaccgcacgccctccgggaagctgcaggacgtggtggtcagcttctacgaggcggtgtcccggaagaacctcggcctggaggtcatcgaccgcaacttcaagaaggacgaggggtgggagttcctgttcaccctcaagcagaacgagtacttcgtgttcccgaaccccgccaccggcttcagccccgaggactacgacctgaccgaccccgccaacaacgccatcatcagcccgaacctgtaccgggtgcagacggtctccgtgggcgactaccgcttccggcaccacctcgagaccaccgtggaggacaacgagaagctgcgcgacatcgcctggaagcggatcgggcccagcggcctggtcggggcggtgaaggtgcgcatcgacaacctcggccggatcctggccgtcggcgagtacgactga

SEQ ID NO: 2093 - RNA, 4179 nt, synthetic construct
  misc_feature 1..4179: note = Cas9 variant
  source 1..4179: mol_type = other RNA
atggagaacaagaactacagcatcggcctggacatcgggaccaactccgtgggctgggccgtcatcaccgacgactacaaggtgcccagcaagaagatgaaggtgttcgggaacacggacaagcacttcatcaagaagaacctcatcggcgccctgctgttcgacgagggggcgaccgccgaggaccgccggctcaagcgcaccgcccggcgccggtacacccgccggaagaaccgcctgcggtacctgcaggagatcttctccgaggagatcagcaagctcgactccagcttcttccaccgcctggacgactccttcctggtcccgaaggacaagcggggcagcaagtaccccatcttcgccacgctcgaggaggagaaggagtaccacaagaagttccccaccatctaccacctccgcaagcacctggccgactccaaggagaagaccgacctgcggctgatctacctggcgctcgcccacatgatcaagtaccgcggccacttcctgtacgaggagagcttcgacatcaagaacaacgacatccagaagatcttcaacgagttcatctccatctacgacaacaccttcgaggggagctccctgagcggccagaacgcccaggtggaggccatcttcacggacaagatctccaagagcgcgaagcgggagcgcgtgctcaagctgttctccgacgagaagtccaccagcctgttcagcgagttcctcaagctgatcgtcgggaaccaggccgacttcaagaagcacttcgacctggaggagaaggcgcccctccagttcagcaaggacacctacgacgaggacctggagaacctgctcggccagatcggggacggcttcaccgacctgttcctggtggccaagaagctctacgacgccatcctgctgtccggcatcctcacggtgaccgacccgagcaccaaggcgcccctgtccgccagcatgatcgagcggtacgagtcccaccagaaggacctggccgccctcaagcagttcatcaagaacaacctgcccaagcgctacaacgaggtcttcagcgaccagtccaaggacgggtacgccggctacatcgacgggaagaccacgcaggaggcgttctacaagtacatcaagaacctgctcagcaagttcgagggcgccgactacttcctggacaagatcgagcgggaggacttcctgcgcaagcagcggaccttcgacaacggctccatcccccaccagatccacctccaggagatgaacgccatcctgcgccgccagggggagcactacccgttcctgaaggagaaccgggagaagatcgagaagatcctcaccttccgcatcccctactacgtgggccccctggcccgggggaaccgcgacttcgcctggctgacccggaacagcgaccaggcgatccgcccctggaacttcgaggagatcgtggacaaggcctccagcgccgaggagttcatcaacaagatgacgaactacgacctctacctgccggaggagaaggtcctgcccaagcactccctgctctacgagaccttcgccgtgtacaacgagctgaccaaggtgaagttcatcgccgagggcctgcgggactaccagttcctcgacagcgggcagaagaagcagatcgtcaaccagctgttcaaggagaagcgcaaggtgaccgagaaggacatcatccactacctgcacaacgtggacggctacgacggcatcgagctcaaggggatcgagaagcagttcaacgcgtccctgagcacgtaccacgacctgctcaagatcatcaaggacaaggagttcatggacgaccccaagaacgaggagatcctggagaacatcgtccacaccctgaccatcttcgaggaccgggagatgatcaagcagcgcctcgcccagtacgactccatcttcgacgagaaggtgatcaaggccctgacccggcgccactacacgggctgggggaagctgagcgccaagctcatcaacggcatctgcgacaagcagaccggggacaccatcctggactacctgatcgacgacggcaagatcaaccggaacttcatgcagctcatcaacgacgacggcctgtccttcaaggagatcatccagaaggcccaggtggtcgggaagaccgacgacgtgaagcaggtcgtgcaggagctgcccggcagcccggccatcaagaaggggatcctccagagcatcaagatcgtggacgagctggtcaaggtgatgggctacgcccccgagtccatcgtgatcgagatggcccgcgagaaccagacgaccgcccgggggaagaagaacagccagcagcgctacaagcggatcgaggactccctgaagaacctcgcgcccggcctggacagcaacatcctgaaggagaaccccaccgacaacatccagctccagaacgaccgcctgttcctgtactacctccagaacggcaaggacatgtacaccgggaagccgctggacatcgaccagctgtccagctacgacatcgaccacatcatcccccaggccttcatcaaggacgactccatcgacaaccgggtcctcacgagctccaaggacaaccgcggcaagagcgacaacgtgccctccctggaggtggtccagaagcgcaaggccttctggcagcagctgctcgacagcaagctgatctccgagcggaagttcaacaacctgaccaaggccgagcgcgggggcctcgacgagcgggacaaggtgggcttcatccgccggcagctggtggagacccgccagatcaccaagcacgtcgcccagatcctggacgcgagcttcaacaccgaggtgaacgagaagaaccagaagatccggacggtgaagatcatcaccctcaagtccaacctggtcagcaacttccgcaaggagttcgagctgtacaaggtgcgggagatcaacgactaccaccacgcccacgacgcctacctcaacgccgtggtcgccaaggcgatcctgaagaagtaccccaagctggagccggagttcgtgtacggggactaccagaagtacgacctcaagcgctacatctcccggttcaagcccagcaaggagatcgagaaggccaccgagaagtacttcttctacagcaacctgctgaacttcttcaaggaggaggtgcactacgccgacggcatcatcgtcaagcgcgagaacatcgagtactccaaggacaccggggagatcgcctggaacaaggagaaggacttcgcgacgatcaagaaggtgctcagctacccccaggtgaacatcgtcaagaagaccgagatccagacccacggcctggaccgggggaagcccaagggcctgttcaactccaacccgagccccaagccctccgaggacagcaaggagaacctcgtgccgatcaagcagggcctggacccccgcaagtacgggggctacgccgggatctccaacagctacgccgtgctggtcaaggccatcgtggagaagggcgccaagaagcagcagaagaccatcctcgagttccaggggatctccatcctggacaagatcaacttcgagaacaacaaggagaactacctgctcaagaagcggtacatcgagatcctgagcacgatcaccctgcccaagtactccctcttcgagttccccgacggcacccgccggcgcctggcgagcatcctgtccaccaacaacaagcggggcgagatccacaaggggaacgagctcgtgctgccgggcaagtacacgaccctgctctaccacgccaagaacatcaacaagaagctggagcccgagcacctggagtacgtcgagaagcaccgcaacgacttcgccaagctcctggagtgcgtgctgaacttcaacgacaagtacgtgggggccctcaagaacggcgagcggatccgccaggccttcaccgactgggagaccgtcgacatcgagaagctgtgcttcagcttcatcgggcccgagaactccaagaacgcgggcctgttcgagctcacgagccagggctccgccagcgacttcgagttcctgggggtgaagatcccccgctaccgggactacgccccgtccagcctgctcaaggccaccctgatccaccagagcatcaccggcctgtacgagacccgcatcgacctctccaagctgggggaggactga

SEQ ID NO: 2094 - RNA, 4179 nt, synthetic construct
  misc_feature 1..4179: note = Cas9 variant
  source 1..4179: mol_type = other RNA
atgaacaacaacaactacagcatcggcctggacatcgggaccaactccgtgggctgggccgtcatcaccgacgactacaaggtgcccagcaagaagatgaaggtgctcgggaacacggacaagcacttcatcaagaagaacctgatcggcgccctcctcttcgacgagggggcgaccgccgaggaccgccggttcaagcgcaccgcccggcgccggtacacccgccggaagaaccgcctgcggtacctgcaggagatcttctccgaggagatgagcaaggtcgactccagcttcttccaccgcctcgacgactccttcctggtgccggaggacaagcggggcagcaagtaccccatcttcgccacgctggccgaggagaaggagtaccacaagaagttccccaccatctaccacctccgcaagcacctggcggactccaaggagaagaccgacctgcggctcatctacctggccctggcccacatgatcaagtaccgcggccacttcctctacgaggagagcttcgacatcaagaacaacgacatccagaagatcttctccgagttcatcagcatctacgacaacaccttcgaggggtccagcctgtccggccagaacgcccaggtggaggcgatcttcacggacaagatcagcaagtccgccaagcgggagcgcatcctgaagctgttcgcctacgagaagtccaccgacctgttcagcgagttcctgaagctcatcgtcgggaaccaggccgacttcaagaagcacttcgacctggaggagaaggcgcccctgcagttcagcaaggacacctacgacgaggacctcgagaacctgctgggccagatcggggacgacttcgccgacctcttcctggtggccaagaagctgtacgacgccatcctcctgagcggcatcctgaccgtgacggactccagcaccaaggccccgctctccgccagcatgatcgagcggtacgagaaccaccagaaggacctggcggccctgaagcagttcatccagaacaacctccaggagaagtacgacgaggtcttctccgaccagagcaaggacggctacgcccgctacatcaacgggaagaccacccaggaggccttctacaagtacatcaagaacctgctgtccaagttcgagggcagcgactacttcctcgacaagatcgagcgggaggacttcctgcgcaagcagcggacgttcgacaacgggtccatcccccaccagatccacctccaggagatgaacgccatcatccgccgccagggcgagcactaccccttcctcaaggagtacaaggagaagatcgagaccatcctgaccttccggatcccctactacgtgggcccgctggcgcgcgggaaccggaacttcgcctggctcacccgcaacagcgaccaggccatccggccctggaacttcgaggagatcgtggaccaggcctccagcgccgaggagttcatcaacaagatgacgaactacgacctgtacctgcccgaggagaaggtcctccccaagcactccctgctgtacgagaccttcgcggtgtacaacgagctgaccaaggtgaagttcatcagcgagggcctccgcgactaccagttcctggactccgggcagaagaagcagatcgtcaaccagctgttcaaggagaagcggaaggtgaccgagaaggacatcatccagtacctccacaacgtggacggctacgacgggatcgagctgaagggcatcgagaagcagttcaacgccagcctgtccacgtaccacgacctcctgaagatcatcaaggacaaggagttcatggacgacccgaagaacgaggagatcctggagaacatcgtccacaccctcaccatcttcgaggaccgcgagatgatcaagcagcggctggcccagtacgccagcatcttcgacaagaaggtgatcaaggcgctgacccgccggcactacacgggctgggggaagctctccgccaagctgatcaacggcatctgcgacaagaagaccgggaagaccatcctggactacctcatcgacgacggctacagcaaccgcaacttcatgcagctgatcaacgacgacgggctgagcttcaaggacatcatccagaaggcccaggtggtcggcaagaccaacgacgtgaagcaggtcgtgcaggagctccccggctcccccgccatcaagaaggggatcctgcagagcatcaagctggtggacgagctcgtcaaggtgatgggccacgcccccgagtccatcgtgatcgagatcgcgcgggagaaccagacgaccgcccgcgggaagaagaacagccagcagcggtacaagcgcatcgaggacgccctgaagaacctggccccgggcctcgactccaacatcctgaaggagcaccccaccgacaacatccagctgcagaacgaccggctgttcctgtactacctgcagaacgggaaggacatgtacaccggcgaggccctcgacatcaaccagctgagctcctacgacatcgaccacatcgtcccccaggcgttcatcaaggacgacagcctggacaaccgcgtgctcacgtccagcaaggacaaccggggcaagtccgacaacgtgcccagcctggaggtcgtgcagaagcgcaaggccttctggcagcagctgctcgactccaagctgatcagcgagcacaagttcaacaacctgaccaaggccgagcgcgggggcctcgacgagcgggacaaggtggggttcatccgccggcagctggtcgagacccgccagatcaccaagcacgtggcccagatcctggacgcccggttcaacaccgaggtgaacgagaaggacaagaagaaccgcacggtcaagatcatcaccctcaagtccaacctggtgagcaacttccggaaggagttcaagctgtacaaggtgcgcgagatcaacgactaccaccacgcgcacgacgcctacctcaacgccgtcgtggccaaggcgatcctgaagaagtacccgaagctggagcccggcttcgtgtacggcgactaccagaagtacgacatcaagcggtacatctcccgcagcaaggaccccaaggaggtcgagaaggccaccgagaagtacttcttctacagcaacctcctgaacttcttcaaggaggaggtgcactacgccgacgggaccatcgtgaagcgggagaacatcgagtactccaaggacacgggcgagatcgcctggaacaaggagaaggacttcgccaccatcaagaaggtcctgagcctcccccaggtgaacatcgtgaagaagaccgagatccagacccacgggctggaccgcggcaagccgcgggggctgttcaactccaaccccagccccaagccctccgaggaccgcaaggagaacctcgtcccgatcaagcagggcctggacccccggaagtacggcgggtacgcgggcatcagcaactcctacgccgtgctggtgaaggccatcatcgagaagggggccaagaagcagcagaagacggtcctcgagttccagggcatcagcatcctggacaagatcaacttcgagaagaacaaggagaactacctgctcgagaaggggtacatcaagatcctgtccaccatcaccctgcccaagtacagcctcttcgagttcccggacggcacccgccggcgcctggcctccatcctgagcacgaacaacaagcggggcgagatccacaaggggaacgagctcgtgatccccgagaagtacaccaccctgctgtaccacgcgaagaacatcaacaagaccctcgagcccgagcacctggagtacgtggagaagcaccgcaacgacttcgccaagctgctcgagtacgtcctgaacttcaacgacaagtacgtgggcgccctgaagaacggggagcggatccgccaggccttcatcgactgggagacggtggacatcgagaagctctgcttctccttcatcggcccccgcaacagcaagaacgccgggctgttcgagctgacctcccagggcagcgcgtccgacttcgagttcctcggcgtcaagatcccgcggtaccgcgactacacccccagctccctgctgaacgccaccctcatccaccagagcatcacggggctgtacgagacccggatcgacctgagcaagctcggcgaggactga

SEQ ID NO: 2095 - RNA, 4179 nt, synthetic construct
  misc_feature 1..4179: note = Cas9 variant
  source 1..4179: mol_type = other RNA
atgaagaactaccacatcggcctggacatcgggaccagctccgtgggcttcgccgcccgcgacgacgagaacaacctcatccgggtcaaggggaagaacgtgatcggcgcgcgcctgttcgccgaggggaagaccgcccaggagcggcgcatggcccggacgagccgccggcgctacaaccggcgcaagtggcggctgcgcctcctgaacgacatcttccacgacgagatcgtgcacaaggacaaggacttcttcaaccggctgaagcagtccagcatctcccccaaggacgaccgcaagaagtacttcggcagcctcctgttcccggagctgtccgacagcgagttctaccacaacggcaaccagaccatctaccacctccggcaccgcctgatgacctccaacgagaaggccgacatccgggagatctacctggcgctccgccacatcgtcaagtaccgggggaacttcctggacgacacccccgtgagctccttcgaggccagcgacctgaagctcggctccttcatccccacgctgaacgacctgttcgagaccatcgacgtgaactacgtcttcaacagcgagaacaccaaccagatcgagtccatcctcctgaacaacgacctgcgcaacagcgacaagtccaagcagctcgtggacctgctgtaccggaacgtgagcgacgtcgacgacaagtccctcgagaagcagttcaacaagttccgcaaggacatcagcaaggagatcgccaagagcttcgtggggtccaagttcaacgtgaacaagctgctggcctacgagaccgacgacggcagcaagatctccctcagcttctccgacgcgagctccgacgacaagatgctggagctggccgacaacctcgacgacgagcgcatcaacatcctgaacgccctgaaggtcatctacagccgggtgcgcctcaaccagatcatccccaacgggatgggcctgtccgagagcatgatcgcctcctacgagctgcacaagaagcagctcaacgacctgaagaagctgctcaacgtgctgccgttccacgagaagtacgccgtcaaggtggcgtacgccgcctacatcggcaacatggacgcccagaagttcacgcaggccgagctgagcaccatcgagtccctcaaggagaaggacagcatcaagaaggtgatcgactgcaagaccgggcacatcaccaacgagtccctgatcagcgtcatcaaccagatcgtggtgaacccctacctggagaactccgacttcgagctcatcgacatcgtcaagaagatcgaccaggacatcaagaacggcgagtacctgctgaagcagcggaacaaccagaacgggaacatcccccaccagctccaccagatggagatggaccagatcatcgagaagcagagcaagtactaccccttcctgggcgagctgaacccgaacgagaaccgccggcacatcgcgaagtacaagatctccgagctggtggccttccgcgtgccctactacgtcggccccctcatcacgcccgaggagcaggccaagaccagcggggccagcttcgcctggatgaagcggaaggaggacggcgagatcaccccgtggaacttcgaccagaaggtggaccgcgaggcgaccgcctcccggttcatcaagcgcctgacggtcaaggacacctacctgttcaacgaggacgtgctccccgacaacagcctgctgtaccagcagttcaaggtgctcaacgagctgaacgtcgtgaaggtgaacaacaagcggctgtcccaggccgagaagcagggggccttcaacgacctcttcaaggtcaccaagaccgtgacggccaagcgcctgaagaactacctggtgagcaacttcaaccacctcgacaccatcgagatcaccggcctgtccgacggggagaagttcaacaacggcctgaccagctacgtcgacttccagaagatcttcggcgacaagatcaacaacctcgagctgatggacgacttcgagtccctgatcgagtggagcacggtgttcgaggaccggcacatcttcgaggagaaggtgcgcaacgagatcaactggatctccgagagcgagctcaagcagctggtcgcgaagcggtactccgggtggggccgcctgagctccaagctcctggtggggatcaacaacgacgagggccggaacatcatcgagcagctgttcgagaccagcgagaccttcatggaggccatctcccgccccgaggtgaagaagcagatcgacgagatcaacagcgacttcatcaagaacaccgacatcgagtccgtcctcgccgacgcctacacgagcccccagaacaagaaggcgatccgggagacctacaagatcgtgaaggacatccagaaggccatgggcgggaaggccccggagagcatctccatcgagttcacccgcaaccccgaggacaagggcgagctgacccgcagccggcactccgagatcagccgcaagtacaaggagctgtccaaggagatcagcaaggagctcaacgacgagctgaagtccaagaagaacagcatggacatcgacaagtactacctgtacttcatgcagatggggaaggacctctacgacggcaagtccatcgacatcgacgacctgaacaactaccagatcgaccacatcgtgccccagagcttctacaaggacgactccttcgacaaccgggtcctgacgtactacaccaacaaccagaagaaggggaacaacacgcccctcaacggcctgaacatcagcaacgagacccgcaagctgtggtcccacctccacgacctggggctgatcagcaagcggaagtacctcaacctgaccatgcagggcctggactccctcagcaagtacaccaagcacggcttcatccgccggcagctggtggagacctcccaggtgatcaagctggtcgccaacatcctcagcgacgagttctccgccgacaacaccaagatcatcgaggtgaaggcgaagatgaacagccagatgcgccacagcttcaacctgtacaagatccgggagctgaacgactaccaccacgccctcgacgcctacctgaccacgttcatcgggggctacctgtacaaccgctacccgaagctccgggggatgttcgtgtacggcgacttcaagaagttcgacgtcaacgacgccaacaacgtgaagaccctgaacttcctgcacgacatcaccaacccctccgacaagttcgtgaaccagatctacgacgagcagagcggcgagctcatcctggaccgcaagcacgccatcgagaccatcaagaagatctaccagtacaagttcatgctgatcacgcgggaggtctccaccaaggacgacaagctcagcgaccagaccgtgtactccgcgaagcgcatcaacaacgtggccagccccatccccgtcaagaaggactccaacccggagctgtacgggttccggaccggcaacgtggaccaccacatggtgatcgtcaagtaccccaagaaggacagcttcgtgtacaaggtggtcgggatccccatccgcttcatgcaggagctgcggtccagcaagaaccagtccgagtacgagaacacgctcaaccagatcgtgcaggccaagctgaaccgcaagaagttcgacttccgggtggtcgtggacaacgtgatgtacggccagctgatccaggacgggggccagaagttcaccctcggcagctccacctaccgctacaacgccaagcagctggtcctggacatggacagcctccggatcctgtccgacgagaagtaccgcaacagcctgaccgacgacgagaagaactccgagttcatcaacatctaccagcaggtcctcaacgtggtgaacgagaagttcgacgtgttcgacgtgcgcgggacgcgggacaagctgaccaagggcctggacaagttcctcaacatcaccagcaacgacaaggagatcgtcctgctgaagatcctctccgggctgcactgcaacgccgcgcgcgtgaagatcaacgagatcggcatcaacaccagcttcggggagctgcagacgacccacggcatcgtgctcagcgagaactcctacatcatctaccagagcccctccggcctgttcgagcggaaggtccgcctgaaggacctctga

SEQ ID NO: 2096 - RNA, 4179 nt, synthetic construct
  misc_feature 1..4179: note = Cas9 variant
  source 1..4179: mol_type = other RNA
atggccaacaagacctggtacctgggcctcgacatcgggagcgcctccgtgggctgggcggccaccgacacggggtacaagatcatccgcaagaacaagaagcggctgtggggcgtccgcctgttcgaggaggccaagaccgccgaggaccggcgcgggtaccggagctcccgccggcgcctcgcccggcgcaagtggcggctgaacctgctcgaggagctgttcaccagcgaggtgaagaaggtggacgagaacttcttcctgcgcctcaaggagtcccagtaccactacgaggacaagacccacaaggtcccctacgcgatcttcaacgacaaggactacacggacaaggactactacaaggactacccgaccatctaccacctccggagcaagctgatgaccgaggagaaccccgacatccgcaaggtgttcctggccatccaccacatcatcaagaaccggggccacttcctgctgcagggccagtccttcaaggacgggaacctcaacaacctgatcaaggagctgctcgagctggacatcctgcacgtgggcttcgaggtcaccgaggaggtggtggacaagatcgccgacatcagcctcgagaagaagacgtccaaggacaagctgaacgacatcaaggagctgtaccccaaggagaagcagctcctggaggtcttccgcctgatcttcgggggcaagaccagcctcgacaagctgttcgccatcgacgagtacaaggagctggacgcggccatcaagtccgtgagcttcaaggagaagatctacgaggaggtgcggcacgactacgagcaggtcctctccaactacatcgagctgctggacctcgccaagctggtgtacgacagcatcatcctgtccgacatcaagaaggaggggaagaccctcagcgagtccaaggtggagctgttcgagaagcaccgcgacgacctgctcaagctgaagaacctggtcaagaacgacagcaagctctccgaggacaagaaggtggagctgtacgccctgatcttcaaggaggacaaggacaagggcaccaactacgtgaactacatccgcaagagcgaggagggcaaggggtgcaactacgaggacttcaagaagttcctcgtcaaggagctggccaagctggaggagagctccgtgaagacggagatcatcaaggacctcgagctggagcagttcctgcccctgcagcggaccaaggacaacagcgtggtcccgtaccagatccacaaggaggagctcgtgaagatcctggacaacgcggcccggtaccactccttcctgaacgagaaggacgagagcggctacaacgtgcgcgagaaggtcatccagctcctggagttccgcatcccctactacgtggggcccctgaactccagcaagaaggccaaggagggcggcttcgcctggtccgtccggaacaccgggtacgagaacacccccgtgacgccgtggaactacagcaaggtgatcgacgagtccgccagcgcggagaagttcatcaccaacctcaccaacaagtgcacctacctgaagggcgaggacgtcctgcccaagtccagcctcctgtactccgagttcgccctgctcaacgagctgaacgccctgaagtacgacgggaaccgcatcagcctcgaggcccggaacacgatcatcgagaagctgttcaagcagcagggcaagaaggtgaccaagacctccatcaagaacctgctcaaggccgaggggtacatcgacggcaagggcgagatcaccgggatcgacatcacggtgaagaacgacctcaagagctaccgcgacttcaagaagatcctgggcaacaagttcaactccgagcacgtcgagaacatcatcctgtggatcaccctgtacggggagagccggaagctgatcaaggcgaagatcgagtccgtgtacggcgaggtgtacagcaaggacgagatcaccaagatgagccgcctcgtctacaaggactgggggcggttctcccgcaagctgctgaccgagctcgtgagcaagaagctgtacaacgaggagacgggcgagtgcctgaacatcatcggcgccatgcggcagaacaacatcctcttcatggagctgctggccgaccgcttcgactactccaagcagatcgtggagttcaacaaggagctccaggaggacgtcaccgagatcgcccccgagatcctggacgacctgtacgtgagccccgccgtgaagcggtccatctggcagaccgtccgcatcgtggaggagctcaagaagatcatcgggtgcgcgccggccaagatcttcgtggagaccacgcggagcaaccaggagaagaagaagcccaccgactcccgcaagaagcagctggagctggcctacaaggccgtcaagaaggacgtgaaggagctcgagaaggagatcggcaccatcaacttcgacgtgctgaacgaccggctgagctccgtcgagcccagcaagctcaaggcgaagaagctgtacctgtactacacccagctcgggcgctgcatgtactccgaggagcccatcaacatcagcgagctgttcgacaacaacaagtacgacatcgaccacatctacccgcagtccaagatcaaggacgacagcttcacgaacaccgtgctggtgaagcgggagtccaacgccgccaagaccgaccgctaccccctcggcagcgacatccagaccccctccaaccggcgcttctggaagttcctgaaggagaaggggctgatcagcgacgagaagtacaaccgcctcgtccggaccgaggagttcagcgacgaggagctgtccggcttcatcgcccgccagctggtggagacgagccagtccgtgaaggccgtcgcgagcatcctcggcgagctgaaccccgagacctccatctgctacagcaaggccgagaacgtgtccagcttccggcagaacttcgggaagatcaagaagggcgaccgcgactccaagaacaacgaccagctgatcaaggtgcgggagatcaacgactaccaccacgccaaggacgcctacctcaacgtcgtggtggggaacgtctacgacaccaagttcacccgcaacgtgttcaacttcatcaaggacaagaaggacggccggaagtacagcctgaacaaggtgttctacgagaacgtctccgacagcaagacggtggcctgggagatggacaagaccatccaccaggtggagaaggtcatgaacaacaacaacatcatggtgacccgccggacctccgagcagaagggcgggctgttcgacgcgacggtgtacaaggccaaggtcgccgccaaggccaaggacggcgtgtactacccgctcaagaccagcaactccgtggtcaaggacgtggcgaagtacgggggctacaccagcatcgggatcgcctactactccatcttcgagtacaccatcgtgaacaagaagggcgaggagaagatcacgcgcatcatccccatccccatctacatcagccagaacatcaaggactccaccgccctgatcgagttcggcaagagccagatcttctgccgggcctacgagaagatcaaggacttcaagctgctctaccgcaagctgtgcatcgggagcaagatcaacatcaacaactaccagtactacatcggcgggaagtccgacgagcggttctactacgacagcgcgatccaggtcaccctggacaagaagtccgagaagtacctcaagatcctgagcaagtaccagaactggaagaaggagaacaaggacggcgagctgtgggagaacatcaccaaggagaacaacatcgagctctacaacaagctggtggagaagatgaactccgagatcttcacgaagaagaagtccaacaagtacaacgagctgaacagcgaggagatccgcaacaacttcatcaagatcagcgtggaggagcaggccaaggtcctcctggagatcctgaacctcctgaccaacaagaagtccatcttcgacctcaagagcatcgacatcaaggccgcccgggggaagatctccttcaacctgaccagcctgatccagttctccatcatcgagcagagcatcaccggcttctacgagaaggagatcacgatcatcggcgacaaggggaacgacatggagaacaacaactcctga

SEQ ID NO: 2097 - RNA, 4179 nt, synthetic construct
  misc_feature 1..4179: note = Cas9 variant
  source 1..4179: mol_type = other RNA
atgaacaacaacaactacagcatcggcctggacatcgggaccaactccgtgggctgggccgtcatcaccgacgactacaaggtgcccagcaagaagatgaaggtgctcgggaacacggacaagcacttcatcaagaagaacctgatcggcgccctgctgttcgacgaggggaccaccgcggaggaccgccggctgaagcgcaccgcccggcgccggtacacgcgccggaagaaccgcctgcggtacctccaggagatcttctccccggagatcagcaaggtcgactccagcttcttccaccgcctggacgactccttcctggtgcccgaggacaagcggggcagcaagtaccccatcttcgccaccctcgccgaggagaaggagtaccacaagaacttccccaccatctaccacctccgcaagcagctggccgactccaaggagaaggcggacctccggctgatctacctggccctcgcccacatgatcaagtaccgcggccacttcctgtacgaggagagcttcgacatcaagaacaacgacatccagaagatcttcaacgagttcatctccatctacgacaacaccttcgaggggagctccctgagcggccagaacgcccaggtggaggcgatcttcacggacaagatctccaagagcgccaagcgggagcgcgtcctcaagctgttcccggacgagaagtccaccgggctgttcagcgagttcctcaagctgatcgtgggcaaccaggccgagttcaagaagcacttcgacctggaggagaaggcgcccctccagttctccaaggacacctacgacgacgacctggagaacctgctcgggcagatcggcgacggcttcgccgagctgttcgtggcggccaagaagctgtacgacgccatcctcctgagcgggatcctgaccgtcacggaccccagcaccaaggcgcccctctccgccagcatgatcgagcggtacgagaaccaccagaaggacctggccgccctgaagcagttcatccagaacaacctccaggagaagtacgacgaggtgttctccgaccagagcaaggacggctacgccgggtacatcaacggcaagaccacccaggaggccttctacaagtacatcaagaacctgctgtccaagttcgagggcagcgactacttcctcgacaagatcgagcgcgaggacttcctgaagaagcagcggacgttcgacaacgggtccatcccgcaccagatccacctccaggagatgaacgccatcatccgccggcagggcgagcactaccccttcctccaggagaacaaggagaagatcaagaagatcctgaccttccgcatcccctactacgtggggcccctggcgcgcggcaacggggacttcgcctggctcacccggaacagcgaccaggccatccgcccgtggaacttcgaggagatcgtcgaccaggcctccagcgccgaggacttcatcaacaagatgaccaactacgacctgtacctgcccgaggagaaggtgctccccaagcactccctgctgtacgagacgttcgcggtgtacaacgagctgaccaaggtcaagttcatcgccgagggcctccgggactaccagttcctggacagcggccagaagaagcagatcgtgaaccagctgttcaaggagaagcgcaaggtgaccgagaaggacatcacccagtacctccacaacgtcgacgggtacgacggcatcgagctgaaggggatcgagaagcagttcaacgcctccctgagcacgtaccacgacctcctgaagatcatcaaggacaaggccttcatggacgacgcggagaacgaggccaccctggagaacatcatccacaccctcaccatcttcgaggaccgggagatgatcaagcagcgcctggcccagtacgactccctgttcgacgagaaggtgatcaaggccctcatccggcgccactacacgggctgggggaagctgagcgccaagctgatcaacggcatctgcgacaagaagaccggcaagaccatcctcgactacctgatcgacgacgggtactccaaccggaacttcatgcagctgatcaacgacgacggcctcagcttcaaggacatcatccagaaggcccaggtggtcgggcgcaccaacgacgtgaagcagatcgtgcacgagctgcccggctccccggccatcaagaaggggatcctgcagagcatcaagatcgtcgacgagctcgtgaagatcatgggccacacgcccgagagcatcgtcatcgagatggcccgggagaaccagaccaccgcccgcggcaagaagaactcccagcagcggtacaagcgcatcgaggacgccctgaagaacctggcgcccgggctcgacagcaacatcctgaaggagtaccccaccgacaacatccagctgcagaacgaccggctgttcctgtactacctgcagaacggcaaggacatgtacacgggggagccgctcgacatcaaccagctgtccagctacgacatcgaccacatcgtgccccaggccttcatcaaggacgactccctggacaaccgcgtgctcaccagctccaaggacaaccggggcaagagcgacaacgtcccctccctggaggtggtgcagaagcgcaaggccttctggcagcagctgctcgacagcaagctgatctccgagcggaagttcaacaacctgaccaaggccgagcgcggcgggctcgacgagcgcgacaaggtcggcttcatccggcgccagctggtggagacccggcagatcaccaagcacgtggcccagatcctggacgcgcgcttcaacacggaggtcaccgagaaggacaagaagaaccggaacgtgaagatcatcaccctcaagagcaacctggtgtccaacttccgcaaggagttcaagctgtacaaggtccgggagatcaacgactaccaccacgcccacgacgcctacctcaacgccgtggtggcgaaggccatcctgaagaagtaccccaagctggagccggagttcgtctacggggactaccagaagtacgacctcaagcgctacatcagccggtccaaggaccccaaggacgtggagaaggccaccgagaagtacttcttctacagcaacctgctgaacttcttcaaggaggaggtgcactacgccgacggcacgatcgtcaagcgcgagaacatcgagtactccaaggacaccggggagatcgcctggaacaaggagaaggacttcgcgaccatcaagaaggtgctcagcctgccccaggtgaacatcgtcaagaagaccgagatccagacgcacggcctggaccggggcaagccccgcggcctcttcaacagcaacccgtcccccaagcccagcgaggactccaaggagaacctggtgccgatcaagcaggggctggacccccggaagtacgggggctacgccgggatcagcaactcctacgccgtgctcgtcaaggccatcatcgagaagggcgccaagaagcagcagaagaccgtgctggagttccagggcatcagcatcctggacaagatcaacttcgagaagaacaaggagaactacctcctggagaaggggtacatcaagatcctgtccaccatcaccctccccaagtacagcctgttcgagttccccgacggcacgcgccggcgcctggcgtccatcctcagcaccaacaacaagcgcggggagatccacaagggcaacgagctggtgatctccgagaagtacaccaccctgctctaccacgccaagaacatcaacaagacgctggagccggagcacctggagtacgtcgagaagcaccggaacgacttcgccaagctcctggagagcgtgctggacttcaacgacaagtacgtgggggccctcaagaacggcgagcggatccgccaggccttcatcgactgggagaccgtcgacatcgagaagctgtgcttctccttcatcggcccccggaacagcaagaacgcggggctgttcgagctcacctcccagggcagcgcctccgacttcgagttcctgggggtgaagatcccccgctaccgcgactacacccccagctccctgctcaacgccacgctgatccaccagagcatcaccggcctgtacgagacccggatcgacctcagcaagctgggggaggactga

SEQ ID NO: 2098 - RNA, 4179 nt, synthetic construct
  misc_feature 1..4179: note = Cas9 variant
  source 1..4179: mol_type = other RNA
atgaacaacaacaactacagcatcggcctggacatcgggaccaactccgtgggctgggccgtcatcaccgacgactacaaggtgcccagcaagaagatgaaggtgctcgggaacacggacaagcacttcatcaagaagaacctgatcggcgccctcctcttcgacgagggggcgaccgccgaggaccgccggttcaagcgcaccgcccggcgccggtacacccgccggaagaaccgcctgcggtacctgcaggagatcttctccgaggagatgagcaaggtcgactccagcttcttccaccgcctcgacgactccttcctggtgccggaggacaagcggggcagcaagtaccccatcttcgccacgctggccgaggagaaggagtaccacaagaagttccccaccatctaccacctccgcaagcacctggcggactccaaggagaagaccgacctgcggctcatctacctggccctggcccacatgatcaagtaccgcggccacttcctctacgaggagagcttcgacatcaagaacaacgacatccagaagatcttctccgagttcatcagcatctacgacaacaccttcgaggggtccagcctgtccggccagaacgcccaggtggaggcgatcttcacggacaagatcagcaagtccgccaagcgggagcgcatcctgaagctgttcgcctacgagaagtccaccgacctgttcagcgagttcctgaagctcatcgtcgggaaccaggccgacttcaagaagcacttcgacctggaggagaaggcgcccctgcagttcagcaaggacacctacgacgaggacctcgagaacctgctgggccagatcggggacgacttcgccgacctcttcctggtggccaagaagctgtacgacgccatcctcctgagcggcatcctgaccgtgacggactccagcaccaaggccccgctctccgccagcatgatcgagcggtacgagaaccaccagaaggacctggcggccctgaagcagttcatccagaacaacctccaggagaagtacgacgaggtcttctccgaccagagcaaggacggctacgcccgctacatcaacgggaagaccacccaggaggccttctacaagtacatcaagaacctgctgtccaagttcgagggcagcgactacttcctcgacaagatcgagcgggaggacttcctgcgcaagcagcggacgttcgacaacgggtccatcccccaccagatccacctccaggagatgaacgccatcatccgccgccagggcgagcactaccccttcctcaaggagtacaaggagaagatcgagaccatcctgaccttccggatcccctactacgtgggcccgctggcgcgcgggaaccggaacttcgcctggctcacccgcaacagcgaccaggccatccggccctggaacttcgaggagatcgtggaccaggcctccagcgccgaggagttcatcaacaagatgacgaactacgacctgtacctgcccgaggagaaggtcctccccaagcactccctgctgtacgagaccttcgcggtgtacaacgagctgaccaaggtgaagttcatcagcgagggcctccgcgactaccagttcctggactccgggcagaagaagcagatcgtcaaccagctgttcaaggagaagcggaaggtgaccgagaaggacatcatccagtacctccacaacgtggacggctacgacgggatcgagctgaagggcatcgagaagcagttcaacgccagcctgtccacgtaccacgacctcctgaagatcatcaaggacaaggagttcatggacgacccgaagaacgaggagatcctggagaacatcgtccacaccctcaccatcttcgaggaccgcgagatgatcaagcagcggctggcccagtacgccagcatcttcgacaagaaggtgatcaaggcgctgacccgccggcactacacgggctgggggaagctctccgccaagctgatcaacggcatctgcgacaagaagaccgggaagaccatcctggactacctcatcgacgacggctacagcaaccgcaacttcatgcagctgatcaacgacgacgggctgagcttcaaggacatcatccagaaggcccaggtggtcggcaagaccaacgacgtgaagcaggtcgtgcaggagctccccggctcccccgccatcaagaaggggatcctgcagagcatcaagctggtggacgagctcgtcaaggtgatgggccacgcccccgagtccatcgtgatcgagatcgcgcgggagaaccagacgaccgcccgcgggaagaagaacagccagcagcggtacaagcgcatcgaggacgccctgaagaacctggccccgggcctcgactccaacatcctgaaggagcaccccaccgacaacatccagctgcagaacgaccggctgttcctgtactacctgcagaacgggaaggacatgtacaccggcgaggccctcgacatcaaccagctgagctcctacgacatcgaccacatcgtcccccaggcgttcatcaaggacgacagcctggacaaccgcgtgctcacgtccagcaaggacaaccggggcaagtccgacaacgtgcccagcctggaggtcgtgcagaagcgcaaggccttctggcagcagctgctcgactccaagctgatcagcgagcacaagttcaacaacctgaccaaggccgagcgcgggggcctcgacgagcgggacaaggtggggttcatccgccggcagctggtcgagacccgccagatcaccaagcacgtggcccagatcctggacgcccggttcaacaccgaggtgaacgagaaggacaagaagaaccgcacggtcaagatcatcaccctcaagtccaacctggtgagcaacttccggaaggagttcaagctgtacaaggtgcgcgagatcaacgactaccaccacgcgcacgacgcctacctcaacgccgtcgtggccaaggcgatcctgaagaagtacccgaagctggagcccgagttcgtgtacggcgactaccagaagtacgacatcaagcggtacatctcccgcagcaaggaccccaaggaggtcgagaaggccaccgagaagtacttcttctacagcaacctcctgaacttcttcaaggaggaggtgcactacgccgacggcaccatcgtgaagcgggagaacatcgagtactccaaggacacgggggagatcgcctggaacaaggagaaggacttcgccaccatcaagaaggtcctgagcctcccccaggtgaacatcgtgaagaagaccgagatccagacccacggcctggaccgcgggaagccgcggggcctgttcaactccaaccccagccccaagccctccgaggaccgcaaggagaacctcgtcccgatcaagcaggggctggacccccggaagtacggcggctacgcggggatcagcaactcctacgccgtgctggtgaaggccatcatcgagaagggcgccaagaagcagcagaagacggtcctcgagttccaggggatcagcatcctggacaagatcaacttcgagaagaacaaggagaactacctgctcgagaagggctacatcaagatcctgtccaccatcaccctgcccaagtacagcctcttcgagttcccggacgggacccgccggcgcctggcctccatcctgagcacgaacaacaagcggggcgagatccacaagggcaacgagctcgtgatccccgagaagtacaccaccctgctgtaccacgcgaagaacatcaacaagaccctcgagcccgagcacctggagtacgtggagaagcaccgcaacgacttcgccaagctgctcgagtacgtcctgaacttcaacgacaagtacgtgggggccctgaagaacggcgagcggatccgccaggccttcatcgactgggagacggtggacatcgagaagctctgcttctccttcatcgggccccgcaacagcaagaacgccggcctgttcgagctgacctcccaggggagcgcgtccgacttcgagttcctcggcgtcaagatcccgcggtaccgcgactacacccccagctccctgctgaacgccaccctcatccaccagagcatcacgggcctgtacgagacccggatcgacctgagcaagctcggggaggactga

SEQ ID NO: 2099 - RNA, 4182 nt, synthetic construct
  misc_feature 1..4182: note = Cas9 variant
  source 1..4182: mol_type = other RNA
atgaagcgcgtgaccgaggactacatcctgggcctcgacatcgggaccaacagctgcggctgggccgtcacggacaagaagaacaacctgctgaagctccgggggaagaccgccatcggctcccacctgttcgaggaggggcacaccgcggccgaccgccggggcttccgcaccacgcggcgccggctgaagcgccggaagtggcgcctccggctgctggaggagatcttcgccgagcccatggccaaggtggacccgggcttcttcgtgcgcctccaccagagctgggtcagccccctggacaagagccggaagaagtaccacgccatcgtgttccccaccgcgaaggaggacaaggccttctaccagaagtaccccaccatctaccacctccgcgacgccctcatgacccaggaccggcagttcgacctgcgcgagatcttcctggccatccaccacatcgtgaagttccgggggaacttcctccaggacacgccggtcaaggacttcgaggcgtccaagatcgaggtgggccccatcctgagcaagatcaacggggccttcgccgagaagatcgtggaggaccaggaccccatcgagctgaacgtcgccaacgccgcggagatcgaggccgtgatccgcggcaaggacgccgacaagaccctctacaagatggacaaggtgaagaagatcgccaagctgctgaccgactccaccgccaaggaggagaagaacgtcgcgaagcagatcgccaacgccgtgatggggtacaagacgcagttcgagaccatcctcggcaaggagatcgacaagagcgacaaggcccagtgggagttcaagctgaccgacggcgacgccgacgacaagctggaggcgctcctgcccgacctggacgagaacgaccagaccatcatcgccgagatcaagaagctgttctccgccatcacgctgagcaccatcgtggacgagaacaagtccctgagccagtccatggtcgccaagtacaacaagcaccaccaggactacaagctcctgaaggcctacatcgacaccctgcaggaccggagcatcgcgaagaagctcctgctggcctacgacctctacgtgaacaaccgccacgggcggctgctggaggccaagaccgagttcaagcaggacggcacgctcaccaaggaggacttctacaagaccgtgaaggacaacctggacgactccgagctggcccgcaagatcgcgcagaagatcgccgccgacaacttcatgccgaagcagcgcaccaacagcaacggggtcatccccttccagctccaccagatcgagctggacaagatcatcgccaaccagtccaagtactaccccttcctggccgcggagaaccccgtggaggaccaccggaagcaggccccgtacaagctcgacgagctggtgcgcttccgggtcccctactacgtgggccccatgatcacgcccgacgagcaggagaagaccagcggcaagtccttcgcctggatggtgcgcaaggaggacgggcagatcaccccgtggaacttcgagcagaaggtcgaccggcaggagagcgccaacaagttcatcaagcgcatgaccatcaaggacacgtacctgctcggcgaggacgtgctgcccgccaacagcctgctgtaccagcggttcgaggtcctcaacgagctgaacaacatccgcatcaacgggtcccggatcagcatcgacctgaagcagcagatcttcaacgacctcttcgaggagaagaagaccgtgaccgagaagtccctgaccagctacctgaagcagaacctccacctccccacggtggagatcaagggcctggcggaccccaccaagttcaactccagcctggcctcctactaccacctcaagagcctgcacgtcttcgacaaggagctggccgacccgcagtaccagaaggacttcgagaagatcatcgagtactccagcatcttcgaggacaagaagatctaccaggacaagctgcacgccgagttcaagtggctgacccccgagcagttcaaggccatctccacctggcgcctccaggggtggggccggctgagctgccgcctgctcgtggagctgcacgacacgaacggccagaacatcatggagcagctgtgggactcccagaagaacttcatgcagatcgtgaccgagcccgacttcaaggacgcgatcgccaaggagaaccagaacgtcacccaggtgaacggggtggaggagatcctcgccgacgcctacaccagccccgcgaacaagaaggccatccggcaggtcgtgaaggtggtcgccgacgtggtgaaggccgccggcgggaagaagccggcgcagttcgccatcgagttcacccgcgaccccgacaagaacccccagctgtcccacatccggggcacgaagctgctcaaggcctaccaggagaccgccggggagctggtcgaccagaagctgaccgacagcctcaaggaggccatgacctcccgcaagctgctgaaggacaagtacttcctctacttcatgcagacgggccgggacgcgtacaccggcaagaagatcaacatcgacgaggtgaccaccaactaccagatcgaccacatcctgccccagagcttcatcaaggacgactccttcgacaaccgcgtgctgacggccaccccgctcaacgccgagaagtccgacgacgtcccctacaagcggttcgccaacaactacgtgagcgacctgaagatgaccgtgggggagatgtggaagcactggcagaaggccggcatcatcaacaagcacaagctggggaacctcctgctggaccccgaccgcctcaacaagttccagaagtccggcttcatcaaccgccagctggtcgagaccagccagatcgtgaagctggtgtccgtcatcctccagaacaagtacccggacgcggagatcatcacggtgaaggccggggacaacagcgccctgcggcagcgcctgaacctctacaagtcccgggacgtgaacgactaccaccacgccatcgacgcgtacctgagcatcatctgcggcaacttcctgtaccaggtctaccccaagtaccgcccctacttcgtgtacggcaagtacaagaagttctcccaggaccccgacctccagaaggacctgatcaagcacttcaaggggttcaccttcatgtggccgctgctccagaaggacaacagcgagcggaaggcccccgaggagatcaaggagaacaactccgagcgcatcgtgttctacaagcaccccgacatcttcgacaagctgcggaaggcctacaactacaagtacatgctggtcagccgcgagaccaccacggagtccagctccatgttcaagatgaccatcttcccccggggcgagcgcgaccggaagaagacccgcaagctcatcccgaaggggaacggcctggaccccaagatctacggcgggtacagcggcaacaccgacgcctacatggtgatcgtgaagatcgacaaggccaaggagtccatctacaaggtcatcggggtgcccatgcgggcgctgacgcgcctcaaccaggccaagaagcagggcaactaccaggaggagctgcaccaggtgctggagccccagatcatgctcgacaagaacgggaagccgaagcggggcgtcaagggcttccgcgtgatcaaggaccacgtgcccttcaagcaggtcgtgctggacggggacaagaagttcatgctgtacagcgcccagtacaagaccaacgccaagcagctcgccctgtcccaggagaccatgcggatcgtgaccgacaacctgaagaagggcgaggaccaggacaagctcctggtcaaggcgtacgacgagatcctgcagaaggtggactgctacctcagcctgttcgacacgagcaacttccgcaacgggctgcacctcggccggaacaagttcatcgacctggaggtgaacgacaagaagatcaccctgtccaacatcctcaacgggctgcacgacaacatggtcctgggcaacctcaagaacatcggcatcgggacgcccctgggccagatgcaggagaagtccgggatcaccctgagccccgaggccgtgctcatcttccagagcccgaccggcctgttcgagaagcgcgtgaagatcgccgacctgtga

SEQ ID NO: 2100 - RNA, 4188 nt, synthetic construct
  misc_feature 1..4188: note = Cas9 variant
  source 1..4188: mol_type = other RNA
atgaagaaggagatcaaggactacttcctgggcctcgacgtggggaccggcagcgtcgggtgggccgtgaccgacacggactacaagctgctgaaggccaaccgcaaggacctctggggcatgcggtgcttcgagaccgcggagaccgccgaggtgcgccggctgcaccgcggggcccggcgccggatcgagcgccggaagaagcgcatcaagctgctccaggagctgttctcccaggagatcgccaagatcgacgagggcttcttccagcggatgaaggagagccccttctacgccgaggacaagaccatcctgcaggagaacgccctcttcaacgacaaggacttcacggacaagacctaccacaaggcgtacccgaccatcaaccacctgatcaaggcctggatcgagaacaaggtcaagcccgacccccgcctgctctacctggcctgccacaacatcatcaagaagcggggccacttcctgttcgagggggacttcgactccgagaaccagttcgacaccagcatccaggccctcttcgagtacctgcgcgaggacatggaggtggacatcgacgcggactcccagaaggtgaaggagatcctgaaggacagctccctcaagaacagcgagaagcagtcccggctgaacaagatcctgggcctcaagcccagcgacaagcagaagaaggccatcacgaacctgatctccgggaacaagatcaacttcgccgacctgtacgacaacccggacctcaaggacgccgagaagaacagcatctccttcagcaaggacgacttcgacgcgctgtccgacgacctggccagcatcctcggcgactccttcgagctgctgctcaaggccaaggccgtctacaactgcagcgtgctgtccaaggtgatcggggacgagcagtacctgagcttcgccaaggtcaagatctacgagaagcacaagaccgacctcaccaagctgaaggcggtgatcaagaagcacttccccaacaactacaagaaggtgttcggctacaaccaggacaacgagagcaagaacaactactccggctacgtcggggtgtgcaagaccaagaacaagaagctggtgatcaacaacagcgtcaaccaggaggacttctacaagttcctcaagcccatcctgtccgccaagagcgagatcaaggaggtgaacgacatcctggccgagatcgagacgggcaacttcctccccaagcagatctccaagagcaacgccgagatcccgtaccagctgcgcaagatggagctggagaagatcctctccaacgccgagaagcacttcagcttcctgaagcagaaggacgagaaggggctgtcccacagcgagaagatcatcatgctcctgaccttcaagatcccctactacatcggccccatcaacgacaaccacaagaagtccttccccgaccggtgctgggtggtcaagaaggagaagtccccgagcggcaagaccaccccctggaacttcttcgaccacatcgacaaggagaagacggcggaggagttcatcaccagccgcaccaacttctgcacctacctgatcggggagtccgtgctccccaagaacagcctgctgtactccgagtacacggtgctgaacgagatcaacaacctccagatcatcatcgacggcaagaacatctgcgacaccaagctgaagcagaagatctacgaggacctgttcaagaagtacaagaagatcacccagaagcagatcagcaccttcatcaagcacgaggggatctgcaacaagacggacgaggtcatcatcctcggcatcgacaaggagtgcacctccagcctcaagagctacatcgagctgaagaacatcttcgggaagcaggtcgacgagatctccaccaagaacatgctcgaggagatcatccggtgggccaccatctacgacgagggcgagggcaagacgatcctgaagaccaagatcaaggccgagtacgggaagtactgcagcgacgagcagatcaagaagatcctgaacctcaagttctccggctgggggcgcctgagccggaagttcctggagaccgtgacctccgagatgcccggcttcagcgagccggtgaacatcatcacggccatgcgcgagacccagaacaacctcatggagctgctgtccagcgagttcaagttcaccgagaacatcaagaagatcaactccgggttcgaggacgccgagaagcagttcagctacgacggcctcgtgaagcccctgttcctgtcccccagcgtcaagaagatgctctggcagaccctgaagctggtgaaggagatctcccacatcacgcaggcgcccccgaagaagatcttcatcgagatggccaagggcgccgagctcgagcccgcccgcaccaagacccggctgaagatcctgcaggacctctacagctcctgcaagaacgacgcggacgccttcagctccgagatccagtacctgagcgggaagatcgagaacgaggacaacctgcgcctccggagcgacaagctgtacctgtactacacccagctcggcaagtgcatgtactgcgggaagcccatcgagatcggccacgtgttcgacacctccaactacgacatcgaccacatctacccccagagcaagatcaaggacgactccatcagcaaccgcgtcctggtgtgctccagctgcaacaagaacaaggaggacaagtacccgctgaagtccgagatccagagcaagcagcgggggttctggaacttcctccagcgcaacaacttcatctccctggagaagctgaaccggctcacgcgcaccacccccatcagcgacgacgagaccgccaagttcatcgcccggcagctggtggagacgcgccaggccaccaaggtcgcggccaaggtgctggagaagatgttccccgagaccaagatcgtgtactccaaggccgagaccgtcagcatgttccggaacaagttcgacatcatcaagtgccgcgagatcaacgacttccaccacgcccacgacgcctacctcaacatcgtggtgggcaacgtctacaacacgaagttcaccaacaacccctggaacttcatcaaggagaagcgggacaacccgaagatcgcggacacctacaactactacaaggtgttcgactacgacgtgaagcgcaacaacatcaccgcctgggagaagggcaagacgatcatcaccgtcaaggacatgctgaagcggaacacccccatctacacccgccaggccgcctgcaagaagggcgggctgttcgaccagacgatcatgaagaaggggctcggccagcaccccctgaagaaggagggcccgttctccaacatcagcaagtacgggggctacaacaaggtgtccgccgcgtactacaccctgatcgagtacgaggagaaggggaacaagatccggagcctcgagaccatccccctgtacctggtgaaggacatccagaaggaccaggacgtcctcaagtcctacctgaccgacctgctcggcaagaaggagttcaagatcctggtgcccaagatcaagatcaacagcctgctcaagatcaacgggttcccctgccacatcacgggcaagaccaacgactccttcctgctgcgcccggccgtgcagttctgctgcagcaacgacgaggtcctctacttcaagaagatcatccggttcagcgagatccgctcccagcgcgagaagatcggcaagaccatcagcccctacgaggacctgtccttccggagctacatcaaggagaacctgtgcaagaagaccaagaacgacgagatcggggagaaggagttctacgacctcctgcagaagaagaacctggagatctacgacatgctcctgacgaagcacaaggacaccatctacaagaagcgccccaactccgccaccatcgacatcctggtgaagggcaaggagaagttcaagagcctcatcatcgagaaccagttcgaggtgatcctggagatcctgaagctgttctccgccacccggaacgtcagcgagctgcagcacatcgggggctccaagtacagcggggtggcgaagatcggcaacaagatctccagcctggacaactgcatcctcatctaccagtccatcacgggcatcttcgagaagcgcatcgacctgctgaaggtgtga

SEQ ID NO: 2101 - RNA, 4188 nt, synthetic construct
  misc_feature 1..4188: note = Cas9 variant
  source 1..4188: mol_type = other RNA
atgaagaaggagatcaaggactacttcctgggcctcgacgtggggaccggcagcgtcgggtgggccgtgaccgacacggactacaagctgctgaaggccaaccgcaaggacctctggggcatgcggtgcttcgagaccgcggagaccgccgaggtgcgccggctgcaccgcggggcccggcgccggatcgagcgccggaagaagcgcatcaagctgctccaggagctgttctcccaggagatcgccaagatcgacgagggcttcttccagcggatgaaggagagccccttctacgccgaggacaagaccatcctgcaggagaacaccctcttcaacgacaaggacttcacggacaagacctaccacaaggcgtacccgaccatcaaccacctgatcaaggcctggatcgagaacaaggtcaagcccgacccccgcctgctctacctggcctgccacaacatcatcaagaagcggggccacttcctgttcgagggggacttcgactccgagaaccagttcgacacgagcatccaggccctcttcgagtacctgcgcgaggacatggaggtggacatcgacgcggactcccagaaggtgaaggagatcctgaaggacagctccctcaagaacagcgagaagcagtcccggctgaacaagatcctgggcctcaagcccagcgacaagcagaagaaggccatcaccaacctgatctccgggaacaagatcaacttcgccgacctgtacgacaacccggacctcaaggacgccgagaagaacagcatctccttcagcaaggacgacttcgacgccctgtccgacgacctggcgagcatcctcggcgactccttcgagctgctgctcaaggccaaggccgtctacaactgcagcgtgctgtccaaggtgatcggggacgagcagtacctgagcttcgccaaggtcaagatctacgagaagcacaagaccgacctcaccaagctgaagaacgtgatcaagaagcacttccccaaggactacaagaaggtgttcggctacaacaagaacgagaagaacaacaacaactacagcggctacgtcggggtgtgcaagacgaagtccaagaagctgatcatcaacaacagcgtgaaccaggaggacttctacaagttcctcaagaccatcctgtccgccaagagcgagatcaaggaggtcaacgacatcctgaccgagatcgagaccggcacgttcctccccaagcagatctccaagagcaacgcggagatcccctaccagctgcgcaagatggagctggagaagatcctctccaacgccgagaagcacttcagcttcctgaagcagaaggacgagaaggggctgtcccacagcgagaagatcatcatgctcctgaccttcaagatcccgtactacatcggccccatcaacgacaaccacaagaagtccttccccgaccggtgctgggtgatcaagaaggagaagtcccccagcggcaagaccaccccgtggaacttcttcgaccacatcgacaaggacaagacggccgaggccttcatcaccagccgcaccaacttctgcacctacctggtgggggagtccgtcctccccaagagctccctgctgtacagcgagtacacggtgctgaacgagatcaacaacctccagatcatcatcgacggcaagaacatctgcgacatcaagctgaagcagaagatctacgaggagctgttcaagaagtacaagaagatcacccagaagcagatctccaccttcatcaagcacgaggggatctgcaacaagaccgacgaggtgatcatcctcggcatcgacaaggagtgcacgagcagcctgaagtcctacatcgagctgaagaacatcttcgggaagcaggtcgacgagatcagcaccaagaacatgctcgaggagatcatccggtgggccaccatctacgacgagggcgagggcaagaccatcctgaagacgaagatcaaggcggagtacgggaagtactgctccgacgagcagatcaagaagatcctgaacctcaagttcagcggctgggggcgcctgtcccggaagttcctggagaccgtgaccagcgagatgcccggcttctccgagcccgtgaacatcatcaccgccatgcgcgagacgcagaacaacctcatggagctgctgagctccgagttcaagttcaccgagaacatcaagaagatcaacagcgggttcgaggacgccgagaagcagttctcctacaacggcctcgtcaagccgctgttcctgagcccctccgtgaagaagatgctctggcagaccctgaagctggtcaaggagatcagccacatcacccaggccccgcccaagaagatcttcatcgagatggccaagggcgcggagctcgagcccgcccgcaccaagacgcggctgaagatcctgcaggacctctacaacaactgcaagaacgacgccgacgccttctccagcgagatcaaggacctgtccgggaagatcgagaacgaggacaacctgcgcctccggagcgacaagctgtacctgtactacacccagctcggcaagtgcatgtactgcgggaagcccatcgagatcggccacgtgttcgacaccagcaactacgacatcgaccacatctacccccagtccaagatcaaggacgacagcatctccaaccgcgtgctggtctgcagctcctgcaacaagaacaaggaggacaagtaccccctcaagagcgagatccagtccaagcagcgggggttctggaacttcctccagcgcaacaacttcatcagcctggagaagctgaaccggctcacccgcacgaccccgatctccgacgacgagaccgcgaagttcatcgcccggcagctggtggagacccgccaggccacgaaggtggccgccaaggtcctggagaagatgttccccgagaccaagatcgtgtacagcaaggcggagaccgtgtccatgttccggaacaagttcgacatcatcaagtgccgcgagatcaacgacttccaccacgcccacgacgcctacctcaacatcgtcgtgggcaacgtgtacaacaccaagttcacgaacaacccctggaacttcatcaaggagaagcgggacaaccccaagatcgccgacacctacaactactacaaggtcttcgactacgacgtgaagcgcaacaacatcaccgcctgggagaagggcaagaccatcatcacggtgaaggacatgctgaagcggaacaccccgatctacacccgccaggcggcctgcaagaagggcgggctgttcgaccagaccatcatgaagaaggggctcggccagcaccccctgaagaaggagggcgccttcagcaacatctccaagtacgggggctacaacaaggtcagcgccgcctactacacgctgatcgagtacgaggagaaggggaacaagatccggtccctcgagaccatccccctgtacctggtgaaggacatccagaaggaccaggacgtgctcaagagctacctgaccgacctgctcggcaagaaggagatcaagatcctggtcccgaagatcaagatcaactccctgctcaagatcaacgggttcccctgccacatcaccggcaagacgggcgacagcttcgtgctgcgccccgcggtgcagttctgctgctccaacgacgaggtcctgtacttcaagaagatcatccggttcaacgagatccgcagccagcgcgagaagatggggaagaccatcagcccctacgaggacctctccttccggagctacatcaaggagaacctgtgcaagaagaccaaggccgacgagatcggcgagaaggagttctacgacctgctccagaagaagaacctggagatctacgacatgctgctcaccaagcacaaggacacgatctacaacaagcgcccgaactccaccaccctggggatgctgaccaagggccggtacgagttcatcaacctcaagcccaaggaccagatcatcgtgatgctggagatcctgaagctgttctgcacgacccgcgaggccatcgacctggggctgatcaagggcaagcccgccgcgggcgtggccaccctcgggaagaagatcagcaaccccgacaactgcatcctgatctaccagtccatcaccggcatcttcgagaagcggatcgacctgctcaaggtctga

SEQ ID NO: 2102 - RNA, 4188 nt, synthetic construct
  misc_feature 1..4188: note = Cas9 variant
  source 1..4188: mol_type = other RNA
atgggcgacaccgtgaagaactaccacatcgggctggacatcggcaccagctccgtcgggttcgccgcccgcgacgacgacaacaacctcatccgggtgaagggcaagaacgtgatcgggacccgcctgttcagcgagggccagaccgcgcaggagcggcgcatggcccgggcctcccgccggcgctacaaccggcgcaagtggcggctgcgcctcctggacgagatcttccacgacgagatcatccacaaggacgccgagttcttcaaccggctgaagcagagctccctcagccccaaggacgagcgcaagcagtacttcggctccctgctgttcccggaggtcggggacagcgagtactaccacgacggcaaccagaccatctaccacctccggcaccgcctgatgacccaggacgagaaggccgacatccgggagatctacctggcgctccgccacatcatcaagtaccgggggaacttcctggacgacacgcccgtgtccagcttcgaggcctccgacctgaagctcgccagcttcgtgcccaccctgaacgacctgttcgagaccatcgacgtcaactacgagttctccatggacaacatcaacgagatcgaggacatcctcctgaacaacaagctgcgcaacagcgacaagtccaagcagctccccgacctgctgaccgagccgatcgtgaacatcgacgacaagagcctcgagaagcagttcaacaaggagcggacggacatctccaaggagatcgccaagagcgtggtcggctccaagatgaacgtgaacaagctgctgagcttcgagagctccgggggctacaagatcgcgttcagcttctccgacgccagctccgaggacaagatgatggagctcagcgacgtgctggacgactcccgcatgaacatcctgaacatcctcaaggtcatctacagccgcgtgcggctgaaccagatcatcccctccggcatggggctgagcgagtccatggtggccgcctacgacctccacaagcagcagctgaaggacctgaagaagctcctgaacgtcctgcccttcaacgagcgctacgccgtgaagatcgcgtacgccgcctacatcggcaacatcgacaagcagaagttcaccaagagcgaggtgaagaccatcgacaagctcaaggagaagtccgccatcatgaacgtcctggacttcaagagcgggcacatcaccaacgaggagctgtccaacgtgatcaaggtggtcatcgtggacaagtacctcaacgacgagaacttcgagtaccacagcatcgtggagaagatcaaccaggacatctccaacggcagctacctgctgaagcagcggaacaaccagaacggcaacatcccccaccagctccaccagatggagctggaccagatcatcgagaaccagtccaagtactacccgttcctgggggagctcaaccccaacagcaaccgcaaccacatcgccaagtacaagatcagcgagctggtcgcgttccgggtgccctactacgtcggccccctgatcacgccggaggagcaggagaagacctccggggccagcttcgcctggatgaagcgcaaggaggacggcgccatcaccccctggaacttcgaggagaaggtggacaaggaggagaccgcctcccggttcatcaagcgcctgacggtgaaggacacctacctcctgaacgaggacgtcctgcccgacaacagcctcctgtacgagaagttcaaggtgctgaacgagctcaacgtggtcaaggcgaacaacaagcggctgaccgtggaggagaagcagggggccttcgacaacctgttcaagaagatgaagaccgtgacggccaagaagctcaagaactacctggtctccaaccacaaccacatcaacagcgtggagatcaccggcctgtccgacgtggacaagttcaacaacagcctctccacctacatcgacttcaagaagatcttcgacgacaagatcgacaaccccgacctgctggacgacttcgaggacatcatcgagtggagcaccgtcttcgaggaccgcaagatcttcgaggagaaggtgcggaaggacatctcctggatcagcgagtccgagatcaaggccgtggtcagcaagcgctactccggctgggggcggctcagcaagaagctgctgaacggcatcacgaacaacgaggggcgcaacatcatcgacgagctctgggaggagtccgagaccttcatggaggccgtgagcaagccggaggtgaaggagcagatcgacggcatcaacagcgacttcatcaagaacaccgacatcgagtccgtcctggcggacgcctacaccagcccccagaacaagaaggccatccgggagacgcacaagctggtgaaggacatccagaaggccatgggcgggcaggcgcccgcctccatcagcatcgagttcacccgcaacccccaggacaagggccagctcacccggtcccgccacagcgaggtgtcccggaagtacaaggagatcagcaaggaggtctccaagaccctgaacgacgagctcaagagcaagaagaactccatggacgtggacaagtactacctgtacttcatgcagatggggatcgacctgtacgacggcagctccatcgacatcgacgacctgaacaactaccagatcgaccacatcatcccgcagagcttctacaaggacgactccttcgacaaccgcgtgctcacgcactacagcaacaaccagaagaaggggaacaacacgcccctgaacggcctgaacatcgacgacaagacccgcgccatctggaaccacctccgggacctggggctgatcaccaagaagaagtacaacggcctcaccctgaagggcatggaccagctgtccaagtacaccaagcacgggttcatccgccggcagctcgtcgagaccagccaggtgatcaagctggtggccaacatcctgtccgacgagttcagcaccgacgacaccaagatcatcgaggtcaaggccaagatgaacagccagatccgccaggtgttcaacctctacaaggtgcgggagctgaacgactaccaccacgcggtcgacgcctacctgacgaccttcatcggcgggtacctctacaaccgctaccccaacctgcggaacatgttcgtgtacggcgacttcaagaagttctccgccgacgtggacaacctgaagaccttcaacttcctccacgacatcaccaaccccagcgacaagttcgaggaccgcatcttcgacgagaagtccggcgagctgatcctggaccggaagcacgccatcgagacgatcaagaagatctaccagtacaagtacatgctcatcacccgcgaggtcagcaccaagaacgggcagctgtccgaccagaccgtgtacagcgccaagcggatcaacaacgtgaaggcgccgatccccgtcaagaaggactccaaccccgagctgtacggcttccgcacggggaacgtggaccaccacatggtgatcgtcaagtaccccaagaaggacagctacgactacaaggtggtgggcatcccgctccggttcgtccagaagctgaaggagaccaaggacaacaaggactacgagaacctgctcaaccagatcgtgcagatgaagctgaaccgcaagaagcaggacttcatcgtggtcgtggacaacgtgatgtacgggcagctgatccaggacggcggcgagaagtacaccctcgggtccagcacctacaagtacaacgccaagcagctggtcatcaacatggacaagacgcggatcctggaggacaaccgctacctcaactccctggacgagggcgaggtgagcgagaagctggtgaacatctacaacgacatcatgaaggtcgtgaactcccggttcgacctcttcgacatcaacaagttccgcgagaagctgaacgacgggctgaacaagttcaagaacatcagcaacgagcagaaggaggagaccctcctgaagatcctgtccggcctccactgcgggagcgccaacgtccccatcaaggagctgggcctgaccacgcccctcggcaagctgcagctgccgtccgggatcgtgctcagcgaggaggccgtggtcatctaccagtcccccagcggcctgttcgagaacaaggtgcggctgaaggacctctga

SEQ ID NO: 2103 - RNA, 4188 nt, synthetic construct
  misc_feature 1..4188: note = Cas9 variant
  source 1..4188: mol_type = other RNA
atgaagaaggagatcaaggactacttcctgggcctcgacgtggggaccggcagcgtcgggtgggccgtgaccgacacggactacaagctgctgaaggccaaccgcaaggacctctggggcatgcggtgcttcgagaccgcggagaccgccgaggtgcgccggctgcaccgcggggcccggcgccggatcgagcgccggaagaagcgcatcaagctgctccaggagctgttctcccaggagatcgccaagaccgacgagggcttcttccagcggatgaaggagagccccttctacgccgaggacaagacgatcctgcaggagaacaccctcttcaacgacaaggacttcgcggacaagacctaccacaaggcctacccgaccatcaaccacctgatcaaggcctggatcgagaacaaggtcaagcccgacccccgcctgctctacctggcctgccacaacatcatcaagaagcggggccacttcctgttcgagggggacttcgactccgagaaccagttcgacacgagcatccaggccctcttcgagtacctgcgcgaggacatggaggtggacatcgacgcggactcccagaaggtgaaggagatcctgaaggacagctccctcaagaacagcgagaagcagtcccggctgaacaagatcctgggcctcaagcccagcgacaagcagaagaaggccatcaccaacctgatctccgggaacaagatcaacttcgccgacctgtacgacaacccggacctcaaggacgccgagaagaacagcatctccttcagcaaggacgacttcgacgcgctgtccgacgacctggccagcatcctcggcgactccttcgagctgctgctcaaggccaaggccgtctacaactgcagcgtgctgtccaaggtgatcggggacgagcagtacctgagcttcgccaaggtcaagatctacgagaagcacaagaccgacctcaccaagctgaagaacgtgatcaagaagcacttccccaaggactacaagaaggtgttcggctacaacaagaacgagaagaacaacaacaactacagcggctacgtcggggtgtgcaagacgaagtccaagaagctgatcatcaacaacagcgtgaaccaggaggacttctacaagttcctcaagaccatcctgtccgccaagagcgagatcaaggaggtcaacgacatcctgaccgagatcgagaccggcacgttcctccccaagcagatctccaagagcaacgcggagatcccctaccagctgcgcaagatggagctggagaagatcctctccaacgccgagaagcacttcagcttcctgaagcagaaggacgagaaggggctgtcccacagcgagaagatcatcatgctcctgaccttcaagatcccgtactacatcggccccatcaacgacaaccacaagaagttcttccccgaccggtgctgggtggtgaagaaggagaagtcccccagcggcaagaccaccccgtggaacttcttcgaccacatcgacaaggagaagacggccgaggccttcatcacctcccgcaccaacttctgcacctacctggtcggggagagcgtgctccccaagtccagcctgctgtactccgagtacacggtgctgaacgagatcaacaacctccagatcatcatcgacggcaagaacatctgcgacatcaagctgaagcagaagatctacgaggacctgttcaagaagtacaagaagatcacccagaagcagatcagcaccttcatcaagcacgaggggatctgcaacaagaccgacgaggtcatcatcctcggcatcgacaaggagtgcacgtccagcctcaagagctacatcgagctgaagaacatcttcgggaagcaggtcgacgagatctccaccaagaacatgctcgaggagatcatccggtgggcgaccatctacgacgagggcgagggcaagaccatcctgaagacgaagatcaaggccgagtacgggaagtactgcagcgacgagcagatcaagaagatcctgaacctcaagttctccggctgggggcgcctgagccggaagttcctggagaccgtgacctccgagatgcccggcttcagcgagcccgtgaacatcatcaccgccatgcgcgagacgcagaacaacctcatggagctgctgtccagcgagttcaccttcaccgagaacatcaagaagatcaactccgggttcgaggacgccgagaagcagttcagctacgacggcctcgtgaagccgctgttcctgtcccccagcgtcaagaagatgctctggcagaccctgaagctggtgaaggagatctcccacatcacccaggccccgcccaagaagatcttcatcgagatggcgaagggcgccgagctcgagcccgcccgcacgaagacccggctgaagatcctgcaggacctctacaacaactgcaagaacgacgccgacgcgttcagctccgagatcaaggacctgagcgggaagatcgagaacgaggacaacctgcgcctccggtccgacaagctgtacctgtactacacccagctcggcaagtgcatgtactgcgggaagcccatcgagatcggccacgtgttcgacaccagcaactacgacatcgaccacatctacccccagagcaagatcaaggacgactccatcagcaaccgcgtcctggtgtgctccagctgcaacaagaacaaggaggacaagtaccccctgaagtccgagatccagagcaagcagcgggggttctggaacttcctccagcgcaacaacttcatctccctggagaagctgaaccggctcacgcgcgccaccccgatcagcgacgacgagaccgccaagttcatcgcccggcagctggtggagacccgccaggccacgaaggtcgcggccaaggtgctggagaagatgttccccgagaccaagatcgtgtactccaaggccgagaccgtcagcatgttccggaacaagttcgacatcgtgaagtgccgcgagatcaacgacttccaccacgcccacgacgcctacctcaacatcgtggtcggcaacgtgtacaacaccaagttcacgaacaacccctggaacttcatcaaggagaagcgggacaaccccaagatcgcggacacctacaactactacaaggtgttcgactacgacgtcaagcgcaacaacatcaccgcctgggagaagggcaagaccatcatcacggtgaaggacatgctgaagcggaacaccccgatctacacccgccaggccgcctgcaagaagggggagctgttcaaccagaccatcatgaagaagggcctcgggcagcaccccctgaagaaggagggccccttctccaacatcagcaagtacggcgggtacaacaaggtgtccgccgcgtactacacgctgatcgagtacgaggagaagggcaacaagatccggagcctcgagaccatcccgctgtacctggtcaaggacatccagaaggaccaggacgtgctcaagtcctacctgaccgacctgctcgggaagaaggagttcaagatcctggtgcccaagatcaagatcaacagcctgctcaagatcaacggcttcccctgccacatcaccgggaagacgaacgactccttcctgctgcgccccgccgtccagttctgctgcagcaacaacgaggtgctctacttcaagaagatcatccggttctccgagatccgcagccagcgcgagaagatcggcaagaccatcagcccgtacgaggacctgtccttccggagctacatcaaggagaacctgtggaagaagaccaagaacgacgagatcggcgagaaggagttctacgacctcctgcagaagaagaacctggagatctacgacatgctcctgaccaagcacaaggacacgatctacaagaagcgccccaactccgccaccatcgacatcctggtgaaggggaaggagaagttcaagagcctcatcatcgagaaccagttcgaggtcatcctggagatcctgaagctgttctccgccacccggaacgtgagcgacctgcagcacatcggcgggtccaagtacagcggcgtggcgaagatcgggaacaagatctccagcctggacaactgcatcctcatctaccagtccatcaccggcatcttcgagaagcgcatcgacctgctgaaggtctga

SEQ ID NO: 2104 - RNA, 4188 nt, synthetic construct
  misc_feature 1..4188: note = Cas9 variant
  source 1..4188: mol_type = other RNA
atgaacgccaaccgcgagatggcctactacatcggcatcgacatggggaccggcagcgtggggatggcgatcaccgacgagaactacaacctgctcaaggtcaagggccaggactactggttcgtgcgggagttcgagacggccaacacccagatcaagcgccggatgcaccgcatctccaagcggcgcctgcggcgccaccaggtgcgggtcgccctgatccgcagctacttcgccgaggagatcctcaagaacgaccccctgttcttcatccggcaggacaactccatctactacctggaggacaaggacagcgtgctcaagaccaaggactgcctgttcgccgactacaactaccacgacaagaactactacaaggactacccgaccatcttccacctccgccaggcgttcatcaaggacacggtgaaggacgacgagaaccacacccggtacgcccgcctcctgtacctggccatcatcaacatgttcgagcaccgggggcacttcctcctgaactccgtcagcgaggacatcaacaaggagatggtgaaggacgccggcgagggcttcaccctgtacctccaggagcgcatcaaggagatcaagcccgtgtcctacagcgacatcctggacgtcctggtggagaagaacatctcccggagcgagaagaaggagcgcatcgtggagctgttcgggatcaagaagtcctgcaagaacggcatggagatcatcaagtgcctgtgcgggctggaggcgaacgtcgccatcatgttcaacctcgacgacatcgagaacaagctgaccatcgtggtgagcaaggacgactacgaggacaagctggccgaggtccagcccctcgtggacgaggagtccttcgagctgctgagccggatcaagcagctctacgactactcccagctgcagagcatcctgaagggctacaaggagaaggaggacggggaggacaagtacctctccgacgtgcgcgtcgagctgtacgagaagcacaaggccgacctgaagctcctgaagaaggtgtacaagcgggacctggacaagaagggcaagatctgcgagggcaagaacatccagcgcagctccaagtacaacttcatgttccgcagcgggaaggacggcacgtacagcgcctacaccaactccctcaacagcttctgctccaagaccatcgagaacaagtaccggcgcaacatgaagaaccgggaccgcgcgagcctgtacgacaccatcaagaaggacctgtccgggatcgagaacgacgacgtgaagaagatcctccgggacatcgagacggagaagttcctgcccaagcagatcaccggcgagaacggcgtcatcccgaaccagatccacgccaaggagctgaaggccatcctcaagaacgccgagaagcacctccccttcctgaccgagaaggacgacagcgggctgaccgtgtccgagcgcatcatcagcctgttccggtactgcatcccctactacatcggccccgtggggaaggactcccgcacgggctgggccagcatcaaggaggaggggcagatcttcccgtggaacatcgagcagaagatcgacgtcgacaagacctccgaggagttcatcacccggctgatcaagacctgcacgtacctcagcaacgagaaggtggtccccaagcagtccctggtgtacgagcgctactgcgtgctgaacgagatcaacaacatcaagatccggggcaagcgcatcgacccccagctgaagcaggagatcttcaaggagctctacatcggcagcaagtgcgggaagaaggtcacccggaagaacctgtgccagtacctggtgaacaagggcgcgatcgaggaggactccgagatcagcgggatcgacaaggacctcaacacctacatgtccagctacggcaagatgtaccagatcttcggggacaagatcaagcgcgacgacatcaaggaggtggccgaggagatcatctactacggcaccatctacggcggggccaaggagatgttcaagaagaagatcgagcagtacgtctccgaggacatcctggacgaggcccagatgaaccggatcctgggcttcaagttcaaggactgggcccgcctcagcaagaagttcctgtacctggaggggtacgacaagggcaaccagaaccagctcacgaccctgatgcaggcgctgtgggactacaacctcaacaccatggagctgatgaacagccccatgttcaccttcaaggagacgctggagaagcagaagaacaagatggagaaggtgctctgcgacttcgagtacgaggacctggacgagtactacttctccgccccggtgaagcggatggtctggcagaccatcgcctgcctgaaggaggtggtgcagatcatggggcacaaccccaagcgcatcttcatcgagatgccccgggccgacgaggagaagggcgagcagggccgcaaggccagccgcaagaaccggctcctgtccctgtacgaggagatcgaggacgagcgcccctggaagaaggagatcgagaacgcggccgagagcgggcggctcaactccaagcgcatgtacctgtactacctgcagatgggcaaggacgcctacaccggggaggacatcgacatcgaggacctcttcgacaacagcaagtacgacatcgaccacatctacccgcggtccctgaccgacgacaacagcctggagaacaacctcgtcctggtgtccgccacgatcaaccaggacgtgaagaagaacgactaccccatcccctacgacaagatccgcggcaacagcaaggtccgggagctgtggcgcttcctccacgagaagaagttcatgaacgacgagaagtacaaccggctgatgtccgacgtgcccctgacccaggagcagctcgcgggctacatcgcccgccagctggtggagaccgcccaggggaccaagggcatcgccgacatcatcaagagcgtcatcccggacgccgacatcatctactccaaggcgaagaacgtgagcgacttccggaagcgctacgggatgctgaagtcccggctcacgaacgacttccaccacgccaaggacgcctacctgaacgtggtcgtgggcaacgtgtacttcaccaagttcacccagaacccccgcaagtacatcaaggacgagaacgacatcgagaacaagaagtacaactacaacctgagcaagatgtacgacaaggacgtcatccggaacgggaaggtggcctggatcgcccagaacggcaagaaggcgggcaccatccagaccatcaagaaggtgatggaccgcaacacgcccatcatcacccggcaggccttcgagcagcgcggggagctctacgacctgcagcccatctccaagcacaaggccaagaaggagaactacgtcccgatcaaggccaccaacgagaagatgaaggacgtgaccaagtacggcgggttcacgagcctgaaccccgcctacttcgtgttcgtcgagtacggcagcgcgaagaagcggcagcgctgcttcgccgtggtgcactcctactgggccagctccatcaagaacaacgaggacctcgtcacccacctgaaggaccgggggtacgagaaccccatcgtgatcgccgacaagatcaagaagaacagcctgatcaagtacaacggctacttcctctacatcgtgggcatggacgcgcgcaagcaggtcgagttctccaacgccaccagcatgtgcctgaacaacaacttcatccagtacatccagaagatcgagaaggccaacaccctgatcgccgaggccaagaagcgccggccctacatcgacgagtccatcacggcggagcgcaacatcgccctctacaacgagctgaagaagaagcacctggacagcatcttcaagaaccacccgaaggggatcggctccgtgctcgagagcggggagggcgccttcgtgcagctgtccctggagcagcagatcgggatcctctacagcatcatccagttctccagcttcaagaagggcaccttctccctgaccctgatcggcgggcccaaggaggtcggccggatccgcatcagcgggaacatgcccaaggcccgggagctcaagctgatccactactccatcaccggcatgtacaagaaggagatcaacctgctcgactga

SEQ ID NO: 2105 - RNA, 4188 nt, synthetic construct
  misc_feature 1..4188: note = Cas9 variant
  source 1..4188: mol_type = other RNA
atggagacccaggccagcaaccagctgatctccagccacctcaagggctaccccatcaaggactacttcgtggggctggacatcggcacctccagcgtcgggtgggccgtgacgaacaaggcgtacgagctgctcaagttccgctcccacaagatgtggggcagccggctgttcgacgagggggagtccgccgtggcccgccggggcttccgcagcatgcggcgccggctggagcgccggaagctccgcctgaagctgctcgaggagctgttcgccgacgccatggcgcaggtcgacccgaccttcttcatgcggctgcgcgagtccaagtaccactacgaggacaagaccaccggccacagctccaagcacatcctcttcatcgacaagaactacacggaccaggactactacaaggagtaccccaccatctaccacctccgggtggccctgatgaagtccgggaccgacgacatccgcaagctgttcctggccgtgcaccacatcctgaagtaccggggcaacttcctctacgagggggccaccttcgacagcaacgcgagcacgctggacgacgtcctgaagcaggccctcgagaacatcaccttcaactgcttcgactccagcgccgccatcggctccatcgggcagatcctgatggagctgggcaagaccaagagcgacaaggccaaggcgatcgagcgcctcgtggacacctacatcatcacggacgaggtggacacctccggcaagacccagaaggagcaggtcaaggaggacaagaagcggctcaagagcttcgccaacctggtgctggggctgagcgcctccctgaccgacctcttcggcagcgtggaggacctggacgaggacctgaagaagctccagatcatcggggacacgtacgacgagcgccgggacgacctggccaaggtctggggcgacgagatccacatcatcgacgactgcaagtccgtgtacgacgccatcatcctgatgagcatcaaggagcccggcctcaccatctccgagagcaaggtgaaggcgttcaagaagcacaaggacgacctggccatcctgaagtccctcctcaagagcgaccgctccatctacaacaccatgttcaaggtcgacgagaaggggctgcacaactacgtgcactacatcaagcagggccggaccgaggagacgagctgcaaccgcgaggacttctacaagtacaccaagaaggtggtcgaggggctgcccgactccaaggacaaggagtacatcctgagcgagatcgagctgcagaccctcctgccgctgcagcgcatcaaggacaacggcgtgatcccctaccagctccacctggaggagctgaaggtgatcctggccaagtgcgggcccaagttccccttcctcaacgaggtcgccgacggcttctccgtggccgagaagctgatcaagatgctggagttccggatcccgtactacgtgggccccctcaacacccaccacaacgtcgacaacgggggcttcgcgtgggccgtgcgcaaggccagcgggcgggtcacgccctggaacttcgacgacaagatcgaccgcgagaagtccgccgccgcgttcatcaagaacctgaccaacaagtgcacctacctgctcggcgaggacgtgctgcccaagagctccctgctctacagcgagttcatgctgctgaacgagctcaacaacgtgcggatcgacgggaagccgctggagaaggccgtcaaggagcacctgatcgaggccgtgttcaagcaggaccacaagaagatgaccaagaaccgcatcgagcagttcctcaaggacaacaactacatccccgagaagcacaagcccgagatcacgggcctggacggcgagatcaagaacgacctggcctcctaccgggacatggtgcgcatcctcgggaacaacttcgacctgagcatggcggaggagatcatcaccgacatcaccatcttcggcgagagcaagaagatgctgcgggagaccctccgcaacaagttctccagccggctggacgacgaggccatcaagaagctgtccaagctccgctaccgggactgggggcgcctgagccggaagctgctcaacgtcatcgagggctgcgacaaggccggggacggcacgcccgagaccatcatcatcctgatgcgcaacttctcctacaacctgatggagctcctgggcgacaagttcagcttcatggagcggatccaggagatcaacgccaagctgatcgaggggcagatcgtgaacccgcacgacatcatcgacgacctcgccctgtcccccgcggtgaagcgcgccgtctggcaggccctgcggatcgtggacgagatcgtgcacatcaagaagaccctccccgcccgcatcttcgtcgaggtgacccgcagcaacaaggccgagaagaagaagaaggactcccggcagaagcgcctgagcgacctgtacgcggccatcaagaaggacgacgccctcctgtccggcctgacgaacgaggagttcgggggcctcaagagcggcctggccaagtacgacgacgccgcgctgcggtccaagaagctctacctgtactacacccagatggggcgctgcgcctacaccggcgaggtgatcgacctgagccagctcaacaccgacaactacgacatcgaccacatctacccccggtccctgaccaaggacgacagcttcgacaacctggtcctctgcaagcgcacggccaacgcccagaagtccgacacctacccgatcagcaaggagatccagaaggcgcagaaggccttctggatcttcctgaagcagcaggggctgatcagcgagcggaagtacgagcgcctcacccggatcacgcccctgaccgccgacgacctgtccggcttcatcgcccgccagctcgtggagaccaaccagagcgtgaaggccgcgaccaccctgctgcggcgcctctaccccggggtcgacgtggtgttcgtcaaggccgagaacgtgacggacttccggcacgacaacgacttcatcaaggtgcgctccctgaaccaccaccaccacgccaaggacgcctacctgaacatcgtcgtgggcaacgtgtaccacgagcggttcacccgcaacttccgggccttcttcaagaagaacggcgcgaaccgcacctacaacctcgccaagatgttcaactacgacgtcaagtgcaccaacgccaaggacgggaaggcctgggccgtgaagacgagcatggacaccgtgaagaagatgatggactccaacgacgtccgggtgaccaagcgcgtgtacgagcagaagggccagctgagcgacatcaacctgaccaaggcgtccaaggtcaaggccgacatctacctccccatcaaggccaacgacccgatcatgagccagaacatgaagtacgggggctactccgacatcaagaacgcctactacacgatcatcgagtacagcgacaagaagaacaactccatcaaggcgttcatccccatccccatcttcatcgccaccaagaccctgaccaagcaggccctgctcgagtacatcaagacggtgctgcccaaggccaacaacctgcggatcatctacaagaaggtgtacaacgaccagctcctgaagatcgacgggttcaactactacctgggcggccgcagcaacgaccgcttctgcatcgacaacgccatccagctcatcgtcccgctggagatccagttctacatcaagctggtggagaagttcaccgcgatcatctccgagaacaagaacatcgccctcaaggccagctccgtcaagagccggaaccccatcaacaaccaggtggagaacatcaccctggagtacacccagaagctgttcgactacctcgtgtccaagttcaacgagctgatctacctgaagatgcgcgggaacaagctcacggacgtgaacaacatcggccggaagcagttcatcaagctgagcctggaggagcgctgcaaggccctcgccgagctgctgaacatcttcaccaacatgaacaagaagctctccctgagcaccatcaacgtcagcgcgtcccggaaggtggtgaacttcaagatcagctccctggacgagttcaagatcgtcaacgagagcatcaccgggctctactcccacgagatcacgatcgtgtga

SEQ ID NO: 2106 - RNA, 4188 nt, synthetic construct
  misc_feature 1..4188: note = Cas9 variant
  source 1..4188: mol_type = other RNA
atgaacctgcgcaacaccaccgacgagtacaacatcggcctcgacatggggacgaacagcgtgggctgggccgtcaccgacaaggtgggggccatcgcgcacttcaagggcatgcccaccctggggtcccggctgttcgacgccgcccagaccgccgccgaggcgcgcgcccaccggggccagcgccggcgctacgtgcggcgccggtggcgcctcgacctgctgcagagcctcttccaggacgagatcgacaaggtcgactccgagttcttcatccggctgcgccagagccggctgcacgtggaggaccgcgaggacggccacgccgactacaagtggccgatcttcaacgactccgacttcacggaggtggactactacaagcggttccccaccatctaccacctccgcaagtggctgatcgagaccgaccagaaggccgacatccggctgatctacctcgcggtccacaacatcgtgaagcaccgcgggaacttcctgcgggagaacaacaagaacctgagctcccgcaacgccgaccccgccgaggccgtgggccacctccggctggccctgaacaactggtgcctcgagcgcgggtacgagtgcgcgtggaagtccggcgggaacgacaacgccatcctgaacgtcctgatcgacggcgagaagcgccggagcgaccaggtgcgcgagatcgccaagctcaccggcatcgactgcggggacgccaagcagagccggcagtgcaacgaggccatcgcgaaggccatcgtgggcctgaaggccgagatgaagaacatcttcggggagttccccgccgagaagacgctgatctacctctccagcgacgacgacgtcgaggtggtgcgcgacgcctgcccggacgactccgtcgagctgttccaggcgctgtgcgagctctacgccgcctacatcctgcagggcctgctcagctacgcccccggccagaccatctccgtgaacatggtgaagaagtacgaccggtacggggaggacctgcacctcctgaaggagctgacccgcacctacgccagcaagcggtacgacgcgttcttccgcggcgagacgtacgaggggtccagcgactacgtcgtggacaaggcccagggctacacccggtacaacctggggaccacccagctctcctacgacgacttccagaaggccgtgaaggagctgttcaagggcacggacgccctgcaggacgagcgctaccagggcatgatggtcgcgttcggggagcagcggttcctccgccggctgaagaccagcgacaacggcagcatctactaccagctgcacctcgaggagctgcacgccatcctggagaaccaggggaagcactaccccttcctcctggccgaggaggacaagatcgagtccctggtgagcttccgcatcccctactacgtgggcccgctcacccgggagaacgccgccgtcgggcacgacggcaaggagcgcttcgcgtggtccagccggcgcgacggcatggagcacgccgtgatcaccccctggaactgggaggagatcatcgaccgggacaagtccgccgaggacttcatcatccgcatgacgggggactgcacctacctgcagggcgagcccgtcctgcccaagtgcagcctgctctacgaggagttctgcgccctgaacgagctgaacggggcccactggaccatcgacgaggacgacgagcgccggttcgacgcggcccagcgcgagcggatcatgtgcgacctcttccgctccacccggaaggtgacgtacaagaaggtgagcgactggctggagcgcgaggactccttcgtcggcgcccgggtgcacgggggccagggcgagcacgggttcgagagccagctgggctcctacatcttcttctgcaaggacgtgttcaagaccgacagcctcgacgaggccgactacccgatgatcgagcagatcatcctgtggtccaccctgttcgaggaccgcgacatcctccggcgcaagatcgaggaggcctacggggaccggctgaccacggagcagatcaaggtcatctgcaagaagcgcttcgcgggctggggccggctgagcaagaagctcctgaccgggatcaaggtggacaccgacaccggccgcaagtccatcatcgacgtgctgcgggaggggaaccccaacgacggccagcgcagccggacgatggtcttcatggaggtgctccgcgacgaggggctgggcttccagaaggccgtggacgacttcaaccgggactacttctccgagcacaacaacggcctgatggacgtcaacgacctccccgggagccccgccatccgccggtccatcaaccaggccgtgcgcatcgtggacgagatcgtcagcatcgcgaagaaggagccggccaacatcttcatcgaggtgacccgcgaggaggacgacccccggaagaagggcaagcgcaccaagcggcgctacgacgccatcaagagcgccctggaggtgttcaagaaggacgacccccagctgtggaaggagctcaccaagaaggactccaacaacatggacgagcggctgagcctgtacttcatgcagcgcgggaagtgcatgtactccggccggcccatcaagatcgaggagctccacacggggaagtacgaggtcgaccacatcatcccgcgcagctacatcaaggacgactccctggagaacaaggtgctggtgtaccgggaggagaaccagcacaagaccgacaccctcctgatcgacagctccatccgccggaagatgggcaagtactggcgcatgctgcacaacgccaagctcatcggcgacaagaagttccggaacctgttccgcgaccacatcgacgacaagaccatgaaggggttcgtcgcgcggcagatcgtggagaccagccagatggtgaagctggtccagacgctcctggaggcccgctaccccggcgcccggatcgtgcccgtgaaggccaacatctcccacgacctgcgcgacgccgcggggctcgtcaagtgccgggaggccaacgacttccaccacgcccacgacgccttcctggcctgccgcgtgggcctgttcatccagaagcgccaccccagcgtgtacgacaacccgatcgggctcgcgcacatcatgcgggactacgcccgcgcccaggcccgggagtacaagaagtcccactacctggcgcacaccaagggcttcatcgtcaacagcttcctgtccagcggcttcgacaaggagaccggggaggtgttcaaggacgactgggacgccgaggccgaggtggagggcatccgccgggtcctcaactaccgccagtgcttcatctcccggatgcccgtggaggccaccgggacgttctgggaccagaccatctacagccccaagtgcggcaagaagctgaccctgcccctcaagcgcgggctggacccggaccggtacggctcctacagccgcgagcagttcgcctacttcttcatctacgaggcgcgggacctgaagcacgagcgccacatcctccagttcgcccaggtgcccgtccgggtggccgcccacatcgccaaggaccccagccagctggagtcctacgcggtgaagctggccggccaggccaacctcgccttcgtccgcatcgtgcggcgccggatcctgaagaagcagctgctcgagctgaacggggaccgcctgatcatcaccggcgtgcgggaggtccgcaacgccacggagttcgcgttcagcctcgacgaggagaccctgatcgagcggtgcgtgcagatcgccaaggtggggtccctgatcggcgtcgtgaacgacgaggacgaggagcagctcagcgccgacctgaacgagctgttctccagcctcgtgaagcgcggcccgaagctgtgcaaccgcctgtacgcccagctcaagctggacaagtacctgtccaagttcgacgagctcaccctgaccgacaaggccaaggtcgtgctgcagctcatcgcgatcacgaacgggagcatcaacatggccgacctgtccgccctgggcagctccaagtacgccgggtgcatgcaggtcagctacttcaagcagctcaacgcgcccatcggcgaggtgaacatcatcgaccagtccgtgaccgggatgttcgagcggcgcacccacatcggcctgtga

SEQ ID NO: 2107 - RNA, 4188 nt, synthetic construct
  misc_feature 1..4188: note = Cas9 variant
  source 1..4188: mol_type = other RNA
atgaaggagatcaaggactacatcatcgggctggacatcgggaccaacagctgcggctacgtggtcaccgacaagcagaacaacatcctcaagctgaaggggaagacggccatcggcgcccgcctgttcaaggaggggcaggcggccgccgaccggcgctccttccggaccacccgccggcgcctcgcccggcgccactggcggctgggcctgctcgaggagatcttcgaccccgagatggagaagatcgacccgaacttcttccgccggctgaaggagagcgactactcccccaaggacagccgcaagcagttcaacgccatcgtgttcaagtccatcaaggcggacaagcggttctacaagaagtaccccaccatctaccacctccgcaacgccctcatgcacgacaaccagaagcacgacctgcgggagatcttcatggccgtgcaccacatcgtcaagtaccgcggcaacttcctgcgggaggacagcgtgaacgccttcaaggcggccaagttctccctccgcggggaggacggcatcgggcccgtggacaagctgaacgacctgctcaaggagatctacagcgagtactccccggagctggccacgaacaacctgagcaagatcgaggacatcatcaaggacaagaacctctacaagcaggacaagctgaagcaggtcgccaccctgctcatcaaggaggccgactccaaggacaaggcgaagctgaacaaggacatcgccaagcaggtcgccaacagcttcatgggctacatgttccggctggacaccctcttctccctgaccgacgtggacgtgaaggactacaagctgaagttcagcgacgccaacatcgacgagtccctcgacgacctgacgagcctgctcaccgacgcccagatcgagttcgtgctggagctgcagtccatctacaacaccatcgtgctcaacgagatcgtccccgacgggatgagcctgtccgagagcatgatcaagaagtacgacgaccacaaggaggacctgaagatcttcaaggagtacatcgacagcctctccgaccagaagaaggcgaagaagctgctgagcgcctacaacctctacgtgaactaccgcaagtccgacctggtggaggccaagaacctgttcaagaacaagaaggtcggcgacaagaacttcgccgacgtgatcagcaacttcgaggtgttcggcaagttcgtctccgacaacctcgacgacagcgagctggccaacaagatcaaggcgcggctggacctcggggagttcctgcccaagcagcgcaccaaccagaacggcgtgatcccctaccagctgcaccaggtggagctcacgcagatcctggagaagcaggggaagtactacccgttcctgatcacccccaaccccgtcgagtcccaccgcaacaacgccccctacgagatcagcgagctggtgtccttccgggtgccgtactacgtcggccccctcatcgacaaccagagcatcaaggacaagcagaacaagaacaagttcgcctggatggtgcgccagaagcagggccagatcaccccctggaacctggaggagatggtcgacaccacggagtccgccaaccagttcatcaagcggatgacccgcaaggacacctacctgctcgccgaggacgtgctgcccaagagctccctggtgtaccagaagttcatgatcctcgacgagctgaaccggatcaagatcgacgggaagaagctgaccagcgagctcaagcacgacatcttcgagaagctgttcaagaagcagaagtccatcaacctggacaacctcaagaactacctgctggtcgagggcaacatcccggggctcatcgagggcctgagcgacgggatcaacttcaacaactccttcagcacgtacatcgactaccgcaacatcttcggcgacgagatcgacaaccccaacaagcaggcggacttcgagaagatgatcgagtggtccaccgtgttcgaggaccggaagatcttcaagcgcaagctgaaggagatcacctggctcaccagcgagcagatcaagcaggtcagctccaagcggtacagcggctgggggcgcctgtccaagaagctgctcacgcagatcaccgacgagaacggcgtgaacatcctgcagcggctgtggaacgagcccgagaccctcaccgaggtgctggccaaccccgtgatcaagcgcaagatcgtcgaggccaacagctccttcacgaaggccaaggacatgaaggacatcctggtggaggcgtacaccagcccgcagaacaagaaggccatccgccaggtgatgcgggtcgtggacgacatcatcgccgccgcccacgggaagaagccctcccagatcgcgatcgagttcgcccgggaggaccaggacaacccccagatgaccaagagccgcaaggcccagctcgaccagatctacgccaagatctccgacgagttcctggacgacgccgtgaagaacgagctgaagaacatgaaggacaacaagcccctcgcgaaggacaaggtcttcctgtacttcaagcagatgggccgggacgcctacagcggggagaagctgtccctcgacaacctgcaggactacgacatcgaccacatctacccgcagagcttcatcaaggacgactccttcgacaaccgcgtgctggtgcagcgggcctacaacaacggcaagagcgacaacgtccccgtgctcctgttcggcaacaagatcgccgccgggctgggcatcaccatccgccagatgtggaagaagtggctcgagctggggctgatctccaagcgcaagttcaacaacctcatcacggaccccgagaagatcagccggaacatggcgtccggcttcgtgaaccgccagctggtcgagaccagccaggtgatcaagctggtggccaacatcctccaggccaagctgcccgacaccgagatcatcgaggtcaaggccagctacaactccatcctgcggaaggagttcaacctctacaagagccgcgaggtgaacgactaccaccacgcgatcgacgcctacctgaccacgatcgtggggaactacctgtaccaggtctacccgaagctccggccctacttcgtgtacggccagttcaagaagttcggcaaggccgagaaccaggaggacgaccccgtgaagaagatcaagaagttcaacttcatctaccagctgatctgggggaaggacgacgccatctgcatctcccacaccaaccagcaggtcttcagcaagaaggacatcatcgacaagctgaccaccgcctacaacttcaagtacatgaacatctcccacgcggtgtacacccgcaacaacaacatgttcaagcagacgctgttcccgatcatcgagcggaccaccgccaagaccaagagcctgatccccaagaagctggaccgccccacggacatctacggcgggtactccaacaacaacgacgcctacctcgccctggtgaaggtcgacaagaagcggggcagcgagtaccgcgtggtgggcatccccatgcgggccgcggccatgctgaaggcctccaagaactacgacgaggacctccgcaaggtcatcgagccgatggtgatgttcgacaagaacgggaaggccaagcggggcatcgaggggttccgcgtgctggtcggcaagatgcccttcaagcaggccgtgctggacgggaacaagaagttcatgctcaccggcaccgtggacacccccaacctgaagcagctggtcctcagccagcagaacatgaagtacatcctggactacatcgaggacgtggactgccggaagcacaagttcggcgacaaggtgcagaaccccgacaagtgcctgctcgaggtcttcgacgagatcatcgagatcgtggacaagtacttcgagctgttcgactcccgcgacttccgggagaagctgcgcaacagccggaacaagttcatcaagctcgaggcgtccaagaaggccgacacgatcctggccatcctgaaggggctccaggccaagagcacccgcgcgaccatcaaggagctgaacatctccgacttcggccggatcatcaccagctccatcagcccggaggcccagctgatctaccagtcccccacgggcctcttcgagcgccgcgtgaaggtcaaggacctgtga

SEQ ID NO: 2108 - RNA, 4188 nt, synthetic construct
  misc_feature 1..4188: note = Cas9 variant
  source 1..4188: mol_type = other RNA
atgagcaagaagtaccagaacaccaagtactacgtgggcctggacatcgggacctccagcgtcggctgggccgtgacggacgccaactacgagctcctgaaggtgaacgggcacaagacctggggctcccgcctgttcaccgaggcggagaccgccctcgagcggcgcacgcaccgggccacccgccggcgcctgcagcggcgcaagcagcggctggacctcctggacgagctgttcgccgaggagctcgccaaggtcgacccccagttcctgctgcgcctcaaggagagccagtaccacatggaggacaagtccaccgacgacaagtacgtgctgttcaacgaccagaaccggaccgacggggagttcttcacggagtacccgaccatctaccacctccgcagcgagctcatgcagggcaagaaggaggacatccgggcggtgtacctggccctgcaccacatcgtcaagtaccgcggccacttcctcctgcccggggacaactacgacatgcagggcaacctgtccgagctcatcaagcggctgttcaagttcatcgaggagaccctgttcatcgaggacctcgggctgaccgacgagatccagagcaagatcgaggagatcctgctcacgaagaccaagacccgcctggaccggcagaaggagatcgtgaagctgttcaacaccaagcaccagaagctcgacgacaagcagaagaagctgctggaggccatcttcaagctctgcctgggcctgaaggggaacatggtgaacatcttcggcgacaagggcgagtacgggatcgacttcacggacgtcgaggacaagaagaagaaggtggagttctccgccgactacgacaacaacatcaacgactacgtggacttcttcggcgagtacttcgagctcctggagatcaccaagaagatcaacgacaccgtcatcttcagcgagatcctggtggacgggaagggcttctccgagagcaaggtgatctcctacgagaagcaccagcaggacctccgcaagctgaagaccctgctcaagagcctggacaagacgctgggctacaagtacggggagggcctctaccagaagatcctgctggacgacgtcaagtccaactacgtgaactacagcgggaactcccagaagctcaagaagtgcaccaaggacgagttctacggcttcatcaagagcaagctgaactccgtgaccaagaaggagaaggtcagcgaggcgcagcagaaggagatcgcccagatcctggccgacatggagttcggggactacctgcccctccagcggaccacggacaacggcgtgatccccaaccagctgcacaagaaggagctgatcgagatcatcgagcagcagaccaagtaccacgacttcttcaacgacgtggacgagaacggcctcaccatcaaggacaagatcatcagcctgatgaccttccgcatcccgtactacgtcgggcccctgaacgactaccacaaggtggccgacggcacggggcacgcctggatcgagaagaagaaggacggcaagatctacccctggaacttcgacgagatggtggacaccgaggcgaccgccgagaagttcatcaagaacctcaccaacaagtgcacgtacctgaagggggaggacgtcctgcccaaggagtccaagctctacagcgagttcatgctgctgaacgagctcaacaacatcaagatcgacaaccagaagctggacccgaagctgaagatgaagatggtgtccgagctgttcatgaagaagaacgagaagatcaccaagaagaagatcgtcgactacctgcggagcatcggccaggccaacggcaacgagatggtgtccgggatcgaccgcgagatcaagagcgacctgaagaccatccacaagatccagcactactaccaggacgcctccctcgagatggccgagaacatcatccgctggaacaccatcttcaacgacagcacgtccgacatcctgaaggacaagatcaccaaggcgtacggcgacgtgctgacccccgggcagatcaagggcctcagcaacctggcctgcaaggactgggggaagctgtccgagaagttcctcaccggcatccggtgcgacgtcggcgagttcaagaacatcagcatcatccaggccatgcgcgacaccaacaacaacctgatggagctgctctccaacaagtacgagttcatggacaagatccaggagtacaacaaggagtactacggggacttcacgttcaaggccgagcccagcatcatggacgacctgtacgtgggccccgggccgaagcgggccatctggcaggcggtgcgcatcgtcgaggagatcaagcggatcatgggccacgaccccgagaagatcttcctggagaccacccgcaccaaccgggcccccaaggtgaagaacacgaagcgctacgacgccctcgagaagaagtacgagtccgtgaaggagcacgagtacgccgaggtcaagaaggagttcgagatcgagaagaacgacagcctgaacatcaagaagctgttcctctacttcacccagctgggccactgcatgtactccgacgagaagatcccctacaacgagctgttcaccaaccggtacgacatcgaccacatctacccgcgcagcaagacccgggacaactccatggacaacctcgtgctggtgaaggccgagtgcaaccgcgacaagaaggacaactaccccatcaagctgaagacgaacatccagcagaagtgccaggtccggtgggcgtacctccgcgacaagaagctgatcaccgaggagaagtacaaccggctggtgcgcaagacgcccctcaccgaggacgagctgagccagttcatcgcccggcagctggtgttcaccagccagtccgtcaaggccaccgccgaggtgttcaagcgcctctacgaggacagcaagatctgctacgtgaaggcggagaacgtctccgacttccggtacgggagcacccgcaagatgtccaaggacgaccagccccagccgttcatcaagaaccgcgacgtgaacgacttccaccacgccaaggacgcctacctgaacatcgtggtcggcaacgtgtacgacgtgaagttcacccagaaccccacgcggttcatcaaggccaacaaggactacagcctgaactacatcttccgctaccccgtcaacaagaagggggagaacgtgtgggaccccgagcagtccatgaagatcgtggagaagaccctcaagagcaacgacgtccgggtgaccaagctggtgaagccgatcacctcccccatcagcaacgagacgctgcacaaggccctcaagtgcaagcccggctcctacctgccccgcaagagctccaaggggaccccgctggcggacgtcaccaagtacggcggctacgagaagatcaagaacgcctactacagcatctacaagtacacctacatgaagaagaaggagtgcatggaggagttcctcctggtgcccatccccatccacctggtgaacaacgacgaggagctcccgaagtacatcaacgacaagatcgccgagcgggccaagaagaagaagctggagacggtcgagtgcatcgtgaaggagctgtaccaggggaccctcgtgcgcatcaacggctacgactaccggatcgccgggtccagcggcaagcagttcgagctgcacaacgggatcaacctgatcgtcgagccctgggtggagaaggtgctcaaggagaccgacaagttcgtccgcaagtccaacagcaagctggacaagaagcagcagaaggagaacaccacggagaccctgatcgagaagcagctcaacgacgtgttcgagtacctgtgccggaagctgaaccagggcatcttcaagaacaacaagcacaccctccccgcgaagctgctgggcgacagcatccagaagcgcttcgaggacgcctccatcgaggacgagttcgaggtgatcaaggagctcatcagcgccatcgccaagaacccccagaacttcaagaccatccagaaggtcctggacatctccgggagctccatcccgcggttcaacctgaagctcacgaagaacaacgtggacgagttcatcatcaagaacgagagcgtgaccggcctgttcacccacgagaaggtcatcttccgcaagtga

SEQ ID NO: 2109 - RNA, 4188 nt, synthetic construct
  misc_feature 1..4188: note = Cas9 variant
  source 1..4188: mol_type = other RNA
atgaagaaggagatcaaggactacttcctgggcctcgacgtggggaccggcagcgtcgggtgggccgtgaccgacacggactacaagctgctgaaggccaaccgcaaggacctctggggcatgcggtgcttcgagaccgcggagaccgccgaggtgcgccggctgcaccgcggggcccggcgccggatcgagcgccggaagaagcgcatcaagctgctccaggagctgttctcccaggagatcgccaagatcgacgagggcttcttccagcggatgaaggagagccccctgtacgccgaggacaagaccatcctccaggagaacacgctgttcaacgacaaggacttcaccgacaagacctaccacaaggcgtacccgaccatcaaccacctgatcaaggcctggatcgagaacaaggtcaagcccgacccccgcctcctgtacctggcctgccacaacatcatcaagaagcggggccacttcctcttcgagggggacttcgactccgagaaccagttcgacacgagcatccaggccctgttcgagtacctgcgcgaggacatggagctcgacatcgacgcggactcccagaaggtgaaggagatcctgaaggacagctccctgaagaacagcgagaagcagtcccggctcaacaagatgctgggcctgaagcccagcgacaagcagaagaaggccatcaccaacctcatctccgggaacaagatcaacttcgccgacctgtacgacaacccggacctgaaggacgccgagaagaacagcatctccttcagcaaggacgacttcgacgccctctccgacgacctggcgagcatcctgggcgactccttcgagctcctgctgaaggccaaggccgtgtacaactgcagcgtcctctccaaggtgatcggggacgagcagtacctgagcttcgccaaggtgaagatctacgagaagcacaagaccgacctgaccaagctcaagaacgtcatcaagaagcacttccccaaggactacaagaaggtgttcggctacaacaagaacgagaagaacaacaacaactacagcgcctacgtgggcgtctgcaagatcacgcacaagaagctggtgatcaagaactccgcgagccaggaggacttctacaagttcctgaagaccatcctctccgccaagagcgagatcaaggaggtgaacgacatcctgaccgagatcgagaccgggacgttcctgcccaagcagatctccaagagcaacgccgagatcccctaccagctccgcaagatggagctggagaagatcctgtccaacgccgagaagcacttcagcttcctcaagcagaaggacgagaagggcctgtcccacagcgagaagatcatcatgctgctcaccttcaagatcccgtactacatcgggcccatcaacgacaaccacaagaagtccttccccgaccggtgctgggtcgtgaagaaggagaagtcccccagcggcaagaccaccccgtggaacttcttcgaccacatcgacaaggagaagacggccgaggagttcatcaccagccgcaccaacttctgcacctacctgatcggcgagtccgtgctgcccaagagctccctgctctacagcgagtacacggtcctgaacgagatcaacaacctgcagatcatcatcgacgggaagaacatctgcgacatcaagctcaagcagaagatctacgaggagctgttcaagaagtacaagaagatcacccagaagcagatctccaccttcatcaagcacgagggcatctgcaacaagaccgacgaggtgatcatcctggggatcgacaaggagtgcacgagcagcctcaagtcctacatcgagctgaagaacatcttcggcaagcaggtcgacgagatcagcaccaagaacatgctggaggagatcatccggtgggcgaccatctacgacgagggggagggcaagaccatcctcaagacgaagatcaaggccgagtacggcaagtactgctccgacgagcagatcaagaagatcctgaacctgaagttcagcgggtggggccgcctctcccggaagttcctggagaccgtgaccagcgagatgcccgggttctccgagcccgtgaacatcatcaccgccatgcgcgagacgcagaacaacctgatggagctcctgagctccgagttcaagttcaccgagaacatcaagaagatcaacagcggcttcgaggacgccgagaagcagttctcctacaacgggctggtgaagcccctcttcctgagcccctccgtcaagaagatgctgtggcagaccctcaagctggtgaaggagatcagccacatcacccaggccccgcccaagaagatcttcatcgagatggcgaagggcgccgagctggagccggcccgcaccaagacgcggctcaagatcctgcaggacctgtactccagctgcaagaacgacgccgacgcgttctccagcgagatccagtacctcagcggcaagatcgagaacgaggacaacctgcgcctgcggtccgacaagctctacctgtactacacccagctggggaagtgcatgtactgcggcaagcccatcgagatcgggcacgtcttcgacaccagcaactacgacatcgaccacatctacccccagtccaagatcaaggacgacagcatctccaaccgcgtgctcgtgtgcagctcctgcaacaagaacaaggaggacaagtaccccctgaaggccgagatccagagcaagcagcggggcttctggaacttcctgcagcgcaacaacttcatctccctcgagaagctgaaccggctgacccgcacgagcccgatctccgacgacgagaccgccaagttcatcgcccggcagctcgtcgagacccgccaggccaccaaggtggcggccaaggtgctggagaagatgttccccgagacgaagatcgtctacagcaaggccgagaccgtgtccatgttccggaacaagttcgacatcatcaagtgccgcgagatcaacgacttccaccacgcccacgacgcctacctgaacatcgtggtcgggaacgtgtacaacaccaagttcaccaacaacccctggaacttcatcaaggagaagcgggacaaccccaagatcgcggacacgtacaactactacaaggtgttcgactacgacgtcaagcgcaacaacatcaccgcctgggagaagggcaagaccatcatcaccgtgaaggacatgctcaagcggaacacgccgatctacacccgccaggccgcctgcaagaagggcgagctgttcaaccagaccatcatgaagaaggggctgggccagcaccccctcaagaaggaggggcccctgagcaacatctccaagtacggcggctacaacaaggtgagcgccgcgtactacaccctgatcgagtacgaggagaaggggtccaagatccggagcctcgagacgatcccgctgtacctggtcaaggacatccagaagaacaaggacggcctcaagtcctacctgaccgaccagatcgggaagaaggagatcaagatcctgatccccaagatcaagatcaacagcctcctgaagatcaacggcttcccctgccacatcaccgggaagatgggcgaggccttcgtgctgcgccccgccgtgcagttctgctgcagcaacgacgaggccctctacttcaagaagatcatccggttcaacgagatccgcaagcagcgcgagaagatgggcaagaccatctccccgtacgaggacctgagcttccggtcctacatcaaggacaacctgtgcaagaagacgaaggcggacgagatcgaggagaaggagttctacgacctcctgcagaagaagaacctggagatctacgacatgctcctgaccaagcacaaggacaccatctacaagaagcgccccaacagcgccaccatcgacatcctggtcaaggggaaggagaagttcaagtccctcatcatcgagaaccagttcgaggtgatcctggagatcctgaagctgttcagcgccacgcggaacgtgtccgacctccagcacatcggcgggagcaagaacgccggcaacgcccgcgtcgggaacaagatctccagcctggacaactgcatcctcatctaccagtccatcaccggcatcttcgagaagcggatcgacctgctgaagatctga

SEQ ID NO: 2110 - RNA, 4188 nt, synthetic construct
  misc_feature 1..4188: note = Cas9 variant
  source 1..4188: mol_type = other RNA
atgagcttcaagaagatcctgggcctcgacgtgggggtcgcctccatcggctgggccgtggtgcgcgagaacgaggagaaccccaacttcaacaccatcaccaagctgggggtccgggtggtgccgatcacgagcgacgagaagctgaacttcgagaagggcaagtccatcaccagcaacgcggagcgcaccctcgcccggtccagccgccggaacctgcagcgcttccggctgcgccggaagaacctcatcgccatcctgctgcagaaccagatcatcacccccacgacgcccctcaccgagaaggggaagttcaccaccttcgagaccctgaagatccgcgccaaggccaccaaggagaagatcgagctggaggagctcgcgcgggtcctgctgcacatcaacaagaagcgcggctacaagtccagccggaaggtgaagaactccgaggacggcaaggccatcgacgggatggaggccgccaagatcctctacgagaacaagctgacccccggccagtacacgtaccagctgctcgagaaggggagcaacaagatcccggacttctactgctccgacctgcagatcgagtgggaggtgatctggaacttccagaagcagttctaccccaacctgctcaccgaggacttcaagaaggagctgaagggcatcgggcagcgcgcgaccgccgccctgttcctcaagaagtacggcatctacaccgccctgaacaagggcaagcgggaggagaagaagctgcaggcctacaagtggcgcagcaagtccgtcagcgagaagatccccgtggaggagctcgcgtacgtgatcgccgagatcaactcccacatcacgaacagctccgggtacctgggcaccatcagcgaccggtccaaggagctgtacttcaaccagcagaccatcggggagaacctctacgcccaggtcgccaagaacacccacgccaagctgaagaaccaggtgttcctgcgccaggactacagcgcggagttcgagcagatctgggagacgcaggccaagttccacccccagctcaccccggagctgaagaagaagatccgggacagcatcatcttctaccagcgcaagctgcggtcccagaagcgcctcatcagcatctgcgagttcgagaaccgcgagatcgagatcatcaagaacggcaagaagaagaagaagaagatcggcctgaaggccgcccccaagtccagccccctgttccaggagttcaagatctggcaggtcctcaacaacatcgtgatcaagcaggaggggaaggaccggctgctgacctgggaggagaaggagctcctgttcaccgagctgaacatcaagggcaacatctccgggcagaaggccctcgcgctgctgaagctcagccccaaggacacgaagatcaacgtgaccatcctggagggcaaccacacccaggagcagctgtaccgcgtgtacctgcggatcctcgggatggagggctacgacgtcttcgacctgctgaagatcccggagaaccaggacgagatcaagcccgccgactccaagatcagcgccgccgagatcaaggagaccgtgaagtccgtgttcaagacgtgcagcatctcccccagcatcctcgacttcgaccccctgctgccgaaccccgagttcgagaaccagtccagctaccagctctggcacctcctgtactcctacgagggcgacagctcccccagcgggaacgagaagctgctggagctgctcaagaacaagttcggcttcaagaaggagcacgccctgctgctcgcgtccatcagctacacctacatctacgggaacctgagctccaaggccatgcgcaagatctacccctacagcaaggagaacacctactccgaggcctgcatgctggccggctaccggcacagcaagaacgcgctcccgcgcgaggagctggtcaagtaccagctgaaggaccggctcgagatcctgcccaagaactccctgcgcaaccccgtggtggagaaggtcctcaaccagctgatcaacctggtgaacagcctcatggacgagtacggggccttcgacgagatccggctggagatggcccgcgagctgaagaagaacgccaaggagcgggagaagtggtccaagaacatcgccgacgcgaccagccgcaaccagaagcacgccgagatcctcaagaaggacttcaagatctccaaccccagcaagaacgacctgatccggtaccgcctgtacctcgagctgaaggccaacggctacaacgacctgtacacgaacacctacatcgacatcaactacctcttcacccaccggtacgacatcgaccacatcatcccgcagtccaaggtcctggacgacagcttctccaacaaggtgctggtgccccgccaggccaacctcgagaagtccaacctgaccgccttcgactacatcagccaccagggcaaggagaaggaggagcactacctgaacgtcatcacggagctctacaagcgggggagcatctccgagaccaagtacaagaacctgcagaagaagggcaacgagatcggggagggcttcatcaaccgcgacctgaagaacacccagtacatcgtgcggaaggcgcgcgagatcctcagcctgatcacccccaacgtggtcaccacgaccggggagatcaccgccaagctgcgcaaggactggaacctcatcaacagcatgaaggagctgaacatggacaagttccggaacgcccgcctgaccgagctcgtggagaactcccggggcgagaagaaggagatcatcatcgactggaacaagcgcaacgaccagcggcaccacgccatcgacgccctggtggtcgcgttcacgacccgcaaccacgtgcagtacctgaactacatgaacgcccgggaggacgagagccacaagcagcactcccacatcctcagcatcgagaagaagatcaagtacgacaagttccacgagaacggctcccgccagagccggttcatctaccccacctccaacttccgcgaggaggccaagaagaagctgaaggagatcctggtgagctacaagaccaagaacaaggtcgtgacggtgaacatcaacaagccgaagaagaagggcgggtactcccccaagcacgagctcacgccccgggggccgctgcacaaggagaccatctacggcatgatccgcatcctgcacaccaaggagatcaaggtcagctccaagctcaacttcgagaccgtggtgcggatccagaacccccgctaccggaacgccctgctggagcgcctcaaggacaacttcaacgaccccaagaaggcgttcagcggcaccaactccctgaccaagaaccccgtcttcctgaccgccaacagcacggagaccgtgccggagaaggtgaccatccagtggttcgagaaggtctacaccatccggaagcccatcaaccccacgaacttcaagaacgagaagaacatcgagaaggtgctcgaccccaccatccgcaccctgctgaagaagcggctccaggagtacaacgggaacgccaaggaggccttctccgacctggagaagaacccgatctggctgaaccaggagaagggcatctgcatcaagaccgtgacgatcaccgggatcagcaacgtcgagtccctccacaccaagaaggaccacttcggcaaggagctgctggacatcaacgggaaccccatccccgtggacttcgtgagcaccggcaacaaccaccacgtcgccatctacgaggactccgagggcaacctccaggagaaggtggtgagcttctacgaggcggtcgagcgcgtgaaccaggggctgcccgtgatcgacacgctgtacaacctcgacctgggctggaagttcctgttcaccatgaagcagaacgagatgttcctcttcccggccgacgacttcgaccccaacgacatcgacatctacgacgagaagaacctgatcctgatcagcaagcacctcttccgggtccagaagctgtccagcaaggactactgcttccgccaccacctggagacctccatcaacttcaacgaccccgccctcaaggggatcacctggcgccgggagagccccaacggcctgcgcaacctggtgaaggtgcggctcaaccacctggggaagatcgtccacatcggcgagtga

SEQ ID NO: 2111 - RNA, 4188 nt, synthetic construct
  misc_feature 1..4188: note = Cas9 variant
  source 1..4188: mol_type = other RNA
atgaagaaggagatcaaggactacttcctgggcctcgacgtggggaccggcagcgtcgggtgggccgtgaccgacacggactacaagctgctgaaggccaaccacaaggacctctggggcatgcgctgcttcgagaccgcggagaccgccgagaagcggcgcctgttccgcggggcccggcggcgcatcgagcggcgccggaagcgcatcaagctgctccaggagctgttctcccaggagatcgccaagatcgacgaggacttcttccagcggatggaggagagccccttctacgccgaggacaagaccatcctgcaggagaacacgctgttcaacgaccgcgacttcaccgacaagacctaccacaaggcgtacccgaccatcaaccacctgatcaaggcctggatcgagaacaaggtgaagcccgacccccggctgctctacctggcctgccacaacatcatcaagaagcgcggccacttcctgttcgagggcgacttcgactccgagaaccagttcgacacgagcgtccaggccctcttcgagtacctgcgggaggacatggagctggacatcgacgcggactccaagaagatcaaggagatcctcaaggacagcgccctgaagaactccgacaagcagaaccgcctgaacaagctcctggggctcaagagctccgacaagcagaagaaggccctcaccaacctgatcagcggcaacaaggccaacttcgccgacctgtacgacaaccccgacctcaaggacgcggagaagaactccatcagcttctccaaggacgacttcgacgccctgagcgacgagctggcctccgtgctcggggacagcttcgagctgctgctccgggccaaggccgtgtacaactgctccgtcctgagcaaggtgatcggcgacgagcagtacctgtccttcgcgaaggtgaagatctacgagaagcacaagaacgacctcaccaagctgaaggaggtcgtgaagaagtacttcccgatcgagtaccgcaacatcttcgggtacaagcagagcgagaacaacaactgcaactacagccggtacgtgggcgtctgcaagtccggcagcaagaagaaggtgatcaacaagaccgcctcccaggaggacttctacaagttcctgaaggacatcctcctgaagcgcagcgacgtgcccgaggccaacgggatcctgacggagatcgagaccggcaccttcctccccaagcagatctccaagaacaacgccgagatcccctaccagctgcggaagatcgagctggagaagatcctcaccaacgccgagaagttcttcagcttcctgaagcagaaggacgagaacgggctgtcccacagcgagaagatcatcatgctcctgacgttcaagatcccgtactacatcggccccatcaacacctcccacaagcagtacttccccgaccgcagctgggtcatcaagaaggagaacgcgccccaggagaagatcaccccgtggaacttcttcgaccacatcgacaaggagaagaccgccgaggccttcatcacgtcccgcaccaacttctgcacctacctgatcggcgagagcgtgctgcccaagaactccctcctgtacagcgagtacaccgtgctgaacgagatcaacaacctccagatcatcatcgacgggaagaacatctgcgacgtcaagctgaagcagaagatctacgaggagctgttcaagaagtacaagaaggtgacgcagaagcagatctccaccttcatcaagcacgagggcatctgcaacaagaccgacgaggtgatcatcctcgggatcgacaaggagtgcaccagctccctcaagagctacatcgagctgaagaacatcttcggcaagcaggtcgacgagatctccacgaagaacatgctcgaggacatcatccggtgggccaccatctacgacgagggggagggcaagaccatcctgaagaccaagatcaaggccgagtacgagaagtactacagcgacgagcagatcaagaagatcctgaacctcaagctgagcggctgggggcgcctgtcccggaagttcctcgagagcatcacgtccgagatccccggcttcatcgagcccgtgaacatcatcaccgcgatgcgcgagacccagaacaacctgatggagctgctcagctccaagttcaagttcaacgagaacatcaagaagatcaacagcgggttcgaggacaccgacaagcggttctcctacaacagcctggtgaagccgctgttcctctcccccagcgtcaagaagatgctgtggcagacgctgaagctcgtgaaggagatctcccacatcacccaggccccgcccaagaagatcttcatcgagatggccaagggcgccgagctggagcccgcgcgcaccaagacccggctgaagatcctccaggacctgtacaacagctgcaagaacgacgccgacgccttctccagcgagatccagtacctgctcgggaagatcgagaacgaggacaacctgcgcctgcggtccgacaagctctacctgtactacacccagctgggcaagtgcatgtactgcggcaagcccatcgagatcgggcacgtcttcgacacgagcaagtacgacatcgaccacatctacccccagtccaagatcaaggacgacagcatcaacaaccgcgtgctcgtgtgcagctcctgcaacaagaacaaggaggacaagtaccccctgaagccggagatccagctgaagcagaagaagttctggaacttcctccagcggaacaacttcatcagcatcgagaagttcaaccgcctgacccggaccacccccatctccgacgacgagacggccaagttcatcgcccgccagctggtcgagacccggcaggcgaccaaggtggccgccaaggtgctcgagaagatcttccccgagaccaacatcgtctacagcaaggccgagacggtgtccatgttccgcaacaagttcgacatcatcaagtgccgggagatcaacgacttccaccacgcccacgacgcgtacctgaacatcgtggtcggcaacgtgtacaacaccaagttcaccaacaacccctggaacttcatcaaggagaagcgcgacaacccgaagatcggggacacctacaactactacaaggtgttcgactacgacgtcaagcggaacaacatcacggcctgggagaaggagaagaccatcatcaccgtgaagaccatgctgaagcgcaacacgcccatctacacccgccaggccgcctgcaagaagggcgagctgttcaaccagaccatcatgaagaaggggctgggccagcaccccctgaagaaggagtgcccgttcagcaacatctccaagtacggcgggtacaacaaggtgagcgccgcgtactacaccttcatcgagtacgaggagaagggcaacaagatccggtccctcgagacgatccccctgtacctggagaaggacatccagaagtcccaggacgggctcaagggctacctgaccgaccagctgggcaagaaggagatcaagatcctcgtccccaagatcaagatcaacagcctgctgaagatcaacgggttcccctgccacatcaccggcaagaccggggccagcttcgtgctccgcccggccgtgcagttctgctgctccaacgacgaggtcctgtacttcaagaagatcatccggttcaacgagatccgcagccagcgggagaagatgggcaagacgatctccccctacgaggacctgagcttccgctcctacatcaaggagaacctctgcaagaagaccaagaacgacgagatcggggagaaggagttctacggcttcctgcagaagaagaacctggagatctacgacatgctcctgatcaagcacaaggacaccatctacagcaagcggcccaactccaccacgctggacatgctcatcaagggccgctacgagttcatcaacctgaagcccgaggaccagatccgggtgatgctggagatcctcaagctgttctgcaccacccgcgaggtgatcgacctggggctcatcaagggcaagagcgaggccggggtcaccacgctgggcaagaagatcagcaacctggactcctgcatcctcatctaccagagcatcaccgggatcttcgagaagcggatcgacctgctgaagatctga

SEQ ID NO: 2112 - RNA, 4188 nt, synthetic construct
  misc_feature 1..4188: note = Cas9 variant
  source 1..4188: mol_type = other RNA
atgaagaaggagatcaaggactacttcctgggcctcgacgtggggaccggcagcgtcgggtgggccgtgaccgacacggactacaagctgctgaaggccaaccgcaaggacctctggggcatgcggtgcttcgagaccgcggagaccgccgaggtgcgccggctgcaccgcggggcccggcgccggatcgagcgccggaagaagcgcatcaagctgctccaggagctgttctcccaggagatcgccaagaccgacgagggcttcttccagcggatgaaggagagccccttctacgccgaggacaagacgatcctgcaggagaacgccctcttcaacgaccgcgacttcaccgacaagacctaccacaaggcctacccgaccatcaaccacctgatcaaggcctggatcgagaacaaggtcaagcccgacccccggctgctctacctggcctgccacaacatcatcaagaagcgcggccacttcctgttcgagggggacttcgactccgagaaccagttcgacacgagcatccaggccctcttcgagtacctgcgggaggacatggaggtggacatcgacgcggactcccagaaggtgaaggagatcctgaaggacagctccctcaagaacagcgagaagcagtcccgcctgaacaagatgctgggcctcaagcccagcgacaagcagaagaaggccatcaccaacctgatctccgggaacaagatcaacttcgccgacctgtacgacaacccggacctcaaggacgccgagaagaacagcatctccttcagcaaggacgacttcgacgcgctgtccgacgacctggccagcatcctcggcgactccttcgagctgctgctcaaggccaaggccgtctacaactgcagcgtgctgtccaaggtgatcggggacgagcagtacctgagcttcgccaaggtcaagatctacgagaagcacaagaccgacctcaccaagctgaagaacgtgatcaagaagcacttccccaacgactacaagaaggtgttcggctacaacaagaacgagaagaacaacaacaactacagcgcgtacgtcggcgtgtgcaagacgaagtccaagaagctggtgatcaacaacaccgtcaaccaggaggacttctacaagttcctcaagcccatcctgctggccaagagcgagatcaaggaggtgaacgacatcctcaccgagatcgagaccgggacgttcctgcccaagcagatctccaagagcaacgccgagatcccgtaccagctgcggaagatggagctcgagaagatcctgtccaacgccgagaagcacttcagcttcctgaagcagaaggacgagaagggcctctcccacagcgagaagatcatcatgctgctgaccttcaagatcccctactacatcgggcccatcaacgacaaccacaagaagtccttccccgaccgctgctgggtgatcaagaaggagaagtccccgagcggcaagaccaccccctggaacttcttcgaccacatcgacaaggacaagacggccgaggcgttcatcaccagccggaccaacttctgcacctacctcgtcggcgagtccgtgctgcccaagaacagcctgctgtactccgagtacacggtgctcaacgagatcaacaacctgcagatcatcatcgacgggaagaacatctgcgacatcaagctgaagcagaagatctacgaggagctgttcaagaagtacaagaagatcacccagaagcagatcagcaccttcatcaagcacgagggcatctgcaacaagaccgacgaggtcatcatcctcgggatcgacaaggagtgcacgtccagcctgaagtcctacatcgagctcaagaacatcttcggcaagcaggtcgacgagatcagcaccaagaacatgctggaggagatcatccgctgggccaccatctacgacgagggggagggcaagaccatcctgaagacgaagatcaaggccgagtacggcaagtactgcagcgacgagcagatcaagaagatcctcaacctgaagttctccgggtggggccggctgagccgcaagttcctcgagaccgtgacctccgagatgcccgggttcagcgagccggtgaacatcatcaccgccatgcgcgagacgcagaacaacctgatggagctgctctccagcgagttcaagttcaccgagaacatcaagaagatcaactccggcttcgaggacgtggagaagcagttcagctacgactccctggtcaagcccctgttcctcagcccctccgtgaagaagatgctgtggcagaccctgaagctcgtgaaggagatcagccacatcacccaggcgcccccgaagaagatcttcatcgagatggcgaagggggccgagctggaccccgtccggaccaagacgcgcctgaagatcctccaggacctgtacaacaactgcaagaacgacgccgacgccttctccagcgagatcaaggacctgtccggcaagatcgagaacgaggacaacctccggctgcgcagcgacaagctgtacctctactacacccagctgggcaagtgcatgtactgcgggaagcccatcgagatcggccacgtgttcgacacctccaactacgacatcgaccacatctacccccagagcaagatcaaggacgacagcatctccaaccgggtgctggtctgcagctcctgcaacaagaacaaggaggacaagtacccgctcaaggcggagatccagagcaagcagcgcgggttctggaacttcctgcagcggaacaacttcatctccctggagaagctcaaccgcctgacccggacgagccccatctccgacgacgagaccgccaagttcatcgcccgccagctggtggagacccggcaggccaccaaggtggccgcgaaggtcctcgagaagatgttccccgagacgaagatcgtgtacagcaaggccgagaccgtgtccatgttccgcaacaagttcgacatcatcaagtgccgggagatcaacgacttccaccacgcccacgacgcctacctgaacatcgtcgtgggcaacgtgtacaacaccaagttcaccaacaacccctggaacttcatcaaggagaagcgcgacaacccgaagatcgccgacacgtacaactactacaaggtcttcgactacgacgtgaagcggaacaacatcaccgcgtgggagaaggggaagaccatcatcaccgtgaaggacatgctgaagcgcaacacgcccatctacacccggcaggccgcctgcaagaagggcgagctgttcaaccagaccatcatgaagaagggcctcgggcagcaccccctgaagaaggagggcccgctcagcaacatctccaagtacgggggctacaacaaggtcagcgccgcctactacaccctgatcgagtacgaggagaagggctccaagatccgcagcctggagacgatccccctctacctggtgaaggacatccagaagaacaaggacgggctgaagtcctacctcaccgaccagatcggcaagaaggagatcaagatcctgatccccaagatcaagatcaacagcctgctcaagatcaacgggttcccctgccacatcaccggcaagatgggggaggcgttcgtgctgcggccggccgtccagttctgctgctccaacgacgaggccctgtacttcaagaagatcatccgcttcaacgagatccgcaagcagcgggagaagatgggcaagaccatcagcccctacgaggacctctccttccgcagctacatcaaggacaacctgtgcaagaagacgaaggccgacgagatcgaggagaaggagttctacgacctgctccagaagaagaacctggagatctacgacatgctgctcaccaagcacaaggacaccatctacaagaagcggcccaacagcgcgaccatcgacatcctggtgaagggcaaggagaagttcaagtccctgatcatcgagaaccagttcgaggtgatcctcgagatcctgaagctgttcagcgccacgcgcaacgtctccgacctccagcacatcgggggcagcaagaacgccgggaacgcccgggtgggcaacaagatctccagcctggacaactgcatcctgatctaccagtccatcaccgggatcttcgagaagcgcatcgacctcctgaagatctga

SEQ ID NO: 2113 - RNA, 4188 nt, synthetic construct
  misc_feature 1..4188: note = Cas9 variant
  source 1..4188: mol_type = other RNA
atgaagaaggagatcaaggactacttcctgggcctcgacgtggggaccggcagcgtcgggtgggccgtgaccgacacggactacaagctgctgaaggccaaccgcaaggacctctggggcatgcggtgcttcgagaccgcggagaccgccgaggtgcgccggctgcaccgcggggcccggcgccggatcgagcgccggaagaagcgcatcaagctgctccaggagctgttctcccaggagatcgccaagatcgacgagggcttcttccagcggatgaaggagagccccttctacgccgaggacaagaccatcctgcaggagaacgccctcttcaacgacaaggacttcacggacaagacctaccacaaggcgtacccgaccatcaaccacctgatcaaggcctggatcgagaacaaggtcaagcccgacccccgcctgctctacctggcctgccacaacatcatcaagaagcggggccacttcctgttcgagggggacttcgactccgagaaccagttcgacaccagcatccaggccctcttcgagtacctgcgcgaggacatggaggtggacatcgacgcggactcccagaaggtgaaggagatcctgaaggacagctccctcaagaacagcgagaagcagtcccggctgaacaagatcctgggcctcaagcccagcgacaagcagaagaaggccatcacgaacctgatctccgggaacaagatcaacttcgccgacctgtacgacaacccggacctcaaggacgccgagaagaacagcatctccttcagcaaggacgacttcgacgcgctgtccgacgacctggccagcatcctcggcgactccttcgagctgctgctcaaggccaaggccgtctacaactgcagcgtgctgtccaaggtgatcggggacgagcagtacctgagcttcgccaaggtcaagatctacgagaagcacaagaccgacctcaccaagctgaaggcggtgatcaagaagcacttccccaacaactacaagaaggtgttcggctacaaccaggacaacgagagcaagaacaactactccggctacgtcggggtgtgcaagaccaagaacaagaagctggtgatcaacaacagcgtcaaccaggaggacttctacaagttcctcaagcccatcctgtccgccaagagcgagatcaaggaggtgaacgacatcctggccgagatcgagacgggcaacttcctccccaagcagatctccaagagcaacgccgagatcccgtaccagctgcgcaagatggagctggagaagatcctctccaacgccgagaagcacttcagcttcctgaagcagaaggacgagaaggggctgtcccacagcgagaagatcatcatgctcctgaccttcaagatcccctactacatcggccccatcaacgacaaccacaagaagtccttccccgaccggtgctgggtggtcaagaaggagaagtccccgagcggcaagaccaccccctggaacttcttcgaccacatcgacaaggagaagacggcggaggagttcatcaccagccgcaccaacttctgcacctacctgatcggggagtccgtgctccccaagaacagcctgctgtactccgagtacacggtgctgaacgagatcaacaacctccagatcatcatcgacggcaagaacatctgcgacaccaagctgaagcagaagatctacgaggacctgttcaagaagtacaagaagatcacccagaagcagatcagcaccttcatcaagcacgaggggatctgcaacaagacggacgaggtcatcatcctcggcatcgacaaggagtgcacctccagcctcaagagctacatcgagctgaagaacatcttcgggaagcaggtcgacgagatctccaccaagaacatgctcgaggagatcatccggtgggccaccatctacgacgagggcgagggcaagacgatcctgaagaccaagatcaaggccgagtacgggaagtactgcagcgacgagcagatcaagaagatcctgaacctcaagttctccggctgggggcgcctgagccggaagttcctggagaccgtgacctccgagatgcccggcttcagcgagccggtgaacatcatcacggccatgcgcgagacccagaacaacctcatggagctgctgtccagcgagttcaagttcaccgagaacatcaagaagatcaactccgggttcgaggacgccgagaagcagttcagctacgacggcctcgtgaagcccctgttcctgtcccccagcgtcaagaagatgctctggcagaccctgaagctggtgaaggagatctcccacatcacgcaggcgcccccgaagaagatcttcatcgagatggccaagggcgccgagctcgagcccgcccgcaccaagacccggctgaagatcctgcaggacctctacagctcctgcaagaacgacgcggacgccttcagctccgagatccagtacctgagcgggaagatcgagaacgaggacaacctgcgcctccggagcgacaagctgtacctgtactacacccagctcggcaagtgcatgtactgcgggaagcccatcgagatcggccacgtgttcgacacctccaactacgacatcgaccacatctacccccagagcaagatcaaggacgactccatcagcaaccgcgtcctggtgtgctccagctgcaacaagaacaaggaggacaagtacccgctgaagtccgagatccagagcaagcagcgggggttctggaacttcctccagcgcaacaacttcatctccctggagaagctgaaccggctcacgcgcaccacccccatcagcgacgacgagaccgccaagttcatcgcccggcagctggtggagacgcgccaggccaccaaggtcgcggccaaggtgctggagaagatgttccccgagaccaagatcgtgtactccaaggccgagaccgtcagcatgttccggaacaagttcgacatcatcaagtgccgcgagatcaacgacttccaccacgcccacgacgcctacctcaacatcgtggtgggcaacgtctacaacacgaagttcaccaacaacccctggaacttcatcaaggagaagcgggacaacccgaagatcgcggacacctacaactactacaaggtgttcgactacgacgtgaagcgcaacaacatcaccgcctgggagaagggcaagacgatcatcaccgtcaaggacatgctgaagcggaacacccccatctacacccgccaggccgcctgcaagaagggggagctgttcaaccagacgatcatgaagaagggcctcgggcagcaccccctgaagaaggagggcccgttctccaacatcagcaagtacggcgggtacaacaaggtgtccgccgcgtactacaccctgatcgagtacgaggagaaggtgaacaagatccggagcctcgagaccatccccctgtacctggtcaaggacatccagaaggaccaggacgtgctcaagtcctacctgaccgacctgctcggcaagaaggagatcaagatcctggtgcccaagatcaagatcaacagcctgctcaagatcaacgggttcccctgccacatcacgggcaagaccggggactccttcgtcctgcgcccggccgtgcagttctgctgcagcaacgacgaggtgctgtacttcaagaagatcatccggttcaacgagatccgcagccagcgcgagaagatgggcaagaccatctccccctacgaggacctcagcttccggtcctacatcaaggagaacctgtgcaagaagaccaaggccgacgagatcggcgagaaggagttctacgacctgctccagaagaagaacctggagatctacgacatgctgctcacgaagcacaaggacaccatctacaacaagcgccccaacagcaccaccctggggatgctgacgaagggccggtacgagttcatcaacctcaagcccaaggaccagatcatcgtcatgctggagatcctgaagctgttctgcaccacccgcgaggccatcgacctggggctgatcaagggcaagccggcggccggggtggccaccctcggcaagaagatctccaacctggacaactgcatcctgatctaccagagcatcacgggcatcttcgagaagcggatcgacctcctgaaggtgtga

SEQ ID NO: 2114 - RNA, 4188 nt, synthetic construct
  misc_feature 1..4188: note = Cas9 variant
  source 1..4188: mol_type = other RNA
atgaagaaggagatcaaggactacttcctgggcctcgacgtggggaccggcagcgtcgggtgggccgtgaccgacacggactacaagctgctgaaggccaaccgcaaggacctctggggcatgcggtgcttcgagaccgcggagaccgccgaggtgcgccggctgcaccgcggggcccggcgccggatcgagcgccggaagaagcgcatcaagctgctccaggagctgttctcccaggagatcgccaagatcgacgagggcttcttccagcggatgaaggagagccccctgtacgccgaggacaagaccatcctccaggagaacacgctgttcaacgacaaggacttcaccgacaagacctaccacaaggcgtacccgaccatcaaccacctgatcaaggcctggatcgagaacaaggtcaagcccgacccccgcctcctgtacctggcctgccacaacatcatcaagaagcggggccacttcctcttcgagggggacttcgactccgagaaccagttcgacacgagcatccaggccctgttcgagtacctgcgcgaggacatggaggtggacatcgacgcggactcccagaaggtgaaggagatcctcaaggacagctccctgaagaacagcgagaagcagtcccggctgaacaagatgctcggcctgaagcccagcgacaagcagaagaaggccatcaccaacctgatctccgggaacaagatcaacttcgccgacctctacgacaacccggacctgaaggacgccgagaagaacagcatctccttcagcaaggacgacttcgacgccctgtccgacgacctcgcgagcatcctgggcgactccttcgagctgctcctgaaggccaaggccgtctacaactgcagcgtgctgtccaaggtgatcggggacgagcagtacctcagcttcgccaaggtcaagatctacgagaagcacaagaccgacctgaccaagctgaagaacgtgatcaagaagcacttccccaaggactacaagaaggtgttcggctacaacaagaacgagaagaacaacaacaactacagcggctacgtcggggtgtgcaagacgaagtccaagaagctcatcatcaacaacagcgtgaaccaggaggacttctacaagttcctgaagaccatcctgtccgccaagagcgagatcaaggaggtcaacgacatcctcaccgagatcgagaccggcacgttcctgcccaagcagatctccaagagcaacgcggagatcccctaccagctgcgcaagatggagctcgagaagatcctgtccaacgccgagaagcacttcagcttcctgaagcagaaggacgagaaggggctctcccacagcgagaagatcatcatgctgctgaccttcaagatcccgtactacatcggccccatcaacgacaaccacaagaagtccttccccgaccggtgctgggtggtgaagaaggagaagtcccccagcggcaagaccaccccgtggaacttcttcgaccacatcgacaaggagaagacggccgaggagttcatcaccagccgcaccaacttctgcacctacctcatcggggagtccgtcctgcccaagaacagcctgctgtactccgagtacacggtgctcaacgagatcaacaacctgcagatcatcatcgacggcaagaacatctgcgacaccaagctgaagcagaagatctacgaggagctgttcaagaagtacaagaagatcacccagaagcagatcagcaccttcatcaagcacgaggggatctgcaacaagacggacgaggtgatcatcctgggcatcgacaaggagtgcacctccagcctcaagagctacatcgagctcaagaacatcttcgggaagcaggtcgacgagatctccaccaagaacatgctggaggagatcatccggtgggccaccatctacgacgagggcgagggcaagacgatcctgaagaccaagatcaaggccgagtacgggaagtactgcagcgacgagcagatcaagaagatcctcaacctgaagttctccggctgggggcgcctgagccggaagttcctcgagaccgtgacctccgagatgcccggcttcagcgagcccgtgaacatcatcacggcgatgcgcgagacccagaacaacctgatggagctgctctccagcgagttcaagttcaccgagaacatcaagaagatcaactccgggttcgaggacgtcgagaagcagttcagctacgacggcctggtgaagccgctgttcctctcccccagcgtcaagaagatgctgtggcagaccctgaagctcgtgaaggagatctcccacatcacccaggccccgcccaagaagatcttcatcgagatggccaagggcgccgagctggaccccgtgcgcacgaagacccggctgaagatcctccaggacctgtacaacaactgcaagaacgacgccgacgcgttcagctccgagatcaaggacctgagcgggaagatcgagaacgaggacaacctccgcctgcggtccgacaagctgtacctctactacacccagctgggcaagtgcatgtactgcgggaagcccatcgagatcggccacgtcttcgacaccagcaactacgacatcgaccacatctacccccagagcaagatcaaggacgactccatcagcaaccgcgtgctggtgtgctccagctgcaacaagaacaaggaggacaagtaccccctcaaggccgagatccagtccaagcagcgggggttctggaacttcctgcagcgcaacaacttcatcagcctggagaagttcaaccggctcacgcgcgccaccccgatctccgacgacgagaccgccaagttcatcgcgcggcagctggtcgagacccgccaggccacgaaggtggccgcccgggtgctggagaagatgttccccgagaccaagatcgtctacagcaaggccgagaccgtgtccatgttccgcaacaagttcgacatcgtgaagtgccgggagatcaacgacttccaccacgcgcacgacgcctacctcaacatcgtcgtgggcaacgtgtacaacaccaagttcacgaacaacctgtggaacttcatcaaggagaagcgcgacaaccccaagatcgccgacacctacaactactacaaggtcttcgactacgacgtgaagcggaacaacatcaccgcctgggagaagggcaagaccatcatcacggtgaaggacatgctgaagcgcaacacccccatctacacccggcaggccgcgtgcaagaagggcggcctcttcgaccagaccatcatgaagaaggggctggggcagcacccgctgaagaaggagggccccttcagcaacatctccaagtacgggggctacaacaaggtcagcgccgcctactacacgctcatcgagtacgaggagaaggggaacaagatccgctccctggagaccatccccctgtacctcgtgaaggacatccagaaggaccaggacgtgctcaagagctacctgaccgacctgctgggcaagaaggagttcaagatcctggtcccgaagatcaagatcaactccctcctgaagatcaacgggttcccctgccacatcaccggcaagacgaacgacagcttcctgctccggcccgccgtgcagttctgctgctccaacgacgaggtgctgtacttcaagaagatcatccgcttcagcgagatccgctcccagcgggagaagatcggcaagaccatcagcccctacgaggacctgagcttccgctcctacatcaaggagaacctctgcaagaagaccaagaacgacgagatcggggagaaggagttctacgacctgctgcagaagaagaacctcgagatctacgacatgctgctgaccaagcacaaggacacgatctacaagaagcggccgaacagcgccaccatcgacatcctcgtcaagggcaaggagaagttcaagtccctgatcatcgagaaccagttcgaggtgatcctggagatcctcaagctgttcagcgcgacccgcaacgtgtccgacctgcagcacatcgggggcagcaagtactccggggtcgccaagatcggcaacaagatcagctccctcgacaactgcatcctgatctaccagagcatcaccggcatcttcgagaagcggatcgacctgctcaaggtgtga

SEQ ID NO: 2115 - RNA, 4191 nt, synthetic construct
  misc_feature 1..4191: note = Cas9 variant
  source 1..4191: mol_type = other RNA
atggacagctccaagcagggcctgcgccggtaccacctcgggctggacatcggcaccaacagcatcgggtggaccgccatcgacgaccacttctccctgctccgcgtgaagggcaagaacgccatcggggtccggacgttcaaggagggcgagaccgcggccgaccgccggggcttccgcaccgcccggcgccggctgagccgccggcgctggcggctgcagttcctcgacgagttcttcgccccctacctggccgaggtggacccgaacttcctggcgcgcctcaagcagtccgacatcagcgccaaggaccccgccaagaaccaggagtacatggggaagctgctgttccccgaccaggaggccgcgtccgacggcaacgggtaccccaccctcatccagatgcggaaggccatgccggccgagaaggccgccgacttccccgtgttcaacatctaccagctgcgctacgcgctgatgaacgagaagcggaagttcgacctccgcgagatctacctggccgtccaccacatcgtgaagtaccggggcaacttcctgaacaacacgagcgtggacaagttcaaggccgaccagatcgacttcaacaagtccttcgagaccctcaacgacctgttccgccaggtccagcccatcgcccccttccagatcgacctgaccaaggtggacgagctcgggaagctgctgctcgacaccaagcagaagaagctggaccggcagaaggccgtggcgaagctgctcccgctgatcgaggacggcacggacaaggagatcgtcaaggcccaccagcagaccgcccgcgagatcagcaagctgatcctcggctacaaggccaaggtggggctgatcctgcagaacaacctcgaccagaccctggacatgtccaccgagaacagcgacgaccagctgatgcagatcgccgaggagctcgacgactaccagatggagctgatcaaccagctgtccctcctgtacagccagatcatgctgaacgagatcgtgcccaacggcgagacggtctccgcgagcatgctcaaccgctactacaagcaccggtgccagctgaaggagctgaaggactacggggccgcccaggacaagaagacccgcgagcagctcgaccacctgtacgccgagtacatcggccagatccccaaggactccaagttcgacttcaccaaggacctgaagaagctcatggacaagagcgacctgggccagaagatcaaggacgagatcgaggccggggactacctgcccaagcagcggacctccgcgaacggcgtgatcccgcaccagatgcaccagcaggagctggaccagatcatcgagaaccagaaggagtactacccctggctcgccgagcccaaccccgtggagaagaacatcaagaacgccaagtacaagctggaccagctggtcagcttccgcgtgccgtactacgtggggcccatgatcacgctcgccgaccagcagaagaccagcaaggcgtccttcgcctgggccgtccggaagaaggccggcaagatcaccccctggaacttctacgacatgatcgaccgcgagaagtccgccaacaacttcatcaagcggatgaccaacaaggacacgtacctgctgagcgaggacgtgctccccgcgagctccctgctgtaccagaagttcaccgtgctcaacgagctgaacaacatccgcgtcaacgggcggaagctgcagccggccctcaagcaggccatctacaccgacctgttccagaagcgcaagaccgtgaacctgaagacgctcaccaacttcctggccatccacgagcccaccctgaccaagcccaagatcgagggcctcagcaacggccggtccttcaacagctccctggggacgtacatcgacatgagcaagatcctgggcgactccctcgacgacctgaactaccgcgacgacatcgagaagatcatcgagtggagcaccgtgttcgaggactccgagatctacggggtcaagctgcaggagatccagtggctcaccaacgagcagcgggagaagctggtgcgcaagcggtaccagggctgggggcgcctgagcaagaagctcctgaccggcatcacggacgagaacggccagcggatcatcgacctgatgtgggacacctccaagaacttcatgcagatcgtccaccagcccgtgttcgaggagcagatcgccgagctcaaccagcagctgctgcaggacgcggacaaggccccgctcgaggtggtcgacgacatcctggccgacgcctacaccagcccccagaacaagaaggccatccgccaggtggtgaaggtcgtggcggacgtggtcaaggccgtggggaacgcccccgcctccatcagcatcgagttcgcgcggaacgaggaccgcaacaaggagctgaagaactcccgccggcacagcatcgagaagctctaccacgagaccgccgagaagctggtgaagcagacgaacctgctcgaggagctgggcaacgtcaaggacctgaacgaccgctactacctctacttcacccaggccgggcgggacatgtacgacggcacccccatcaacatcgacgagatcagcacccactacgagatcgaccacatcctgccgcagtccttcctgaaggacaacagcctcgacaaccgcgtgctggtgaagaagtccgagaacgccgccaagagcgaccgggtccccgcgaagctgtacggggccaagatgcgcgccttctggaagcagctcaaggagtcccagctgatcagcaaccggaagtacctgaacctcaccacggaccccgagcaggtcgacaagtaccagatgcagggcttcgtgcaccgccagctggtggagacccggcagatcatcaagctggccgccaacatcttcggctccctctacccggacagcgcggtgatcgagacccgcgccgagctgaccaagcagctgcgggagaagttctccctctacaaggtgcgcgacgtcaacgactaccaccacgccgtggacgcctacctgacggccttcgcggggcactacctgtaccagcggtaccccaagctccgccccatgttcgtgtacggcgactacgccaagatctacgccgacgacctgaagcggctgcgcagcgtcaacctcttccacgacctggagaaggaccagtacaactccgggaccgccgtgaaccccgagaccaaggagaagatcgtggacgtcgactggctgagcgactacgtgtccaagatccagcacttcaagtacatgctcatcagcaaggcggtgtacacccagcacggccagctgtacggcgccacgatcctgccggtcgcccaggtggacaagatctccgcccccatcgggatcaaggacgacaagcccgtggacatctacggcgcctacaccaacgaggtcgcggcctacatggccatcgtgcgggtgaacgggaagaagcccaagtacaaggtcgtgagcgtgccggtccgcatgctccagcggctgaagatggccgagcagaagggccacgaccagtacatgcagaccctgcacgacgtgctcctgcgcaacttcacctccctgaagaagaaccggaagacggggctcaaggaggccgtggtcaaggacttcgacgtgctggtgccctgcgtccgctacaaccagctggtgatcgacggcgacaccaagttcaccctcggcagcgcgacctaccagcacaacgccaagcagctggtgctgtgcaaccacagcctcgagacgctggccaacaacttcgagtacgtccgcaagcaccccgacgaggccgacgagcggatgatcatgctgtacgacgacatcctcgaccaggtgaaccactacttcaccctgtacgacaagaacaagttccgcgagaagctgaacgccgggcgggacaagtacctcaagctgcccaccttctcccagttcgagaacaacaagaagaccgcgatcggcaagagcgaggccatcatcaacatcctgcgcgggctccacgccaacgccgccatcacgaacctgaagtgcctgggcgtgtccaccccgttcgggcagctccagagcccctccggcatcgagctgagcgagaacgcgaagctggtctaccagtcccccaccggcctgttcagccgggaggtgctcctgaaggacctgtga

SEQ ID NO: 2116 - RNA, 4191 nt, synthetic construct
  misc_feature 1..4191: note = Cas9 variant
  source 1..4191: mol_type = other RNA
atggccaacctgcgcaactacaagggcgactacaacatcgggctcgacatgggcaccgggagcgtgggctgggccgtcaccgactccgaggggaagctgctgcacttcaagaagcagcccacgtggggcagccgcctcttcgactccgcggagaccgccgccagcgcccggatcccgcggggccagcgccggcgctacgtgcggcgccggtggcgcctggacctgctccagcagctgttccaggacgaggtgtccaaggccgaccccgagttcttcatccggctgcgccagagccggctcctgaaggaggaccgcgaggaggggcaccgggactacaaccaccccctgttcaacgactccgacttcaccgagaccgactactacaaccgcttccccacgatctaccacctccggaagtggctgatggagaccgacgagaaggcggacatccgcctggtctacctcgccgcccacaacatcgtgaagcaccggggcaacttcctgcgccaggagaacaccagcctgtccgccaagaacgcgcggccgctcgacgccctgcgcgagttccgcagcgccctggtggactggtgcgccgagctcgggtacgagtgcaaccccgacgagtccggcgagatcagcaacgagatcctgtccgtcctggaggaggagcacgtggccaacagcgacaagaagaagcggatctccagcctcatcggggtggcgatgaacgagggcgccaaggagtccaaggcctgcaacgacgccctggccggcgcgatggtcgggctgaaggccgagttcaagaacgtgttcggcgagatcagcgccgagcagacctccatctacctcagcaacgacgaggccgtggacgccctgcgcgaggggatccccgacgagggcctggagctgttcggcaagctctgcagcgtctactccgcgtacgtgctgcaggggctcctgagctacgcccccggccagacgatctccgtgaacatggtcgccaagtacgagaagtacgggaacgacctgaagaccctcaaggccctggtgtgcgagtacgcccgggcggagtacgacagcttcttccgcggcgagttctaccgggaccaggacgggcacgagctgaacatctacaacgcctccaaggcccagggctacacccgctacaacctcggcaccagcaagatgtcctacgaggacttcgagaaggccgtgaagaagctgttcgcggggacggccgccgaggaggacggccggtacctgcagatgatgaaggagttcggggagcagcgcttcctccggcgcctgaagaccagcgacaacggctccatctactaccagctgcacctcgaggagctgaccgccatcctgagcaaccaggggaagcactacccgttcctcgtcgaggacgccgagaagatcaagtccctggtgagcttccggatcccctactacgtgggccccctgaccgaccgcaacgcgcggaaggacaagcacggcaagaaccgcttcgcctggtccgagcgcaagagcgggatggaggacgccgtcatcacgccctggaactgggacgaggtgatcgaccggggcaagtccgccgaggccttcatcacccggatgaccgggatgtgcacctacctgcagggcgaggacgtgctcccgaagtgcagcctgctgtacgaggagttctgcgtcctcaacgagctgaacgggtcccgctggggcatggacggcgacaaggagcaccggttcgacgcggccgaccgcgaggccatcatcgaggagctgttcaagaagaagaagacggtgaagtacaaggacgtcgccaactggctcgagcgcgaggccgggcggatgaacgtgcacgtgatgggcgggcagggcgagaccggctacgagagcaagctgtccagctactacttcttccgccgggacatcttcgacgtcgaggagctggaccgcgcggactaccccatgatcgagcagatcatcctctggaacaccctgttcgaggaccggcgcatcctgaaggagaagctcgaggacgcctacgggcccaagggcaacgggcggctggacgacgaccagatcaagaagatctgccgcaagcggttcaccggctgggggcgcctgagcaagaagttcctcacgggcatcaaggtggacaccgactgcggcccccggtccatcatggacgtgctgcgcgagggggacccgaacgccggcttccgggggaagaccatggtcatgatggaggtgctgcgcgacgagaacctcggcttccagcagaaggtggacgagttcaacaagaactacttcgggcagaagggcaaggccctggaggtcaacgagctgcccggcagccccgcgatccggcgctccctcaaccaggccatccggatcgtggacgagatcgccaagatcgccgggaaggaccccgagagcatcttcatcgaggtgacccgcgacgacgagctggacaagcggggcaagcgcacgaagcggcgctacgacgccctgaaggaggcgctcaccgtcttcaagaaggaggacccggagatctgggccgagctgcaggccacctcccccagcgacctggacgagcgcctcaccctgtacttcatgcagcgggggaagtgcctgtactccggcgagcccatcgacatcaacaagctcagctccggggagtacgaggtggaccacatcatcccccgcagctacatcaaggacgactccctggagaacaaggccctggtgtgccggaagtacaaccagagcaagacggacgccatgctcctggacccgtccatccgccggaagatgcgcagctactgggacatgctgctcgacgcgaagctgatcggccccaagaagcaccggaacctgctccgcgaccacatcgacgagaaggccatgaagggcttcgtcgcccggcagctggtggagacctcccagagcgtgaagctggccgggtccctcctgagcgtccgctaccccaacgccaacatcgtgcccgtgaaggcgagcatgtcccacgacctgcgggaggccgccggcttcgtcaagtgccgcgaggccaacgacttccaccacgcgcacgacgcctacctcgcctgccggatggggctgttcatccagatgcgccacccgaaggtgtacgagaaccccatcgccatgacccgggtgatgcagaagtacgcccagcagcagagcaaggagttcaaccgcaaccaccgggtccccggcacctccgggttcatcgtgaacagcttcatgtccagcggcttcgacaaggagacgggcgagatcttcaaggacacctggaacgcggagaccgagatcgaggggatccgcaaggccctgaactaccggcagtgctacatctcccgcatgccgatggaggacaccggcgccttctggaacgccaccgtgtacagcccccgcgaccccaagatggggcccaagctcgccctgccgctgaagaagggcctcgaccccaagaagtacggcgggttctccagccagcagttcgcgtacttcttcgtctacgaggcccgggacaagaaggacaagcaggtcttccgcttcgccgaggtgcccgtgtggctggcctcccagatcgagagcgacaagatcgccctggagcggtacgcgacgggcctcgccgaggccgagaagctgaagttcgtgcgcatcgagcgggccaagatcctgaagaagcagctcatcgagatcgacggggaccgcttcatcctgaccggcaagaaggagatgcggaacgggcgcgagctggccctctcccagaaggagaccctgaacctgatcgtggcgggcgacgagaacgccagcctcgacgaccggggcaacgcctccgacgccgtcttcgacgcgatcgtgcgccagggggacgagatcggcctgcggctgtacaagcagctcaagatcgccgagatcgccgagcgctaccggagcgtgggggccgacgccaaggtcggcgcggtgatgtccctgctgagctccatcaacgccagcagcaacatggtgaacctctccatggtcgggggcagcaagtacgccggcaacctgcagcccaactactccaacctgctcagcgacccggagaccaacttcgtgatcatcgaccagtccgtgacggggatgttcgagcgccggacccgcatcggcctgtga

SEQ ID NO: 2117 - RNA, 4191 nt, synthetic construct
  misc_feature 1..4191: note = Cas9 variant
  source 1..4191: mol_type = other RNA
atgaccaagccctacagcatcggcctggacatcgggaccaactccgtgggctgggccgtcatcacggacgactacaaggtgccggccaagaagatgaaggtgctcgggaacaccaaccgcgactacatcaagaagaacctgctgggcgcgctcctgttcgacgggggcgagaccgccgagggccggcgcctgaagcggaccgcccgccggcgctacacgcggcgcaagaaccggctccgctacctgcaggagatcttcgccgaggagatgatgcaggtcgacgagagcttcttccagcggctggacgactccttcctcgtggaggaggacaagcaggggagcaagtaccccatcttcggcaccctgaaggaggagaaggagtaccacaagaagttcaagaccatctaccacctccgcgaggagctcgccaactccaaggagaaggcggacctgcggctggtgtacctcgccctggcccacatgatcaagttccgcgggcacttcctgtacgagggcgacctcaaggccgagaacaccgacgtccaggcgctgttcaaggacttcgtggaggagtacgacaagacgatcgaggagagccacctgtccgagatcaccgtggacgccctcagcatcctgaccgagaaggtctccaagagctcccggctggagaacctcatcgcccactaccccaccgagaagaagaacacgctgttcgggaacctgatcgccctcagcctgggcctgcaggccaacttcaagaccaacttccagctctccgaggacgcgaagctgcagttcagcaaggacacctacgaggaggacctggagggcctcctgggggaggtgggcgacgagtacgccgacctgttcgtgtccgccaagaacctctacgacgccatcctgctgagcgggatcctcaccgtcgacgacaactccacgaaggcgcccctgagcgcctccatggtgaagcgctacaaggagcacaaggaggagctggccgccttcaagcggttcatcaaggagaagctcccgaagaagtacgaggagatcttcaaggacgacaccaagaacggctacgccggctacgtgggggccgacaagaagctgcgcaagcggagcggcaagctggcgaccgaggaggagttctacaagtacgtcaaggggatcctcaacaaggtggagggcgccgactacttcctggacaagatcgaccgcgaggacttcctgcggaagcagcgcaccttcgacaacgggagcatcccccaccagatccacctccaggagatgcacgccatcctgcgccggcagggcgagcactaccccttcctgaaggagaaccaggacaagatcgagaagatcctgacgttccgcatcccctactacgtgggcccgctcgcccggaaggggtcccgcttcgcctgggcggagtacaaggccgacgagaagatcaccccctggaacttcgacgacatcctggacaaggagaagtccgccgagaagttcatcacccggatgaccctgaacgacctctacctgcccgaggagaaggtcctgcccaagcacagcccgctctacgagacgttcaccgtgtacaacgagctgaccaaggtgaagtacgtcaacgagcagggcgaggccaagttcttcgacaccaacatgaagcaggagatcttcgaccacgtgttcaaggagaaccgcaaggtgacgaaggacaagctgctcaactacctgaacaaggagttcgaggagttccggatcgtcaacctgaccgggctcgacaaggagaacaaggcgttcaacgccagcctgggcacctaccacgacctgcgcaagatcctcgacaagtccttcctggacgacaaggtgaacgagaagatcatcgaggacatcatccagaccctgacgctgttcgaggaccgggagatgatccgccagcggctgcagaagtacagcgacatcttcaccacccagcagctgaaggagctcgagcgccggcactacaccgggtggggccgcctgtcctacaagctgatcaacggcatccggaacaaggagaacaagaagacgatcctcgactacctgatcgacgacgggtacgccaaccgcaacttcatgcagctgatcaacgacgacgccctcagcttcaaggaggagatcgcccgggcgcagatcatcggcgacgtcgacgacatcgccaacgtggtgcacgacctgcccgggtcccccgccatcaagaagggcatcctgcagagcgtcaagatcgtggacgagctcgtgaaggtcatggggcacaaccccaccaacatcatcatcgagatggcccgcgagaaccagaccaccgacaagggccggcgcaactcccagcagcgcctgaagctgctccaggacagcctgaagaacctggacaacccggtgaacatcaagaacgtggagaaccagcagctccagaacgaccggctgttcctgtactacatccagaacggcaaggacatgtacaccggggagacgctcgacatcaacaacctgtcccagtacgacatcgaccacatcatcccccaggccttcatcaaggacaacagcctggacaaccgcgtcctcacccggtccgacaagaaccgcggcaagagcgacgacgtgccctccatcgaggtggtccacgagatgaagtccttctggagcaagctgctgagcgtgaagctcatcacccagcggaagttcgacaacctgaccaaggcggagcgcgggggcctgacggagaacgacaaggccggcttcatcaagcggcagctcgtggagacccgccagatcaccaagcacgtcgcccaggtgctggacgcccggttcaacgccaagcacgacgagaacaagaaggtgatccgcgacgtcaagatcatcaccctcaagagcaacctcgtgtcccagttccggaaggacttcaagttctacaaggtgcgcgagatcaacgactaccaccacgcgcacgacgcctacctgaacgccgtcatcgggacggccctgctcaagaagtaccccaagctggcgagcgagttcgtgtacggcgagttcaagaagtacgacgtgcggaagttcatcgccaagtccgacaaggagatcgggaaggccaccgccaagtacttcttctacagcaacctgatgaacttcttcaagaaggaggtcaagttcgccgacggcaccgtggtggagcgcccggacatcgagacctccgaggacggggagatcgcgtggaacaagcagacggacttcaagatcgtccggaaggtgctcagctacccccaggtgaacatcgtcaagaagaccgaggtgcagacccacggcctggaccgcggcaagccccgggggctgttcaacgccaacccctccccgaagcccaagcccgacagctccgagaacctcgtgggcatcaagcgcaacctggaccccaagaagtacgggggctacgccgggatcagcaactcctacgccgtcctggtgaaggccatcatcgagaagggcgtgaagaagaaggagaccatggtcctcgagttccagggcatcagcatcctggaccggatcacgttcgagaaggacaagcgcgcgttcctgctcgggaagggctacaaggacatcaagaagatcatcgagctgccgaagtactccctgttcgagctcaaggacgggagccggcgcatgctggcctccatcctgagcaccaacaacaagcgcggcgagatccacaaggggaacgagctgttcgtgccccagaagttcaccaccctgctgtaccacgccaagcggatcaacaaccccatcaacaaggaccacatcgagtacgtgaagaagcaccgcgacgacttcaaggagctcctgaactacgtcctggagttcaacgagaagtacgtgggcgccacgaagaacggcgagcggctcaaggaggccgtggcggacttcgactccaagagcaacgaggagatctgcaccagcttcctgggggccgtcaactccaagaacgccggcctgttcgagctcaccagcctggggtccgccagcgacttcgagttcctgggcgtgaagatcccgcgctaccgggactacaccccctccagcctcctgaaggactccatcctgatccaccagagcatcacggggctctacgagacccgcatcgacctgtccaagctgggcgaggactga

SEQ ID NO: 2118 - RNA, 4191 nt, synthetic construct
  misc_feature 1..4191: note = Cas9 variant
  source 1..4191: mol_type = other RNA
atgaagcgcgtgaacgaggactacatcctgggcctcgacatcgggaccaacagctgcggctgggccgtcaccgacaagaagaacaacctgctgaagctccgggggaagacggccatcggctcccacctgttcgaggaggggcacaccgcggccgaccgccggggcttccgcaccacccggcgccggctgaagcgccggaagtggcgcctccggctgctggaggagatcttcgccgagcccatggccaaggtggacccgggcttcttcgtgcgcctccaccagagctgggtcagccccctggacaaggaccggaagaagtacaacgccatcgtgttccccacggcgaaggaggaccaggccttctacaagcactacgccaccatctaccacctccgcgacgagctcatgacccaggaccggcagttcgacctgcgcgagatcttcctggccatccaccacatcgtgaagtaccgggggaacttcctccaggacacccccgtcaaggacttcgaggcgagcaagatcgaggtgggcccgatcctgtcccacatcaacaacgccttcgccgagaagatcgtggaggaccaggaccccatcgagctgaacgtcgccaacgccgcggacatcgaggacgtgatccgcgggaaggacgccgagaagacggtgtacaagctcgacaaggtcaagaagatcgccaagctgctgaccgacagcaccgccaaggaggagaagaacgtggccaagcagatcgcgaacgccatcatgggctacaagacccagttcgagacgatcctcgacaaggagatcgacaagtccgacaaggcccagtgggagttcaagctgagcgacgccgacgccgacgacaagctggacgcgctcctgcccgacctggacgagaccgaccagaccgtggtcgccgagatcgagaagctgttctccgccatcaccctgagcacgatcgtggacgagaacaagtccctgagccagtccatggtggagaagtacaagaagcacaagaaggactacaagaagctcaagaagtacatcaacaccctgcaggaccagaccaaggccaagaagctgctcctggcctacgacctgtacgtcaacaaccggcacgggcgcctcctggaggcgaagaagaccttcgaggacaagaagaagaagaaggccctgacgaaggacgagttctacaagatcgtgaaggacaacctcgacgacagcgacctggcccacgagatccagcaggagatcgccgcggacaacttcatgcccaagcagcggaccaactccaacggcgtgatcccgttccagctgcaccagatcgagctcgacaagatcatcgccaaccagggcaagtactaccccttcctggccgccgagaaccccgtcgaggaccaccgcaagcaggccccctacaagctggacgagctcgtgcgcttccgggtgccgtactacgtcgggcccatgatcaccgcggacgagcaggagaagaccagcggcaagtccttcgcctggatggtgcgcaaggaggacgggcagatcacgccctggaacttcgagcagaaggtcgaccggcaggagagcgccaacaagttcatcaagcgcatgaccatcaaggacacctacctgctgtccgaggacgtgctccccgccaacagcctgctgtaccagcggttcgaggtgctgaacgagctcaacaacatccgcatcaacggcagccggatctccgtcgacctgaagcagcagatcttcaacgacctgttcgaggagaagaagaccgtgacggagaagtccctcacctcctacctgaagcagaacctgcacctcccgaccgtggagatcaagggcctggccgaccccaccaagttcaacagctccctggcgagctactaccacctcaagtccctgcacgtcttcgacaaggagctggccgacccccagtaccagaaggacttcgagaagatcatcgagtacagctccatcttcgaggacaagaagatcttccaggacaagctccacgccgagttcaagtggctgacgcccgagcagttcaaggccatcagcacctggcgcctgcaggggtggggccggctctcccgcaagctgctggtggagctccacgacaccaacgggcagaacatcatggagcagctgtgggacagccagaagaacttcatgcagatcgtgaccgagccggacttcaaggacgccatcgcgaaggagaaccagaacgtcacgcgggccaacggcgtggaggagatcctggccgacgcctacacctcccccgcgaacaagaaggccatccgccaggtggtcaaggtggtggccgacgtcgtgaaggccgccgggggcaagaagcccgcgcagttcgccatcgagttcacccgggaccccgacaagaacccgcagctcagccacatccgcggcaccaagctgctgaaggcctaccaggagaccgccggggagctcgtggaccagaagctgacggactccctgaaggaggccatgaccagccggaagctcctgaaggacaagtacttcctgtacttcatgcaggcgggccgcgacgcctacaccgggcagaagatcaacatcgacgaggtctccaccaactaccagatcgaccacatcctcccccagagcttcatcaaggacgactccttcgacaaccgggtgctgacggccacgcccctgaacgccgagaagtccgacgacgtgccctacaagcgcttcgccaacaactacgtcagcgacatgaagatgaccgtgggcgagatgtggaagcactggcagaaggcggggatcatcaacaagcacaagctcggcaacctgctgctcgacccggaccggctgaacaagttccagaagtccggcttcatcaaccgccagctggtggagaccagccagatcatcaagctcgtcagcgtgatcctgcagaacaagtaccccgacgccgagatcatcaccgtgaaggccggggacaacagcgccctgcgccagcggctcaacctgtacaagtcccgcgacgtcaacgactaccaccacgcgatcgacgcctacctgagcatcatctgcggcaacttcctctaccaggtgtaccccaagtaccggccgtacttcgtgtacgggaagtacaagaagttctcccaggaccccgacctgcagaaggaggtcatcaagcacttcaagggcttcaccttcatgtggcccctgctccagaaggacaacagcgagcgcaaggcccccgagaagatcaaggagaacaactccgaccggatcgtgttctacaagcacccggacatcttcgacaagctgcgcaaggcctacaactacaagtacatgctggtgagccgggagaccaccacggagaactccggcctcttcgacgtcaccatctacccccgcggggagcgggacctggccaagacccgcaagctgatccccaagagcaacggcctcgaccccaagatctacgggggctactccgggaacaccgacgcgtacatggtgatcgtgaagatcgacaagggcaaggagagcatctacaaggtcatcggcgtgccgatgcgggccctggcctccctgaaccgcgccaagaagcaggggaactacaaggaggagctccaccaggtgctggagccccagatcatgttcgacaagaacggcaagcccaagcggagcgtcaaggggttccgcatcatcaaggaccacgtgcccttcaagcaggtcgtgctggacggcgacaagaagttcatgctcaactccagcacgtacgagatcaacgccaagcagctgaccctgaccccggagaccatgcggatcgtgacggacaacctcaagaagggggaggaccaggaccagctgctggtgaaggcgtacgacgagatcctccagaaggtcgaccagtacctgcccctgttcgacgtgaacaagttccgcaacagcctccacctgggccgggccaagttcctggacctcgccgtgaacgacaagaagatcaccctgaccaacatcctgaacggcctccacgacaacctggtcacccccgacctgaagaacatcgggatcaagacgcccctcggcaagctccaggtgccgtccgggatcgtgctgagctccgaggccatcctgatcttccagagccccaccggcctgttcgagaagcgcgtccggatcgccgacctgtga

SEQ ID NO: 2119 - RNA, 4194 nt, synthetic construct
  misc_feature 1..4194: note = Cas9 variant
  source 1..4194: mol_type = other RNA
atgaaggactacaacatcggcctggacatcgggaccagctccatcggcttcgccgccatcgacgacgacaacaacctcatccgcgtgaaggggaagaacgtcatcggcagccggctgttcgcggaggggaagaccgccgccgagcgccggggcttccgcacggcccggcgccggtacaaccgccggaagtggcgcctgaagctcctggacgagatcttctacgaggagatcatccacatcgaccccgagttcttcaaccggctgaagcagtccagcatctccccgaaggacgagagcaagaagtacttcggctccctcctgttccccgacaagaccgacagcgcctactaccacgacgggaaccagaccatctaccacctccgcaaccggctcgtgcaccagaaggagaaggcggacatccgcgagatctacctggccctgcggcacatcgtgaagtaccgcggcaacttcctcgactccacccccgtcagctccttcgaggccgacaacctgaagctggacgagctcgtgcccgtgatcaacgacatgtacgagaacatcgacatcgacttcagcatcaacgtcgacaacatctccgagatcgagaaggtgctgctggacaaccacctcaagagcgccgacaagcaggaccggctgaaggagctgctctacgacaacccggagtaccccgacgacaaggtgaagcagaaggagatctccaagttccgcaaggacctggacaaggagatcatcaaggtcatcgtggggtacaagttcaacgcgtacaagatcgtgaactacatccccgacgacggcagcaagttctccttcagcttctccgacgagagcagcgacgacaagctggacgacctctccgaggtcctggacgacagccagatggagatcctgaacacgctcaaggtgatctactcccgggtgcgcctgaaccagatcatccccaacgggatgggcctgagcgagtccatggtcgccaagtacaaccggcaccacgagcagctcgaggacctgaaggagctgctcgacgtgctgccgaacgacgagaagcgcagcatcgagtacgcctacaccgcctacatcggcaacgtggacaagcagaagtacaacaacaacctggtcgcctccctcaaggacctgcccatcaagggggacatcaacaagaagatccaggcggtgttcgagtacgccaagggccacatcagctcccaggacctgtacgacgtgatcaagaccatcatcatcgacaagtacctcgaggacgagagcttcgagtaccacgacctggtcgagcgcatctccaacgacatcgacaacaaggactacctgctcaagcagcggagctcccagaacgggaacatcccccaccaggtgcaccagatggagatggacaagatcatcgccaaccagagccagtactaccccttcctgggcgtgctgaacccgaacgagtcccgccggcacatcgccaagtacaagatcagcgagctcgtctccttccgcgtgccctactacgtcggccccctgatcacccccgaggagcaggagaagacgagcgggaagcacttcgcctggatgaagcggaaggaggcgggcaagatcaccccgtggaacttcgaggagaaggtggacaaggaggccaccgccgccaagttcatcaagcgcctgaccgtgaaggacacgtacctcctgaacgaggacgtcctgcccgacaactccctgctctaccagcagttcaaggtgctgaacgagctgaacatcgtgaaggtcaacaacaagcggctcaccctgagcgagaagcagggggtgtacaacgacctgttcaagaacaccaagagcatcaccgtgaagcgcctcaagaactacctgatctccaactacaagcacctggagaacatcgagatcacgggcctcagcgacggggacaagttcaacaactccctgggcacctacaacgacttcaagaagatcttcggcgcccggatcgacgacgtcaactacagcgcggacttcgagaacatcatcgagtggtccaccgtgttcgaggaccgcagcatcctgaaggagaagctcgagaaggacatcgactggatcacccccgaggagatcaaggccgtggtcgccaagcggtactccgggtggggccgcctgagcgccaagctgctcacggagctgctggacgacgacgggcagcggatcatcgacatcctctggaacgactccatcaccttcatggaggccgtgagcaagcccgagatcaaggcgcagatccagaacatcaaccgcgacttcatcaaggccaccgacatcgagaccgtgctggacgaggcctacacgtccccgcagaacaagaaggccatccgggaggtctacaagctggtgaaggacatccagaaggcgatgggcgggaaggcccccagctccatcagcatcgagttcacccgctcccccgaggacaacggcagcgtgaccaagacccggtacaacaacatgcagaacaagtacaaggagctcggcaaggagctgtccgacgacctgagcgcccagctcaaggagtacaaggggcgcatggaccaggacaagttctacctgtacttcatgcagatgggcaaggacctgtacgacgggagcacgatcaacctcgacgacctgaactcctaccagatcgaccacatcgtcccccagagcttctacaaggacgactccatcgacaaccgggtgctgacccactacaccaacaaccagaagaagggcaaccacaccccgctcaacgggctgaacatcgacgcccagacgcagaacctgtggaagcacctcaacaagctgggcctgatcagcaagaagaagctccagaacctgtgcttcaaggacatcaaccagctgtccaagtacaccaagcacggcttcgtgcgccgccagctcgtcgagaccagccaggtgatcaagctggtggccaacatcctgtccgacgagttcgcgaacgacgggaccaagatcatcgaggtcaaggccaagatgaacagcctcatgcgggacacgttcaacctgtacaaggtgcgccagctgaacgactaccaccacgccgtggacgcctacctcaccaccttcgtcggcaagtacctgtacaagcggtaccccaagctgcgctccatgttcgtgtacggggacttcaagaagttcagcgccgaggacgacctcaaggacatcaagaccttcaacttcctgcacgacatcaccaaccccaaggagtccaacaaggagaagatctacgacgagaagtccggcgagctgatcctcgaccggaagcacgcgatcgagacgatcaagaagatctaccagtacaagttcatgctgatcgtgcgcgaggtcagcaccaagagcggccagctgttcaagcagaccatctactccgccaagaagaccaacgggctcaagagcgccatccccgtgaagtccaacctggagccgagcatctacggctaccggtccgggaacgtggaccaccacatggtcatcgtgaagatcaagaagggcacgaagtacagcttcaaggtgatcgggatcagcgcccgcgccatccaggagctggagatcgcgaagaagatcggcaactaccgggacaagctctacgaggtcgtgtccgaccgcctgagccagtccatgaagtccgtggagagcttccggatcatcctggacaacatcatgtacggccagctcatcgtcgacgggaacgacaagttcaccctgggcagcgccgactaccgcaagaactcccggcagctggtgctctgcaccaacagcctgaagatcctgaaggacgaggactacatgaaccgcctctccgacatccagcggagcaagctgatggtgcaggtctacgacgagatcatcaagatcatgaagaacaagtactccctgttcatcagcaacaccgagaagctcctggagaagcgcgacatcttctgcgggctgtccttcgacgagcagaagatcgtgatctggaagatcatcatcgacctccacaacggccccttcacgaagatccaggagctggggatcaacaacaagatgggcaccttccagaccaagcacggcatcatcctgaccgagaacgccatcgtgatctaccagagcccctccgggctgttcgagcggaaggtccgcctgaaggacctgtga

SEQ ID NO: 2120 - RNA, 4194 nt, synthetic construct
  misc_feature 1..4194: note = Cas9 variant
  source 1..4194: mol_type = other RNA
atgaagaaggtgctgggcctcgacctggggaccaacagcatcggctgggccctggtcaacgaggccaccaaggaggagaagaaggaggggaagtccagcgagatcatcaagctcggcgtgcgcgtgaaccccctgacggtcgacgagaagaccaacttcgagaaggggcggccgctgtccaccaacgcggaccgcaccctcaagcggagcgcccgccggaacctgcagcgctacaagctgcggcgccggaacctcatcgagatcctgatcaagaacggcttcatcacgaaggacacgcccctgaccgagaccggcaaggacacgacccaccagaccctcaagctgcgcgccaagtccgccaaggagaaggtggacctgaaggacttcgccaagatcctcctgaccatcaacaagaagcgggggtacaagagctcccgcaaggtgaacagcgacgaggacggcctggcgatcgacgggatggccgtcgccaagcacctctacgagcagaacctgacgcccggccagtacgtgctgaacctcctgcagaagaacaagaagtacgtgcccgacttctaccggtccgacctgcaggaggagttcaagaacatctggaacaaccagaagacctactacttcgacatcctcaccgacaccctgttcgaggagctgaaggacaagaacaagagccagacgtgggccatctgcaagaagccgttcgacatcgcggggatcaagcagatcggcaaggcctccgacaagcgcctcgagcggtacaagtggcgcaccgagggcctgacccagaagctgaacctcgagtacctggccatcgccctgcaggagatcaacaacgacatcaacaagagctccgggtacctcggcgccatcagcgaccggtccaaggagctgttcttcaacaaggagaccgtcggggagaacctgtaccgccagctcgtgaagacgccccacaccagcctgcggaaccaggtgttctaccgccaggactacctggacgagttcgagaccatctgggagacccaggcgaagttctacccccagctcacgcacaccctgaaggaggagatccgggacgtcatcatcttctaccagcgcaagctgaagtcccagaagtccctcatcagcttctgccagttcgagagctgggagcagacctacatcgagaaggagaccggcaagagcaagacgcgcaccgtgggccggaaggtgatccccaagtccagcccgctgttccaggagttcaagatctggcagaacctgaactccctcgagttccgcaacagcgacgagggggagatcatcgagttcatcaagctggacgaggacatccggcagaccgtcttcgaggagctgaacctccgcggcaacctgaagcccaacgacgtgctgaagatcctggggaactacatctccctcggcaaggtgagccagtggaagtgcaacttcgaggagatcgaggggaaccggaccaacgccgccctgtacaacgtctaccagatcatcgccgagaacgagggctacggcttcgactgggccaagaagacggcgtccgagatcaacaaggagctgaagaacatcttcccccagctcgggatcgacgccagcatcctggacttcgacttcacccaggccaacttcgacaagcagacctcctaccagctgtggcacctcctgtacagcgccgaggaggacttcaagatctccgaggaggacaaggtgctgtacggcaacagctccgtgagcctcaagaagaagctgcaccagaagtacgggttcaagcccgagtacaccaagctgctcacgaacatctccctgcagccggactacggcaacctgagcgccaaggcgatctgcaacatcctcccctacctgaaggagaacaacgtctactccgaggcctgcgacctgaccgggtacaaccacagcaacttcctcaccgccgaggagcaggccaagcgccccctgaagcccatcctggagctcctgaagaagaactccctgcggaacccggtggtggagaagatcctcaaccagatggtcaacgtggtcaaccaggtgatcgagacctacggcaagcccgacgagatccgcatcgagctgacccgggagctgaagaagtccgccaaggagcgcgcgaacatgaccaagagcatcgccgacgccacccggcgcaacgacgactaccggaagaccatcatcaaggagttcggcatccccaaccccaccaagagcgacgtggtccgctaccggctctggcaggagctggccagccgcgggtacaaggacatcttcacggacaccgagatcaagccgcaggagctgttctccaacaagatcgacatcgagcacatcatccccaaggcgctcctgttcgacgacagcttctccaacaagaccctggccttcaagaaggacaacctcaagaaggccaaccggaccgcctacgacttcatcgccaacgactacgcgcccaacctggagaactacatcgagcgcgtggagagcctgcacaaggaccggaagatcacgcgcgccaagcgcaacaagctcctgatgctgcagtccaagctccccgacggcttcatcgagcgggacctgcgcaacagccagtacatcaccaaggaggccaagaagatgctgtacgaggtgtgccggaccgtcgtgtccaccagcgggtccatcacggacaagctccgcgaggactgggacctgatcaacgtgatgaaggagctgaacttcccgaagtacaaggccctcggcctgaccgagaagatcgagcggtacgacatcggggccgagaagatgaaggaggtcgagatcatcgaggactggaacaagcgcaacgaccaccggcaccacgcgatcgacgccctgaccgtggccttcagcacccactcccacatccagtacctcaaccacctgaacgcccgccgggacgagggccacaagaagcacgccgcgatcatcgccatcgagagcacgatcaccgagaaggagggcaacaagaagcgccggttcatcgcgcccctgcccaacttccgcctccaggccaaggagcacatcgagtccatcctggtgagcttcaagaacaagaacaaggtcgtgaccaacaacatcaacaagaccaagcggatcaagaaggacaagttcaacacgaaggtgcagctgacgccccgcgggcagctccacaaggagaccatctacggcaagatcaagcagccgctggagaagcacatcaagctgaacaagtccttcaccctcgagcaggccaagctgatcatcgacaagcggcagcgcgagaaggtcctgaaccacctcgagaagtacgcccacaacagcgacatcgccttcaacagcaagaccctgaagaagaaccccctgctcatctccgacgagcccctgaaggaggtgctgtgcttcgaggaggtgttcaccatccggaaggacatcagctacgacaacttcaagaacgagaagcagctcgacaaggtcatcgacgagaaggtgaagcaggccctgaaggagcgcatcaaccagtacaacggggacttccgggaggccttctccgacatcgagcgcaacccgatctggctgaacaaggcgaagggcatctgcgtgaagcgggccaccatcaagggcgtcagcaacgccgagcccctccacaccgccaagaaccacctgggggaggaggtgctgacggagaacaaggagcagatccccgtggactacgtctccaccggcaacaaccaccacgtggccatctacgaggacgaggacgggaacctccaggagaaggtggtcagcttctacgaggcggtgatccgcgtgaacgagggcctgcccatcatcgacaaggagtacaacaagtccctggggtggaccttcaagttcaccatgaagcagaacgagatgttcgtcttcccgagcgaggacttcaaccccacggagatcgacctcctggaccagaagaacgcctccctgatcagccccaacctcttccgcgtgcagaagttcaccatcaaggactacttcttccggcaccacctggagaccaccgtggagaacaacaacacgctgaagaacaccacctggcgccgggagggcctctccggcatctacgggatcatcaagatccgcctgaaccacctgggcgagatcgtccaggtgggggagtactga

SEQ ID NO: 2121 - RNA, 4194 nt, synthetic construct
  misc_feature 1..4194: note = Cas9 variant
  source 1..4194: mol_type = other RNA
atgaacgagaacaaggagtggttcctgggcctcgacatcgggaccgccagcgtgggctgggccgcgaccgacacgaactacaacctgctgaagctcaaggggaagaagtcctggggcgtccgcctgttcgacgaggcccagaccgccaaggagcggcgcgactgccggagcaagcgccggcgcctggcccggcgcaagtggcggctcgggctgctggaggagctgttcgccgaggagatcaacaagatcgaccccaacttcttcatgcgcctccgggagtccaagtacaaggtgagcgacaagaccggcaacgtgccgtccatcctgttcaacgagaagaactacaccgacaaggagtactaccgcaactacaagacgatctaccacctccgggcggacctgatccacaagaacaaccccgacatccgcgagctgttcctcgccatccaccacatcctgaagtaccggggccacttcctgttcgccgggcagcagttcaagggcagcgagatcaaggacaacatccgcgagctcctgcagtacaactccctgaacatcaagatcgacatcaccgacgagctcatcaacaacatcgccgagatcctgctgaagaagaagaacagcaccgacaagatcatcgagttcaagaagctgttcgcggacgagaagcagctcatcgaggccctgcggctcgccctggggaacaagacccagctggccaagctgttcgacatcgaggcctacaaggagctcgacatctccatcaagacgatcagcttcaaggagaagatctacgaggacgtccgctccaactacgaggagatcctgggcgagtacatcatcgtgctcgacaccgcgaagctgatctacgacgccatcatcctgagcaagatcaagatcaagaacatgaccatctccgagagcaaggtggtctcctacgagaagcacgggaaggacctcaagcagctgaagcacctgatcaaggaggactgcaagctcagcaagaaggagaagcggcagctgttcgagaacatcttcgtgaaggaggacgagaagggcgccaactacgtgaactacatcggcaagaacaacgccgggtccagcaagtccagctgcagctacgaggacttcaagaagttcctgaccaaggagctcaagtgctgcgaggagtccaagctgaagcaggacatcctggccgagctcgagctggagacgttcctgccccgccagcggaccaaggacaacagcgtcatcctctaccagatccacaaggaggagctggagaagatcctgaacaacgcggtgcagtaccaccccttcctgaacaacaccgacgagtacggcatctccatcaaggagaagatcatccagctcctggagttccgcatcccgtactacgtggggcccctgaacaccagccacaaggtcggcgacggcgggttctcctggagcgtgcgcaacaagggctacgagcacatcgccgtgacgccctggaacttcaacaaggtcatcaacaaggaggagtccgccaagaacttcatcgagaacctcaccaaccagtgcacctacctgctgtacgaggacgtgctccccaagcacagcctgctgtactccgagttcgccctcctgaacgagctgaacagcatcaactacgggggcaagcggctcaccgtggagcaccgcaacctgatcatcgagcggttcttcaagcagtccgccccgaaggcgacggggaaggagctgaagaagttcctcatgagcgagggcgtcatcgacggcaaggacgagctgtccgggttcgacgtgagcatcaagaacgacctgaagtcctaccgcgacttcaagaagatcctcggcgacaagttcgacagcgagaaggtggagaagatgatccggtggatcaccctgttcggggagtccaagcagctgctcgtcgacaagatcaccaaggagtacggcgacatctacagcctggaggagatcaagaagatctccgggctgacctacaaggactggggccgcctcagcgagaagctgctgacggagatcgtgagctcccagctctacgacgagagcaccggcgagtgcttcaacatcatcaacgccatgcggaacaacaccctgctgttcatggagctcctggggaccaactacgactacttcgagaagatcaacatctacaaccgccggctgcgcaaggagatcacggagatcacgccccacatcctcgacgacctgtacgtgtcccccgccgtcaagcggagcatctggcaggtcgtgcgcatcgtggaggagctgaagaagatcatcggctccgagcccaagcggatcttcgtggagaccacccgcagcaacaaggagaagaagggggacgacggccggaaggactcccgcaagaaggccctcctggagctgtacaagaagatcaagaccagcgacatcgtcgagctcgagaaggccctggggcacaccgtggacttcgacaagaagaagcaggacctgaccgacatcgacaacaacaagctcaaggcgcggaagctgtacctgtactacacccagctcggccgctgcctgtacacgggcaaggccatcgacctgaacaacctcctgtccagcaactccgagtacgacgtggaccacatctacccgcagagcaagaccaaggacgggtcctggaacaacctggtcctcgtgaacaagaccgagaacagcaagaagtccaacggcctgatcagcgagtccatccagcggaagaacaagcacttctggcgcttcctgaaggccaagaacctcatcagcgaggagaagtacaagcgcctgacccggaccgaggacttcacggacgacgagctgagcgggttcatcgcccgccagctcatcgagacctcccagagcgtgaaggcggtctcccagatcctgcagaacctgaaccccaccaccgagatctgcttcagcaaggccgagaacgtgcacgacttccggcaggagttcggcaagatcaaggtgggcaagcgccggaacctcacggaggagcagcagaaggaggccaaggaggggcagctgatcaaggtccgcgacctgaacgacctccaccacgccaaggacgcctacctgaacatcgtggtgggcaacgtctaccacatcaagttcacccggaaccccaagaacttcatccgcaagaactccaagaaccgggagtacaccctgaacaccctcttctacagcgacaagatcgagcgcaacggggaggtggcgtgggagaagggcaagacggagaagatcgtgtccagcgtcatgtgcaacaacctgatcaacgtgacccggcgcacctccgagcagaagggggccctgtacgacgccaccatctacaaggccaacgccgcgaaggagggcagctactaccccgtgaagacgaagaacaagaacctcaaggacgtcacccggtacggcgggttcacctccatcaagatcgcctactacagcatcttcaagtacgacatccgcaacaaggacaaggtgaaggagaacatcaagatcatcccgatccccatctacatctcccagaacatcaagaccgacctggacctgatcaacttcgccgagaagcagatcaagctcaagaagggcgagaacatcgagaacctgcagctgatctacaagaagctcaacatcggggccctggtgaagatcgactactacccctactacgtcggcgggaagacgaacgacaacttctacatcgacggcgccgtccaggtgctgctcagctccgacatcgagcggtacctgaaggaggtggtgaagttcgtgaacttccagcgcgagaacaaggaggcgaaggtcagcaaggagcacatctccagcgaggagaacatcgagctgtacaacaccctcctgtgcaagatgaccgccaagatcttcacccacacgaagaacaacaagtacaacgacctggcccaggacaaggccaagaacaccttcaagaacctctccctggaggagcagtgcaaggtgctgctcgagatcctgaacctgctcaccaacaagaagaccacgttcgacctgagcctgatcaacgagaaggcgagccgggtgaagtgcggcttcaacctcctgaaccagaagcagttctccatcatcgagcagagcgtcaccgggctgtacgagaaggagatcaagatcatcgaggactga

SEQ ID NO: 2122 - RNA, 4197 nt, synthetic construct
  misc_feature 1..4197: note = Cas9 variant
  source 1..4197: mol_type = other RNA
atggagacccaggccagcaaccagctgatctccagccacctcaagggctaccccatcaaggactacttcgtggggctggacatcggcacctccagcgtcgggtgggccgtgacgaacaaggcgtacgagctgctcaagttccgctcccacaagatgtggggcagccggctgttcgacgagggggagtccgccgtggcccgccggggcttccgcagcatgcggcgccggctggagcgccggaagctccgcctgaagctgctcgaggagctgttcgccgacgccatggcgcaggtcgacccgaccttcttcatgcggctgcgcgagtccaagtaccactacgaggacaagaccaccggccacagctccaagcacatcctcttcatcgacaagaactacaacgaccaggactacttcaaggagtaccccacggtgtaccacctccggagcgagctgatgaagtccgggaccgacgacatccgcaagctgttcctggccgtgcaccacatcctgaagtaccggggcaacttcctctacgagggggccaccttcgacagcaacgcctccaccctggacgacgtcatcaagcaggcgctggagaacatcacgttcaactgcttcgactgcaacagcgccatctccagcatcggccagatcctcatggaggccgggaagaccaagtccgacaaggccaaggccatcgagcacctggtggacacctacatcgcgaccgacacggtggacaccagcagcaagacccagaaggaccaggtcaaggaggacaagaagcgcctgaaggccttcgccaacctcgtgctgggcctgaacgcctccctcatcgacctgttcggcagcgtggaggagctggaggaggacctcaagaagctgcagatcaccggggacacgtacgacgacaagcgggacgagctggccaaggcgtggtccgacgagatctacatcatcgacgactgcaagagcgtctacgacgccatcatcctcctgtccatcaaggagcccggcctgaccatcagcgagtccaaggtgaaggccttcaacaagcacaaggacgacctcgccatcctcaagagcctgctgaagtccgaccgcagcatctacaacaccatgttcaaggtggacgagaaggggctgcacaactacgtccactacatcaagcagggccggaccgaggagacgtcctgcaaccgcgaggacttctacaagtacaccaagaagatcgtggagggcctgagcgactccaaggacaaggagtacatcctcagccagatcgagctgcagatcctgctccccctgcagcggatcaaggacaacggggtgatcccgtaccagctgcacctcgaggagctgaaggccatcctggcgaagtgcggccccaagttccccttcctgaacgaggtcgccgacgggttctccgtggccgagaagctcatcaagatgctggagttccgcatcccctactacgtgggcccgctgaacacccaccacaacgtcgacaacgggggcttcgcctgggccgtgcgcaaggcgagcggccgggtgaccccctggaacttcgacgacaagatcgaccgcgagaagtccgccgccgccttcatcaagaacctcacgaacaagtgcacctacctgctgggggaggacgtcctccccaagagctccctgctgtacagcgagttcatgctcctgaacgagctgaacaacgtgcggatcgacggcaagcccctcgagaaggtcgtgaaggagcacctgatcgaggcggtgttcaagcaggaccacaagaagatgaccaagaaccgcatcgagcagttcctgaaggacaacgggtacatcagcgagacccacaagcacgagatcacgggcctcgacggggagatcaagaacgacctggcctcctaccgggacatggtccgcatcctgggcgacggcttcgaccggagcatggccgaggagatcatcaccgacatcaccatcttcggggagtccaagaagatgctccgcgagaccctgcggaagaagttcgccagctgcctggacgacgaggccatcaagaagctcacgaagctgcgctaccgggactggggccgcctgtcccagaagctcctgaacgggatcgagggctgcgacaaggcgggggacggcaccccggagaccatcatcatcctgatgcggaacttcagctacaacctcatggagctgctgggcgacaagttctccttcatggagcgcatccaggagatcaacgccaagctcaccgaggggcagatcgtgaacccccacgacatcatcgacgacctggccctgagccccgccgtgaagcgggccgtctggcaggcgctccgcatcgtggacgaggtggcccacatcaagaaggccctgcccgcccggatcttcgtcgaggtgacgcgctccaacaagaacgagaagaagaagaaggacagccggcagaagcgcctgtccgacctctacgccgcgatcaagaaggacgacgtgctgctgaacggcctcaacaacgagatcttcggggagctcaagagctccctggccaagtacgacgacgccgccctgcgcagcaagaagctgtacctgtactacacccagatgggccggtgcgcgtacaccggcgagatcatcgagctctccctgctgaacaccgacaactacgacatcgaccacatctacccgcgcagcctcaccaaggacgactccttcgacaacctggtcctgtgcaagcggacggccaacgcccagaagtccgacgcctaccccatcagcgaggagatccagaagacccagaagcccttctggaccttcctcaagcagcaggggctgatcagcgagcgcaagtacgagcggctgacccgcatcacgcccctcaccgccgacgacctgagcggcttcatcgcgcggcagctggtggagaccaaccagtccgtgaaggccgccaccacgctcctgcgccggctgtacccgggggtcgacgtggtgttcgtcaaggccgagaacgtgaccgacttccgccacgacaacaacttcatcaaggtgcggagcctcaaccaccaccaccacgccaaggacgcgtacctgaacatcgtcgtgggcaacgtgtaccacgagcgcttcacccggaacttccgcgccttcttcaagaagaacggggccaaccggacctacaacctggccaagatgttcaactacgacgtcaactgcacgaacgccaaggacggcaaggcgtgggacgtgaagacctccatggacaccgtgaagaagatgatggacagcaacgacgtccgcgtgaccaagcggctcctggagcagacgggcgccctggccgacgccaccatctacaaggcgaccgtggccgggaaggccaaggacggcgcctacatcgggatgaagaccaagtccagcgtcttcgccgacgtgtccaagtacggcgggatgacgaagatcaagaacgcgtacagcatcatcgtgcagtacaccggcaagaagggcgaggtcatcaaggagatcgtgcccctccccatctacctgaccaaccgcaacaccacggaccaggacctgatcaactacgtggcctccatcatcccccaggccaaggacatcagcatcatctacgggaagctctgcatcaaccagctggtcaaggtgaacggcttctactactacctcgggggcaagaccaactccaagttctgcatcgacaacgccatccaggtgatcgtcagcaacgagtggatcccgtacctgaaggtgctggagaagttcaacaacatgcggaaggacaacaaggacctgaaggccaacgtggtctccacccgcgcgctcgacaacaagcacaccatcgaggtgcggatcgtggaggagaagaacatcgagttcttcgactacctggtcagcaagctgaagatgcccatctaccagaagatgaaggggaacaaggccgccgagctctccgagaagggctacggcctgttcaagaagatgagcctggaggagcagtccatccacctcatcgagctgctgaacctcctgacgaaccagaagaccaccttcgaggtgaagcccctggggatcaccgccagccgcagcacggtgggctccaagatcagcaaccaggacgagttcaaggtcatcaacgagtccatcaccgggctctacagcaacgaggtgaccatcgtgtga

SEQ ID NO: 2123 - RNA, 4197 nt, synthetic construct
  misc_feature 1..4197: note = Cas9 variant
  source 1..4197: mol_type = other RNA
atggagaagtcctacagcatcggcctggacatcgggaccaacagcgtgggctggtccgtcatcaccgacgactacaaggtgcccgccaagaagatgcgcgtgctcgggaacacggacaagaagtacatcaagaagaacctgctgggcgccctcctgttcgacagcggggagaccgcggaggccacccggctgaagcgcaccgcccggcgccggtacacgcgccggaagaaccgcctccggtacctgcaggagatcttcgccaaggagatggccaaggtcgacgagtccttcttccagcgcctggacgagagcttcctcaccgacgacgacaagaccttcgactcccacccgatcttcggcaacaaggcggaggaggacgcctaccaccagaagttccccaccatctaccacctccggaagcacctggccgacagccaggagaaggccgacctccgcctgatctacctggcgctcgcccacatgatcaagttccggggccacttcctgtacgacaacttcaacgacgacaacttcgactggcgcaacatcgacatccagaagcggtacgaggagttcatcgagacgtacgactccaccctgggggagagctacctcgccgacatctccgtggacgccgccagcatcctggaggagaaggtgtccaagaccgagcgcctggagaacctcctgaagtactaccccaccgagaagaagacgaccttcttcggcaacctgatcaagctcatcctggggcagcaggcgaagttcaaggccatcttcaacctggaggacgagatcagcctccagttcgccacccccacctacgacgaggacctggaggagctgctcggcaagatcgacaacggggactcctacagcgagctgttcgtcgccgcccagaacctgtacaacacgatcctcctggcgtccttcctgaagaccgacaacaagagcgccaaggccccgctctccaccagcatgatcgagcggtacgagaaccacaagaaggacctggccaagctgaaggacttcgtgaagaagaactgccccgaccagtaccacgacatcttccgcgacaagagcaagaacggctacgccggctacatcgacaacggggtgtcccagaacgacttctacaccttcatcggcaagtgcctcgaggagagcctgaagaaggacaagggggcgcagtacttcctggacaagatcgaccgggacgacttcctccgcaagcagcggacgttcgacaacggcgccttcccctaccagatccacctccaggagatgcacgccatcctgcgccgccagggcgactactaccccttcctcaaggagaaccaggacaagatcgagaagatcctgaccttccggatcccgtactacgtcgggcccctggcccgcaaggactcccggttcgcctgggcgaactaccgcagcgacgaggccatcaccccctggaacttcgacgaggtggtggacaaggagaagtccgccgagaagttcatcacccggatgacgctcaacgacctgtacctgcccgaggagaaggtcctgccgaagcacagcctcatctacgagaccttcaccgtgtacaacgagctgaccaacatcaagtacgtgaacgaccagggcaacgccatccacttcgactccgagctgaaggagaagatcttcaaccagctgttcaaggagaaccgcaaggtcagcaagaagacgctgatcgacttcctgaacaactccgaggggatctacaccgacaagctcgtgggcatcgacgaggaggtgaagtacctgaacgcgagcctggggacctaccacgacctcaagaagatcctggagtccttcatggacgacgagatcaacgagaagatcatcgaggacatcatccagaccctgacgctgttcgaggacatcgagatgaagcggcagcgcctgcagaagtacgacgacatcttcacccccaagcagctgaaggagctcgcccggcgcaactacaccggctggggccggctgagctacaagctgatcaacgggatccgcaacaaggagaacaacaagaccatcctcgactacctgaagaacggcaaccggaacttcatgcagctgatcaacgacgaccgcctctccttcaagcagatcatcatcgacgcccggaagatcgagaagctggacaacatcgagagcgtcgtgtacaacctgcccgggtcccccgccatcaagaagggcatcctccagagcatcaagatcgtggacgagctggtcaaggtgatggggcacaacccggacaacatcgtgatcgagatggcccgcgagaaccagacgaccaaccagggcaagaaccggtcccagcagcgcctgaagcggctccaggacagcatgtccaacttcaaggacagcagcatctccctgaaggacgtcgacaacagcgacctgcagaacgaccgcctcttcctgtactacatccagaacggcaaggacatgtacaccggggaggagctggacatcgaccacctctccgactacgacatcgaccacatcatcccccagagcttcatcaaggacaactccatcgacaaccgcgtgctgaccagctccgcgaagaaccggggcaagagcgacgacgtccccgggcgcgacgtggtgctgaagatgaagcccttctggaagaagctctacgacgtcaagctgatctccaagcggaagttcgacaacctgaccaagagcgagcacggcgggctcacggagtccgacaaggccggcttcatcaagcgccagctggtggagacccggcagatcaccaagtacgtggcccagatcctggacggccgcttcaacaccaagcgggacgacaacaacaaggtcatccgcgacgtgaaggtgatcacgctcaagagctccctggtcagccagttccggaaggacttcgggttctacaaggtgcgcgagatcaacgactaccaccacgcccacgacgcctacctgaacgcggtggtcggcaccgccatcctcaagaagtacccgaagctggcccccgagttcgtgtacggggagtacaagaagtgcgacgtgcggaagctgatcgccaagtccggcgacaagagcgagatcggcaaggccaccgcgaagtacttcttctactccaacctcatgaacttcttcaagcgcgtcatccggtacagcaacgggatgatcgtggtgcgccccgtcatcgagtacagcaaggacaccggcgagatcgcctgggacaaggagaaggacttcaagacggtgtgcaaggtgctgtcctgcccccaggtcaacatcgtgaagaaggtggagaagcagagccacgggctggaccggggcaagccgaaggggttctacaacgccaacccctcccccaagcccaagaagggcagcaaggtcaacctcgtgccgatcaaggccaacctgaaccccaagaactacggcgggtacgcgggcatctccaacagctacgccgtgctggtcgacgccaccatcgagaagggggccaagaagaagctcacccgcatccaggagttccagggcatctccatcatcgaccgggagaagtacgagaagaacaaggtggagttcctgaaggggctgggctacaaggagatctacagcatcatcaccctccccaagtactccctgttcgagctggccgacggcagccgccggatgctcgcgtccatcctgagcacgaacaacaagcgcggggagatccacaagggcaacgagctggtgctcccggccaagtacatccccctgctgtaccacgccaaccggatccacaacaccttcgagaccgggcaccgcgagtacgtcgagaagcacatcgccgagttcaaggagatcgccgagatcatcctcgagttcaacaacaagtacgtgaacgcgaagaagaactccagcatcatcgagaaggccctggagtccttcgacagcttctccctggacgagatctgcgacagcttcgtgggcaagctcaagaagaacaacaccaagaagaactccgggctgttcgagctggtcagcctcggcagcgcctccgacttcgagttcctggagacgaaggtgccccgctaccgggactacacccccagctccctgctcaacgccaccctgatccaccagagcatcaccggcctgtacgagacgcgcatcgacctctccaagctgggggaggagtga

SEQ ID NO: 2124 - RNA, 4197 nt, synthetic construct
  misc_feature 1..4197: note = Cas9 variant
  source 1..4197: mol_type = other RNA
atggagacccaggccagcaaccagctgatctccagccacctcaagggctaccccatcaaggactacttcgtggggctggacatcggcacctccagcgtcgggtgggccgtgacgaacaaggcgtacgagctgctcaagttccgctcccacaagatgtggggcagccggctgttcgacgagggggagtccgccgtggcccgccggggcttccgcagcatgcggcgccggctggagcgccggaagctccgcctgaagctgctcgaggagctgttcgccgacgccatggcgcaggtcgacccgaccttcttcatgcggctgcgcgagtccaagtaccactacgaggacaagaccaccggccacagctccaagcacatcctcttcatcgacaagaactacacggaccaggactactacaaggcctaccccaccatctaccacctccgggccgagctgatgaaggacgggacctacgacatccgcaagctgttcctggccgtgcaccacatcctgaagtaccggggcaacttcctctacgagggggcgagcttcgactccaacgccagcaccctggacgacgtgctgaagcaggccctcgagaacatcacgttcaactgcttcgactccagcgccgccatcggctccatcgggcagatcctgatggagaccggcaagaccaagagcgacaaggcgaagaccatcgagcgcctggtcgacacgtacatcatcaccgacgaggtgaacgcctccggcaagacccagaaggaccaggtgaaggaggacaagaagcggctcaaggccttcgccaacctggtcctggggctcaacgccagcctgatcgacctgttcggcagcgtggaggagctcgaggaggacctgaagaagctgcagatcaccggggacacgtacgacgacaagcgcgacgagctcgcgaaggcctggtccgacgagatctacatcatcgacgactgcaagagcgtgtacgacgccatcatcctgctgtccatcaaggagcccggcctcaccatcagcgagtccaaggtcaaggccttcaacaagcacaaggacgacctggccatcctcaagagcctgctgaagtccgaccggagcatctacaacgcgatgttcaaggtggacgagaagggcctgcacaactacgtgcactacatcaagcaggggcgcaccgaggagacctcctgcaaccgggaggacttctacaagtacacgaagaaggtcgtggagggcctccccgacagcaaggacaaggagtacatcctgtccgagatcgagctgcagaccctcctgccgctgcagcgcatcaaggacaacggggtgatcccctaccagctccacctggaggagctgaaggtcatcctggccaagtgcggccccaagttccccttcctcaacgaggtggccgacgggttcagcgtggccgagaagctgatcaagatgctggagttccgcatcccgtactacgtcggccccctcaacacctcccacaacgtggacaacggcgggttcgcctgggcggtgcggaaggccagcggccgcgtcaccccctggaacttcgacgacaagatcgaccgggagaagtccgccgccgcgttcatcaagaacctgacgaacaagtgcacctacctgctcggggaggacgtgctgcccaagagctccctgctctacagcgagttcatgctgctgaacgagctcaacaacgtccgcatcgacggcaagccgctggagaccaaggtgaaggcccacctgatcaaggccgtgttcaagcaggaccacaagaagatgaccaagaaccggatcgagcagttcctcaaggacaacaactacatccccgagaagcacaagcccgagatcacggggctggacggcgagatcaagaacgacctggcctcctaccgcgacatggtccggatcctcggcaacaacttcgacctgagcatggccgaggagatcatcaccgacatcaccatcttcggggagagcaagaagatgctgcgcgagaccctccggaagaagttcgcgtcctgcctggacgacgaggccatcaagaagctgagcaagctccgctaccgggactggggccgcctgtccaagaagctgctcaacgggatcgacggctgcgacaaggccggggacggcacgagcgtgaccatcatcgaggccatgcgggacttctcctacaacctgatggagctgctcggcgaccgcttcctgttcatggagcggatccaggagatcaacgacaagctgaccgaggggcagatcgtgaacccccacgacatcatcgacgacctcgccctgagcccggcggtcaagcgcgccgtgtggcaggccctgcggatcgtggacgagatcgtccacatcaagaaggccctccccgcccgcatcttcgtggaggtgacccggtccaacaaggcggagaagaagaagaaggacagccgccagaagcgcctgtccgacctgtacgccgccatcaagaaggacgacgccctcctgagcggcctgacgaacgaggagttcgggggcctcaagtccgagctggcgaagtacgacgacgccgccctgcggagcaagaagctctacctgtactacacccagatgggccgctgcgcctacaccggggaggtcatcgacctgtcccagctcaacaccgacaactacgacatcgaccacatctacccccggagcctgaccaaggacgactccttcgacaacctggtgctctgcaagcgcacggccaacgcgcagaagtccgacacctaccccatcagcaaggagatccagaaggcccagaaggccttctggatcttcctgaagcagcagggcctgatcagcgagcggaagtacgagcgcctcacccggatcaccccgctgacggccgacgacctgagcgggttcatcgcccgccagctcgtggagaccaaccagtccgtcaaggcggccaccaccctgctgcggcgcctctaccccgacatcgacgtggtgttcgtcaaggccgagaacgtgacggacttccggcacgacaacaacttcatcaaggtgcgcagcctgaaccaccaccaccacgccaaggacgcctacctgaacatcgtcgtgggcaacgtgtaccacgagaagttcacccggaacttccgcgcgttcttcaagaagaacggggccaaccggacctacaacctcgccaagatgttcaactacgacgtcaagtgcaccaacgccaaggacggcaaggcgtgggacgtgaagacgtccatggacaccgtgaacaagatgatgaccagcaacgacgtccgcgtgaccaagcggctgctggagcagtccggcgccctcgccgacgccacggtgtacaaggccaccgtcgcggccaaggccaaggacggggcctacatcggcatgaagaccaagagctccgtgttcgccgacgtgaccaagtacgggggcatgacgaagatcaagaacgcgtacagcatcatcgtccagtacatcgggaagaagggcgaggtggtgaaggagatcgtccccctgcccatctacctgaccaaccgcaacatcaccgaccaggacctcatcgactacgtggcctccatcaccccgcaggccaaggacatcagcatcatctaccggaagctgtgcatcaaccagctggtgaaggtcaacggcttctactactacctcgggggcaagacgaactccaacatctacatcgacaacgccgtggaggtggtcgtgcccgccaacatcgcggtgtacatcaaggtcctggagaagttcgccctgctccacaaggacaacaacaacatcaaggccagcaccgtgaccacccgcatctacaacgaggggtccacgaacatcgtgagcatcaccgacaaggacggcctgatcgtctacgactacctgatgtccaagctccggacgcccctgtacatgaagatgaaggggaacaaggtggacgagctgagcaccgtgggccgctccaagttcatgaacatgaccctcgaggagcagagcatctacctgctggaggtcctcaacctgctgaccaactccaagaccaccttcgacgtgaaggccctcggcatcacggccagccgcagcaccatcggggtcaagatccacaccctggacgagttcaagatcatcaaccagtccatcaccggcctgtacagcaacgagatcaccatcgtgtga

SEQ ID NO: 2125 - RNA, 4197 nt, synthetic construct
  misc_feature 1..4197: note = Cas9 variant
  source 1..4197: mol_type = other RNA
atggagacccagaccagcaaccagctgatcacgtcccacctcaaggactaccccaagcaggactacttcgtgggcctggacatcgggaccaacagcgtcggctgggccgtgaccaacacctcctacgagctgctcaagttccacagccacaagatgtgggggtcccgcctgttcgaggagggcgagagcgccgtgacgcggcgcgggttccggtccatgcgccggcgcctggagcggcgcaagctccggctgaagctgctcgaggagctgttcgcggacgccatggcccaggtcgacagcaccttcttcatccgcctgcacgagtccaagtaccactacgaggacaagaccaccggccacagctccaagcacatcctcttcatcgacgaggactacacggaccaggactacttcaccgagtacccgaccatctaccacctccggaaggacctgatggagaacggcaccgacgacatccgcaagctgttcctggccgtgcaccacatcctgaagtaccgggggaacttcctctacgagggcgccacgttcaacagcaacgcgttcaccttcgaggacgtgctgaagcaggccctggtcaacatcaccttcaactgcttcgacaccaactccgccatcagctccatcagcaacatcctcatggagtccgggaagaccaagagcgacaaggccaaggcgatcgagcgcctggtggacacctacaccgtgttcgacgaggtcaacacccccgacaagccccagaaggagcaggtcaaggaggacaagaagacgctgaaggccttcgccaacctcgtgctgggcctgtccgccaacctcatcgacctgttcgggagcgtggaggacatcgacgacgacctgaagaagctccagatcgtgggcgacacctacgacgagaagcgggacgagctggccaaggtgtggggcgacgagatccacatcatcgacgactgcaagagcgtctacgacgcgatcatcctgatgtccatcaaggagcccgggctcaccatcagccagtccaaggtgaaggccttcgacaagcacaaggaggacctggtgatcctcaagagcctcctgaagctggaccgcaacgtctacaacgagatgttcaagtccgacaagaagggcctccacaactacgtgcactacatcaagcaggggcggaccgaggagacgagctgctcccgcgaggacttctacaagtacaccaagaagatcgtggagggcctggccgacagcaaggacaaggagtacatcctgaacgagatcgagctccagaccctgctgccgctccagcggatcaaggacaacggcgtcatcccctaccagctgcacctggaggagctcaaggtgatcctggacaagtgcgggcccaagttccccttcctgcacaccgtgtccgacggcttcagcgtcacggagaagctgatcaagatgctcgagttccgcatcccgtactacgtggggcccctgaacacccaccacaacatcgacaacggcgggttctcctgggccgtccggaagcaggccggccgcgtgaccccctggaacttcgaggagaagatcgaccgcgagaagtccgcggccgccttcatcaagaacctgaccaacaagtgcacgtacctcttcggcgaggacgtgctgcccaagagcagcctgctctactccgagttcatgctgctgaacgagctcaacaacgtccggatcgacgggaaggccctggcccagggcgtgaagcagcacctgatcgacagcatcttcaagcaggaccacaagaagatgaccaagaaccgcatcgagctgttcctgaaggacaacaactacatcaccaagaagcacaagccggagatcaccgggctggacggcgagatcaagaacgacctcacgtcctaccgggacatggtgcgcatcctggggaacaacttcgacgtcagcatggcggaggacatcatcaccgacatcaccatcttcggcgagtccaagaagatgctgcggcagaccctccgcaacaagttcggcagccagctgaacgacgagaccatcaagaagctgagcaagctccggtaccgcgactgggggcggctgtccaagaagctgctcaagggcatcgacgggtgcgacaaggccggcaacggggcccccaagacgatcatcgagctgatgcgcaacgacagctacaacctgatggagatcctcggcgacaagttctccttcatggagtgcatcgaggaggagaacgccaagctggcccagggccaggtggtgaacccccacgacatcatcgacgagctggcgctcagccccgccgtcaagcgggccgtgtggcaggccctgcgcatcgtggacgaggtcgcgcacatcaagaaggccctgccgtcccggatcttcgtggaggtggcccgcaccaacaagagcgagaagaagaagaaggactcccggcagaagcgcctcagcgacctgtactccgccatcaagaaggacgacgtcctgcagagcgggctccaggacaaggagttcggcgccctgaagtccgggctggcgaactacgacgacgccgccctccggagcaagaagctgtacctgtactacacccagatgggccgctgcgcctacaccggcaacatcatcgacctcaaccagctgaacacggacaactacgacatcgaccacatctacccccggtccctgaccaaggacgacagcttcgacaacctcgtgctgtgcgagcgcaccgccaacgcgaagaagtccgacatctaccccatcgacaaccgcatccagaccaagcagaagcccttctgggccttcctgaagcaccaggggctcatcagcgagcggaagtacgagcgcctgacgcggatcgccccgctgaccgccgacgacctctccggcttcatcgcccgccagctggtggagaccaaccagagcgtcaaggcgaccacgaccctgctccggcgcctgtaccccgacatcgacgtggtgttcgtcaaggccgagaacgtgagcgacttccggcacaacaacaacttcatcaaggtgcgctccctgaaccaccaccaccacgccaaggacgcctacctcaacatcgtcgtggggaacgtgtaccacgagaagttcacccggaacttccgcctgttcttcaagaagaacggcgcgaaccggacctacaacctggccaagatgttcaactacgacgtcatctgcacgaacgcccaggacgggaaggcctgggacgtgaagaccagcatgaacaccgtgaagaagatgatggcctccaacgacgtccgcgtgacccggcgcctcctggagcagagcggcgcgctggccgacgccacgatctacaaggcctccgtggccgcgaaggccaaggacggcgcctacatcgggatgaagaccaagtacagcgtcttcgccgacgtgaccaagtacggcgggatgaccaagatcaagaacgcctactccatcatcgtgcagtacacgggcaagaagggggaggagatcaaggagatcgtccccctccccatctacctgatcaaccggaacgcgaccgacatcgagctgatcgactacgtcaagagcgtgatcccgaaggccaaggacatctccatcaagtaccgcaagctctgcatcaaccagctggtgaaggtgaacggcttctactactacctgggcgggaagaccaacgacaagatctacatcgacaacgccatcgagctcgtggtcccccacgacatcgccacctacatcaagctgctggacaagtacgacctcctgcggaaggagaacaagacgctgaaggcgagctccatcaccaccagcatctacaacatcaacacctccacggtggtgagcctctccaacaaggtcggcatcgacgtgttcgactacttcatgagcaagctgcgcacgcccctgtacatgaagatgaaggggaacaaggtggacgagctctccagcaccggccggtccaagttcatcaagatgaccctggaggagcagagcatctacctgctcgaggtcctgaacctgctcacgaacagcaagaccaccttcgacgtgaagcccctggggatcaccggctcccgcagcaccatcggcgtgaagatccacaacctggacgagttcaagatcatcaacgagtccatcacggggctctacagcaacgaggtcaccatcgtgtga

SEQ ID NO: 2126 - RNA, 4200 nt, synthetic construct
  misc_feature 1..4200: note = Cas9 variant
  source 1..4200: mol_type = other RNA
atgaagaccatcctgggcctcgacctggggaccacgagcatcggctgggccctggtgaaggaggccgagcccttctccgacgagaagtccgagatcgtccgcctcggggtgcgggtgatcccgctgaccgtcgacgagcgcaccagcttcgagaacggcaagagcatcaccacgaacgcgctgcggacccagaagcgcgggatgcggcgcaacctccagcggtacaagctgcgccggcaggccctgatcgaggagctcaagtccaccggctggatcggcaacgacttcatcttcagcgagaccgggcccggctccacgttccgcaccctgcggctgcgcgccaagagcgcctccgaggaggtgaccctcggggacctggcccggatcctgctccagatcaacaagaagcgcggctacaagagctcccggaagatggtgagctccgacgacgggcaggcgatcgacggcatggccgtcgccaaggagatgtacgacaagggcctgacccccggggagtacgtgtaccagcgcatgctggagggcaagtacgccatccccgagttctacaagagcgacctccaggaggagttcgaccggatctgggcgctgcagaagtccttccacatcgagctgacggacgagctctaccgcaagctgagcgaccggaacaagtcccagacctgggccatctgccgcgacgagctggggatccagggcctcaagagctccttcatcggcaaggagcggctgaaggaggcctaccgctaccgccacctggccgccacccaggaggtgaacatggaggtcctgacctgcgcgctccaggagatcaacgggcagaaggccagcctgagcggcctcctgtccaagatcagcgaccggtccaaggagctgtacctcaacaacctgacggtggggcagatgctgctcaagcgcatcgaggacaacccgaacaacagcctgaagaacatcgtgttctaccggcaggactacctggacgagttcgagcgcatctggaccgtccagtccaagtaccacaccgagctcacccacgagctgaagaagcggctgcgcgacatcatcatcttctaccagcggcccctcaagagccagaagggcctgatctccctgtgcgagctcgagacgaaggacatcgaggtggccatcgacggggtgaagaagatgaagaacatcggcccccgcgtctgcccccggagctccccgctgttccaggagttcaagatctggcagaccatcaacaacatcttcgtgaacggcgccgccctggacgacgaggacaagagcgtgatcgcgaaggagctcatgttcaaggacaagctgaaggactccgacctgctgaagctcctgttcaagaccaccaaggggcagagcgtcaacttcaaggaggtggacggcaaccgcacgatggccaccctgatgaaggcctgcttcaagatcgccgagaacctcgggtacgacgacatcggcctgtccaagctgagctccgaggaccagatggtgcggatcgaggggatcttcaaggagcagggcttcaagaccggcttcctccacttcgacagctccctggccagccccgagttcgagaaccaggactcctaccgcctgtggcacctcctgtacagctacgagggggacaagagcgcgtccggcaacgagagcctggtcaagtgcatcatggacctctgctccatggacgaggggagcgccaagatcctggcctcctgcaccttcctgcccgactacggcagcctctccgccaaggccatgcggaagatcctgccctacatgaaggacgggctggagtacacggcggcctgcgccatggccggctaccgccacagcaagcggtccctcaccaaggaggagctggacaccaaggagtacagcgaccgcctgtccctcctgccgaagaacagcctgcggaaccccgtggtggagaagatcctcaaccagatgatcaacgtcgtgaactccgtcatcgacgtgtacggcaagcccgacgagatccgcatcgagatggcgcgggagctgaagaagtccgccaaggagcgcgaggaggcccagcgcgacatcgccagcagcaccgccgagtcccagaaggtgatcgagatcctgaagggggagcccttcttcctccagttcccgacgcggaacgacatcatccgctaccggctgtaccaggagctggcgcagaacggcttcaagaccctctacagcaacacctacatccccaaggacaagctgttcagcaaggagttcgacatcgagcacatcatcccccaggccctgatcttcaacgactccttcgccaacaagaccctcgagagccgccagtgcaacctggagaaggggaaggagacggccatggactacgtcaagtccaagtacgacgagaccggcgtgcagacctactgcgaccgggtgaacggcctgatcgggaagggcatcagcaagaccaaggccaagtggctcctgatggaggggaaggacatccccgaggacttcatcaaccgcgagctgcgggactcccagtacatcgcgaagaaggcccgcgagatcctcgagagcctggtcaagttcgtggtgccgaccacgggctccgtcaccgcccggctgcgcgaggactggcagctcgtgaacgtgatgcaggagctgaactgggagaagtacgcccggctggggctcaccggcgtccgcgaggacaaggacggccggcgcatccccttcatccaggactggaccaagcggaacgaccaccgccaccacgccatggacgcgctgacgatcgccttcacccggcgccagttcatccagtacctgaaccacctcaacagcaagatcgacgtggtgtcctgggacaagaaggacctggacctgcgggactacgacctcgaggacatcaagttcgggaacctgagcgccggcgaccgctacgggatcgtcaaggccctgcaggacaagttcctctacaaggacggcaacgacaagtaccggttcgtgccgcccatccccctggacgagttccgccgccaggcgaaggagcagctgtccgacatcctcatcagcttcaaggccaagaacaaggtgtgcacccggaacgtcaacgtgaccaagaacaagggcggggccaaccgcaaggcccagctgacgccccggggccccctgcacaacgagaccatctacgggtccagcctcgagtacgtgaccaaggagaacgagaagatcggctccagcttcgacaccgagcgcatcacgaccgtctgcaagaagaagttccgggacgccctggcgcgccggctggaggagttcgggggcgaccccaagaaggccttcaccgggaagaactccccggagaagaaccccatctgggtggacgagcaccacagcgagcaggtccccgccaaggtgcgcaccgtgacgatgggccagcggttcaccggccgcaagccgatcgacgccaccctcaagatcgagaaggtgatcgacaagcggatccgcgagatcctgcaggcccggctggacgagttcgacgggaaggcggccaaggccttctccaacctcgacgagaaccccatctggctgaacaaggagaagggcatcgccatcaagcgcgtcaccgtgagcgggcccgccaaccccgtgccggtccggttcaagcgcgacaaggacggcaagcccatcatcgacgacgcggggaagacgatcggcgccgacttcgtgacccccggcaacaaccaccacatcgccatcttccgggacagctccgggaagctgcaggagcaccccgtgagcttcctcgaggccaccatcgcgaagtcccacggcctggacgtcatcgaccgcaactacaacaaggacgaggggtgggagttcctgttcaccctcaagcagaacgagtacttcgtgttcccgaacagcgagacgggcttcaaccccctggactacgacctgaccgacccccggaactacgccgagatctcccccaacctctaccgcgtgcagagcatctccaccaacgactacttcttccgccaccacctggagaccacgagcgagaagaacaactccctgtacggcatcacctggaagcggatccgcaacgccagcgccctcgaggggctggtcaaggtgcggatcgacaacctgggccgcatcgtggccgtcggggagtacgactga

SEQ ID NO: 2127 - RNA, 4200 nt, synthetic construct
  misc_feature 1..4200: note = Cas9 variant
  source 1..4200: mol_type = other RNA
atggagacccaggccaccgcccagctgatcagcggccacctcaaggggtaccccatctacgactacttcgtgggcctggacatcgggacgaactccgtcggctgggcggtgaccaaccgcatctacgagctgctcaagttccggagccacaagatgtgggggtcccgcctgttcgaggagggccagaccgccgtggtccggcgcggcttccggagcatccgccggcgcctggagcggcgccggctccgcctgaagctgctcgaggccctgttcgccgacgccatggcgcgggtggactccaccttcttcatccgcctgcgggagagcaagtaccactacgaggacaagacgaccgggcacaagtccaagcacatcctcttcatcgacgacaactacaccgaccaggactacttcgccgagtacccgaccatctaccacctccgcgccgacctgatggagaacggcacgagcgacatccggaagctgttcctggccgtgcaccacatcctgaagtaccgcgggaacttcctctacgagggcgcgaccttcgactccaacagctccctggacaccgtcctgaagcgggccctcgagcagatcgagttccacatcttcaacgccaccagcgaggacgccctgcactccatcctggacatcgtgaagctccaggacaagaccaagagcgacaaggccaaggcgatcgagtccctggtggacacgtacatcaccgacaaggtcgagagctcctgcaccgacaaggagaagaaggacctgctcaaggccgacaagaagcgcctgcgggccttcgccaacctgatcctcgggctgaacgccaacctgacggacctcttcggcaccatcgaggagatcgaggaggacttcgtgaagctgcagatcaccggcgacacctacgaggagaagcgcgacgactacgcgaaggtgtggggcgacacgatccgcatcatcgacgactgcaagagcgtctacgactccatcatcctgatgagcatcaaggagcccgggctcaccatcagccagtccaaggtgaaggccttcaacaagcacaaggaggacctggccatcctgaagcggctcctcaagagcgacaagtacatctacaagaacatgttcaaggccgacgagaaggggctggccaactacgtgcactacatcaagcagggccgcaagaacgagaccggctgctcctgcgaggacttctacaagtacaccaagaaggtcgtggagagcctgcccgactccagcgacaaggcgtacatcctgaacgagatcgagctgcagaagctcctgcccctgcagcggatcaaggacaacggggtgatcccgtaccagctccacctggaggagctgaaggccatcctggagaagtgcaaggacacgttccccttcctcaacaccgtctccgacggcttcaccgtggccgagaagctgatcaagatgctggagttccgcatcccctactacgtggggcccctcaacccgagccactccatcgacaagggcgggttcgcctgggtcgagcggaaggagcccggccaggtgaccccctggaacttcgaggacaagatcgaccgcgagaagtccgccgaggcgttcatcaagaacctgacgaacaagtgcacctacctgatcggcgaggacgtgctccccaagagcagcctgctgtactccgagttcatgctcctgaacgagctgaacaacctccggatcgacgggaagccgctggagcaggccgtcaagatgcacctgatcgacgccgtgttcaagaaggagcacaagaagcagaccaagaaccgcatcatcgagttcctcaaggacaacaactacatcctgggcaagcacaagcccgaggtcgacgggctggacgagagcatcaagggcgacctcgcctcctaccgggacatgaagcgcatcctgggggacgacttcgacgtgagcatggcggagtccatcatcaccagcatcacgatcttcggcgagtccaagaacatgctgcgggagaccctccgcaagaagttcggcagcatcctgagcgaggaccagatccggtccctggccaagctccgctaccgggactgggggcgcctgagcaagaagttcctgatcggcatcgacgggtgcgtgaagggcgaggacgggacccccggcaccatcatcgacatgatgcggaacacgtcccacaacctcatggagctgctgggcgacaccttcagcttcatggacgtcatcatcgaggagaacgacaagctcaccaagggccaggtggtggacccccacgagatcatcgaggagctggggctgtccccggccgtcaagcgcgccgtgtggcaggccctccggatcgtggacgaggtcatccacatcaagaaggcgctgcccagccgcatcttcgtggaggtggcccgcaccaacaaggacgagaagaagaagaaggactcccggaagaagcgcctgcaggagctctacaagagcatccagaaggagtcccccgagtggctgagcgtcacccgggacgagtccgacaagctgatcagcaacctcgaccgcgccgacgactccagcctgcggtccaagaagctgtacctctactacacgcagatggggcgctgcatgtacagcggccgggtgatcgacctggaccagctgaacaccgacaagtacgacatcgaccacatctacccccgctccctcaccaaggacgacagcttcgacaacctggtgctgtgcgagcggcaggagaacgccaagaagtccgacaactacccgatcgaccccgacatccagaacgcccgcaagcccttctggaccttcctcaaggaccagaacctgatcagcagccggaagtacgagcgcctgacgcgggtcctccccctggaggcggacgacctgaccggcttcatcgcccgccagctcgtggagaccaaccagtccgtgaaggccgtcaccacgctgctgcggcgcctctacccgggggtggacgtggtcttcgtgaaggccgagaacgtgaccgacttccggcacgacaacgacttcatcaaggtccgcagcctgaaccaccaccaccacgccaaggacgcgtacctgaacatcgtggtgggcaacgtctaccacgagaagttcacccggaacttccgcaagttcctcaagaagaacggggccaagcggacctacaacctggcccgcatgttcgacttcgacgtgatgtccacgaacgccaaggacggcaaggcgtgggacatcaagaccagcatgaacatcgtgaagaagatgatggcctccaacgacgtccgcgtgaccaagcggctgatggagcagaagggggccctcagcgacgccaccgtgtacaaggcctccgtcgcgggcaaggccaagggcggggcctacatcggcatgaagacgaaggacagcgtgttctccgacgtgagcaagtacgggggccgcacctccatcaagaacgcctacagcatcgtcgtggagtacaccgggaagaagaacgagatcatcaaggagatcgtgcccctgcccgtctacctgatcaaccggaacaagaccgaccaggagctcatccactacatcgtgtccatcatcccccaggccaagaacgtgagcatcatctacaagaagctgtgcatcaaccagctggtcaaggtgaacggcttctactactacctcggcgggaagacgaacaactacttctggatcgactccgcgatccaggtggtcatcgccgacgagtggatcccgtacctgaaggtgctggagaagttcgacgtgatgcgcaagcagaacaaggagctcaaggtcggcaccgtgagcacctccatccagaaccaggggaagaaggtggtcatcaagatcctggaggagcggaacgtggagttcttcagctacctggtcggcaagctccacagctccatctacagcaagatgaaggggaacaaggccggcgagctggccaccaagtccctggagatcttcgtgaacatgagcctcgagaaccagtgcatctacctgatggagctgctcaacctgctgacgaacaagaaggcccccgacgtgaagcccctcggcatcaccgcgtcccgcgggaccatcggcagcaaggtctccaaccaggacgagttcaagatcatcaacgagagcatcaccgggctgtactccaacgaggtgacgatcgtgtga

SEQ ID NO: 2128 - RNA, 4200 nt, synthetic construct
  misc_feature 1..4200: note = Cas9 variant
  source 1..4200: mol_type = other RNA
atgaacctgcgcaacaccaccgacgagtacaacatcggcctcgacatggggacgaacagcgtgggctgggccgtcaccgacaaggccggggcgatcgcccacttcaagggcaagcccaccctggggtcccggctgttcgacgccgcccagaccgccgcgggcgcccgcatccaccggagccagcgccggcgctacgtgcggcgccggtggcgcctcgacctgctgcagtccctcttccaggacgaggtgagcaaggtcgactccgagttcttctgccggctgcgccagagccggctgtacgtgggcgaccgcgagaaggggcacgccgactacacgtggccgatcttcaacgactccgacttcaacgaggtggactactacaagcggttccccaccatctaccacctccgcaagtggctgatggagaccgacgagaaggccgacatccggctgatctacctcgcgacccacaacatcgtcaagcaccgcggcaacttcctgcgggagaacaacaagagcctgtccagccgcgacgccaaccccgcccaggccgtgaagtccctccggctggccctgaacgactggtgcagcgagcgcgactacgagtgcgcgtggaagggggaggaggacgacggcgccatcgacgaggccatcctcaacgtgctggccgacggggagaagggccgctccgaccaggccaaggagatcgcgaagctgacgggcgtcgactgcggggacgccaagcagagcaagcagtgcaacgaggccatcgccaaggccatcgtgggcctcaaggtggagatgaagaacatcttcggggagttccccgcggagaagacctcctacatctacctgagctccgacgaggacgtcgaggccgtgcgggagagctgcccggacgactccggcgagctgttccaggccctctgcaagctgtacagcgcctacatcctgcaggagctcctgagctacgccgacccctccggccagaccatcagcgcgaacatggtggccaagtacaagcagtacgggcgcgacctgcggctcctgaaggagctgacccgcacgtacgcgccccagaagtacgacctcttcttccggggcgagacctacgccgggtccagcgactacgtcgtggacgaggcccgcggctacacccggtacaacctggggaccacgaaggccaactacgacgacttccagaagtccgtgaaggagctgttcaagggcaccgacgccctccaggacgagcgctaccaggagatgatggtcgccttcggcgagcagaagttcctgcggcgcctgaagaccagcgacaacgggtccatctactaccagctccacctggaggagctgcacaccatcctcgagaaccagggcaagcactaccccttcctgctgagcgaggaggacaagatcgagtccctcgtgagcttccggatcccgtactacgtggggcccctgacgcgcaagaacgccgcgatcggccacgacgggaaggagcggttcgcctggtccagccgcaaggacggcatggagcacgccgtcatcaccccctggaactgggaggagatcatcgaccgggacaagtccgccgaggacttcatcatgcgcatgaccggcgactgcacctacctgcagggggagcccgtgctcccgaagtgcagcctgctgtacgaggagttctgcgccctgaacgagttcaacggcgcgcactggacggtggacggggacgacgagcggcgcttcgacgccgcccagcgggagcgcatcatgtgcgacctcttccgccggacccgctccgtcacctacaacaaggtgagcgactggctggagcggaagtacaacttcaccggcgcccgcgtccgcgggggccagggcgagcacgggttcgagtccaagctgggcagctacatcttcttctgcaaggacgtgttcaagacggacgggctcgacgaggccgactacaccatgatcgagcagatcatcctgtggtccaccctgttcgaggaccgggacatcctcaagcggaagatcgaggaggcgtacggcggcgaccgcctgaccagcgagcagatcaaggtgatctgcaagaagcggttcacggggtggggccgcctgagcaagcggctcctgaccgacatcaaggtcaacaccgacaccgggcgcaagtccatcatggacgtgctgcgggagggcaaccccaacaacgggcagcgcagccggacgatggtgttcatggaggtcctccgcgacgaggacctgggcttccagaaggccatcgacggcctgaaccgggactacttccgcgagcacaacaacgggctcatggacgtgaacgacctgcccggctcccccgccatccggcgcagcatcaaccaggccgtgcggatcgtcgacgagatcgcgtccatcgcccgcaaggagccgaccaacatcttcatcgaggtgacccgcgaggaggacgacccccggaagaaggggaagcgcaccaagcggcgctacgacgccatcaagagcgccctggagaagttcaagaaggacgacccctccctctggaaggagctgtgcgagaaggcccccggcgacatggacgagcggctgagcctctacttcatgcagcgcgggaagtgcatgtactccggccggccgatcaagatcgaggagctgcacaccggcaagtacgaggtggaccacatcatcccccgcagctacatcaaggacgactccttcgagaacaaggtcctggtgtaccgggaggagaaccagcacaagacggacgcgctcctgatcgacagctccatccgccagaagatgggcgggtactggcggatgctgcacgacgccaagctcgtgggggacaagaagttccgcaacctgttccggaaccacatcgacgacaaggccatgaagggcttcgtcgcccgccagatcgtggagaccagccagatggtgaagctggtccagaccctcttcgaggcccggtaccccaacacccgcatcgtgcccgtgaaggcggggatctcccacgacctgcgggaggccgccggcctggtcaagtgccgcgaggccaacgacttccaccacgcccacgacgcgttcctcgcctgccggatcggcctgttcatccagaagcgccacccgagcgtgtacgacaaccccatcgggctggcccgcatcatgcgggactacgcccgcatgcaggcgcgggagtacaagaagtcccactgcctcgcccacacgcagggcttcatcgtgaacagcttcctgagctccgggttcgacgaggagaccggcgagatcttcaaggacgactgggacgccaaggccgaggtcgaggggatccgccgggtgctgaactgccgccagtgcttcatcagccggatgcccgtggagggcgacacccgctacggcgggcggtactggggcgagaccatctactcccccaaggggaagcacaagcacgagatcccgctcaagcagggcctggaccccaacctgtacggcgggtacagcgacctcctgtactcctacttcctgatctacgaggccagcgacgtctccagcggcgagcgcgtgctccggttcatcgggatccccacgtccatcgcggcccgcatggccaaccagaagcggctggaggagtacgtgagccgcctggccctccaggagaacctggagcacgtccggatggtgcgcaagatcatgaagaagcagctgatcgaggtggacaactgccggctcctggtcaccgccgcggacgccgtgaccaacgccaccgagctggccttctccctcgacgagatgaagatcatcagcacgtgcgccaagtgcatcaacggcgcggacccgtccgccatcgacaagatcgggaacgcccaggacagcttcttcgacaacctgaagcgccggggctccgaccgctgcgccctcctgttcagccagctgaagctggacaagctctcccagaacttctacatgatcagctccgacgacaagagcaagatcctgatcagcatcctggaccggatccgcgccaagtccaacagcgtggacctctccctggtcggcggggcgaagcacgccgcccagatgaagttcgacttcaacgccaagctgaacaaccccgcgagctccttcgtgctcatcgaccagagcgtgaccggcatgttcgagcgccggacccgcatcgggctgtga

SEQ ID NO: 2129 - RNA, 4203 nt, synthetic construct
  misc_feature 1..4203: note = Cas9 variant
  source 1..4203: mol_type = other RNA
atgaacctgcgcaacgccaccggcgactacagcatcgggctcgacctgggcaccaactccgtggggtgggccgtcacggacagcaacggctccatggcgcacttcaaggggaagcccaccctgggcagccggctgttcgacgccgccgagaccgccgccggcgcgcgccagcaccgggggcagcgccggcgctacgtgcggcgccggtggcgcctggacctgctccagggcctgttccaggacgaggtgaacaaggtcgactccgagttcttcatccggctgcgccagagccggctccacgtggaggaccgcgccgaggggcacgccggctaccggtggccgctgttcaacgacaccgacttcacggagaaggactactacaagcgcttccccaccatctaccacctccggaagtggctcatggagaccgacgagaaggccgacatccgcctgatctacctggcggcccacaacatcgtgaagcaccgggggaacttcctccgcgaggacaacaagaacctgtccagccacaacgccaaccccgccgaggccgtccggtccctgcgccaggcgctcgacgactggtgcgccgagcgcggctacgtgtgcgcctggaccagcgtggacgacctggccgaggccgactcccacatcctggacatcctcacgaacagcaaggagcggcgcgcggaccaggccaaggagctggccaagctgttcggcgtcgactgcggggacaccaagcagtccaagagctgcaactccgccctcgccaaggcggtggtgggcctgaagaccgagctgaaggacgtcttcggggagttctgcgccgagaagaccgccatccacctcagctccgacgacgacgtggaggccatccgggacgccatccccgacgacagcggcgagctgttccaggtgctgtgcgcggtctactccgcctacgtgctccaggagctgctgagctacgccccgggccagacgatcagcgccaacatggtggcgaagtacgaccagtacgggaaggacctcaagctgctgaagaacctcgcccgcacctacgtctcccgggagaactacgacgccttcttccgcggccagacctacgaggacagcaacgactacaacgtggacaaggcccaggggtacacccggtacaacctgggcacgaccaaggcctcctacgacgacttcaagaagtccgtggagaagctgttcaaggggacccaggcggagcaggacaagcgctaccagggcatgatgaagcggttcgccgaggagaagttcctccgccggctgaagacctccgacaacggcagcatctactaccagctgcacctcgaggagctgcgcgccatcctgaagaaccaggggaagcaccaccccttcctcctggaggaggagaagaagatcgagtccctggtcagcttccggatcccctactacgtgggccccctctccagcaagaacgcctccctggaccacaaggggaagcagcgcttcgcctggagcgagcggcgcccgggcatgaaggacacggtgatcaccccctggaactgggaccagatcatcgactgcgaccagtccgcggagaagttcatcctgcggatgaccggggactgcacctacctgcagggcgagcccgtcctccccaagtgcagcctgctgtacgaggagtactgcgtgctcaacgagctgaacggcgcccgctggacgatcgacggggacgactggcggcgcttcgacgtcgcccagcgcgagggcatcctgcacgacctcttccggaagacccgctccgtggcctacaacaaggtggccgactggctggagcgggaggagaactgggcgaacgcccacgtccgcgggggccagggggagaacagcttcgagtccaagctgggcagctacatcttcttctgcaaggacgtgttcaagaccgccgccctcgacgaggcggactacccgatgatcgagcagatcatcctgtggaacaccctgttcgaggaccgggccatcctcaagcgcaagatcgagcaggcctacggcgagcaccacgggggcaagctgacggacgagcagatcaaggtgatctgcaagaagcggttcaccgggtggggccgcctgtcccggaagctcctgaccggcatcaaggtcgacgccgacaccgggcgcgtgagcatcatggacgtgctgcgggagggcaaccccaacgaggggcagcgcagccggacgatggtcctcatggaggtgctgcgcgacgaggacctgggcttccagaagaagatcgacgacttcaacaaggcctacttcgcggggcagggcgagggcctcatgtccgtgaacgacctgcccgggagccccgccatccggcgctccatcaaccaggccatccggatcgtcgacgagatcgccagcatcgccggcaaggcgccgtccaacgtgttcatcgaggtgacccgcgaggaggacgacccccggaagaaggggcgccggaccaaccgccgctacgaggacatcaagaacgccctggagaacttcaagaccgaggaccaggagctctggagcgagctgctgggcaaggcccccaacgacctcgacgagcggctgtccctgtacttcatgcagcgcgggaagtgcatgtacagcggccggcccatcaagctcgaggagctgcacacgggcaagtacgaggtcgaccacatcatcccgcgctcctacatcaaggacgacagcttcgagaacaaggtgctggtgtgccgggaggagaaccagcgcaagaccaacgagatgctcatcgaccccgccatccggcgccggatgggggactactggcgcatgctgcacaaggccaagctgatcggcgacaagaagttcaacaacctcttcatgcgggaccgcatcgacgacaagaccctgaaggggttcgtcgcgcggcagctggtggagacctcccagagcgtgaagctcgtccagaccctgctggaggtgcgctaccccaacacgaagatcgtgcccgtcaaggccaacatctcccacgacctccgggaggccgccgacctggtgaagtgccgcgaggcgaacgacttccaccacgcccacgacgcctacctggcctgccgggtgggcctcttcatccagaagcgccacccgagcgtctacgccaaccccatcgggctgtcccgggtgatgcgcgactacgcgcgcaagcaggccggcgagttcaacaagacccacagcatggcccacaccaagggcttcatcgtgaactccttcatgaccagcgagttcgacaaggagacgggggagatcttctgggacgccgaggccgcggtcgaggacatccggcgcgtgctgaactaccggcagtgcttcatcagccgcatgcccgtggaggacaccggcgccttctgggaccagaccatctacagcccccggagcaacaagcgcctcgagctgccgctgaaggacgacctcgaccccaacaagtacgggtcctacagccgggagcagttcgcctacttcttcatctacgaggcccgcgacgccaagaagtccaagaccgtcctgcggttcgcccaggtgcccgtgcgcgtcacgagcgcgatcgcccgggactccagcaagctggacgagtacgcctccggcctcgccgtgcaggaggggctggagttcaccaagatcatccgccggcgcatcctgaagaagcagctcctggagctgaacggcgaccggctcgtgatcaccggcgcgaaggaggtccgcaacgccaccgagttcgccttcacgctggaggagaccgccctggtggcgatgtgcagcgagatcgcccgggagggggtgccgtccgagatcgccagcgacgtccagtccatcagctcccagctcagcgacctgttcctggccctcatcgagcgcggcctgaccatcggggtgcggctgcacggccagctcaagctgggccagtacctgcgccagttcgaggacgccgcgctccgggacaaggccaaggtgatcatcgggatcatctccatcaccaacggcgccacgaacaccctggacctgagctccctcaacgggagcaagaacgtcggccaggtgcgcatcacccacaacaagctgctgaacgacaagagcacctcctacgtgctcatcgaccagagcgtcacggggatgttcgagcgccggacccgcatcggcctgtga

SEQ ID NO: 2130 - RNA, 4203 nt, synthetic construct
  misc_feature 1..4203: note = Cas9 variant
  source 1..4203: mol_type = other RNA
atgaagaccatcaccgaggactacatcctgggcctcgacatcgggacgaacagctgcggctgggccgtgatggacaagaagaaccgcctgctgcggctccgcgggaagcgggccatcggctcccacctgttcgaggaggggcacagcgcggccgaccgccggtccttccgcaccacccggcgccggctgaagcgccggaagtggcgcctccggctgctggaggagttcttcgccgagcccatggccaaggtcgacccggccttcttcgtgcgcctccaccagagctgggtgtccccgctggacaaggaccggaagaagtaccacgcgatcgtcttccccaccgccaaggaggaccacgagttctaccacgactaccccacgatctaccacctccgcgacgccctcatgcgggaggaccgccagttcgacctgcgggagatcttcctggccatccaccacatcgtgaagtaccgcggcaacttcctccaggacaccccggtgaacagcttcgtcgcgtccaagatcgacgtggccagcttcctgaccaacgtgaaccaggcctacgccgacaagtacggcgaggagcagaacttcatcgagctgaacgagaacaacgccgcggccatcgaggccgtcatccgggggaaggacaaggacaagaccacgaagcagctcgacaaggccaagaagatcaccaagctgctgcagtccagcaccaacaagtacgagaagaacgtgacccgccagatcgccaacgcgatcatcggctacaagacgcagttcgagaccatcctcgggaaggacatcgacaagaacgacaaggccgactgggagttcaagctgtccgacggcgacgccgacgacaagctggagaacctcctgcccgagttcgacgacaacgaccagtacatcgtggccgagatcaagaagctgttcgggagcatcgccctctcccagatcgtctacgagaacatgaccctgagccagtccatgaagtgcaagtacaaggaccacggcgaggactacgacctgctcaagcagtacatcgcgaccctgagcgaccactcccaggtgcgcaagctgctcctggcctacgacctgtacgtgaacaaccggcacggccgcctcctggaggccaagaaggagttcaagcaggacaaggccctgacgcaggacgagttctacaagatcgtcaaggagaacctcgacgacagccagctggcccagaagatcctgcagaagatcgacgaggggaagttcatgcccaagcagcgggtgaacaagaacggctacatcccctaccagctccaccagatcgagctggaccagatcatcgcgaaccagtccaagtactacccgttcctggccgaggagaaccccgtgaaggagcaccgcaagcaggccccctacaagctcgacgagctggtccggttccgcgtgccctactacgtggggccgctgatcagccccgacgacaagcggaaggacgagcagcagaacaagaaccacgagatgttcaagttcgcctggatgaagcgcaaggacgacaacggcgcgatcaccccctggaacttcgcccagaaggtcgaccgggagaccagcgccaaccgcttcatcaagcggatgaccgtgaaggacacgtacctcatcggcgaggacgtgctgcccgcccgctccctgctgtaccagaagttcgaggtcctcaacgagctgaacaacatccgggtgaacgggaagcgcctggagccgaagttcaagcagaaggtcttcaacgagctgttcaagcagaagaacaaggtgaccaagaaggccttcaaggagttcatcctgcagaacaccggcatgaagaccgcggagatcgacgggctggccgaccccacgaagttcaacagctccctcagctcctactaccacctcaagagcaccaaggtgttcgacaagcagctggacgacccccagtaccaggccgacttcgagaagatcatcgagtactccagcatcttcgaggacgccgagatctaccaggagaagctccacaaggagatcaagtggctgacccccgcccagttcaaggcgatcgccaactggcggctgcagggctgggggcgcctctcccggaagctgctggtcgagctcaagggcaagggcggggagaacatcatctaccagctgtggaccacgcagaagaacttcatgcagatcgtgaacgagccggagctgaagaaggccatcgtgaaggagaaccaccaggccaccgaggagaagggcatcgagaagatcctcgacgacagcttcacctcccccgccaacaagaaggcgatccgccaggtcatcaaggtggtggacgacgtcgtgaaggccgccgggggcaagaagcccgcccagttcgcgatcgagttcacccgggagcccaagtggaacccgcacctgagcaacatccgcgggacgaagctgctccaggtgtacgaggacaccgccaagaagctggtcgaccagtccctgaccgacagcctccgcgagaacatgaccaaccggaacctgctgaaggacgagtacttcctctacttcatccagggcggccgcgacgcctacacggggaagaagatcgacatcgacgacatccccaagaagtaccagatcgaccacatcctgccccagtccttcatcaccgacgacagcctggacaaccgggtgctcaccgagatcgagatcaaccagaagaagggcaagaagtacgcctcccacctgttcgcccccaagccggcgttcgggctgaaccagagcatctccgagatgtggaagacctggcagaaggccggcctcatcagccagcgcaagctgaacaacctgctgttcgaccccgacctggtgaaggacaagcagaagaaggggttcatcaaccggcagctggtcgagaccagccagatcatcaagctcgtgtccatcatcctgcaggacaagttccccgacacggagatcatcaccgtgaaggccggctacaacaccgccctgcgcaaggagctcaagctgtacaagagccgggaggccaacgactaccaccacgcgatcgacgcctacctgaccgccatctgcgacaacttcctctaccaggtctacccgaacttccgccccttcttcgtgtacggccagttcaagaagttctcccaggacacggacaagcagaagaaggccgtgaagtactacgggctgaagaacttcctgctccccctgctggacgacagcaccggcgacgaggtcatggtgaaccacaccaagcacgtggtcttccacaagcagcgggacatcttcaaccgcctcatccaggcctacaactacaagtacatgctggtgtcccgggagaccacgaccgagaacagcaacatgttcaacatgaccatctacccccgcggggagcgggaccgcaagaagacccggaagctgatcccgaagggcaaggacctcgaccccgcgatctacggcgggtactccggcaacacggacgcctacatggtgatcgtcaagatcgagaagaccaaggagaccctgtacaaggtggtgggggtccccatgcgcgccctggccagcctcaagaaggcgcagaaggagggcaactacgaccaggagctgaacaaggtgctggagcccctcatcatgttcaacaagaacgggaagtccaaggccggcatcaagggcttcaccgtggtcaaggaccacgtgcacttcaagcaggtcgtgatcgacggggacagcaagttcatgctgtactccgcccagtaccgggccaacgccaagcagctgacgctcagccaggagaccatgaaggtggtgaccgacaacaccgacgacatggaccagaagaacgcggacaaggaccagctgctgctcaacgcctacgacgagatcctggagaaggtcgaccagtacctgcccctcttcgacatcaacggcttccgccaggggctgcacgacggccgggccaagttcgccgccctgaagacgtccgagaagaagtacaccctcaagaacgtgctgaacgggctgcacgacaacctcgtgacccccaacctgaagaacatcggcatcaagacccccttcggcctgatgcagagctccagcgggatcacgctctcccccaacgcgaagctggtcttccagagcccgaccggcctgttcgagaagcgcgtgaagctcaccaacctgtga

SEQ ID NO: 2131 - RNA, 4203 nt, synthetic construct
  misc_feature 1..4203: note = Cas9 variant
  source 1..4203: mol_type = other RNA
atgggcaagcagaagttcaacgactactacctggggttcgacatcggcaccaacagcgccgggtgggccgtgaccgacctccagtacaagctgctgcgcttcaacaagaaggacatgtggggctcccgcctcttcgacgaggcgcagacgagcaaggagcggcgggtctaccgcaactcccggcgccggctggaccgccggaagaagcgcctgaagctcctggaggagctgttcctcgacgagatcagcaagatcgacaacaccttcttcaagcggctgaaggagtccaacctgtacaacgaggacaagagcatcaagttcaactaccccctcttcaacgacaaggactacaccgacatcgacttctacaacgagtacaagaccatctaccacctccgcaaggacctgatcttcgaggacaagaagttcgacatccggctcgtgttcatcgccctgcaccacatcctgaagtaccgcgggcacttcatcttcgagggccagtccttcgaggagatcaagagcttcgactccatcttcacgcagctcagctcctacttcctggagaacttcgacttcaacatcgacgtgagcatcaaggagaagctggaggagatcatcctctccgacaacaccaagagcatcaagaagaccgagttcaagaagatcttctccgacaacaaggtcctgagcgtgctgaacatggccatcggctccaaggtgagcctcaaggacgtcttcaacaacgaggagctgaaggagcagaagatctccttcagcgagatcgactacgagaacgagaagcgggacgagttctaccagctgctcggggaggacatcttcctgatcgacctggccaagaagatctacgacttcatggtgctcaagaagatcctgaagaacaccgacagcttctccgccagcaaggtggcgctgtactgcgagcacaagaaggacctcgacgacctgaagtacatcttcaagaagtacctgacgaaggaggactacttcaagttcttccgctccaacgtcgagaagatcaactacccgagctacatcggcctcaacaagatcaagtccaagaagatcatcaaggagaacaagtgcagcatctccgacatcaacaaggagctgaagaacaagtacctgaaggacatcaagctcgaggccaaggacaaggagctgttcaaccggatcttcaacaagctggacgagttcaagttcctcgagaagctcaagagctccgagaacagcaccgtgccctaccaggtgcacgagatcgagctgaagaagatcctcgacaaccagcgcaagtactaccccttcctgaacgagaagatcgacgggaagtccgtctacgagaagatcatccagctgttcgagttcaagatcccctactacatcggcccgctcaacaccgaccccaacgtgaaggggaagaacacctgggtggtccggaaggacgagaacaacaagacgcccatcaccccctggaacttcgagcagaaggtggacatgcagaagtccgccgaggagttcatcaagcgcatgaccaaccggtgcacctacctgaaggccgaggacgtgatcgcgaagaacagcctgctgtacgaggagttcatcctcctgaacgagctgaacaaggtcacggtggacaacgagatcctccacccgaccctgaagaccgagatcatcaacgagctgttcaagaccacggtgaaggtcaccaagaagaagttcatcgagttcctcaagaagaagcaggccgtgaacgacgtggagagcatcaccggcatcggcgtcgagttcaactgcaagctgcaggggtacaacaccttccgcaagatcctgggcaagaagatcgagaacgtgaacgtcaagaacttcgtggagaagtgcatcgagctcaagtgcctgtacgggtccgacaagaagctgttcgagaacgccatcggcaagatctaccgcgagtacaacatcacggacgaggagttcaacaagatcaaccggctcaacttcaacaagtgggcccgcctgagcaagaagttcctgaccgagatctccttcgagaagaccgacggcaccaagcggttcgagagcgtgatcgaggccctccgctccacgaactacaacctgatggagctgctcagcgacaagttcaacctgcagagcaagatcgacgagatcaacggggaggacgacttctccaacatcgacatcaaggagtacgtcgacaagctgtacgtgagcccctccgtgaagcggagcatcatccagacctacaagatcgcgatggagatcaagaagatcaccaagaaggaccccaagaagatcttcatcgagatggccaaggacaagggcgagaaggggaagaccacggagaagcgcaaggacaagatcaagaagctctacaagaacatcaaggacaccctgtccgactactgcaacaacctgcaggacctcaccctgcaggtcgagaagtacgacgacaaccggctgcgccagaagaagctgttcctgtacttcatgcagatgggcaagagcatgtacaccgggcggtgcatcgacctggaggacctcttcaacaacaacgtgtacgacatcgaccacatctacccccagtccaaggtgaaggacgacagcttcgacaacatcgtcctggtggagaaggaggagaaccaccgcaagtccaacgagctgctcaaggaggagatccagagccggatgaacaactactggatcttcctgcgcgagaacaagttcatctccaaggagaagtacaaccggctgacgcgcaagaaggacttcaccgacgaggagctcggcgacttcgtggcccggcagctggtcaccacccgccagagcaccaaggagatcgccaagttcttcgagaagatcttcgagaagacgaccgtggtgtactccaaggccagcctggtctccgagttccgggagaagtacgacatcatcaaggtgcgcgaggtgaacgacgcgcaccacgcccaggacgcctacctcaacatcgtcgtgggcaacgtgttcaacaccaagttcaccaagaactactggaagttcacgaaggacatcaagcggcagaacgaggagaacccgaacgagaagaaggggtacaacctgcgcaagatctacgagagcgacgtcttctgcaacgactccgtggcctgggtgtacagcaaggagaaccccaagtacaacaccatcaacaccgtcaaggacatggtgtaccgcaagaccgccaacatcacgcggatgctggtggagggcaaggggcagctgttcaacctgaccatcaaggacaagacccagctgaagaagaacgtcggcaacatcgtggcgaacacccccatcagcctcaagaaccgcaagctgcacctgaactccgtggagatcgccaagaagtacgggtacttcgacagcctcaacaacgcctacttcgtcctgttcaagtacgaggagaagggcaaggagaagatcggcttcgactccatcacgatcgcctacaaggagcggctgaagaagaacctcgacatcgagaagttcctggagaacaaggggtacaagaacagcaagctgatccgcaagatcttcaagaaccagaaggtgctcatcaacggctacccctacctgctgaagtccttcaacaagcagagccagatcaagttcaacaacttcaagatcctctacctgaacgagaacaacctgaagttcgccaaggacgcgatcaagttcgagaagaacaacgccaacgtggacctcaagaagcagaagtacatcgtctccttcctgaagaagaagaagcagaacgagatcaacgagacctacgaggagtgcatcgaccggctgaacgacgagttcgacaccctcttcctgaagctgtgcgacatccagaagtccagcatctacaccaactacaagctccaggacttcagctccaacaagaagtccatcgagatcaaggacaagttcgacatcttcaagagcctggacctgtacaagaagtccaagctcatcaaggagttcctgaactactacaagtacgagaagaacgacctggacttcagcctcatcgacatcgacaagaaggccaactgcatccagaagcacttcacggaggacctggtgaaggacttcgtgatcgtcgacgagagcgtgaccgggctgttcgtgaagaaggagcgcctcaagtga

SEQ ID NO: 2132 - RNA, 4203 nt, synthetic construct
  misc_feature 1..4203: note = Cas9 variant
  source 1..4203: mol_type = other RNA
atgaagaccatcaccgaggactacatcctgggcctcgacatcgggacgaacagctgcggctgggccgtgatggacaagaagaaccgcctgctgcggctccgcgggaagcgggccatcggctcccacctgttcgaggaggggcacagcgcggccgaccgccggtccttccgcaccacccggcgccggctgaagcgccggaagtggcgcctccggctgctggaggagatcttcgccgagcccatggccaaggtcgacccggccttcttcgtgcgcctccaccagagctgggtgagccccctggacaaggaccggaagaagtaccacgcgatcgtcttccccaccgccaaggaggaccacgagttctaccacgactaccccacgatctaccacctccgcgacgccctcatgcgggaggaccgccagttcgacctgcgggagatcttcctggccatccaccacatcgtgaagtaccgcggcaacttcctccaggacaccccggtgaacagcttcgtcgcgtccaagatcgacgtggccagcttcctgaccaacgtgaaccaggcctacgccgacaagtacggcgaggagcagaacttcatcgagctgaacgagaacaacgccgcggccatcgaggccgtcatccgggggaaggacaaggacaagaccacgaagcagctcgacaaggccaagaagatcaccaagctgctgcagtccagcaccaacaagtacgagaagaacgtgacccgccagatcgccaacgcgatcatcggctacaagacgcagttcgagaccatcctcgggaaggacatcgacaagaacgacaaggccgactgggagttcaagctgtccgacggcgacgccgacgacaagctggagaacctcctgcccgagttcgacgacaacgaccagtacatcgtggccgagatcaagaagctgttcgggagcatcgccctctcccagatcgtctacgagaacatgaccctgagccagtccatgaagtgcaagtacaaggaccacggcgacgactaccacctcctcaagcagtacatcgcgaccctgagcgaccacggccaggtgcgcaagctgctcctggcctacgacctgtacgtgaacaaccggcacgggcgcctcctggaggccaagaaggagttcaagcaggacaaggccctgacgcaggacgagttctacaagatcgtccgggagaacctcgacaactcccagctggcccagaagatcctgcagaagatcgaggaggagaagttcatgcccaagcagcgcgtgaacaagaacggcttcatcccctaccagctccaccagatcgagctggaccagatcatcgcgaaccagagcaagtactacccgttcctggccgaggagaaccccgtgaaggagcaccggaagcaggccccctacaagctcgacgagctggtccgcttccgggtgccctactacgtggggccgctgatctcccccgacgacaagcgcaaggacaagcagcagaacaagaaccacgagatgttcaagttcgcctggatgaagcggaaggacaacaacggcgcgatcaccccctggaacttcgcccagaaggtcgaccgcgagaccagcgccaaccggttcatcaagcgcatgaccgtgaaggacacgtacctcatcggcgaggacgtgctgcccgcccggagcctgctgtaccagaagttcgaggtcctcaacgagctgaacaacatccgcgtgaacgggaagcggctggagccgaagttcaagcagaaggtcttcaacgagctgttcaagcagaagaacaaggtgaccaagaaggccttcaaggagttcatcctgcagaacaccggcatgaagaccgcggagatcgacgggctggccgaccccacgaagttcaactccagcctctccagctactaccacctgaagtccaccaaggtgttcgacaagcagctggacgaccccgagtaccaggccgacttcgagaagatcatcgagtacagctccatcttcgaggacgccgagatctaccaggagaagctccacaaggagatcaagtggctgatccccgcccagttcaaggcgatcgccaactggcgcctgcagggctgggggcggctcagccgcaagctgctggtcgagctcaagggcaagggcggggagaacatcatctaccagctgtggaccacccagaagaacttcatgcagatcgtgaacgagccggagctgaagaaggccatcgtgaaggagaaccaccaggccacggaggagaagggcatcgagaagatcctcgacgactccttcaccagccccgccaacaagaaggcgatccggcaggtcatcaaggtggtggacgacgtcgtgaaggccgccgggggcaagaagcccgcccagttcgcgatcgagttcacccgcgagcccaagtggaacccgcagctgtcccacatccgcgggaccaagctgctccaggtgtacgaggacacggccaagaagctggtcgaccagagcctgaccgactccctcaaggagaacatgaccaaccggaacctgctgaaggacgagtacttcctctacttcatccagtgcggccgcgacgcctacaccggcaagaagatcgacatcgccgacatccacaagaagtaccagatcgaccacatcctgccccagagcttcatcacggacgactccctggacaaccgggtgctcaccgagatcgagatcaaccagaagaagcacaagaagtacgccagccacctgttcgcgaccaagcccgccttcgggctgaaccagtccatcagcgagatgtggaagacctggcagaaggccggcctcatctcccagcgcaagctgaacaacctgctgttcgaccccgacctggtgaaggacaagcagaagaaggggttcatcaaccggcagctggtcgagaccagccagatcatcaagctcgtgagcatcatcctgcaggacaagttcccggacacggagatcatcaccgtgaaggccggctacaacaccgccctgcgcaaggagctcaagctgtacaagtcccgggaggcgaacgactaccaccacgccatcgacgcctacctgaccgccatcaacgacaacttcctctaccaggtctaccccaacttccgccccttcttcgtgtacgggcagttcaagaagttcagccaggacacggacaagcagaaggaggccatcaagtactacggcctgaagaacttcctggagccgctcctggacgactccaccggcgacgaggtgatggtcaaccacaccaagcacgtggtgttccacaagcagcgggacatcttcaaccgcctgatccaggcgtacaactacaagtacatgctcgtcagccgggagaccacgaccgagaactccaacatgttcaacatgaccatctacccccgcggggagcgggaccgcaagaagacccggaagctgatccccaagggcaaggacctggaccccgccatctacgggggctacagcggcaacacggacgcctacatggtgatcgtgaagatcgagaagaccaaggagaccctctacaaggtcgtgggggtgccgatgcgcgccctggcgtccctgaagaaggcccagaaggagggcaactacgaccaggagctcaacaaggtcctggagcccctgatcatgttcaacaagaacgggaagtccaaggccggcatcaaggggttcaccgtggtgaaggaccacgtccacttcaagcaggtcgtgatcgacggcgactccaagttcatgctctacagcgcccagtaccgggccaacgcgaagcagctgacgctgtcccaggagaccatgaaggtggtgaccgacaacaccgacgacatggaccagaagaacgccgacaaggaccagctcctgctgaacgcctacgacgagatcctcgagaaggtggaccagtacctgcccctgttcgacatcaacggcttccgccaggggctccacgacggccgggccaagttcgccgcgctgaagacgagcgagaagaagtacaccctgaagaacatcctcaacgggctgcacgacaacctggtcacccccaacctcaagaacatcggcatcaagaccccgttcgggctgatgcagtccagctccggcatcacgctgagccccaacgccaagctcgtgttccagtcccccaccggcctgttcgagaagcgcgtgaagctgaccaacctctga

SEQ ID NO: 2133 - RNA, 4203 nt, synthetic construct
  misc_feature 1..4203: note = Cas9 variant
  source 1..4203: mol_type = other RNA
atgaagaccatcctgggcctcgacctggggaccaacagcatcggctgggccctggtgaaggagacggagaactccaacgagaagtccgagatcatcaagctcggggtccgcgtgaaccccctgaccgtggacgagaagaccaacttcgaggccggccggccgctgagcaccaacgcggaccgcacggccaagcggagcgcccgccggaacctccagcgctacaagctgcggcgcaagaacctgatcgacctcctgatcaagcaccggctgatcgacaaggacacgcccctcaccgagatcgggaagaacaccacccaccagaccctggagctgcgcgccaaggccgcgcgggagcgcatcgagctcgaggacctggcccgggtcttcctggccatcaacaagaagcgcggctaccggtccagccgcaaggtgaacaacgaggaggagggccaggtggtcgacgggatggccgtggcgaagaagctctacgacgagaacctgacccccggccagtacgcctacgagctgctctccaaggggaagaagtacgtgcccgacttctaccggagcgacctgcaggccgagttcgactccatctgggagtaccagaagcagttctacgccgacatcctggacgacgagctctacaacgccctgaagggccaggggcagcagaacagccgcaagcggttcctggcgatcaagggcgtctacaccgccgagaacaagggcaagcgcgacgaggtgaagctccagcactacaagtggcggtccgaggccatcacgcagaagctgagcatcgaggaggtggcctacgtcctggtggagatcaacaacgacctcaacaagtccagcgggtacctgggcgccatctccgaccgcagcaaggagctgtacttcaacaaggagaccgtgggggagaacctctggaagcagatccagaagaacccgcacacctccctgaagaaccaggtcttctaccgccaggactacctggacgagttcgagcagatctgggagacccaggcgcagttccacccccagctcacgctggccctgaaggagcagatccgggacgtggtgatcttctaccagcgcaagctcaagagccagaagggcctgctgtccttctgccagttcgagagctgggagatcgagcggaaggacgagaacggcaacgtcatcctcaacaagaccacccagctgcccaagcgccagaccgtggggcggcgcgtggcccccaagagctccccgctgttccaggagttcaagatctggcagaacatcaacaacctcgagatcgccaagatcagcgacggcaactccaagaacaagaaggagacggaggccctgagcgacgacgagcggaagctcctgttcgaggagctgaacctgcgcgggaacctgtcccagaaggaggtcctccagatcctgggcctgaaggacaaggagtacaagaccaacttccccgaggggctcgagggcaaccggaccaacgcggccctgttcaacatctaccagcagatcgccgagaacgagggctacggggactggaccaagaagtccgcccaggagatcaaggaggagctgaaggccgtgttcccccagatcggcatccaggcggacatcctcgacttcaacgccgagctggacgggaaggagttcgagaaccaggccagctaccagctgtggcacctcctgtacagcgccgaggaggacgacaagatcaacgaggaggaccagatcatctacggcaactccgcggtgagcctgaagaagaagctctgcgagaagttcgggttcacgcccgagtacgccaagtggatcgccaacgtctccctgcaggacgactacggcaacctgagcaccaaggccatgcgcaagatcatcccgtacctcatcgacggcaacgactactccgaggcctgcgcgctggccgggtacaaccacagcaactccctgaccaaggaggagaacgacaaccgggagcgcctcaacaagctggagctgctccccaagaacagcctgcggaaccccgtggtcgagaagatcctgaaccagatggtgaacgtggtcaaccaggtgatcgagacctacggcaagcccgacgaggtgcgcatcgagctcgcccgggagctgaagaagtccgccgaggagcgcgccgagatgacgaaggggatcaacgaggcgacccggcgcaacgaggacatcaagaagctgatcaccaagaacttcggcatcccgaaccccaccaagaacgacgtcgtgcggtaccgcctctgggaggagctggcgcccctggcctacaaggacgtgttcacggggcgccagatcaagaaggaggacctcttcagctccaagatcgacatcgagcacatcatccccaaggccctgctgttcgacgacagcttcagcaacaagaccctcgccttccgggagaccaacctgaagaaggccgaccgcaccgcctacggcttcatcgagtccgactacaacgccacgctggacgactacatccagcgggtcgagaccctctacaacaacgccaagggcaccatcagcaaggggaagcgcaacaagctgctgatggcgcagaagaacctcccggacggcttcatcgagcgggacctgcgcaactcccagtacatcgccaagaaggccaagagcatgatcgagaaggtgttcaacgacgtgaacgtcacctccgggagcatcaccgaccggctgcgcgaggactgggacctcatcaacgtgatgaaggagctgaacttccccaagtacaaggccctgggcctcacggagatcgaggagcggtacgacatcggccaggagaagaccaagaaggtggaggtcatcaccgactggaccaagcgcaacgaccaccggcaccacgccatggacgcgctgacggtggccttcaccaccaagtcccacgtgcagtacctgaacaacctcaacaccatccacagcctgaagggggacgaggtcgacctggagctctccaagctgtacggcctgaagaacacgatcaccgaggtggtgaacaagaagcgcaagttcatcccgcccatgcccaacttccgggaggaggccaagaagcacatcgagaccatcctcgtcagcatcaagaacaagaacaaggtgtacaccaagaacatcaacaagacgaagaaggagtccgggtaccacaccaaggagcagctgacgccccgcggccagctgcacaaggagaccgtgtacggcaagagcaagcggcccatgaacaagcccaccaagatcaacaagaacttctccctcgagcaggcccagctgatcatcaacgtccaggagaaggagctggtgctccgccacctggcccagttcgacaacaacccggcggtggccttcgacaccaagaccctgaagaagatgcccctcctgaagaacggggagcccctgaaggaggtcctctgcttcgaggagatcttcaccatccggaaggacatcacgccggacctgaagatcgagaaggtggtggacgagaagatcaaggccatcctggagcagcgcaagaaggacttcggcgggaacgccaaggaggccttcagcgacctcgacaagaaccccatctggctgaacaaggagaagggcatctgcatcaagcgggtcaccatcaccggggtgtccaacgcggaggccctgcaccaccagaaggaccacctcggccgcgagatcctggacgacaacgggaaccccatccccgccgacttcgtgagcaccggcaacaaccaccacgtcgccatctacgaggacgagaagggcaagctgcaggagaaggtggtgtccctctacgaggcggtcgcccgggccaaccaggggctgccggtggtggacaagggcctgaacgaggacctcgggtggaagttcctgttcacgatgaagcagaacgagatgttcgtcttccccaacgacgacttcgacgtgaacgacatcgacctgctcgacgagaacaacgccaagatcatcagccagcacctgttccgcgtgcagaagctggccaccaagaactacatgttccgccaccacctcgagaccaacgtccaggaggtgaaggagctgaacgacatcgcgtacaagagcatccggtccaccgagcccctgaagaacatcaagaaggtgcgcatcaaccacatcggcaagatcgtccaggtgggggagtactga

SEQ ID NO: 2134 - RNA, 4209 nt, synthetic construct
  misc_feature 1..4209: note = Cas9 variant
  source 1..4209: mol_type = other RNA
atggccaagaaggactacaccatcggcctggacatcgggaccaacagcgtgggctgggccatcatcgacgacaacctcaagctgctgaagcgcaacatgacgatcaaggggaacaccgacaagaagtccgtcaagcgggacctctggggcagcctgctgtactccgggaacagcgacaagaccacctccgcggccgacgcccgcagcaagcggggcctccgccggcgcctgcggcgccggaagtaccgcctggaccggctcaagcagatcttctccgagatcatcaacgacaaggcccccaacttcttcgacaagctgaacgagagcttcctgaacccgaaggacaagaagtacggcaagtaccagatcttcgacacggagaaggaggagaaggactactaccgccggtaccccaccatctaccacctccgcaaggacctgatcgagtccagcaagaagcaggacatccggctggtgtacctcgccctggcgcacatcctgaagtcccgcgggaacttcctcttcgagggcaacatcgacgacctgaagaacgacttcgccgggatctacgaggaggtggtcgagctgtgcatgaccatcaacgccgaggacgtggacctcgagttcgaggaggtggacaagcagagcctgaactccatcatcaagaacgaggacatcagcgagatcgagcagggcctggagaacttcgccgacgagcacgtcatcttcaaggagcagaacaagaagaagaacgacctcttctccaactgctgcaagatcatctgcgggcacaccgtgaaggcgaacaagttcgccagcgagctggactccgagctgttcatcagcttcaagtccgacgactacgtggacgtcatcgacgtgatccagagcggcaacgagaacatcgccaacctcctgctggcctgccggaaggcctacgactacatcatgttcaaccgcctcgtggacctgaacatcgacagccccgcgaagctgtccagcaacatggtctccctctacaaccagcacgagaaggacctgaaggcctacaagaagctgatcaaggagttcaacaagttcaagcggagcaacggctgcaaggacctcgagatgatcatcctgacggccgacgacatcgactccttccgcaagaaggtggacaagaaggaggggaagctgaacggcatcaacaagaagatcacccacgagcaggccctcaagaagcagctgaaggacatgaagaagatcctggaggacaagaacaccgaggccgaggacaagcagatcaacgacatcctcaagatgatcaccagcatcgaggagcgggtgaacaagtcctgcttcctgaagaacctgcgcagcacggacaacgcgtccatccccaaccagatccagcgccaggagatggaggccatcctcgacaagcaggccaagttctacccgttcctgaacgagcacaaggacgagctgctccagctgctgagcttccggatcccctactacgtcgggcccctggtgaacaagaagtactcccgcttcgcctggctcgtgcggaaggagggccaggtccagaagatcacccccaccaacttcgacggcgtggtggacaagcacaagaccgccgagaagttcatggagcgcctgatcgggaaggacgtctacctgccgaacgagcgggtgctccccaaggcgagcctgctgtaccaggagtactgcatcttcaacgagctcacgaaggtggcctacatcgactccaccggcaagaagaacaacttcagctccgaggagaagctgaacatcttcgagaagctgttcaagaccaagcgcgaggtcaccaagacggacctctgcaagtgcctgaacaacgtgtgcaagctgaaggagaaggtcaaggagaccgagatcatcgggatcaaggccaagttcaacgccaagtacagcacctaccacgacctcaagaagatcaacggcatggagcagctgatcgccgacgaggaggggaagcccctgtgcgaggacatcatctccatcctcaccatcttcgaggacaaggacatccggctggtgcgcctgaaggagctcctgtgccagaacaaggacctgatcaacaagttcagcctctccgcggagaagctggccaaggtgctgagcacgaagcactacaagggcttcggcaacgtcagcgccaagctcatcaacgggatccgggacaagaactgcaagaccatcctggactacctgatcgaggacgacaaggaggcctactacggccgcaacaaccccaaccggaacctcatgcagctggtgaacgactcccgcctggcgttcaaggggcagatcgaccgggagcagaacacccacctcgaggacctgagcctggacgagttcctcgacgacctgtacgtgtccccgagcatccgccggggcatccgcctgaccatccggctcgtcgacgagctggtggagatcatggggtacctgcccaagaacatcgtgatcgagatgccccgcgaggacggcgagaagggcaagatcgccgacacgcggtactccaagctcgagaagatgctgaagaaggacgccgccctggaggacctctaccgcgtcctgaagacctacgagaagaacaagaaggccctggcgaacgacgccctctacctgtacttcctgcagaacgggcgcgacatgtacaccggcaaggagatcaacctcagcgagctgcactcctacgacatcgaccacatcatccccaagagcttcaagtacgacgactccctggacaacaaggtgctcaccgccaagaagatgaacatggacaagcggacgggggccctggaccacaacatcatcgagaaccagtgcggcttctggcgcgtgctgctccagcaggacaagatcagcctggagaagtacaccaacctgatgaagaccgagttcaccgaggccgacaaggcggggttcatcatgcggcagctcgtcgagacgcgccagatcaccaagttcgtggcccggtacctggacaacaagttcaacggcctgatctccgacccgaacgacaaggtgaacatcctcctgccccgcgccagcctgtgccaccagttccgggagaccttcggcttctacaaggtccgcgagctcaacgacatgcaccacgcccacgacgcctacctgaacgcggtgatcgccaacaccctgaacaagaacgcctacctctccgacctgctgaagtacggggcctacagcaagtacaagaagaacggcttcaacaactccaacgggatcatggactacttcggcaacacccagttcaactgcctcttcgtggtcgagcggacgctggacaagtgccgcgtgaacatcgtgaagcaccccgagaccgcgagcggcgagttctacaacgagaccatccagaagaacaaggtcaacgggggctccagcacccggagcctgaagtccagcgtgaaggtgctccagaacacggagcagtacgggggcttcaccaacgtcaacaacgcctacttcatcctgttcgactacaaggccaagtccaagctgaagcgcaagctcatcggggtgcccatcgtggaccggcagaagttcgagcaggacccggtcacctacctggaggccaagggcttcgacgagcccaagctggtgcagaagctcctgaagtacaccctgctcgagtacgaggacggcaagcgccggtacctgacgggggtgaccggcaagcgctgcgagctggtccgggccaaccagctcctgctgccccgcaacatgatggcgctcctgcaccacctccaggagtggcagaagcacgacttcgggatcaaggagatgaccaaggtgatcaagaacaccaacaacatcgaggccaagttcgacaagctgttcgagcacatgatgaagttcatcgacaagtacagcgagcccccgaagatcgtgtccagcaagatctccgaggagtaccacaagctgcgggagagcctgtgccaggacgacaacaagatcaagatctacgccgagatcggcaaggccctcctgtccctgctgcacctcgtcgacagcaagtccgcctgcgtgttcaagttcagcgggctggagatcaaccgcatccggtaccagtccatcaacgagaagaaggagcccgtgatcatcttccagagcctgtccggcctccgcgagagccgctacaagtacaaccagtga

SEQ ID NO: 2135 - RNA, 4209 nt, synthetic construct
  misc_feature 1..4209: note = Cas9 variant
  source 1..4209: mol_type = other RNA
atgaagctgcgcaacgccaaggactacagcatcggcctcgacgtggggaccggctccaccgggtgggccgtcacgaccctggacggcgacctgttcaccttcaaccaccggcccaccctcgggagccgcctgttcgagtccgcgagcacggcccaggagacccgggaggcccgcggcgcccggcgccggctgaagcgccggcgctggcggatctccctcctgcaggagcagttcgccgcggagatggagagctgcgactccaacttcttcatccgcctgaaccagagccggctctggcaggaggaccgcaccgagcagggcaaggggtacctgttcggcgggaagccgatcctgtgcggcgcccagatcttcgccaacgagcaggagtactaccagcagttccccaccatcttccacctccggaagttcctggtggagtgctccgagcaggtcgacctgcgcctcatctacctggccctgcacaacatcgtgaagtaccgggggaacttcctctaccaggacaacaagacgctgaacgtgcgcaacttcaacctggacagccagatcgcggacttcctcgaccagctgcagctgtggtgcgagaacaacgacctctgcttccacgagatcgacggcaccaccaccctggcctcccagctgaacacgtgcttccaccagcagagcaaccagcagaagaaggacaccctcaagaccttcttcgcgacctgcatcgagaacgacaagatcgccggcgagctgacgaaggccctgctcgggtacaagaccgacttcaagatcatcttcaacatcgagggcgagaaggacgagtacaaggccaagtgcaacgaggaggagaagatcctgaagctgcaggagaccatcgacgacgccaaccaggtgctcctgcagtccatcctgaacctctacagcgggatcatcgtcgagaagatcctgaacaacaccgccgtgaagaacgagtccgcccagtgcacgctgagcgcctaccactgctactcctacgcgctctacagcaagcagctgcggaccctgaagaagctcgtgcgcaagtacaacccccagcggtacaacgagtgcttcaacctgtccgccgaggaccccaaggccaagaagcagctgtgcacctacgcccgctacaacgcccagcacagcaccgactacgacgagttcaagaagtacatcaaggacctcttcgagaacacggacgcggtcaacgacgccgcctaccagcagatgaagcaggacttcgacgaggagaagttcctgcgccggcagaagaccagcgacaacggcgtgtacccgtaccagttccacctggaggagatgcagctcatcatcgagaaccaggcccagcactaccccttcctgaccaagatcaagcccaagctggagtccctggtgaccttccgcatcccctactacgtcggcccgctcacgcagaaggggatccagcggaacggccgcaagttcgcctggagcaagcggaacaaggacgcggagaaccagcgcatctacccctggaactgggactccatcatcgacaagagcgcctccgccgaggccttcatcctgcggatgaccgggaagtgcacctacctgtacggcgaggacgtgctccccaaggagagcctgctgtaccaggagttctgcgtgctcaacgagctgaacggggcgcgctggaactgcgacggcgagcggcgcatgcccctgtccaacaaggactgcaaggccatctaccggcagctgttcctgaagaagcagaaggtcagctacgccgacgtgtccaactacctgaaggcccagggccacatcaacaacagcgtggccgggggccagggggagcacggcttcgagtccaccctcagctcccaccacttcttccgcaagctgttcaacgtcgacgcggccaacgacctgacggcccagcagatcgagaccgccgagcagctcatcctgtgggggaccatcttcgaggacaaggagatcttcgagcagaagatcaaggagcggttcggcgacatgttcagcaaggacgagatcaagaccatcgcccgccggaagttctccggctgggggaagtgcagcaagcagctgctctccggcctgacggtggagaccccgcgcgggcgggagagcatcatcgacgtgctgcgcaacggccaccccgagaacgggcggaccctcgtcttcatgcaggtcatcaccgacaagaagctggagttcgacaagaagatcgaggagtacaacaacgagcacctggcgaagaccaacgagtccgtgctcgacacggccatcatgagccccgccatcaagcgcggcgtgaaccaggccctgcacatcgtgggcgagatccgccggatcaccaagcacgacccgacctgcatctacatcgagaccacgcgcgacgagaaggacgggaagcacaacacccggaccagctcccgctacagctccctgaagaagaacctcgagaccctcaagagcatcgacaaggccaacgcgcccgccatcaagcactccctggagctcctggagacgtacaagaagcagaacatcgacgacaagctgttcctctacttcacccagaacggcaagtgcatgtacagcgggaagtccctggacatcaacaacctgagctcctaccagatcgaccacgtcatcccccagagctacatcaccgacaactccttcgacaaccgggtgctcgtgtacgccagcgagaaccagcgcaagtccgacagcctgctgctctccagcgtcatccaggccaagcaggagcccttctggacctccctggagaaggcgggcctgatcagcgagaagaagcacaacaacctcaagcgcaagagcctgtccgacgcccagatcaagggcttcatcaaccggcagctggtggagacgagccagatcgtgaaggtcctccgggacgagctgtcccgcatcctgcccgacaccaagatcatcccggtgaaggccagcctctcccacgacgtgcggatcgcctgcaacctgtacaagagccgcaccgccaactccttccaccacgcgcacgacgccctgctcgccagcaccatggggcggttcgtccagacgcgcttccccgacatgtacgagaaccccgtgcggtacgtgaagatcctgcgcgcctacatcgcccagtccaagctgcagcacagcgcgcagacccggaacttcgactcccgcagcttcatggcccactccttcttctgcgactacagcaacgagaacggcgacaccatctggaactccgccagcgagatcgagcggctccgccgggccctgtcctacaagaacctgtacctcacccgccgccccttcatcgacgccgggcagttctgggaccagacgatctacagcccgcacgacaagaagaagacccccgactccctgatccccctgaagaagaacctcgacacccagaagtacggcgggtacagcggcaaggactacgcgcacttcttcatctacagcgtcctgaacaagcagggcgacgtggagtaccggttcgacggggtgcccctgtacatcgccgccaacatcaaccgcgacgaccggggcgccctcgcgcagtacgccaagcagctggtcgagcacgagaacgtgccgaacgccaagcgcaagaccaaggacctggtgttccagcggatcgagcgcgcctgcgtccccaagtaccagctcatctgcatctcccagtgcagcggggactccgaccggagcgtgtccgactactactacatcacgggcaagaaggaggtgcgcaacgccctgcagctggcgttccccatgcacctctacggggccatcaacgccatcgaggacaagaaggagctggacgacagcgccctggaggagctcgtcgtgtacatcctgcggaacgccccgcgcatcgcgcccgacgtgttccggcgcctgaacctcaccgagaagctggccgactgcctggacatccccgaccggatcgagctccagaactccatctacggcctgttcaacctgatcaacgccgagagcaacgtcgtgaacctccagatcttcggcggggccaagaccgccggcgtgaagctgatcaacctgaactccctcctgaacgaccccgcgaccacggtcaccttcatcgaccagagcgtgaccgggatgttcgagcgcaaggagaccatcggcatctcctga

SEQ ID NO: 2136 - RNA, 4209 nt, synthetic construct
  misc_feature 1..4209: note = Cas9 variant
  source 1..4209: mol_type = other RNA
atgggcaagcaggagttcaacgactactacctggggttcgacatcggcaccaacagcgtggggtgggccgtcaccgaccagcagtacaagctcctgcgcttcaacaagaaggacatgtggggctcccggctgttcgaggaggccaagacggcgaaggagcgccgggtgtaccgcaacagccggcgccggctcgaccgccggaagcgccggctgaagctgctcgaggagctgttcctggacgagatcctcaaggtggactccaccttcttcaagcgcctggaggagagcaacctgtacaacgaggacaagtccatcaagttcaactaccccctcttcaacgacaaggactacaccgacatcgacttctacaaggagtacaagaccatctaccacctccggaaggccctggtcttcgaggaccgcaagttcgacatccggctcctgttcatcgccctgcaccacatcctcaagtaccgcgggcacttcatcttcgagggccagagcttcgaggacatcaagtccttcgactacatcttcacggagatccaggactggatcctggagaacttcgagatcaacatcgacatcaacctgaaggagaagctcgaggagatcatcctgagcaacaacaccaagtccatcaagaagatcgagttcaagaagatcttcagcgacaaccggatcctggccatcctcaacatgggcgtggggtgcaaggtggacctgaaggacgtcttcaacaacgaggagctgaaggaccagaagatctccttcaccgagatcgactacgagaacgagaagcgcgacgagttctaccagctcctgggcgaggggatcttcatcgtggacctggccaagaagatctacgacttcatggtgctcaagaagatcctgaagaacagcgactacttctccgagagcaaggtcgcgctgtacgaggagcacaaggaggacctcaaccggctgaagtacatcttcaagaagtacctgaagtccagcgactactacaagttcttccgctccaacagcgagaagaccaactacccgtcctacatcggcctcaacaagatcaagacgaagcggctgatcgagaacaacaagtgcagcatcagcgacatcaacaaggagctgaagaacaagtacctcaaggacatccaggtggaggccgaggacgaggagctgttcaaccgcatcctgcacaagatcaacgagaacaagttcctcgagaagctgaagtccagcgagaactccaccgtgccctaccaggtccacgagatcgagctgaagaagatcctcgacaaccagcgcaagtaccacagcttcctgaacgagaagtccgacgggatgaccctgtgcgagaagatcatcaagctgttcgagttccggatcccctactacgtgggccccctgaacaccaacccgaacatgaacaagaagaacaagaacacgtgggtggtcaagaaggaggagaacagcaagtccagcatcaccccctggaacttcgagaagaaggtggacgagcagaagtccgccgaggagttcatcaagcgcatgaccaaccggtgcacctacctgcgcggcgaggacgtgatccccaagaacagcctgctctacgaggagttcgtcctgctgaacgagctcaacaaggtgacggtggacaacgagctgctgcaccccaccctcaagaacgagatcatcgacgagctgttcaagaccaccgtcaaggtgacgaagaagaagatcaccgagttcctgaagaagaagcaggccatctccgacgtggagagcatcaccgggatcgacgtcgagttcaacggcaagctccaggggtacaacaccttccggaagatcctgggcgagaagatcgagaacctgaacatcaagaagttcgtggagcgctgcatcgagctcaagtgcctgtacggctccgacaagaagctgttcaagaacgcggtcgggaagctctacaaggagtacaacgtgacggacgaggagttcaccaagatcaacaagctgaacttcaacaagtggggccggctgagcaaggagttcctcaccgggatccgcttcgagaagaccgacggcacggagcggttcgagtccgtgatcgccgccctgcgcagcaccaactacaacctgatggagctcctgtccgacaagttcaacctgcagagcaagatcgacgagatcaacggggaggacgacttctccaacatcgacatcaaggagtacgtcaacgagctctacgtgagcccgagcgtgaagcggtccatcatccagacctacaagatcgccatggagatcaagaagatcaccggcaagaaccccaagaaggtcttcatcgagatggccaagggcgggggcgagaaggggaagcgcacggagcggcgcaaggacaagatcaaggagctgtacaagaacatgaaggacagcctgtccgactactgcaacaacctccaggacctgagctcccaggtggagaagtacgacgacaaccggctgcgccagaagaagctgttcctgtacttcatgcagatgggcaagagcatgtacaccgggaacgacatcgacctgtccgagctgttcaacaacaacatctacgacatcgaccacatctacccccagagcaaggtgaaggacgactccttcgacaacatcgtcctggtggagaagcaggagaaccacagcaagtccaacgagctgctcaagcccgagatccagagcaagatgaacaactactggatcttcctgcgggagaacaagttcatctccaaggagaagtacaaccgcctgacccggaagaagaacttcaccgacgaggagctcggcgacttcgtggcgcgccagctggtcacgacccgccagagcaccaaggaggtggccaagctgttcgagaagatcttcgacggcaccgaggtggtctactccaaggccagcctcgtgtccgacttccgggagcgcttcgacatcatcaaggtgcgggaggtcaacgacgcccaccacgcccaggacgcgtacctgaacatcgtggtggggaacgtcttcaacaccaagttcacgaagaactactggaagttcatcaaggagaacaaccgcaagaacgaggagaacccgaacaagaaggagggctacaacttcaagaacatctacgagagcgacgtgttccggaacgaggacgtggcctgggtcttcagcaaggagaacaaggagatcaacaccatcaagaccgtgaacaagatggtgtaccgcaagaccgtcaacatcacggagatgctggtggaggggaagggccagctgttcaacctcaccatcaaggaccggacccagctgaagaagaaggtggggaacatcgtcgccaacatccccaagtccctcaagaaccgcaacaccaagctcaagagcgacgagctggccaagaagtacggctacttcgactccctcaacaacagctacttcgtgctgttcaagtacgtggagaaggagaaggagaagatcggcttcgacgggatcacgatcgtcgacaaggagaagctgaagaagaactccgacatcgagcggttcctcgagaacaagggcaacaagaacgccaagctgatccgcaagatcttcaagaaccagaaggtgctgatcgacgggtacccctacctcctcaagagctgcaacaaggacaaggcgatccggttcgacaacttcaagtccctgtacctcgacgagaacgacctgaagttcacccgcgacgccatcaagttcgagaagaacaacgccgacatcgacctgaagaagcagaagtacatcatcagcttcctcaagaagaagaagcagaacgagatcaacgagacctacgaggagtgcatcgagcggctgaacaacgagttcgacaccctgttcctcaacctgtgcgacatccagaagtcccccatctacaagaactacaagctgccggacttcatcagcaagaagaacgtggtcgaggtgaaggacaagttcgaggtgttcaagaacctcgagctgtacaacaagtccaagctgatcaagaacttcctcaactacttcaagtacgacaacaacaagctggacctgatcgccatcggcatcgacagcaaggccaactgcatccagaagcacttcacggaggacctcatcaaggacttcgtcatcgtggacgagtccgtgaccggcctgttcgcgaagaaggagcgcctggagtga

SEQ ID NO: 2137 - RNA, 4209 nt, synthetic construct
  misc_feature 1..4209: note = Cas9 variant
  source 1..4209: mol_type = other RNA
atgacctaccgcaactaccacatcggcctggacatcgggaccagctccgtgggcttcgccgtgcggtacgacaacggggagctcgtgcacaagaagggcagcaacctggtgggggcccgcctgttcaaggagggcgagacggcggaggagcggcgcctcaaccggggcgcccgccggcgctacaaccggcgcaagtggcggctgaacctgctcaaccagatcttcaagcccctgatcgaggtcaacgacccgaccttcttcaagcgcctggagcagtccaacctcgtgaactacgacaagagcgagtccttcagcctgctgaacaaccagtccgacgacaagctccaccagcagttccccaccatctaccacctccgggactacctgatgaagtccaccgagaaggccgacatccgcctcatctacctggccgtgcaccacatcgtcaagtaccgggggaacttcctggacgccagccccgtggacagcttcgaggcgtccaacctcaaggtggacgagatcctgacgcagatcaacctgctcctggacaacctgaccgacgacctccgcctgaacacccagtacgtcaccgacatcgagcagacgctgctcagcaacaccgagtccaacaaggacaaggagaaggtgatccagaagctgctgctccacaaggaggccatcaagatcgacaaggaccggaccgcccagatcgccaagctggtgctgggctacaaggcggacatcgccaagctgttcgggatcaccgagaagctgcagacgcccaagctggagctcagcgccgccaactccgacgacgccctgatggagctgagcgcggagctcaacgaggaccagatcggcatcctgctgcagctcaagaccctgtactcccgcgtccggctgaaccagatcatcccgagcgggacctccctcagcaagagcatgatcgagaagtacgagctgcaccacacccagctgaagtccttcaaggagaacatcctcctgaagctgcgccggaacacggccgtgcgccgcaacctggagctcgcctacgccctgtacgtgggcaacgcccagaccaagcaggaggtcttcgagcccaagaaggcgcggttcaccagcgacgacttcgcctccctgaaggccaacgccaagagcgcctccagcgtgaaggaggcgcccaagaacaccaagacgaagctcaccaccgacgacttctacaacatcctgaccgagctgttcgccacgttcgagtccgagctcagcgccgacgaggacatgatcaaggaggtggagcagatcaagaaggccatcaccggcgacaactacctgcccaagcagcgcaccgaccagaacgggaacatcccgcaccagctgcaccagatcgagctccggcagatcctgcagaaccagctgccccactaccccgagatggacaagatcaacgagcagaagcccatcgagaagctcgtcaccttccgcgtgccgtactacatcggccccctgatcacgcccgaggaccagcagaagtccagcgccgcgaacttcgcctggatgaagcggaaggagcagggggccatcaccccctggaacttcgacgacaaggtggaccgcatgcagtccgccaccaacttcatcaagcggatgaccgtcaaggacacgtacctgatcaacgaggacgtgctcccggaccgcagcctgctgtaccagcggttcaaggtgctcaacgagctgaacctggtcaaggtgaacaaccagctcctgtccatcggcgagaagcaggcgatctaccacgacctgttcgagaagcagaagaccgtcagcaccaagaagctccagtcctacctgcagagcgagcagggctacggggacaacatcgagatctccggcctgagcaaccccgacaagttcaacaacgggctcaccacgtacatcgacttcaagaacatcttcggcgacctggtggaggacaccaccaagcagaaggagttcgagcagatcatcgagtggtccaccgtgttcgaggaccgcgccatcttcaaggccaagctgcaggaggtcaactggctcaccgaggagcagatcaaggccctggtggccaagcggtacagcgggtggggccgcctgagctaccggctcctggcggagctggtgaacgacaacggcgagcgcatcatcgacatcctctggaacaacaaggggtccaacctgatgagcatcgtctcccaggacgagttccagcagcagatcgcccggatcaacagccacgaggtgcaggagctgggcatggagtccgtgctcgccaacgcctacacgagcccccagaacaagaaggccatccgccaggtcatgaaggtggtggacgacatccagctggcgatgaacgggcaggcccccacctccatcagcatcgagttcacccggaagccggaggagaactccgagatcagcaagtcccgctacgagaccatcacgagcatctaccagtccctgagcaaggacatcgagaaggaggtcaaggacaacctcaacaagaacaagtccagcctgaagaagaacctgtccgacaagtactacctctacttcacccagctgggccgggacatctacaccaaccagcccatccccttcaacgagatcccctactacgacatcgaccacatcgtgccgcgcagcgtggagatgaacgacagcctgaacaaccgcgtcctcgtggccaagtccatcaaccagatcaagaagaacaacgcccccatcgacagctccctgaagatcaccagcgagacgcggcagctgtggaagaagctcctggactccgggctgatcaccaagcagaagtactacaagctcagctccagcatcaagaacaccgtgtccccctacgtcaagcagggcttcatcaaccgccagctggtggagaccagccaggtgatcaagctggtcgccaacatcctcggcacgaagtaccagaacgacgacaccgagatcatcgaggtgaaggcgcacctgaactccgagatccggaagaccttcgagttctacaagctgcgcgagctcaacgactaccaccacgggttcgacgcctacctgaccacgctggtgggcgggtacctctacaaccggtaccccaagctgcgcagctacttcgtctacggcgaccacaagcggctggacaaggcccagctctccgagctgaagaacttcaacttcctgcacgggctcaccaaccccaagagcggctccgacggcctgatcaccgccagcgggtcccagcaggtcgtgctggaccgcaacgagaccatcaagcggctcaacaagatctaccgctacaagtacatgctgatcagccgggaggtgttcacgaagcagggccagttctacaacgagaccatctacccggcgaagcccaacaccgccaagatgatcccgctgaaggacaacaagccctccgaggtgtacgggggctacagcagctccaacgtgagcaagatcgccctcatcaaggagaagaacaccgacaactaccagttcatcggcatccccatccgctccatcgccaagctgaagcaggccaaggcgaacagcaagacggtctaccagaccgagctgaaccgggtgatcaagtccgtgctcgccagccagaagaccaagaagcagaaggagttcgaggtcatcctggacaacgtgaagtacaaccaggtggtcgtggaccagggggagaagtactacctgggctccccctactacaagaagaacgccaagcagctcgtgatcagcccggagtccgtcaagatcctggccgacaaggccaccgcggacctgcccgagcaggaggcccacaacaagctcatgacggtgtaccaggagatcgtggacgtcctgaacaagcacttcgccctgtacgacatcaacaacgtgcgcaagaagctcaacgacgggctgatcaagttcagccagctgcccaactacgacgagacctccaagaaccggttcgacatcagcaagtccatcaagaccaagtacgccgtgatcatgcgcatcctcagcggcatcaagaaccagacctccgaggtccccgagctggggctcaagagcccgctgaacaagatgcagacgaagggcggcatcaagatctcccccgaggccaagatctactacagctcccccaccgggatcttcagccacttcaagcaggtcaagaacctgtga

SEQ ID NO: 2138 - RNA, 4209 nt, synthetic construct
  misc_feature 1..4209: note = Cas9 variant
  source 1..4209: mol_type = other RNA
atggagcgcatcctgggcctcgacctgggggtgagctccatcggctgggccctggtcgaggaggacgtgaagaaccccgagaacaacaagatcatcaagctcggggtgcgggtcaacccgctgaccatcgacgagaagaccaacttcgagaagggcaagagcatcacgaccaacgccgggcgcacctccgcgcggagcgcccgccggaacctgcagcgcttcaagctccggcgcaagaagctgctggagatcctcatccactacaagatcatcaagaacgacgccgtgctggccgagaccggcaagaacacgaccttccagacccagtacctgcgggccaaggcggcccgcgagaagatcgagctcgacgagctggcccgggtgctgctcctgatcaacaagaagcgcggctacaagtccagccggaaggtccagaacgacgacgacgggaaggccatcgacggcctgtccgtggcgaaggagctctacgagaagaactacacccccgggcagtacgcctacgacctgctgaagcgcggcaagaagcagatccccgacttctaccggagcgacctccagaacgagctggaccgcatctgggagttccagaagcagtaccaccccgacatcctgacggacgagttcaagaaggagctcgaggggaagggccagcgggccaccgccgccatcttcctgaaccgctacaagatctacaccgcggacaacaagggcacccgggaggagaagaagatccaggcctaccagtggcgcgtggaggccctgtcccagccgctcgacgtcaaggaggtggcctacgtgatcgccgagatcaacaacaacctgaacaacagctccgggtacctgggcgcgatcagcgaccggtccaagaagctctacttcaacgggcagacgatcggcgagtacctgttcgaggagctgagcgccaacccccacacccgcctcaagaaccaggtcttctaccgccaggactaccaggacgagttcgagaagatctggaagatccagaccaagttccaccccgagctgaccaaggagctgaaggagcaggtccgggacatcgtgatcttctaccagcgcaagctcaagtcccagaagggcctgatcagcttctgcgagttcgagtcccgggagatcgagatcgaggagaacgggaagcgcaagcggaagaaggtgggcctgaaggtggcccccaagagctccccgctgttccaggagttcaagatctggcaggtcctcaacaacatcgagatcaagaacgaggacgagcgccggtacctggagcccgaggagaaggagctcctgttcaacgagctgaactgcaaggggaacctcacgagccagaagtgcctggagctgctcggcttcaagagcaaggacgccaagctgaacttcaaggtggtggaggggaaccgcaccaacgagaagctgtacgacgccttcctgaagatcctcgagctgcagggctacaacgtgttcgagctgctcaagatcaaggaggacaaggacgaggcgaagctgtccgagctgaaggccagcgccgacgagatcaagggcatgatcaaggagatcttcaacgccaacctcatcaacacctccatcctggacttcaacgccgagctggaggggaaggacttcgagaaccaggcgagctaccagttctggcacctcatgtactcctacgagggcgacaacagcccctccgggaacgagaagctgtacgagctgctcgagaagaagttcggcttcaagaaggagcacagcaagatcctgtccaccatcgtcttcagccaggagtacgggtccctgagcacgaaggccatgcggcgcatctacccctacatcaaggacaacaagtactccgaggcctgcctcctggccggctacaaccacagcaagcactccctgaccaaggaggagctcgagaaccggaagctgaaggagcagctggaggtgctcccgaagaacagcctgcgcaaccccgtggtcgagaagatcctgaaccagatgatcaacctcgtgaacgcgaccatctccgagtacggcaagctggacggggtccggatcgagctggcccgcgagctcaagaagtccgcccaggagcgggaggacatggccaagagcatcaacgaggccaccctgctgcaccagaagtacgcgacgatcctcaagcaggagttcggcgtggtgaaccccagccgcaacgacatcatccggtacaagctgtacatggagctgaccgtcaacgggtacaaggacctctacaccaacaccaagatcgagaaggagaacctgttcacggacaagtacgacatcgaccacatcatcccccagagccgcttcttcgacgactccttcagcaacaaggtgctggtgccgcggcagtccaacctcgacaagggcaacctgaccgcctacgacttcatgagcaacaaggggtccgagcgcgaggagcacttcctgaacgtcatcaaggagctcctggacaagggcagcatctccaaggccaagtacgagaagctgaagaagaagggcctcgagatcggggacggcttcatcgagcgcgacctgcgggacacccagtacatcgccaagaaggccaaggagatcctgttcgagatcaccaacagcgtggtgacgacctccgggcgcatcaccgacaagctccggaaggactgggacctggtcaacatcatgaaggagctgaacctcgacaactaccgccggctgggcctgaccgagatcgtgcgcaacagcaagggcgaggagaaggagctcatccccgactggacgaagcggaacgaccaccgccaccacgcgatggacgccctgaccgtggccttcaccacccggaaccacatccagtacctgaactacctcaacgcccgcaaggacgagaagcacaaggagcaccagaacatctacgccatcgagaacatcatcaccgaggtcatcgagaagaagaacgggtccaagacgcggcgcttcaaggcgcccatgaacagcttccggcacgaggccaagcagcacctgaaggagatcctggtgtcccacaagaccaagaacaaggtggtcaccagcaacatcaacaagaccaagaagaagggcgggatccacaagaagacggagctcacgccccgcggccagctgcacaaggagaccgtgtacgggtccaagaagttcctgcagagccgggaggagaaggtgtccgccaagttcgactacgagaccatcctcatggtcgtgaacccgatccaccgcaacgccctgctgaaccggctcaaggagtacggcaacgaccccaagaaggcgttcagcggcaagaacgccatcaacaagaaccccgtgtacctggacgacagcaagaccgacatcctgtccgagaaggtcaccctcagctggtacgagaccgggtacaccatccgcaagtccgtgacgcccgacaacttcaaggactacaagaacctggagaagatcaccgacctgggcatcaagaagatcctcaaggagcggctggaccagttcaaggggaacgccaaggaggccttcagcaacctggacaaggacccgatctggctcaacgaggagaagggcatcgccatcaagaccgtgaccatcacgggggtctccaacgcggagagcctgcacttcaagaaggaccacctgggcaaggagatcctcgacgagaacggcaacaagatccccggggacttcgtgtccaccggcaacaaccaccacctggccatctacctggacgaggaggagaagctcgacgacaagatggtgaccttctacgaggccgtcctgcgcgtgaaccaggggctgcccgtgatcgacaaggactacaacaaggagaagggctacaagttcctcatgaccctgaagcagaacgagatgttcgtcttccccaacgaggacttcgacccgaacgagatcgacctgctcgacgagcggaacctggagcgcatcagcaagcacctgttccgcgtgcagaagatctccaaggtggggtacggcaacagcttcgtccgggacttcgtgttccgccaccacctcgagacgaccgtggaggagcggaaggagctgcgcaacatcacctacatccagctgaagtccctcgagggcctgcggaacatcatcaaggtccgcctgaaccacctcgggaagatcgtgcagatcggcgagtactga

SEQ ID NO: 2139 - RNA, 4215 nt, synthetic construct
  misc_feature 1..4215: note = Cas9 variant
  source 1..4215: mol_type = other RNA
atgaccaagaacatcctgggcctcgacctgggggtgagctccatcggctgggccctggtccaggaggacagcaagaaccccgagaacaaccgcatcgtgaagctcggggtgcgggtcaacccgctgaccgtggacgagcagatcaacttcgagaagggcaagcccatcacgaccaacgcctcccgcaccctggcgcggagcgcccgccggaacctccagcgcttcaagttccggcgcgccaacctgatcgacgtgctgaagaagtgcaacatcctcaagcagggggacctgctgaccgagatcggcaagaactccacgttccagacccaggagctccgggccaagagcgccaaggagaaggtcgagctgtccgacttcgtgcgcgtgctgctcctgatgaacaagaagcggggctaccgcagctcccggaaggcgaagaacgaggacgaggggcagatcatcgacggcatgagcgtcgccaagaagctgtacgaggagaacctcacccccggggagtactcctaccagctgctgatcgagaacaagaagcagctccccgacttctaccgcagcgacctgcagtccgagttcgaccgggtgtggaagttccagaagcagttcaacccggagatcctgaccgacgacctctacaaggagctgcagggcaagaacaagaacgccacgtgggccgtgctgaaggagcccttcagcctcgtcgggatcaagcagatcggcaccatccaggagaagaaggcggagaagtacttctggcgctccgaggccgtgaagcggcagctggacttcgagagcctggccgtggtcttccaggagatcaactccaacctcaacaacagctccggctacctgggggccatcagcgaccgcagcaaggagctgtacttcaacaaccagaccgtgggcgagtacctcttccagcagctgaaggagaactcccacaccaagctgaagaaccaggtgttctaccggcaggactacctcgacgagttcgagaagatctgggagacgcagagcaagtactacaaggagctgaccaaggagctgaaggaggagatccgcgacatcatcatcttctaccagcggaagctcaagtcccagaaggggctgatcagcatctgcgagttcgagaaccgcgagatcgagatcaccgagaacggcaagatcaagaagaagaccgtcggcctgaaggtggcccccaagtccagccccctcttccaggagttcaagatctggcaggtcctgaacaacctggtgttccagtccatcgagagcaaggagctgttcccgctggacctggacatcaaggagtccatcttcaacgaggtgaacatcaaggggaacctcagcgcgaagaacgtgctggacctgatgggctactccgggaaggagtggaagacgaacttcaagaacatcgagggcaaccgcaccaacgagaacctgtacaccgccttcctcaagatcatcgccagcgaggggatcgagttccccaaggagttcaagctgtccatcgacgacgacatcaaggtcagcaagatcgacatctccagcgagaagatcaaggagttcatcaaggagaacttcctgaagctcggcatcaacacctccatcctggacttcaaccccgagctggacggcaaggacttcgagaagcaggagagctaccagctctggcacctcctgtactcctacgagggggacgacagcgccagcggcaacgtgaagctctacgagctgctggagaagaagttcgggttcaagaaggagcactccaagatcctcgccgacgtcggcttcagccccgactacgggtccctgagctccaaggcgatgcggaagatctacccgtacatcaaggagaacaagtacagcgacgcctgccacctggccggctacaaccactccaagaacagcttcacgaaggaccagctcgccaaccgcatcctgaaggagcagctggagatcctccccaagaacgccctgcggaaccccgtggtggagaagatcctgaaccagatgatcaacctcgtcaacgaggtgatcaaggcgtacggcaagcccgacgagatccgcatcgagctggcccgggagctgaagaagaacgccgaggagcgcgccaacatgacctccgacatcagcaaggccaccctcctgcaccagaagtacgcggaggtgctgcagaaggagttcgggatcaaggccccgtcccggaacgacatcatccgctacaagctctacctggagctggagaagaacctcttcaaggacctgtacaccgacgtccagatcaagcgggaggagctgttcacggacaagtacgacatcgaccacatcatcccccagagccgcttcttcgacgactccttcagcaacaaggtgctcgtgccccggggcgccaacctgaagaaggggaacttcaccgccctggactacatggagatcgagggcaaggagaagctcgagaagttcctgaacatcatcaaggagctgttcgacaagggggcgatctccaaggccaagttcgagaagctccagaagaagggcagcgagatcggcgaggggttcatcgagcgcgacctgcgggacacccagtacatcgccaagaaggccaaggagatcctgttcggcatcaccaactccgtcatcagcacgagcgggcgcatcaccgacaagctccgggaggactggaacctggtgaacaccatgaaggagctgaacctcgagaagtaccgcaagctgggcctgaccgagctcatcgtgaactccaagggcgaggagaaggagcggatcatcgactggacgaagcgcaacgaccaccggcaccacgccatggacgcgctgaccgtcgccttcaccacccacaaccacatccagtacctgaactacctcaacgcccgcaaggacgagaagcacaaggagcaccagaacatcttcgccatcgagaacacgatcaccgagatcgtggagaagaagaacgggagcaaggagcgccggttcaagctgcccatcaagaacttccgcaccgaggccaagaagcagctggaggaggtgctcatctcccacaaggcgaagaacaaggtcgtgaccaagaacatcaacaagatcaagaagaagggcagcatcatcgccaagaccgagctgacgccgcgggggcagctgcacaaggagaccatctacggctccagcaagttcctcaagaccaaggaggagaagatctccgggaagttcgacctggagatgatccagaaggtgcagaacgagaagtaccgcaacgccctgctcaagcggctgcaggagttcggcggcgacagcaagaaggccttcaccgggaagaacgtcatctccaagaaccccatcttcctgaacgccgagaagacggagcagctccccgagaccgtgaccctggcgtggtacgagaccggctacacgatccgcaaggtggtcaaccccgacaacttcaaggacttcaagaacatcgagaaggtgatcgacaagggggtgcgggacatcctgaccgagcgcctcaaggagttcaacggcaacagcaaggaggccttctccaacctggagaagaacccgatctggctgaacaagagcaaggggatctccatcaagaccgtcaccatcacgggcatcaacaacgccgaggccctccactacaagaaggaccacctgggcaaggagatcctggacgagaacgggcagcggatcgcggtggacttcgtgagcaccggcaacaaccaccacgtcgccatctacgaggacgacaacgggaacctccaggagaaggtggtgtccttctacgaggccgtcgagcgcgtgaaccagaacctgcccatcatcaacaaggagtacaacttcgagctgggctggaagttcctcttcaccatgaagcagaacgagatgttcctgttccccagcgacgacttcgaccccaaggaggtggacctgttcgacgacaagtacctctccctgatcagcaagaacctgttccgggtccagtccatcagcatcgtgcagtacgggaacagcgtgatccgcgacttcaagttccggcaccacctcgagacctccgtcagcgacgagaagaagctgcagggcgtgacgtaccagcagatcaagtccctgcagccgctcaaggacatcatcaagatccgcctgaacaacctgggcaagatcgtgcagatcggggagtactga

SEQ ID NO: 2140 - RNA, 4215 nt, synthetic construct
  misc_feature 1..4215: note = Cas9 variant
  source 1..4215: mol_type = other RNA
atgaagggcaacatcgagaagaagaagcaggagttcaacgactactacctggggttcgacatcggcaccaacagcgtggggtgggccgtctccgacctcagctacaacctgctgcgcttcaacaagaaggacatgtggggcgcccgcctcttcgacgaggcgaagaccgccaaggaccggcgggtgaagcgcaactcccggcgccggctggagcgccggagcaagcgcctgaagtacctcgaggagatcttcgagacggagatctgcaagatcgacaagaacttcttccggcgcctggaggagtccaccctgcacaacgaggacaagaccttcgacttccggttccccatcttcaacgacgagaactacaccgacaaggagtactacaaggacttcccgacggtgtaccacctccgcaacgagctgatcaagaacgagaacaagaagttcgacatccggctgatctacctcgccatccacaacatcctgaagtaccgcgggcacttcatcttcgagggccaggacttcgacagcgtcaccgacttcaaggaggtgttctccgagctgagcgcctacctctccgagaacctggaggagaacctggacatcaacctctgcgacaacatcaaggacatcatctgcagcaaggagaacaagacctccaagggcaagagcttcgtgtccctgatcgacagcaaggtcatccagtccgtgctgcggtgctgcatcgggtaccgcgtgaagttcaaggacatcttcatcaactacgaggagaaggagaagaacgagggcatcaacctcagcgagatcgagtacgacgagaagcgggacgagatcgccctgtccctgggggagaacatcctcctgatcgacatctgcaagaaggtctacgacttcatgatcctgaacaacatcctcaagggcaacaagtacatcagcgagtccaaggtgaacctgtacgacgagcacaagtgcgacctgtgcaacctcaagtacatcttcaagaagtacctgcccaagaaggactacttcgagttcttccgcaacgagaacaaggagaagaactacgtgagctacatcagctccagcctgaacaacgggaagaagaagaacacgtgcacccaggaggacctcaacaaggagatcaaggagtacatcgcgaagatcaaggagtacgaggagaacgacgccgtcctggagaagatcaacctgaagctcaacgagaacaagctgctgcccaagctcaagaccaacgacaacggcgtgatcccctaccagatccacaagatcgagctggagaagatcctgcagaaccagtccaagtactacgacttcctcctggagaagatcgacggcatcaccaacatcgagcggatcgagaagctgttcaccttccgcatcccgtactacatcgggacgctcaagggcaagttcagctgggccaagctgaaggagaacaagaagatcaccccctggaacttcgagaagatcgtggacatggaggagtccgccaaggcgttcatcgagcgcatgagcaaccggtgctcctacctgaagaccgagaacgtcctccccaagaacagcctgctgtactccgagtacgagctgctcaacgagctgaacaaggtgaagatcaagaacgagttcatcaacgtggtcctgaagaacgagatcatcgacgagctgttcaagaccacgagcaaggtgaccaagaagaagttcgtggactacctgaagaccaagcagatcttcgtcgagaaggaggacatctccgggctggacaacgagttcaagagcaagctcgactcctacatcaagttcaagaaggtgatcggcgacaagatcgacaccctgcgcggctacaacttcgtggagaagtgcatcgagttcaagtgcttctacggggacgacaagaagctgttcaagaacgccatcaacaacacggagttcaaggactacgtcagcgacgacgagctcaagaagatcaacaagatgaagttcaacaagtggggccggctgtccaagcgcctgctcaccgagatctgcttcgagaacgtgatcgagagcgagtccttcgagaacatcatcgtcgccctgcggagcaccaactacaacttcatggagttcacctccaagaagttcaacctgagcgagaaggtggccgaggagaaccaggagaacacgctcgagaagttcaacatcaacgagtacgtggacgagctgtacgtcagcccctccgtgaagcgcagcatcatccagacctacaagatcgccatggagatcaagaagatcaccgggaagaacccgaagaagatcttcatcgagatggcgcggggcgggggcgagaagggcaagaagaccgagaagcgcaaggagcggatcaagacgctgtacgccaacatgaaggactccaacgaggagttcctcaacaacctggacaacctgaagctcagcgtggacaactacgacgacaaccgcctgcgggagaagaagctgttcctctacttcatgcagctggggaagtccatgtacaccggcaagaacatcgacctgaacgagctcctgttcgccaacacctacgacatcgaccacatcatcccccagagcaagctgaaggacgactccttcgacaacatcgtcctcgtggagaagaccatcaacaaggacaaggacaaccgcgactacctggacgagagcatccggctgcgcatgaacaagttctggaacttcctccgggagaaggggttcatcacgatcgagaagtacaaccgcctgcggcgcaacacctacttctccgacgacgagctgagcggcttcatctcccggcagctcgtgaccacccgccagagcacgctggaggtcaagaagctgttcgagttcatcttccagaacaccgacgtggtgtgctccaaggccaacctcgtcagcgacttccgcgagaagtacgggatcatcaaggtgcgggacctgaacgacgcccaccacgcgcaggacgcctacctgaacatcgtggtcggcaacgtgttcgacaccaagttcaccaagaactactggaagttcatcgaggaccgccggaaggtggacaacatccgcgagacctacaacttcaagaagatcttcgactacgacgtctcccggggcgagaacgtggcctggctcaaggactacagcatcaacacgatctccgagatgatcaacaagaagaccgccaacatcacccagatgatcaccgaggggaagggccagctgttcgacctgacgatcctcaagaagtccaagatcgacaagaagctgaccgtgatccccaacacccccaagatcctcaagagcagcctcaaggacagctgcaagatcgccgagaagtacgggtacttctccaccctgatgccggcgtacttcgtcgtgttcaagtacatcgacaagaacaaggaggtgttcggcttcgaccgcatcttcatcttcgaccgggagaagatcaacagcaacgaggacatcgagaagtacctggaggacaaggggtacaactcccccaagttcatccgcaaggtcaacctcaagcagaagatcctgctgaacggctacccctaccggatcgtgggcttcacggacaacaagctcgagatcaagaacagcaagcagttctactccgacggggagcacctgaagtacatcaagcacctgagcgccttctacaacaacaacaacaacgtgaagaacggcgagtaccgcatcaacttcctcaagaagacctccgagaacgaccggaacgagaccaccgacgaggccaaggagcgcctgaacatcgagttcatcaagctgtacgagtacttctgcgagcggctcaacagcaagatctacgccaactactacaactccaagaagtacgacgagctgatcgaggtcttcgactgcttcaagaacctgaacctcctggacaaggccaagctgctcctggagttcctgaagatcttcaagaaggacacgtacgggaacttcaagctcctggagaagcccgagctggacaagaacggcaagcagaagctcgacaagaacggcaacctgagcttcgaggggctgtccatggcgttcggcaagctcaacgggaagaagttcaagcagctggtggagaaggacatccagttcgtggacgagagcgtcaccggcctgttcgagaagaaggaggggctcgagaagtggcaggacggcgagcagtga

SEQ ID NO: 2141 - RNA, 4215 nt, synthetic construct
  misc_feature 1..4215: note = Cas9 variant
  source 1..4215: mol_type = other RNA
atggccaagaagatcctgggcctcgacctgggggtgagctccatcggctgggccatcgtcgaggaggacgcggagaacgtgatgaacaacaagatcgtgaagctgggggtccgcgtgaaccccctcaccgtggacgagcagatcaacttcgagaagggcaagccgatcaccacgaacgccgggcggaccctggtccgcggcgcccggcgcaacctgcagcggttcaagctccgccggctgcacctgatcgacatcctccagaagcgcaacatcctgaagcaggccgacctgctcgccgagagcggccggaactccaccttccagacccaggagatccgcgccaagagcgcgaagcagaaggtggagctgtccgagctggcccgggtgctcctgctgatcaacaagaagcgcgggtacaagagctcccggaaggccaagaacgaggacgagggccagatcgtcgacgggatgagcgtggcgaagaagctctacgaggagaacacgacccccggcgagtactcctacgagctgctcaagagcgggaagaagcagctctccgacttctaccgcagcgacctgcaggccgagttcgaccgggtgtggaacttccagaagcagttctaccccgagatcttctccgacaacctgtacaaggagctccagggcaagaacaagaacgccacctggaagatcctggagatccccttcagcctggtcggcatcaagcaggtcgggaccacgcaggagaagaagatcgagaagtacttctggcgctccgaggccgtgaagaagcagctcgacttcgagagcctggccgtggtgttccaggagatcaactccaacctgaacaacagctccggctacctcggggcgatcagcgaccggagcaaggagctgtacttcaacaaccagaccgtgggcgagtacctgcactgccagctcaaggagaacccgcacaccaagctgaagaaccaggtcttctaccgccaggactacctggacgagttcgagaagatctgggagatccagtccaagtaccacaccgtgctcacgaaggagctgaaggaggagatccgggacgtgatcatcttctaccagcgcaagctcaagagccagaagggcctgatctccatctgcgagttcgagaaccgggagatcgagatcaccgagaacgggaagatcaagaagaaggaggtcggcctgaaggtggcccccaagagctccctgctgttccaggagttcaagatctggcaggtcctgaacaacctgcagttccagaacatcgagagcaaggagatcttccccctcgacctggactgcaaggagtccatcttcaacgaggtgaacatcaaggggcgcatcagcgccaaggccgtgctggacgtcctcggctactccgggaaggagtggaagaccaacttcaaggacatcgagggcaacaacagcaacgagaacctgtacaacgcctacctgaagatcatcgcgaacgagggcatcgagttccccaaggagttcaagtgcaacctggacgacgacatcaacgtgtccaagatcatctgcagcgccgggaagatcatcgagttcgtgcgcgagaagttctccgagctcggcatcaacaccagcatcctggacttcaactccgagctggaggggacgaacttcgagaagcagaagtcctaccagctctggcacctcctgtacagctacgacggcgacgacagcccgtccgggaaccagaagctgtacgagctgctggagaagaagttcggcttcaagaaggagcacagcatcatcctcgccgacatcggcttcccccaggagtacgggagcctgtccaccaaggccatgcggaagatcatcccccacctgaagaccggcctccccttcgccaagaagtccgacaacgacaccatcctgagcgcgacggccatggccgggtacaaccacagcaagtccctgaccaccgaggagctcaccaagcgcgtcctgaaggagcacctggagatcctcccgaagaacagcctgcggaaccccgtggtggagaagatcctgaaccagatgatcaacgtcgtgaacgaggtgatcaaggagtacggcaagcccgacgagatccgcatcgagctcgcccgggagctgaagaagaacgccgaggagcgcgcgaacatgacgtccgagatcgggaaggccaccatccagcaccagaagtacagcgagatcctgcagaaggagttcggcatcaagtcccccagccggaacgacatcatccgctacaagctctacctggagctgtccaacaacggcttcaaggacctctacaccgacatccagatcaagcgggaggagctgttcaccgacaagtacgacatcgaccacatcatcccgcagagccgcttcttcgacgactccttcagcaacaaggtcctggtgccccgcggggccaacctcaagaagggcaacctgacggccttcgactacctggagtccgaggggaaggacaccctcgagaagttcatcaacaccatcaccgagttctacgacaagggcatcatcacgaaggcgaagtacgagaagctgcagaagaagggcaccgagatcggggacggcttcatcgagcgggacctgcgggacacccagtacatcgccaagaaggccaaggagatcctcttcgggatcaccaacagcgtggtctccacgagcggccgcatcaccgacaagctgcgggaggactggaacctggtgaacaccatgaaggagatgaacctcgagaagtaccgcaagcgggggctgaccgagaccgtgatcaacagcaagggcgaggagaaggagaagatcatcgactggtccaagcgcaacgaccaccggcaccacgccatggacgccctgacggtcgcgttcaccacccacaaccacatccagtacctcaactacctgaacgcccgcaagaacgaggaccacaagcagcacaaggtgatcagcaacatcgagaacctgatcaccaaggtgttcgagaagaagaacggctccaagcagcgccggttcctcgagcccatccacaacttccgcatcgacgccaagaagcacctggaggagatcctgatcagccacaaggccaagaacaaggtcgtgacgaagaacatcaacaagatcaagaagaaggggtccatcatcgccaagatcgagctcacgccccggggccagctgcacaaggagaccatctacgggagctccaagtacctgaagaccaaggacgagaagctcagcggcaagttcgacctggagaccatcaacaaggtgcagaacgagcgctacaagaacgcgctgctcgagcggctgaaggtcttcgggtacgactccaagaaggccttcaccggcaagaacatcctggccaagaacccgatcttcctcaacatcgagaagaccgagcagctgcccgaggtgctgaccctcgcctggtacgagacgatctacaccatccgcaagagcatcaactccgacaacttcaaggactacaagaacatcgacaaggtgaccgacaagaaggtccacaacatcctgaccgaccggctgcgcgagttcaacggcaacagcaaggaggccttctccgacctcgagaagaaccccatctggctgaacaagcccaaggggatcgcgatcaagacggtgaccatcaccggcgtgaacaacgtcgaggccctgcactacaagaaggaccacttcgggaaggagttcctcgacgagaagggccacaagatcccggtggacttcgtgagcaccgggaacaaccaccacgtcgccatctacgaggacacggccggcaacctgcaggagcgggtgctgtccttctacgaggcggtggagcgcgtcaaccagggcctcagcgtgatcgacaaggagtacaactccagcctggggtggaagttcctgttcaccatgaagcagaacgagatgttcctcttccactccgaggacttcaacccccaggagatcgacctgtacgacgagaagaacctgcggctcatcagcaagaacctgttccgcgtgcagaagttcaccgtcaaggactacttcttccggcaccacctggagaccaacgtggaggacaacagcaagctcaagggcgacacgtggaagcgcgaggggctgaacggcatccgggggatcctgaaggtgcgcctcaaccacctgggcaagatcgtccaggtgggcgagtactga

SEQ ID NO: 2142 - RNA, 4215 nt, synthetic construct
  misc_feature 1..4215: note = Cas9 variant
  source 1..4215: mol_type = other RNA
atgagcaagaagatcctgggcctcgacctggggaccacctccatcggctgggccttcgtgcgcgaggccgaggacttccaggaggagagctccatcgagcggatcggggtccgcgtgaaccccctgacgaccgacgagcagatcaacttcgagaagggcaagccgatcagcgtgaacgcggaccggaccctcaagcgcggggcccggcgcaacctgcagcggtacaagcagcgccggaccaacctgatccagctcctgaagcagtacaagatcatcaacgagaacacgatcctggccgaggacgacaagaacaccacccactccacctacgccctccgcgccaaggcggtcagcgagaagatctccaaggaggccttcgcccgggtgctgctgatgatcaacaagaagcgcggctacaagagctcccggaaggccaagaacgaggacgagggccaggcgatcgacgggatgagcgtggccaagcgcctctacgaggaggacatcacgcccggccagctgtgcctgcagctcctgaaggaggggaagaagaagctgcccgacttctacctctccgacctgcaggccgagctggagaagatctggaacttccagaagaagttctaccccgagatcctcaccgacgagttcaagaaggagatcgagggcaaggggcagcgggccaccagcgcctccttctgggcgaagtacaagttcaacaccgccgagaacaagggcagccgcgacgagaagaagatgcaggcctgggagtggcggtccaaggccatcaacacgcagctgacccgcgaggaggtcgcctacgtgatcaccgagatcaacaacaacatcaacaacagctccggctacctgggggcgatcagcgaccggtccaaggagctctacttcaacaaggagaccgtgggcgagtacctgttccgccagctgcggtacagcccgcacacgcgcgtcaagaaccaggtgttctaccgccaggactacctcgacgagttcgagaccatctgggagaaccagagccggtaccacaacgagctgaccaacgagctgaagtccgagatccgcgacgtggtcatcttctaccagcggaagctcaagagccagaaggggctgatctccttctgcgagttcgagagcaagcagatcgagatccagaaggacggcaagatcgtgaagaagatcatcggcctgaaggtgtcccccaagagcagccccctcttccaggagttcaagatctggcagatcctgcagaacctggagttcaccaacaaggagacgaaggagaagaaggtccccgacttcgaggccaagaacctcctgttcgaggagctgaacatcaaggggaacctcaagggcgagaaggccatcgagatcctggggtacaagccgaaggagtggctggtgaactacaaggagctcgacggcaaccgcaccaaccaggtgctgtacgaggggtacctgaagatcctcgaggtcgagggctacgacatcaaggacctgctgaagatcaagtccaacaaggacgaggtgaacctctccgagctgagcaagcccgtgtccgagatcaaggacctgatcaagagcatcttcgagtccctgaacatcaacaccgccatcctcgacttcaaccccgagctggagggcaaggacttcgagcggcaggccagctaccagctgtggcacctcctgtactcctacgagggggacaacagcaacaccggcaacgacgagctgtaccgcctcctgtaccagaagttcgggttcggcaaggagcacgcgcagatcctggccaacctctccttcagccaggactacgggtccctgagcgccaaggccatgcggaagatctaccccttcatcaaggagaacagctactccgaggcctgcagcctggcgggctacaaccactccagctccatcacgaaggaggagaacgacaagcgcgagctcaaggagaagctggagctgctcccgaagaacagcctgcggaaccccgtcgtggagaagatcctgaaccagatggtgaacgtcatcaacgccatcatcgccgacccctccatgggccgccccgacgagatccggatcgagctcgcccgcgagctgaagaagaacgcggccgagcgggccgagatgaccatccacatcaacaaggccaagagcgagcacgacaactaccgcaagatcctgaccaccgagttcgggatcccgaaccccacgcggaacgacatcatccgctacaagctctacgaggagctgaaggtgaacggctacaagaccctgtactccaacacctacatcccccgggagaagctgttcagcaaggagttcgacgtcgagcacatcatccccaaggccctcctgttcgacgactccttcagcaacaagaccatctgcgcgcgccaggagaacctcgacaaggggaacaagacggccttcgacttcatccagtccttctacggcaaggagaagttcgaggagtacctgcagcggatcgagagcctggccaagatcaaggagggggacaccttcgtgatctccaaggccaagtacaagaagctcctgctgccggagatcgagatcggcgagggcttcatcgagcgcgacctccgcaacagccagtacatcgccaagaaggcgaagtccatgctgctggacatctgcaagaccgtggtccccaccacggggagcatcaccgaccggctccgcgaggactggggcctgatcaacatcatgcaggagctgaacttcgagaagtacaagaagctcgggctgatcgagatggtggagaagaaggacggcagcttcaaggagcggatcaccgactggaccaagcgcaacgaccaccggcaccacgccatggacgccctgaccgtggccttcacgaagcacaaccacatccagtacctcaactacctgaacgcccgcaagaacgagaaccacaagatgcacggcaacgtcatcgcgatcgagcagaaggagaccgagctgctcgtggactccgtggggaagcggaagcgcaagttcaagctgcccatcagcaacttccgggaggtcgccaagatgcacctggagaacatcctcgtgtcctacaaggccaagaacaaggtggccaccaagaacaagaaccgcttcaagaccaagaacggcgagaaggtcaagatcgagctgacgccccgggggcagctgcacaaggagaccgtgtacggcaagatgaagaagtacgagaccaaggaggagatcatcgggagcaagttcgacgaggcgaccatcctcaaggtggccaacctggagcagcgcaacgccctgctccagcggctgaaggagaacaacaacgacccgaagaaggccttctccggcaagaacagcctgaagtccaaccccctctactacggcgtcgacagcaagcccatccccgagcgcatcaagatcgtgtggctggaggacgactacacgatccggaaggagatcaccccggacctgaagatcgacaaggtgatcgacatcgggatccgccggatcctcgagaaccgcctggccgagttcaacggcaacgcgaaggaggccttctccaacctggagaagaaccccatctggctcaacgaggggaagcggatcgccatcaagcgcgtcaccatcagcggcgtgaagaacgccgagaccctgcactacaagaaggaccacctggggcacgagatgctcgacaagcagggcaagcggatccccgtggacttcgtctccacgggcaacaaccaccacgtggccatctacaaggacgacaagagcgacctgcaggagaaggtggtctccttctacgaggcggtggagcgcatcaaccaggagctgccgatcatcgacaagagcttcaaccacgacctcgggtggcagttcctgttcaccatgaagcagaacgagtacttcgtgttcccccgcgacggcttcgacccctacgagatcgacctgctcaaccccgacaactacaagatcatctccccgaacctgttccgggtccagaagatcgccaccaagaactacgtgttcaaccaccacctggagaccaaggccgtggacggggagctcctgaagacgaagaaggacctgagcgacatcacctaccgcttcatccagacccccgtcaacctcaagaacatcatcaaggtgcggatcaaccacatcggccagatcgtgaagatcggggagtactga

SEQ ID NO: 2143 - RNA, 4218 nt, synthetic construct
  misc_feature 1..4218: note = Cas9 variant
  source 1..4218: mol_type = other RNA
atgaagaccatcctgggcctcgacctggggaccaacagcatcggctgggccctggtgaaggaggccgagaactccaacgagaagtccgagatcatcaagctcggggtgcgcgtgaaccccctgacggtggacgagaagaccaacttcgaggcgggccggccgctgagcaccaacgccgaccgcaccgccaagcggagcgcccgccggaacctccagcgctacaagctgcggcgcaagaacctgatcgacctcctgatcaagaaccagctgatcgacaaggacacgcccctcaccgagatcgggaagaacaccacccaccagacgctggagctgcgggccaaggcggcccgcgagcggatcgagctcgaggacctggcccgcgtcttcctggccatcaacaagaagcggggctaccgctccagccggaaggtgaacaacgaggaggagggccaggcggtggacgggatggccgtcgccaagaagctctacgacgagaacctgacccccggccagtacgcctacgagctgctctccaaggggaagaagtacgtgcccgacttctaccgcagcgacctgcaggccgagttcaacgcgatctgggagtaccagaagcagttctacgccgacatcctggacgacgagctctacaacgccctgaagggccaggggcagcagaactcccggaagcgcttcctggccatcaagggcgtgtacaccgccgagaacaagggcaagcgggacgacgtcaagctccgccactacaagtggcggagcgaggcgatctccaagaagatcaacatcgaggaggtggcctacgtgctggtcgagatcaacaacgacctgaacaagagctccgggtacctcggcgccatcagcgaccgctccaaggagctgtacttcaacaaggagaccgtgggggagaacctgtggaagcagatccagaagaacccgcacacgagcctcaagaaccaggtgttctaccgccaggactacctggacgagttcgagcagatctgggagacccaggcccagttccacccccagctgaccctcgccctgaaggagcagatccgggacgtcatcatcttctaccagcgcaagctgaagtcccagaagggcctcctgagcttctgccagttcgagtcctgggagatcgagcggaaggacgagaacggcaacgtgatcctgaacaagaccacgcagctccccaagcgccagaccgtggggcggcgcgtcgcgcccaagagcagcccgctgttccaggagttcaagatctggcagaacatcaacaacctggaggtgaccaagatctccgagggcgccagcaagaacaagaaggagaccgagacgctctccgacgacgagcggaagctgctgttcgaggagctcaacctgcgcgggaacctgagccagaaggaggtgctgcagatcctcggcctgaaggacaaggagtacaagaccaacttctccgaggggctggagggcaaccggaccaacgccgccctcttcaacatctaccagcagatcgccgagaacgagggctacgggttcgactggagcaagaagtccgcgcaggagatcaaggaggagctgaaggccgtcttcccccagatcggcatccaggccgacatcctggacttcaacgccaacctcgacgggaaggagttcgagaaccaggcgagctaccagctgtggcacctcctgtactccgccgaggaggacgacaagatcaacgaggaggaccagatcatctacggcaacagcgccgtgtccctgaagaagaagctgtgcgagaagttcgggttcacccccgagtacgccaagtggatcgccaacgtgagcctccaggacgactacggcaacctgtccacgaaggcgatgcgcaagatcatcccctacctgatcgacggcaacgactacagcgaggcctgcgccctcgccgggtacaaccactccaacagcctgaccaaggaggagaacgacaaccgggagctgctcgacaagctggagctgctcccgaagaactccctgcgcaaccccgtcgtggagaagatcctgaaccagatggtcaacgtggtgaaccaggtcatcgagacctacggcaagcccgacgaggtgcggatcgagctcgcccgcgagctgaagaagtccgcggagaagcgggccgagatgaccaagagcatcaacgaggccacgcgccggaacgaggacatcaagaagctgatcaccaaggacttcgggatccccaacccgaccaagagcgacgtggtccgctaccggctctgggaggagctggcgcccctggcctacaaggacgtgttcaccggcaagcagatcaagaaggaggacctcttcagctccaagatcgacatcgagcacatcatccccaaggccctgctgttcgacgacagcttctccaacaagacgctcgtgttccgcgagaccaacctgaagaaggccgaccgcaccgcctacgacttcatcgagagcgactacaacgccaccctggacgactacatccagcgggtcgagacgctctacaacaacaccaaggggaccatctccaagggcaagcgcaacaagctgctgatggcgcagaagaacctccccgacggcttcatcgagcgggacctgcgcaacagccagtacatcgccaagaaggccaaggccatgctgtaccaggtgttcaaggacgtgaacgtcacctccgggagcatcaccgaccggctccgcgaggactgggacctgatcaacgtgatgaaggagctgaacttcccgaagtacaaggccctcggcctgacggagatcgaggagcggtacgacatcgggcaggagaagaccaagcgcgtggaggtcatcaccgactggaccaagcggaacgaccaccgccaccacgcgatgaacgccctgacggtggccttcaccacctccagccacatccagtacctcaactacctgaacgcccggaagaacgagtcccacaaggagcacaagaacatcaagggcatcgagaacaagatcacccacaagcagaaggacaagcgcaagttcatcccgcccatgcccaacttccgggaggaggccaagaagcacatcgagacgatcctggtgagcatcaagaacaagaacaaggtctacaccaagaacatcaacaagaccaagaagaagtccggccacaacaccaaggagcagctcacgccccgcgggcagctgcacaaggagaccgtgtacggcaagagcaagcggcccatgtccaagcccaccaagatcaacaagaacttcagcctggagcaggcgcagctcatcatcaacgtgcaggagaaggagctggtcctgcgccacctcgcccagttcgacaacaaccccgccgtggccttcgacaccaagacgctgaagaagatgccgctgctcaagaacggggagcccctgaaggaggtgctgtgcttcgaggagatcttcaccatccggaaggacatcacccccgacctcaagatcgagaaggtcgtggacgagaagatcaaggccatcctggagcagcgcaagaaggacttcggcgggaacgcgaaggaggccttctccgacctggacaagaacccgatctggctcaacaagaagaagggcatctgcatcaagcgggtgaccatcacgggcgtcagcaacgccgaggccctgcaccaccagaaggaccacctggggcgcgagatcctcgacgacaacggcaaccccatccccgcggacttcgtgagcaccgggaacaaccaccacctggccgtgtacctggactccgagggcaagctccaggacaacatcgtcagcttctacgaggccgtggtgcggacctcccaggggctgcccgtcgtggacaagggcctgaacaaggacctcggctggaagttcctgttcagcctgaagcagaacgagatgttcgtgttcccgaacgacgacttcgacatcaacgacttcgacctcctggacgacaagaaggccgagctgatctccaagcacctctaccgcgtccagaagatcagcaaggtgtccgccgggaacagcttcgtgcgcgacatcgtcttccggcaccacctggagaccacggtgaaggaggtgaaggagctgaaggacatctcctacatccagctcaagagcctggagggcctgcgcaacatcaagaaggtccggatcaaccacatcgggaagatcgtccaggtgggcgagtactga

SEQ ID NO: 2144 - RNA, 4221 nt, synthetic construct
  misc_feature 1..4221: note = Cas9 variant
  source 1..4221: mol_type = other RNA
atggagaagaagatcatcggcatcgacctgggggtgaccagcatcggctgggcctacgtcatcgaggacgagaacgggcactcccgcatcctccggatcggcacccgcgtgaaccccctgacgaccgaggagctgaagaacttcgagcaggggaagccgatcaccgagaccgccgagcggacgctcaagcgcagcatgcggcgcaacctgcagcggtacaagcagcgccggaccaacctgatcaacgtgctcctgaagaacaagctgatcaccgagaccacggcgctcgccgaggacggcaagggcaccacccacctgacccacgccctgcgcgccaaggccgcgtacgcccagatccccctcgaggacttcgcccgggtcctgctgatgctcaacaagaagcgcgggtaccggtccagccgcaaggtgaagacggaggccgacggccaggcgatcgacgggatggccgtggccaagaagctgtacgaggagaacatcacccccggccagctgtgctacaccctcctgctgcaggggaagaagaccctccccgacttctaccggtccgacctgcaggtcgagatggagaaggtgtggacgttccagaagcagttccaccaggccatcctgaccgacgagttccgcaagtacatcgccggcaagggccagcgggcgaccgccgccagcttctgggggaagtacggcttcaacaccgccgagttcaaggggtcccgcgaggagaagaagctcaagagctacgagtggcggtcccaggccatcacgaccccgctgagccaggaggaggtggcggccgtcatcaccgacatcaactccaacatcgccaacagctccggctacctgggcgccatcagcgaccgctccaaggagctgttcttcaacaagcagaccgtggggcagtaccagtacaacctgctgcagcagaacccccacacgaacctcagcggccaggtgttctaccggcaggactacctggacgagttcgagaccatctgggagacccaggccaccttccacacgatgctgaccccctccctcaaggaggagatccgcgacatcgtcatcttctaccagcgcaagctcaagagccagaagaagctggtgtccatctgcgagttcgagaagcggatcctcgagcccctgcagggggacaaggtggtcggctacaaggtggcgcccaagagcagccccctgttccaggagttcaagatctggcaggccctcgggcgcatggagatccagcacaaggtgaccaaggagcggcacttcctggacctggacgccaagcagctcctgttcgacgagctgaacgtcaagggcgacctcaccaaggagaacgccctgacgatcctgggcttcaagcccaaggagtgggagtgcaacctcctgaagctggaggggaaccgcaccaaccaggccctgtacgaggcgtacctcaagatcctggagctggagggctacgaggtgaaggacctcctggggctgaagctcgacaaggacgacatcaagctgtccgagctgcccgtggacgccgccgacatcaagaagatggtccgggagatcttcgagaccctcaacatcaagaccagcctgctggacttcaacgccacgctcccgggcaagtccttcgagcagcagcacgcgtaccagctgtggcacctcctgtacagctacgagggggacaactcccccagcggcaacaagaagctgcaggacctgctccaggccaagttcggcttcaccaacgcccacgggcagatcctggccaacgtgtccctggagaccgactacggcagcctctccgccaaggcgatccgcaagatcttcacccacatcaaggagaaccactacagcgccgcctgcgccctggccgggtacaaccactccagctacctgtccaaggaggagaacgagcagcggatcctcaaggaccgcctgaccatcctgcccaagaacagcctccggaaccccgtggtcgagaagatcctgaaccagctgatcaacctcctgaacacgatcttcgacgacccgtacctgggcaagcccgacgagatccgcatcgagctcgcgcgggagctgaagaagaacgtgcaggagcgccagcggctgaacaccgagatcaccaagaacaacaccgagcacgagcgcatcacgaagatcctcatcaaggaggacaacatcaagaaccccacccggaacgacatcatccgctacaagctgtaccaggagctgaagcacaacgggtacaagaccctctactccaacacctacatcccccgggaggagctgttcggcaagaacttcgacatcgagcacatcatcccgcagagcatcctgttcgacgactccttcagcaacaagacgctctgcgtccgcaaggagaacatcgacaaggccgaccggaccgccatggacttcatcggcccctacttcggggaggacaaggtgcaggagtacatcaaccgcgtggagatgctgcaccagatcaacctgaagaaccccgaggagggcatcgggaagggcaagtacaagaagctcctgatgaaggcctccgagatcggccaggggttcatcgagcgcgacctgcgggacacccagtacatcgccaagaaggcgcgccagatgctcctggaggtcacccggacggtggtggccaccaccggcagcatcaccaagcgcctgcgggaggactgggggctcgtcaacgtgatgcaggagctgaacatggacaagtaccgccagcagggcctgacggagctcatcgagaagaaggacgggagcaccaaggagcggatcaccgactggaccaagcgcaacgaccaccggcaccacgccatggacgccctgacgatcgcgttcaccaagcactcccacatccagtacctgaacaacctcaacgcccgcaagagcgacgacaagaagggcaaggagatcttcggcatcgagcagaaggagaccgagaaggtgaaggacgacaccgggcagacgcagcggcgcttcaagctgcccatgccggacttccggcaggccgccaagcaccacctggagcacctcctgatctccttcaaggccaagaacaaggtcttcaccaagaacaagaacaagtacaagaccaagaacggcgagcaggtcaagctggagctcaccccgcgcgggcagctgcacaaggagacgatctacggccggatcaagaagtacgtgacccacgaggagaaggtgagctccaagttcaacgcgcagctgatccagaccgtggccaacagcaagtaccgctacgccctcctgaagcggctggaggagaacgggaacgaccccaagaaggccttcaccggcaagaactccctcgacaagacgcccctgttcgtggacgccacccagcaggagaagatcccgcccgtcgtgaagctggtgagcatcgagcagggctacaccatccgcaaggacatcacccccgagaacttcaaggacgcgaagtccatcgagaagatcgtcgacgtggggatccggaacctcctgcaccaccgcctggagacgtacaacggcaacgagaaggaggccttctacaacctcgacaagaacccgatctgggtgaacgagagcaaggggatctgcatcaagcgggtcaccatcaccggcgtgaccaacgccgagcccctgcactacaagcgcgaccaccacgggaagcccatcctggacaacaacggcaaccgcacccccgccgacttcgtgtccacgggcaacaaccaccacgccgcgatctaccgggacgccgccgggaacctccaggacaacgtcgtgagcttctacgaggccgtggcgcgcgtcaaccagggcctgccgatcatcgacaagtccctgaacaaggagctcgggtggcagttcctgttcagcctgaagcagaacgagtgcttcgtgttccccaacgagggcttcgaccccctcgagatcgacctgtacaaccccgccaacaacaagctgatcgccgccaacctcttccgggtgcagaacttctcccgcctgcagtacgggaacaacatcatccgggactacaacttccgccacatctacgagaccagcgtcgagaaccggaaggagctgaaggacatcgcctacaagcaggtcaagtccctcccgatcttcgagaagatcatcaaggtgcgcatcaaccacatcggccagatcgtgaagaccggcgagtactga

SEQ ID NO: 2145 - RNA, 4224 nt, synthetic construct
  misc_feature 1..4224: note = Cas9 variant
  source 1..4224: mol_type = other RNA
atgatccgcaacatcctgggcctcgacctgggggtgagctccatcggctgggcctacgtccaggaggacagcaagaactccgagaacaaccggatcatcaagctgggggtgcgcgtgaaccccctcaccgtcgacgagcagctgaacttcgagaagggcaagccgatcaccacgaacgccgggcggaccctggcgcgcagcgcccggcgcaacctccagcggttcaagctgcgccggtccaacctgatggacgtgctcaagaagaacaacatcctgaaggagaccgacctgctcgccgaggtgggcaagaacagcaccttccagacgcaggagctgcgcgccaagtccgccaaggagaagatcgagctgagcgagttcgcgcgggtcctcctgctgatcaacaagaagcgcggctacaagtccagccggaaggccaagaacgacgaggacgggcagatcgtggacggcatggccgtggccaagaagctgttcgaggagaacctgacccccggggagtactcctaccagctgctccagcagggcaagaagcagctgcccgacttctaccgcagcgacctgcaggcggagttcgacaagatctgggacttccagaagcagttcaaccccgagatcttcaccaacgagctctacgagaagctgcaggggaagaaccggaacgccacctggaaggagctggagttcccgttctccctcgtcggcatcaagcagacgggcaccatgcaggagaagaaggtggagaagtacttctggcgcagcgaggccgtgaagaagcagctggacttcgagtccctggccgtcgtgttccaggagatcaacagcaacctcaacaactccagcgggtacctgggcgccatctccgaccggagcaaggagctgtacttctacaaccagaccgtgggggagtacctcttccagcagctgaagaccaacccccacacgaagctgaagaaccaggtcttctaccgccaggactacctcgacgagttcgagaagatctgggagacccagagcaagtaccacaaggagctgaccaaggagctgaaggaggagatccgggacatcaccatcttctaccagcgcaagctcaagtcccagaagggcctgatcagcatctgcgagttcgagaaccgggagatcgagatcacggagaacggcaagaccaagaagaagaccgtggggctgaaggtggcgcccaagtccagccccctcttccaggagttcaagatctggcaggtcctgaacaacctgcagttccagaacatcgagaccaaggaggtgttcccgatcgacctcgacttcaagcagtccatcttcgacgaggtgaacatcaagggcaagctgagcgccaaggacgtcctggacctcgtggggtactccggcaaggagtggaagacgaacttcaaggagatcgaggggaactacaccaacgagaacctgtacaccgccttcctgaagatcatcgccagcaaggagatcgagttccccaaggagttcaagatcaccatcgacgacgagatcaaggtgtccaagatcaacgccagcgcggagatcatcaagctgttcgtccgcgagaagttctccgagctcggcatcgacacgagcatcctggacttcaaccccgagctggagggctccgacttcgagaagcaggccagctaccagctctggcacctcctgtactcctacgagggggacgacagctccagcggcaacgagaagctctacgagctgctggagaacaagttcgggttcaagaaggagaactccaagatcctcgccgagatcggcttcagccaggactacgggagcctgtccagcaaggccatgcgcaagatctacccctacatcaaggagcacaagtactccgtggcctgcagctacgcgggctacaaccactccaagaacagcctgaccaaggagcagctcgagaaccggatcctgaaggagcgcctggacatcctcccgaagaactccctgcggaaccccgtcgtggagaagatcctgaaccagatgatcaacctcgtgaactgcctgatcgacgagtacagcgagaaggacaaggacggccagatcgtcaagtacttcaagttcgacgagatccgcatcgagctggcccgggagctcaagctgaacgccgaggagcgcgccaccatgacctccgagatcaacaaggccacgatccagcaccagaagtacgcggaggtgctgcagcgggagttcgggctcaaggcccccagccgcaacgacatcatccggtacaagctgtacctggagctcgccaacaacggcttcaaggacctgtacaccgacgccaagatcgagcgcgagaacctgttcaccgacaagtacgacatcgaccacatcatcccccagtcccggttcttcgacgacagcttctccaacaaggtgctcgtcccgcgcaacgcgaacctgaagaaggggaacttcaccgccttcgactacctggagatcgagggcaaggagaagctcgagaagttcctgaacatcatcaaggacctgtacgacaagggggccatcacgaaggccaagtacgagaagctccagaagaaggacttcgagatcggcgacggcttcatcgagcgggacctgcgcaacacccagtacatcgccaagaagtccaaggagatcctgttcgggatcaccaacagcgtggtgaccacgagcggccggatcaccgacaagctccgcgaggactggaacctgatcaacaccatgaaggagctgaacctcgagaagtaccggaagctggggctgaccgagaccgtcatcaactccaagggcgaggagaagcagcgcatcatcgactggacgaagcggaacgaccaccgccaccacgcgatggacgccctcaccgtggccttcaccacccacaaccacatccagtacctgaactacctgaacgcccgcaaggacgagaagcacaaggagcaccagaacatcttcgccatcgagaacctcatcacggagatcatcgacaagaagaacggcagcaaggagcggcgcttcaaggagcccgtgaagaacctgcgggcggaggcccgcaagcacctggacgagatcctcatcagccacaaggtcaagaacaaggtggtgaccaagaacatcaacaagatcaagaagaaggggtccgtcatcgccaagaccgagctgacgccccggggccagctgcacaaggagaccatctacgggagctccaagttcctcaagaccaaggaggagaagatcagcggcaagttcgacgtggagaccatccagaaggtgcagaacgagcgctaccggaacgccctgctgaagcgcctccaggagttcgggggcgactccaagaaggccttcaccggcaagaacgtcatcagcaagaaccccatcttcctgaacaacgagaagacggagcagctgccggagaccgtgaccctcgcgtggtacgagatggggtacaccatccggaaggccgtgaaccccgacaacttcaaggacttcaagaacatcgagaagacgatcgacaagggcatccgcgacatcctgaccaagcggctgaaggagttcaacgggaactccaaggaggccttcagcgacctcgacaagaaccccatctggctgaacaagtccaagggcatcagcatcaaggccgtcaccatcaccgggatcaacaacgcggaggccctgcactacaagaaggaccacctcggcaaggacttcctggacgagaacggcaagcgcatcgccgtggacttcgtgtccacggggaacaaccaccacgtcgccatctacgaggacgagaacggcaacctgcaggagaaggtggtgagcttctacgaggccgtcgagcgggtgaaccagaacctccccatcatcgacaaggagtacaactccgagagcgggtggaagttcctgttcaccatgaagcagaacgagatgttcctgttcccgtccgaggacttcaaccccaaggagatggacctcttcgacgagaagaacgtgaacctgatcagcaagaacctgttccgcgtccagaagttcaccatcaaggactacttcttccggcaccacctcgagaccaacgtggaggactccagccccctgaagggcatcacgtggaagcgcgaggggctgaacggcatcgagaacatcctcaaggtgcggctgaaccacctgggcaagatcgtccagatcggggagtactga

SEQ ID NO: 2146 - RNA, 4227 nt, synthetic construct
  misc_feature 1..4227: note = Cas9 variant
  source 1..4227: mol_type = other RNA
atgaccaagaacatcctgggcctcgacgtgggggtgagctccatcggctgggccctgatcaacgaggacatcgagaaccccaagaacaacaagatcatcaagctgggggtgcgcgtgaacccgctcaccgtcgacgagcagatcaacttcgagaagggcaagcccatcacgaccaacgccgggcggaccctggcgcgcggcgcccggcgcaacctgcagcggttcaagctccgccggttccacctgatcgacatcctgcagaagaacaacatcctcaagcaggccgacctgctggccgaggtgggcaagaacagcaccttccagacgcaggagatccgcgccaagtccgcgaagcagaaggtggagctcagcgagctggcccggatcttcctgctcatcaacaagaagcgcgggtacaagtccagccggaaggccaagaacgaggacgagggccagatcatcgacgggatgttcatcgccaagaagctgtacgacgagaagctgacccccggcgagtactcctaccagctcctgaaggagagcaagaagcagctgcccgacttctaccgctccgacctccagagcgagttcgacaagatctggaacttccagaagcagttctacccggagaacttctccgacaacctgtacaaggagctgcaggggaagaacaagaacgcgacctggaagaccctcgagatccccttcagcctggtcggcatcaagcagacgggcaccctgcaggagaagaagctcgagaagtactcctggcggagcgacgccgtgaagaagcagctggactacgagaagctggccgtggtcttccaggagatcaactccaacatctacaacagctccgggtacctcggcgccatcagcgaccgctccaaggagctgtacttcaacaaccagaccgtgggggagtacctgtacaaccagatcaaggagaacccccacaccaagctcaagaaccaggtgttctaccggcaggactacctggacgagttcgagaagatctgggagacgcagagcaagtaccacaccaccctgaccaaggagctcaaggaggagatccgcgacatcatcatcttctaccagcggaagctcaagagccagaagggcctgatctccatctgcgagttcgagaaccgcgagatcgagatcaaggagaacggcaagatcaagaagaagacggtcgggctgaaggtggcccccaagagctccccgctgttccaggagttcaagatctggcagatcctgaacaacctccagttccagaacatcgagagcaaggagatcttccccatcgacctggacttcaaggagtccatcttcaacgaggtgaacatcaagggccggatcagcgcgaaggccgtcctggacctcctggggtactccggcaaggagtggaaccccaacttcaaggacatcgaggggaacaacaccaacgagaacctgtacaacgcctacctcaagatcatcgccgacgaggagttcgagctgcccaaggagttcaagctgaacggcgacgacgacctgtacgtgagcaagatcgcctgctccgcgagcaagatcaaggacttcgtgaaggagaagttctccgagatcggcatcaacaccagcatcctcgacttcaacccggagctggaggggaaggacttcgagaagcaggcctcctaccagttctggcacctcctgtacagctacgagggcgacgactcccagagcgggaacgagaagctgtacgagctgctcgagaagaagttcggcttcaagaaggagcactccaagatcctgagcaacatcgggttccccctggactacggcaacctctccaccaaggccatgcgcaagatcatcccccacctgaaggccggcctgagcttcgccaagaagtccaaggaggacaacatcctcagcgcgacggccatggccgggtacaaccacagcaactcctacaccaaggaggacctggccaagcgggtcctgaaggagaagctcgaggtgttccccaagaacagcctgcgcaacccggtggtcgagaagatcctgaaccagatgatcaacctcgtgaacgaggccgtggaggagtacggcaccatcgacgaggtccgcatcgagctggcgcgggagctgaagaagaacgccgaggagcgcgccaacatgacctccgagatcgggaaggccacgctcctgcaccagaagtacgcggagatcctgaagaaggagttcgacatccccgtgcccagccggaacgacatcatccgctacaagctctacctggagctggccaacaacggctacaaggacctctacaccgacgtccagatcaagcgggaggagctgttcaccaacaagtacgacatcgaccacatcatcccccagtcccgcttcttcgacgacagcttctccaacaaggtgctggtgccgcgcggggccaacctcaagaaggccaaccagaccgccttcgactacctggagaacgaggacaagcagaagctggagaagttcctcaacatcatcaagaacctgtacgacaagggcgagatcacgaaggcgaagtacgagaagctgcagaagaagggcagcgacatcggggagggcttcatcgagcgggacctccgggacacccagtacatcgccaagaaggccaaggagatcctgttcgggatcacccactccgtcatcagcacctccggcaagatcacggacaagctgcgcgaggactggaacctcgtgaacaccatgaaggagctgaacctggacaagtacaagaagctcggcctgaccgagaccctgctcaacagcaagggggaggagaaggagcggatcatcgactggtccaagcgcaacgaccaccggcaccacgccatggacgccctgacggtggcgttcaccacccacaaccacatccagtacctgaactacctcaacgcccgcaaggacgaggaccacaagcagcacaaggtcatcagcaacatcgagaacctgatcaccaaggtgttcgagaagaagaacggcgccaagcagcggcgcttcatcgagcccatcaacaacttccgggtggacgccaagaagcacctggacgagatcctcatctcccacaaggccaagaacaaggtcgtgaccaagaacatcaacaagatcaagaagaaggggagcgtggtcgcgaagacggagctgacgccccgcggccagctgcacaaggagaccatctacgggagctccaagttcctcaagaccaaggacgagaagatcagcggcaagttcgacctggagaccatcaacaaggtgcagaacgagaagtacaagaacgccctgctccagcggctgcgcgagttcggcgaggactccaagaaggccttcaccgggaagaacgtgatcagcaagaaccccatctacctggacgaggagaagaccctccagatcccggagtccgtcaccctggcctggtacgagatgatctacacgatccgcaagcccgtgaaccccgacaacttcaaggactacaagaacatcgacaaggtgaccgacgagaagatccgggcggtcctgaccgaccgcctccggaagttcaacggcaacagcaaggaggccttctccgacctggagaagaaccccatctggctgaacaagagcaaggggatcgccatcaagaccgtgacgatcaccggcatgtccaacgtggaggccctccactacaagaaggaccacctggggaaggagatcctggacaagaagggcgaccgcatgccggtcgacttcgtgagcaccggcaacaaccaccacgccgcgatctacgaggacgccaaggggaacctccaggagcgggtggtctccttctacgaggccgtggagcgcgtgaaccagggcctgagcgtcgtgaacaaggactacaacgccgggctgggctggaagttcctcttcaccatgaagcagaacgagatgttcctgttcccctccgaggacttcaaccccaaggagatcgacctgtacgacgagaagaacctcaagctgatcgccaagaacctgttccgggtgcagaagttcggggagctcagcaagtccggcttctggttccgccaccacctggagacgagcgtcgacgtgaagaaggagctgcggaactactcctacctcgacttctacagcaaggacttcatgaagaccatcgtgaaggtccgcctgaaccacctgggcaagatcgtccaggtgggggagtactga

SEQ ID NO: 2147 - RNA, 4230 nt, synthetic construct
  misc_feature 1..4230: note = Cas9 variant
  source 1..4230: mol_type = other RNA
atgagcatcatcaacttccagcgccggggcctgatggagacccaggcctccaaccagctcatcagctcccacctgaaggggtaccccatcaaggactacttcgtgggcctggacatcgggaccagctccgtcggctgggccgtgacgaacaaggcgtacgagctcctgaagttccgcagccacaagatgtgggggtcccggctgttcgacgagggcgagagcgccgtggcccgccggggcttccgctccatgcggcgccggctcgagcgccggaagctgcgcctgaagctcctggaggagctgttcgccgacgccatggcgcaggtcgacccgaccttcttcatgcggctccgcgagagcaagtaccactacgaggacaagaccaccgggcactccagcaagcacatcctgttcatcgacaagaactacacggaccaggactactacaaggcctaccccaccatctaccacctccgggccgagctgatgaaggacggcaccgacgacatccgcaagctgttcctggccgtgcaccacatcctcaagtaccgggggaacttcctgtacgagggcgcgaccttcgactccaacgccagcacgctggacgacgtgatcaagcaggccctcgagaacatcaccttcaactgcttcgactgcaactccgccatcagctccatcgggcagatcctgatggaggccggcaagaccaagagcgacaaggcgaaggccatcgagcacctggtcgacacctacatcgccacggacaccgtggacacctccagcaagacccagaaggaccaggtgaaggaggacaagaagcgcctcaaggccttcgccaacctggtcctgggcctcaacgcgagcctgatcgacctgttcgggtccgtggaggagctcgaggaggacctgaagaagctgcagatcacgggcgacacctacgacgacaagcgggacgagctcgccaaggcctggagcgacgagatctacatcatcgacgactgcaagtccgtgtacgacgccatcatcctgctgagcatcaaggagcccgggctcaccatctccgagagcaaggtcaaggccttcaacaagcacaaggacgacctggcgatcctgaagtccctcctcaagagcgaccgctccatctacaacaccatgttcaaggtggacgagaagggcctgcacaactacgtgcactacatcaagcagggccggacggaggagaccagctgcaaccgcgaggacttctacaagtacaccaagaaggtcgtggaggggctgcccgactccaaggacaaggagtacatcctgagcgagatcgagctgcagaccctcctgccgctgcagcgcatcaaggacaacggcgtgatcccctaccagctccacctggaggagctgaaggtcatcctggccaagtgcgggcccaagttccccttcctcaacgaggtggccgacggcttctccgtggccgagaagctgatcaagatgctggagttccggatcccgtactacgtcgggcccctcaacacgcaccacaacgtggacaacggcggcttcgcctgggcggtgcgcaaggccagcgggcgggtcaccccctggaacttcgacgacaagatcgaccgcgagaagtccgccgccgcgttcatcaagaacctgaccaacaagtgcacctacctgctcggcgaggacgtgctgcccaagagctccctgctctacagcgagttcatgctgctgaacgagctcaacaacgtccggatcgacgggaagccgctggagaaggccgtgaaggagcacctgatcgaggccgtgttcaagcaggaccacaagaagatgacgaagaaccgcatcgagcagttcctcaaggacaacaactacatccccgagaagcacaagcccgagatcaccggcctggacggggagatcaagaacgacctggcctcctaccgggacatggtccgcatcctcggcaacaacttcgacctgagcatggccgaggagatcatcaccgacatcaccatcttcggcgagagcaagaagatgctgcgggagacgctccgcaacaagttctccagccggctggacgacgaggcgatcaagaagctgtccaagctccgctaccgggactgggggcgcctgagccggaagctgctcaacgtgatcgagggctgcgacaaggccggggacggcacccccgagaccatcatcatcctgatgcgcaacttctcctacaacctgatggagctcctgggggacaagttcagcttcatggagcggatccaggagatcaacgccaagctgatcgagggccagatcgtgaacccgcacgacatcatcgacgacctcgccctgtcccccgccgtcaagcgcgcggtgtggcaggccctgcggatcgtggacgagatcgtccacatcaagaagaccctccccgcccgcatcttcgtggaggtgacgcgcagcaacaaggccgagaagaagaagaaggactcccggcagaagcgcctgagcgacctgtacgccgcgatcaagaaggacgacgccctcctgtccggcctgaccaacgaggagttcgggggcctcaagagcgggctggccaagtacgacgacgccgcgctgcggtccaagaagctctacctgtactacacccagatgggccgctgcgcctacaccggcgaggtcatcgacctgagccagctcaacaccgacaactacgacatcgaccacatctacccccggtccctgacgaaggacgacagcttcgacaacctggtgctctgcaagcgcaccgccaacgcccagaagtccgacacctacccgatcagcaaggagatccagaaggcccagaaggcgttctggatcttcctgaagcagcaggggctgatcagcgagcggaagtacgagcgcctcacccggatcacgcccctgaccgccgacgacctgtccggcttcatcgcccgccagctcgtggagaccaaccagagcgtcaaggccgccaccacgctgctgcggcgcctctaccccggggtggacgtggtcttcgtgaaggcggagaacgtgaccgacttccggcacgacaacgacttcatcaaggtccgctccctgaaccaccaccaccacgccaaggacgcctacctgaacatcgtggtgggcaacgtctaccacgagcggttcacccgcaacttccgggccttcttcaagaagaacggggccaaccgcacctacaacctcgcgaagatgttcaactacgacgtgaactgcacgaacgccaaggacggcaaggcctgggacgtgaagaccagcatggacaccgtcaagaagatgatggcctccaacgacgtgcgggtgaccaagcgcctgctggagcagagcggcgcgctcgccgacgccacggtctacaaggccgccgtggcggagaaggccaaggacggggcctacatcggcatgaagaccaagtccagcgtgttcgccgacgtctccaagtacgggggcatgaccaagatcaagaacgcctacagcatcatcgtgcagtacgcggggaagaagggcgaggtggtcaaggagatcgtgcccctgccgatctacctgaccaaccggaacacgaccgaccaggacctcatcgactacgtggcctccatcatcccccaggccaaggacatcagcatcatctaccgcaagctgtgcatcaaccagctggtcaaggtgaacggcttctactactacctcgggggcaagaccaactccaagttctgcatcgacaacgccatccaggtgatcgtcagcaacgagtggatcccctacctgaaggtgctggagaagttcaacaacatgcgcaaggacaacaaggacctcaaggccaacgtgatctccacccgggcgctggacaacaagcacacgatcgaggtccgcatcgtggaggagaagaacatcgagttcttcgactacctggtgagcaagctcaagatgcccatctaccagaagatgaaggggaacaaggccgccgagctgtccgagaagggctacgggctgttcaagaagatgagcctcgaggagcagtccatccacctgatcgagctgctcaacctgctgaccaaccagaagaccaccttcgaggtcaagccgctcggcatcacggccagccggagcaccgtgggctccaagatcagcaaccaggacgagttcaaggtgatcaacgagtccatcaccgggctgtacagcaacgaggtcaccatcgtgtga

SEQ ID NO: 2148 - RNA, 4233 nt, synthetic construct
  misc_feature 1..4233: note = Cas9 variant
  source 1..4233: mol_type = other RNA
atgaccaagaacatcctgggcctcgacctgggggtgagctccatcggctgggccctggtccaggagaacagcaagaaccccgagaacaacaagatcgtgaagctcggggtgcgcgtcaacccgctgaccgtggacgagcagatcaacttcgagaagggcaagcccatcacgaccaacgcctcccggaccctggcgcgcagcgcccggcgcaacctccagcggttcaagctgcgccgggccaacctgatcgacgtgctcaagaaggggaacatcctgaagcagggcgacctgctcaccgagatcggcaagaactccacgttccagacccaggagctgcgcgccaagagcgccaaggagaaggtcgagctgtccgacttcgtgcggatcctcctgctgatcaacaagaagcgcgggtacaagagctcccggaaggcgaagaacgaggacgagggccagatcatcgacgggatggccgtggccaagaagctctacgaggagaacatcacccccggcgagtacagctacaagctgctgcaggaggggcgcaagcagctccccgacttctaccggtccgacctgcaggccgagttcgacaagatctggaacttccagaagcagttcaacccggagatcttcaccaacgagctgtacaagcgcctccagggcaagaaccggaacgcgacgtggaaggagctggagatccccttctacctggtcggcatcaagcagatcgggaccatgcaggagaagaagatcgagcgctacttctggcggagcgaggccgtgaagaagcagctcgacttcgagtccctggccgtggtcttccaggagatcaacagcaacctgaacaactccagcggctacctcggggccatctccgaccgcagcaaggagctgtacttcaacaaccagaccgtgggcgagtacctgtacaaccagctcaagatcaacccccacaccaagctgaagaaccaggtgttctaccggcaggactacctggacgagttcgagaagatctgggagacgcaggccaagtaccacaagaagctcaccaaggagctgaaggaggagatccgcgacatcgtcatcttctaccagcggaagctgaagtcccagaagggcctcatcagcttctgcgagttcgagaaccgcgagatcgagatcaccgtgaacgggaagaccaagaagaagacggtgggcctgaaggtcgtgccccgcagctccccgctgttccaggagttcaagatctggcagcggctcaacgacctggagttcaagaacgtggagaccaaggagatcttccccctggagctcgagcacaaggagatcctgttcgggaacctgaacatcaagggcaacctcagctccaaggagctgatcgagcagctggggtaccccagcaaggagtggaagtgcaacttcaaggagatcgacggcaacaagacccacgagaacctgtacaccgcgttcctcaagatcatcgccaacgagggcatcgagttccccaaggagttcaagctgtccatcgacgacgacatcaaggtcagcaagatcgacgtgtccagcgagaagatcaaggagttcatcaaggagaacttcctgaagctcgggatcaacacgtccatcctggacttcaacccggagctggacggcaaggacttcgagaagcaggagagctaccagctctggcacctcctgtactcctacgagggggacgacagcgcctccggcaacgagaagctgtacgagctgctggagaagaagttcgggttcaagcgcgagtacagcaagatcctcgccgacgtgggcttctcccaggactacggcagcctgtccagcaaggccatgcggaagatcttcacctacatcaaggagaacaagtactccgaggcgtgccacctggccgggtacaaccacagcaagaacagcctcaccaaggagcagctggccaaccgcatcctgaaggagcagctcgagatcctgcccaagaacgccctgcggaaccccgtcgtggagaagatcctcaaccagatgatcaacctggtcaacgaggtgatcaaggagtacggcaagcccgacgagatccgcatcgagctggcccgggagctcaagaagaacgcggaggagcgcgccaacatgacctccgacatcagcaaggccacgctgctgcaccagaagtacgccgaggtgctccagaaggagttcgggatcaaggccccgtcccggaacgacatcatccgctacaagctgtacctggagctcgcgaacaacggctacaaggacctgtacaccaaccagaagatcgagaaggagaacatcttcaccgacaagtacgacatcgaccacatcatcccccagagccggttcttcgacgactccttcagcaacaaggtcctggtgccccgctgcgccaaccaggacaaggacaactacaccgccgtggactacatcgagaagaagtacggggagcggggcaaggaggacttcctcaaccgcatccacctggtcttcaagtccaaggaggccatcgcgggcaagagcgagtcccagatcagctccatgaacacgaagttcctgaagctccagaagaaggggagcgagatcggcgaggggttcatcgagcgggacctgcgcgacacccagtacatcgccaagaaggccaaggagatcctgttcggcatcaccaactccgtgatcagcacctccggccggatcacggacaagctccgcgaggactggaacctggtgaacaccatgaaggagctgaacctcgagaagtaccggaagctggggctgaccgagctcatcgccaacagcaagggcgaggagaaggagcgcatcatcgactggaccaagcgcaacgaccaccggcaccacgccatggacgcgctgacggtcgccttcaccacccacaaccacatccagtacctgaactacctcaacgcccgcaaggacgagaagcacaaggagcaccacaacatcttcgccatcgagaacatcatcaccgagatcgtggagaagaagaacgggtccaaggagcggcgcttcaagctgcccatcaagaacttccggaccgaggccaagaagcagctggaggaggtgctcatcagccacaaggcgaagaacaaggtcgtgacgaagaacatcaacaagaccaagaagaagggcggggtggtcagcaagatcgtgctgaccccgcgcggccagctgcacaaggagaccatctacggctccgccaagttcctcaagacgaaggaggagaagatcagcgggaagttcgacctggagaccatcaacaaggtgcagaacgagaagttcaagaacgccctgctcgaccggctgaaggagttcaacggcgactccaagaaggccttcaccgggaagaacgtccccgccaagaaccccatctacctgaacgagcagaagaccgagcaggtccccgagagcgtggtgctcgcgtggtacgagacgggctacaccatccgcaaggccgtgaacgccgacaacttcaaggactacaagaacctggagaagatcatcgacaagggggtgaaggagatcctgaagaaccggctcaacgccttcaacggcaacgcgaaggaggccttctccgacctggagaagaagccgatctggctgaaccagagcaagggcatcgccgtcaagaccgtgaccatcacggggatcaacaacgccgagaccctccactacaagaaggaccacttcggcaacgagctgctggacgagaacgggaagaagatccccgtggacttcgtctccaccggcaacaaccaccacgtggccatctacgaggacgcggacgggaacctccaggagcgcgtggtcagcttctacgaggccgtggagcgggtgaaccagggcctgtccatcatcgacaaggagtacaaccaggacctgggctggaagttcctcttcaccatgaagcagaacgagatgttcctgttccccagcgaggacttcaaccccaaggagacggacctgttcgacgagaagaacctcaacctgatctccaagaacatgttccgcgtccagaagttcgggagcctgctctccggcttctggttccggcaccacctggagaccaccgtggacctgaacagctccctcaaggacaccagctacaaggtgatccagtcctgcaacaacctgaagctgatcgtcaaggtgcgcctcaaccacctggggaagatcgtgcagatcggcgagtactga

SEQ ID NO: 2149 - RNA, 4236 nt, synthetic construct
  misc_feature 1..4236: note = Cas9 variant
  source 1..4236: mol_type = other RNA
atggtgaagaaggagtacttcatcggcctggacatggggaccagctccgtcggctgggccgtggccgacaccaactacaacctcctgcgcgcgaaggggaaggacatgtggggcgtgcggctgttccccgaggccagcacggccgccgaccgccggtcccaccgcaccgcccggcgcaacaacaagcggaaggcggcccgcgaggggttcctccgggagatcttcgaggacgagatcaacaagatcgacccgggcttcttcgagcgcctgaaggagagcaagtactacctggaggacaagctcaccgacacccccttcgtcctgttcgccgacaagggctacacggacaaggagtactacgacgagtaccccaccgtgttccacctgatcaaggagctcatctccgagaaggggctggagccccacgacatccggctggtgtacctcgcctgcctgaacatctacaagcaccgcggccacttcctgaacgacaccctcagcggggacggcatcgacaacatcaactccctgtgcaacgacttcaccagctacctggcggactacaaccagaactccgaggacgacgggacggagaagatggacctcgacagcaccgtcctggccggcgtgttcgaggagaccctgtgcaacaagcacctctccaacagcgccaagaagcgggacctgatcgacaagctgggcatcaccaacaagacgaagtacctcaccgagatgatggccctgatctccgggctggccagctccgtgagcaacatgttcgcgaaggacacctacgacgaggagcagaagaagttcaagctctccttccgcagctccaacctggacgaggacatggtcaaggtgcaggccatgctgaccccggaggagtacgagatgatctgcatcatgaagaagatccacgactggagcgtggtcagcgtgatcatgggctcccacaagtacatcagcgacgcccgggtggagctctacgagaagcacaagcaggacctggccaagctgaaggccatctacaaggagtacctccccgacaagtacgacgcgatgttccgcgagatgacggacaactcctacagcgcctacgtcgggaaggtgtccagcaacaagaagtcccagaccggcaaccacaaggtgcggatgcagcgccggggcgccaagtgcaagcaggaggacttctacgaccgcatcaagaaggagatcaacagcgtcccccaggaggagaagatcgacatcctgcaggacatggagaccaactccttcctgcccaagcagctcaccaacgagaacggggtgatcccgtaccagctgcacctggccgagctcaagaagatcctggacaacgccagcacgtacctgcccttcctcaactccgcggacgagaccggcatcagcaacaaggacaagatcatccagctgttcgagttccggatcccctactacgtggggcccctgttcaagtccgagaagaacaagaccaacgcctgggtcgtgcgcaaggagagcggcaaggtgtacccgtggaacttcaacgagaagatcgacgagaagcagtccgccgagatcttcatcgagcgcatggtccggcactgcacctacctcaacaacgagagcgccctgcccaagaactccctgaagtacgagcgcttccgggtgctcaacgagctgaacaacctgcgcatcaacggggagcggatcagccccgagctgaagcagcgcatctacaacgagctgttcaaggtcaagaagaagcggatcacgaagtccatgctctgcgagtacctgtacaagaacggcatcgccgacaaggacagcgagctcagcggcttcgacgggaccttcgcgaacgccctgctgtcctacggcaagttccgcgagctgttcaacgtggacaccctcaccgacaagcaggaggccgccgcggaggacatcatcaagtggagcacggtgtacggggactccaagaagttcctgcaggagaagatcgaggagaactacggccccgagagcgagaacccgctcctggacaacaagcagatcaagcgggtcatggggtacaagttcaccgactggggcaacctgtcccgcgagttcctcaacctggagggcgccgacaaggacaacgacaccaccacgggggaggtgatgcccctgatcacccggatgtgggaggagaactacaacctcatggagctgatgagcaacaagttctcctaccgcgacgccctggccgagaagaccgaggagatcgagaagaccctcacggacatcgagtacgaggacctggaggacctgtacatcagcgcccccgtgaagcggatgacctggcagaccctcctgatcctgaaggagatctaccagatcatgggctacgcgcccaagaagatcttcgtcgagatggcccgcgaggaggaggagaaggtgaacgggaagggcgcccggaagtccagccgcaagaagcggctcgaggacctgtaccgcaactgcaaggacgcctccaaggagctgagcaccgggatcaagaacgccgacgaggcgatcctccggcgcaagaagctgtacctgtactacctccagaagggcaagtgcatgtactccggcaagaccatcgacttcaagagcctgttcacgaacaactacgacatcgaccacatctacccgcagtccgtggtcaaggacgacagcctggagaacaacatggtgctcgtggagcgcaactacaacaacaagaagtccgacaccttccccatcttcagcgactggcagaacaagatgaagcccttctggaccatgctgaaggagcaggggttcatcaacgaggagaagtacaagcggctgacccgcacggacgagctcaccgacgacgagctggccaacttcgtcaaccggcagctggtggagacccgccaggccaccaaggtgatcgccgagctcctgaagaacagcttcgacgacatcgactccaagatcgtctacgccaaggcgggcaacgtgagcgagttccggcacaagttctccatgaagtacgacaaggagacggagaagtccagcgtgatccaccccgagctggtcaagtgccgcatcatcaacgacttccaccacgccaacgacagctacctcaacatcgtggtggggaacatctacgacgtcaagttcacccagaacccgtacaactacatcaaggagtacaagaagcagaagaacaactccgccctgagcgagcaggagaaggagaagtaccacatggacaagatcttcaacttcgacgtgaagcggaacggcgaggtggcctggatctcccgcggcgacaacaagaccctggagaccgtcctcaaggtgatgcggaagaacacgcccatcgtgacccgcatgaacttcgaggagcacgggcagctggcggacctgaccatctacagcgcctccgacgccctcagcaagaagggcgtcgggtacatcaaggtgaaggcctccgacgcccggctggacgtgctgaagtacggcgggtacaagaagtacaagggcgcgtacttcttcctcgtcgagcacaccgagaagaacaagcgcgtgcggacgatcgagaacatgcccctgtacctgaagaacgagctcaacaccaaggagaagatcgagctgtggtgcgccgacaaggagaacggcctggggctcgtggaccccgacgtccgcctgggcaagatcaagctgtacagcaagatccggatcgacgggttcgacctctacctgaccggccgcaccgggaacaacctgctcacgtccaacgccgtgcagctgaagatcggcagcaacaagccgtccgacaacgacaagctgttctggcggtactacatcaacaagctcagcaagtacaccgagaactccgagttcgtgagcatccagaacaacatcaagctgtacgacctgttcgtcgagatcaacaacgccggcgtgtacagcaagcgccagaaccccatcggggacaagctcctggagggccggtccaagttcatcaacctgaccctcagcaagcaggtcgagaccctgctggggatcatccgcatctactccctcgagaaccagggcgccgacctgagcaacatcgggggccaggagaagaacggcacgatgaagccccacaagcggatctccgacaagaaggaggtgctgctcatcaaccagagcgtgaccgggctgtacgagtccaagatcgacctgctcaagatctga

SEQ ID NO: 2150 - RNA, 4236 nt, synthetic construct
  misc_feature 1..4236: note = Cas9 variant
  source 1..4236: mol_type = other RNA
atgaagaacatcctgggcctcgacctggggacgaacagcatcggctgggccctgatcaagcagaacgccgaggagcgccaggggtccatcctcggcatggggacccgggtgctgcccatgagccaggacgtcctgggcgacttcggcaaggggaactccgtgagccagacggcggcccgcaccggctaccgggggatccgccggctccgcgagcggttcctgctgcgccgggagcgcctccaccgggtgctgaacatcctgggcttcctcccgtactactacgccgcccagatcgacttcgacaagcgcttcgggaagttcaaggccgagaccgagcccaagctgccctacaacaacgagggcttcatcttcaagaactccttcgaggagatgctgagcgacttcaagatctcccagcccgagctcctgagcggcaacaagaaggtcccgtacgactggaccatctactacctgcggaagaaggcggtgtcccagaagatcgagaaggaggagctcgcctggatcctgctgaacttcaaccagaagcgcgggtactaccagctccggggcgaggacttcgacgaggagaaggacaagacgttcgtgaccctgaacgtcgacaaggtgatcgacagcggggagaaggtgaagggcaacatcctgttcgacatctacttcaccaacggctggaagtacgagaagcagaccacgaagcccgaggactggctcgggcgctccaaggagttcatcatcaccgagagcctgctgaagaacggcgaggtccggcgcaccttcaaggccgtggactccgagaaggactggatcgccatcaaggcgaagaccgagcaggagatcgagacggcccacaagaccgtggggagctacatctacgacgccatcctccagaaccccaagcagaagatcaagggcaagctggtccggaccatcgagcgcaagttctacaaggaggagctgcggaagatcctcgagaagcagaaggacttccacctggagctgcagaacgaggacctctactccgactgcgtgcgcgagctgtaccgcaacaacgacacccaccagctgagcctcgccaagaagtccttcatccacctgttcctggaggacatcatcttctaccagcggcccctcaagagccagaagtccagcgtgagcaactgcacgctggagtgccgcaagtaccgggacaagaacggggccgagggcatccagttcctgaaggtcatcccgaagtccaacccctactaccaggagttccgcatctggcagtggatgagcaacctcaagatctaccggcgcgacgacgacgtgaacatcacctccgagtgcctgaagaccgcggaggactacgaggacctgttcgtgttcctcaacatccggaaggaggtcgaccagaaggcctgcctgcgccacttcaagctgagcgagaagacccaccggtggaactacgtggaggacaagaagtacccctgcaacgagacgggcaccatgatctccgagcgcctcaagaaggtgggggacagccccgacaacatcttcacccgggagatggagcagcagatctggcacatcatctactccgtcaacgacaagaccgagtacgagaaggccctcaagagcttcgccaagaagaacgagctggacaacgactccttcttcgaggccttccgcaagttcccgcccttcgacagcgagtacggctccttcagcgagaaggcgatcaagaagctgctccccctgatgcggatcgggaagcactggaactgggaggccgtggacgagaagatcaagaaccgcatccagaagatcatcatcggcgagtacgacgagaacatcaaggacaacatccgggagaagacgctgtccctccagaaggagagcgacttccaggggctgcccctgtggctcgcccagtacgtggtctacggccgccactccgaggccagcgtggccggcaagtggaactccgtcgacgacatcgaggagtacctgaaggagttcaagcagcacagcctgcggaacccgatcgtggagcaggtcatcatggagaccgtgcgcgtggtgaaggacatctggatcaagtacgggaacggcgcggccgacttcttcgacgagatccacatcgagctcgggcgggagatgaagctgcccgccaaggagcgcaacaagatgacccagaagatctccgagaacgagaacaccaacctgcgcatcaaggccctcctggccgagatgatgaacgacagcgaggtccagaacgtgcggccctacagccccatgcagcaggagatcctgaagatctacgaggacggcgcgctcaactccgagatcagcgtggacgacgacatcctgaagatctccaagacggcccagccgagcccctccgacctgaagaagtacaagctctggctggagcagaagtaccgcagcccctacaccggggacatcatccccctgaacaagctgttcaccaccgagtacgagatcgagcacatcatcccgcagtcccggtacttcgacgacagcttctccaacaaggtcatctgcgagagcctggtgaaccgcctgaaggacaactacatcggcctcggcttcatcaagcagttccacgggtacaagatctccgacaagacgaaggtgttcgaggtcgaggagtacgaggacttcgtgaagaagaactacgccaacaaccggagcaagcgctccaagctgctgctcgaggagatccccgaggagatgatcgagcggcagctgaacgacacccgctacatcagcaagtacatctccggcatcctgagcaacatcgtgcggaagaaggagaacgacgagggggtcaactccaaggacatcatccccggcaacggcaagatcaccagccagctcaagcaggactgggggctgaacgacgtgtggaacgacctgatcctcccccgcttcgagcggatgaacgagctgaccaagagctcctacttcacggtgtggaacgagaagtaccagaagttcctgccgaccgtccccgtggagttcagcaagggcttctccaagaagcgcatcgaccaccggcaccacgccctcgacgcgctggtgatcgcctgcgccaccaaggaccacgtcaacctgctcaacaacaagagcgccaagtccgagatgaagcgctacgacctgaagcggaagctgatgaagttcgagaagaagacctaccagcacagccagaccggggagcgcatcgtgaaggacgtgcccgtcgagttcctcaagccgtggaacgacttcacggtggaggccaaggagaacctggagaagatcatcgtgtccttcaagcagaacctgcgggtcatcaacaaggcgaccaaccactacgagaagtggatcgagaaggacaacgtgaaggtgaagggcctcgtcgagcagcaggggctgaactgggccatccgcaagcccctgcacaaggacaccgtgagcggcaaggtggacctccccggcatcaaggtccccaaggggaagatcctgaccgccacgcggaagtccatcgacaccagcttcgacctgaagaccatcaactccatcaccgacacgggcgtgcagaagatcctcaagaactacctggagtacaaggggaacagctccgaggaggccttcagctccgagggcatcgaggacatgaacaacaacatcgagaagttcaacgaggggaagctgcaccagccgatcaccaaggtgcgcatcttcgagctcggcagcaagttccccctgggccagatcgggaacaagaagcacaagtacgtcgagaccgccaagggcaccaacctgttcttcgcgatctacgaggacgacaaggggaagcggacgtacgagaccatccccctcaacgaggtgatcgagcgccagaagcagggcctggcccccgtgaccctgaagtccaagaacgacttctacctctgcccgaacgacctggtctacgtggccgccgagggggagagcgtgaacaagatcgacttcaagtacgcctcccaggagttcatccacaacatctacaaggtcgtgagcttcagcggctcccagatcttcttcgtgaagcagaacatcgcggtcagcatcgtgaacaaggccgagttctccaccctgaacaagatggagcgcgccgtggacggcaagatgatcaaggactgctgcatcaagctcaagatcgaccggatcgggaacatcaccaagagctga

SEQ ID NO: 2151 - RNA, 4239 nt, synthetic construct
  misc_feature 1..4239: note = Cas9 variant
  source 1..4239: mol_type = other RNA
atgatgaccaagaacatcctgggcctcgacctggggaccaacagcatcggctgggccctgatcaagcagaacgccgaggagcgcaaggggtccatcctcggcatggggacgcgggtgctgcccatgagccaggacgcgctgggcgacttcggcaaggggaactccgtcagccagaccgccgcccgcaccggctaccgcggggtgcggcggctccgcgagcggttcctgctgcgccgggagcgcctccaccgggtgctgaacatcctgggcttcctcccggactactacgccgcccagatcgacttcgacaagcgcttcgggaagttcaaggcggagaccgagcccaagctgccctacaacaacgagggcttcatcttcaagaactccttcgaggagatgctgagcgacttcaagatctcccagcccgagctcctgagcgagaacaagaagatcccgtacgactggacgatctactacctgcggaagaaggccgtctcccagcgcatcgagaaggaggagctcgtgtggatcctgctgaacttcaaccagaagcggggctactaccagctccgcggggaggacttcgacgaggagaaggacaagaccttcgtgaccctgaacgtcgacaaggtgatcgacagcggcgagaaggtgaaggggatcgtcctgttcgacgtgtacttcaccaacggctggaagtacgagaagcagatcacgaagcccgaggactggctcggccggtccaaggagttcatcatcaccgagagcctgctgaagaacggggaggtgaagcgcaccttcaaggccgtcgactccgagaaggactggatcgccatcaaggcgaagaccgagcaggagatcgagatcgcccacaagacggtgggcagctacatctacgacgccatcctccagaaccccaagcagaagatcaaggggaagctgatccggaccatcgagcgcaagttctacaaggaggagctgcggaagatcctcgagaagcagaaggagttccaccccgagctgcagaacgaggacctgtactccgactgcgtgcgcgagctctaccgcaacaacgacgcccaccagctgagcctggccaagaaggacttcatccacctcttcgtcgaggacatcatcttctaccagcggccgctgaagtcccagaagtccagcgtgagcaactgcaccctggagtgccgcaagtacaaggacaagaacggcgaggagcggatccagttcctcaaggtgatccccaagagcaacccctactaccaggagttccgcatctggcagtggatgtccaacctgaagatctaccggcgcgacgacgacgtcaacatcaccagcgagtacctgaagacgaccgaggactaccaggacctcttcgtgttcctgaacacccggaaggaggtggaccagaaggcgtgcctgaagcacttcaagctcaacgagaagacccaccgctggaactacgtcgaggacaagcggtacccctgcaacgagacggggaccatgatcctggagcgcttcaagaaggtgggcgactccgccgacaacatcttcacccgggagatggagcagcagatgtggcacatcatctacagcgtgaacgacaagaccgagtacgagaaggccctgaagtccttcgccaagaagaacgacctcgacaacgtcagcttcttcgaggccttccgcaagttcccgcccttcgactccgagtacggcagcttctccgagaaggcgatcaagaagctgctgcccctgatccggacggggaagtactggaactgggaggccgtggacgagaagaccaagaagcgcatccagaagatgatcaccggcgagtgggacgaggacatcaaggacaacatccgggagaagaccctcagcctgcagaaggagtccgacttccaggggctgcccctctggctggcccagtacgccgtctacggccgccacagcgaggcctccgtggcggggaagtggaacagcgtgaacgacatggaggagtacctgaaggagttcaagcagcactccctccggaacccgatcgtcgagcaggtcatcacggagaccatccgcgtggtgaaggacatctggatcaagtacggcaacggcgccgccgacttcttcaacgagatccacatcgagctggggcgggagatgaagctgcccgccaaggagcgcagcaagatgacccagaagatctccgagaacgagaacaccaacctccgcatcaaggccctgctggtggagatgatgaacgacagcgaggtgcacaacgtccggccctactcccccatgcagcaggagatcctcaagatctacgaggacggcgcgctgaacagcgagatcagcgtggacgacgacatcctgaagatctccaagacggcccagccgagcccctccgacctcaagaagtacaagctgtggctggagcagaagtaccgcagcccctacaccggggacatcatccccctcaacaagctgttcaccaccgagtacgagatcgagcacatcatcccgcagtcccggtacttcgacgacagcttctccaacaaggtgatctgcgagagctccgtcaaccgcctgaaggacaactacatcggcctcgggttcatcaagcagttccacggctacaagatcagcgacaagacgaaggtgttcgaggtggaggagtacgaggacttcgtcaagaagaactacgcctccaactggagcaagcggtccaagctgctgctcgaggagatccccgaggagatgatcgagcgccagctgaacgacacccggtacatcagcaagtacatctccggcatcctgagcaacatcgtgcgcaagaaggagaacgacgacggggtgaactccaaggacatcatccccggcaacgggaagatcaccagccagctcaagcaggactggggcctgaacgacgtctggaacgacctggtgctcccccggttcgagcgcatgaacgagctgaccaagagcaacgacttcaccgtgtggaacgagaagtaccagaagttcctgccgacggtccccgtggagttctccaagggcttcagcaagaagcggatcgaccaccgccaccacgccctcgacgcgctggtgatcgcctgcgccacccgggaccacgtcaacctgctcaacaaccagtccgcccgcagcgagatgaagcggtacgacctgaagcgcaagctgatgaagttcgagaagaaggcctaccagcactcccagaccggggagcggatcgtgaaggacgtgcccgtcgagttcctcaagccgtgggacaacttcatcgtggaggcgaaggagaacctggaccgcatcatcgtgagcttcaagcagaacctgcgggtcatcaacaaggccaccaaccactacgagaagtggatcgagaagaacaacgtgaaggtgaaggccctcgtcgagcagcagggcctgaactgggccatccgcaagcccctgcacaaggacacggtgtccgggaaggtggacctccccggcaccaaggtccccaaggggaagatcctgaccgccacccgcaagagcatcgacacgtccttcgacatgaagaccatcaacagcatcaccgacaccggcatccagaagatcctgaagaactacctcgagtacaagggctcctacgaggacgcgttcagcccggaggggatcgaggacatgaacaagaacatcgagaagttcaacgacggcaagcagcaccagcccatcatcaaggtgcggatcttcgagctggggtccaagttccccctgggccagatcgggaacaagaagcacaagtacgtggagacggccaagggcaccaacctcttcttcgccatctacgaggacgacaagggcaagcgcacctacgagaccatccccctgaacgaggtcatcgagcggcagaagcaggggctggccccggtgacgttcaagagcaagaacgacttctacctctcccccaacgacctggtgtacgtcgccgcggagggcgagagcgtggacaacctggacttccagtccgacagccaggagtacatcaacaacgtgtacaaggtcgtgtccttcagcgggagccagatcttcttcgtgaagcagaacgtcgccgtgtccatcgtgaacaaggccgagttcagcaccctcaacaagatggagcgcgccatcgacggccggatgatcaaggagtgctgcgtcaagctgaagatcgaccgcatcgggaacatgaccaagtcctga

SEQ ID NO: 2152 - RNA, 4245 nt, synthetic construct
  misc_feature 1..4245: note = Cas9 variant
  source 1..4245: mol_type = other RNA
atgaagaagatcctgggcctcgacctggggaccaacagcatcggctgggccttcgtggaggaggccgagaacgagtccgagaagtcctccatcatcaagctgggggtccgcgtgaaccccctcaccgtggacgagcagcagaacttcgagaagggcaagagcatcacgaccaacgcggaccggaccctgaagcgctccatgcggcgcaacctgcagcggtacaagcagcgccgggagaacctcatcgacatcctgatgaagaacgggttcaccagcgacgacacgatcctgtccgagaacggcaaccgcaccaccttcgagacctaccggctccgcagcaaggccgtcgccgagaagatctccctgcaggagttcgcccgggtgctgctcatgatcaacaagaagcgcggctacaagagctcccggaaggccaaggggacggaggacggcgagctgatcgacgggatggaggtggcgaagaagctgtacaactacaacctcaccccgggccagctgtgcctgcagctcctgaacgaggggaagaagcacctccccgacttctaccgcagcgacctgcaggccgagttcgaccggatcttcgacatccagatgaccttctacaccgagtacctgacgctggagctcaaggaggagctgcgcggcaagaagcgggacgccgtctgggccatctgcgcgaagatcttcaaggagaagggcttcgagctgatcgggaccaagcgccagggctccaccgccgagcagaagcacgagaactacagctggcgggccaaggggctctccgagaagctggagctggagcagctcgtggtggtcctgcagcagatcaacatccagctgaacagctccagcggctacctcggcgccatctccgaccgcagcaaggagctgttcttcaacaagcagaccgtggggcagtaccagatggccgtgctggacaagaaccccaacgcgggcctccggaacatggtcttctaccgccaggactacctggacgagttcaacgccatctgggagaagcaggccctgttccaccccatcctcacggacaccctgaaggacgagatccgcgacgtgatcatcttctaccagcggcgcctcaagagccagaaggggctgatctccttctgcgagctggagagccggaagatcgaggtggagatcgccggccagaacaagaccaagatggtcgggtcccgcgtgatcccgcggagcagccccctgttccaggagttcaagatctggcagagcctcaacaacatcgaggtgttcggcaagggcaagaagtccaagaagcagaaggagcagaccctgttcgaccagacggaggaccccctggagttcgggggccgccgggagctctacgaggaggagaaggagctgctggccctggagctcagcatcaagaaggagctgaagaaggcggacatcctgaagctcctgttcgacaaccccaaggagctggacctcaacttcaacgccgtccaggggaacctgacccaggccaccctgttcaacgtgtacaagaagatcatcgagctctccggccacgagatcgacgtggagaaggacagcgcctccaagatcctcaagagcatcgaggagatcttcaaggccctgaactacaacaccgagatcctgcacttcgactccgagaagtcccaggaccagcaggcgatgtacatgctgtggcacctcctgtacagcttcgagggggacaacagcaacacgggcaacgagaacctgatcaacaagatctccaagctgtacggcttcgagaaggagtacgccaagatcctcgccaacgtcagcttccaggacgactacgggtccctgagcgccaaggccatcagcaagatcctgccgtacctcaaggagggccacaagtccgacatcgcgtgcgacctggccgggtacaagcacagcgcctccagcctgacccgcgaggagctcgagaacaagacctacaaggaccggctggagatcctgcccaagaacaccctccgcaaccccgtggtggagaagatcctgaaccagatgatcaacgtcatcaacctgatcatcgactcccgggagctcaagaagtccgccaaggagcgcgaggagctgaccaagagcatcagcgagacgaccaagctgcaccagcagtacaaggacatcctcgcgaaggcccccttcaacctgaccaacacgtcccggaacgacatcatccgctacaagctgtacgaggagctcaaggacaacggctacaagaccctgtacagcaacaagtacatctccccggccgccctgttcagcggggacttcgacatcgagcacatcatcccccagtcccgcctcttcgacgacagcttctccaacaagaccctggagctgcggagcatcaacatcgagaagggcaacaagaccgcctacgacttcatcaagggcaagtacggggagacgggcgaggacaactgcctcgacaagtacctgaaccggatcgagaccctgtacaagaacgggatcctcaagaagtccaagtacaacaagctgaagatgcaggacaaggacatccccgacggcttcatcgagcgcgacatccgggacacccagtacatcgcgaagtacgccaagaccctgctcggcgacctggtgaagttcgtcgtgagcaccagcgggtccgtgacggagcgcctgcgcgaggactggcagctcgtcgacgtgatgaaggagctgaactgggagaagtacatgcagctgggcctcaccgaggagttcaccaacgaggaggggcaccggatccgcaagatcaaggactggaccaagcggaacgaccaccgccaccacgccatggacgccctgacggtggccttcaccaagcggcagttcatccagtacctgaacaacctcaacgcgcgccggatcagcgacgagcagggcatctccaacagcgagaaggacgagcgcaacaacgtctccatcaccaccaacgacatgaagctgaacacgcgggacgtgctggggatcgagaagaaggagctctaccgcgacaaccggggcaagctgcgcttcaaggcccccatgccgctgctcgagttccgggaggaggccaagcgccacctggagaacaccctgatcagcatcaaggccaagaacaaggtgaccaccatcaacatcaacacgctcaagaaggccggcggggtctacaagaagacccagctgacgccccggggccagctgcacaacgagaccatctacgggtcccagaagcagtacatcgtgaaggaggagaccatcaacgcgaagttcgacgtggagaagatcgccaccgtcaccaaccccgtgtaccgcgaggccctcctgaagcggctggagcagaacaacaacgaccccaagaaggccttcaccggcagcaacgcgctcacgaagaagccgatgtggttcgacgagcagcagaccgagaaggtgcccgagaaggtcaagaccgtgtccttcgagaccatctacacgatccgcaaggagatcagccccgacctgaagatcgagaaggtggtcgacgagaaggtgcggcagatcctgaacaaccgcctcaacgagtacaacgggaacgccaagcaggccttctccaacctggacgagaaccccatctggctgaacaaggagaagggcatcaccatcaagcgggtgaccatcaccggcatcaacaacgcccaggccctccacgagaagctggacaaggacgggaagccgatcctggacggcgaggggaagaagcagcccgtcgacttcgtgaacacgggcaacaaccaccacgtggcggtctactgcgacgccgacgggaacctccaggagaacgtgatcagcttctacgaggccgtgacccgccgcaacctgggcctgcccatcatcgacaaggactacaagaaggacgacggctggcagttcctcttctccatgaagcagaacgagtacttcgtcttccccaacgagagcaccgggttcaacccgaacgaggtggacctgctgaaccccgacaactactccctcatcagccccaacctgttccgggtgcagaagttcaccatcaaggactacttcttccgccaccacctggagacgaacgtcgagtccaacagcaccctcaagggcatcacctggctgcggtgcgggctgaacaacatcgacaacatcatcaaggtgcgcatcaaccacatcggccagatcatccacgtgggggagtactga

SEQ ID NO: 2153 - RNA, 4248 nt, synthetic construct
  misc_feature 1..4248: note = Cas9 variant
  source 1..4248: mol_type = other RNA
atggccaagttcaacaagccctacagcatcggcctggacatcggggtgtccagcgtcggctacgccgtgatcaccgaggactaccgcgtgccggcgttccggttcaaggtcctcgggaacaccgagaaggagaagatcaagaagaacctgatcggctccacgaccttcgtgcccgcccagagcgcccaggtgacccgcgtcttccgggtgaaccgccggcgcatcgaccggcgcaaccaccggatcgcctacctgcgcgacatcttccagaaggagatcgagaaggtggacaagaacttctaccggcgcctcgacgagtccttccgggtcctgggggacaagagcgaggacctgcagatcaagcagcccttcttcggcgacaaggagctcgagaccgcctaccacaagaagtaccccacgatctaccacctccgcaagcacctggcggacgccgacaagaactccccggtggccgacatccgggaggtgtacatggccctcagccacatcctgaagtaccgcggccacttcctgaccctcgacaagatcaaccccaacaacatcaacatgcagaactcctggatcaacttcatcgagagctgccaggaggtcttcgacctggaggtgtccgaggagagcaagaccatcgcggccatcttcaagtccagcgagaaccggcaggagaaggtgaagcagatcctgtcctacttccagcaggagctcctgaagaaggacaagagcatcttcaagcagctgctccagctgctgttcgggctcaagaccaagttcaaggactgcttcgagctggaggaggagcccgacctgaacttctccaaggagaactacgacgagaacctcgagaacctgctgggcacgctcgaggaggacttcagcgacgtcttcgccaagctgaagatcctgcgcgacaccatcctcctgtccgacatgctgacctacaccggggccacgcacgcccggttcagcgcgaccatggtggagcgctacgaggagcaccggaaggacctccagcgcttcaagagcttcgtgaagcagaacctgtccgagcaggactacctggacatcttcggccgcaagacccccaacgggttcgacgtcgacaaggagaccaagggctacgtgggctacatcagcaacaagatggtgctcacgaacaagcagaagaccatccagcagaacttctacgactacatctccgggaagatcaccggcatcgagggggccgagtacttcctgaacaagatcagcgacggcaccttcctgcggaagctccgcacgaccgacaacggcgccatcccgaaccagatccacgcctacgagctggagaagatcatcgagcggcaggggcgcgactaccccttcctgctcgagaacaaggacaagctgctgtccatcctcaccttcaagatcccctactacgtcggccccctggccaaggggaacaacagccggttcgcgtggatcaagcgcgccacctcccaggacatcctggacgacaacgacgaggacacgcggaacggcaagatccgcccgtggaactaccacaagctcatcaacatggacaagacccgggacgccttcatcaccaacctgatcgggaacgacatcatcctgctgaacgagaaggtgctccccaagcgcagcctgatctacgaggaggtgatgctgcagaacgagctcacccgggtcaagtacaaggacaagtacggcaagacgcacttcttcgactccgagctgcgccaggagatcatcaacaacctgttcaagaccaacagcaagcgggtgtccagcgccatgctcctgaactacctggagaactacaccaacctccaggccgtcgagatcgtgtccggcatcgagaagggcaagagcctgaactccaccctgaagacgtacaacgacctcaagaccatcttcagcgaggagctgctggactccgagatctaccagaaggagctcgaggagatcgtgaaggtcatcaccgtgttcgacgacaagaagtccatcaagaactacctgaccaagtacttcgggcgcctggagttcctcaacgaggagcggatcaaccagctgagcaagctgcgctacacggggtggggccggtacagcgcgaagctcctgctggacatccgcgacgaggacaccgggttcaacctcatgcagttcctgcggaacgacgacgagaaccgcaacctgagccagctcatctccgacagcaccctgtccttcgacagcgccatcaagtccatccagagcaagtccaccgtggaggacgacgtcttcgacgagatcaagaagctggccggcagccccgccatcaagcgcggcatcctcaactccatcaagatcgtggacgagctggtgcagatcatcgggtacccgccccagaacatcgtcatcgagatggcccgggagaacatgaccacggaggagggccagaagaaggcgaagacccgcaagaccaagctggagagcgccctcaagaacatcgagaactccgtgctggagaacgggaaggtgccccacagcgacgagcagctgcagtccgagaagctctacctgtactacctgcagaacggcaaggacatgtacagcctcgacaagaccgggtcccccacgcccctgtaccgggaccgcctggaccagtacgaggtcgaccacatcatcccgtacagcttcctccccatcgactccatcgacaacaaggtgctgacccaccgggagaacaaccagcgcaagctgaacaacatccccgacaaggagaccgtggccaacatgaagcccttctgggagaagctctacaacgccaagctgatcagccagaccaagtaccagcggctgacgaccagcgagcgcaccccggacggcgtcctcaccgagtccatgaaggcgggcttcatcgagcggcagctggtggagacgcgccagatcatcaagcacgtggcccggatcctggacaaccgcttcctcgacaccaagatcatcaccctcaagagccagctgatcaccaacttccggaacacgttccacatcgccaagatccgcgagctgaacgactaccaccacgcccacgacgcctacctggcggtcgtgatcgggcagaccctgctcaaggcctaccccaagctggcccccgagctgatctacggccaccacgcccacttcaaccggcacgaggagaacaaggccaccatccgcaagcacctctactccaacatcatgcggttcttcaacaaccccaacagcaaggtgtccaaggacatctggaactgcaaccgcgacctgccgatcatcaaggacatcatctacaacagccaggtcaacttcgtgaagcggaccatgatcaagaagggggcgttctacaagcagaacatcatccccaacgactccagcgtgacggtcgacaagcgcttccccatcaagaacaagaagtacctggacccgaagctctacggcggctactacgagcggaactccgccctgagcgtgttcatcatcgggcagtccttcaacaagaacaacaagctgaaggtggtcaaggagttctacgacatcaacatcatcgactaccccctcttcaacaccgaccccatgagcttcttcaacgacgactccgagaacggcttcctgaccaagaacaacctgcagagcgtgcaggccttctacaagatccccaagtactccctcatccagaagaacgacgggacccgcatgctgttcgagagcacgaccaacttccacaaggccacccagttcaagctgaccgaggcccagaacgagctgttcttccacatgaagcgcctgctgacgaagaccgacttcatggacctcaagtccgaggagagcatcaaggagtcccaggacttcatcatgaaccacaagaacgagttcgacaacatcgtgaacggcctgttcgggtacgcggagcggcagctgggcagcaagagcctcttcacccaggcccacgaggcctacaagctgcgcaagtacccggtcttctccctgaacgaggagaccatccggtactactacgacaacttcctccgcctgttcagcctgacgaagtccggcaccagctccgggtacgtggtgggcctcttcgaggcccccaagctgcggaacgtcgtgtaccgcgcgaccaaggacgagagcaacgccaccctgatccaccagtccatcacggggctctacgagacccggatcgacctgagcaagctgggcgaggactga

SEQ ID NO: 2154 - RNA, 4248 nt, synthetic construct
  misc_feature 1..4248: note = Cas9 variant
  source 1..4248: mol_type = other RNA
atgaacctgcgcaacgtggccaaggagggcatcaactacaacatcgggctcgacctgggcaccgggagcgtcggctgggccgtgaccgacgagcagggggagctgttctccttcaagggcaagacgacctggggcagccggatcttccccaccgcggagaccgccgccgacacgcgcctcaagcgggggcagcgccggcgctacgcccggcgccggtggcgcctggacctgctccagtccctgttcgaggaggagatcaagaaggtggacccggagttcttcacccggctgcgccagagccacctcctgaaggaggacaagacctacgccgcgatcctgtccagcaagggcgccacccggcccctcttccccgagggggaggccgaggtcgagtactacaagaagtaccccacgatctaccacctccgcaaggccctgatggagtccaacaaccaggaggacatccggctgatctacctggcgttccacaacatcgtgaaggcccgcggcaacttcctgcaccaggacaccccggggctcaccgccagcaacgccaacatgggcgacgccgtggagaagctgtgctccgcgctggaggactggtgcagctcccagaacatcgagtgcgccatccggaagaaccagaagtccatccaggacctcatggagggcaagaccatcgagcccagcgagagcaacgccctgaaggagacgttcgacgcctcccgcagctcccggaaggacaaggccagcgtcctggcggggtggatcgccatccagcccggcgagcagttcgagcccaagcaggccaaggacgcctccaaggagatcgccaacgcggtgttcgggctcagcgccaacatgaagaaggtgttcgtcgagctggaggaggaccagaagatctacctgaacaacgacgagcaggtcgaggccttctacaccgtgtgcccggacgagggcgtggccctcttcgaggccctgcagagcatgtactccgcgtacgtgctgatgggcatcctcaagggggccgacggcgggagcatctccagctgcaaggtggccgcctacgagcagtacaaggaggacctgaagctgctcaagaccctggtccgcgagttcgcgcccaagaagtacgacgagttcttccggggcgacatcttcgacgccaagaaggggttccgcacccgcaactacgaccccgccacggccaagggctacaccaagtacaactccgtgcggggcgccagctacgacgcgttcaagaaggaggtggagaagctgttcgaggggaccgccgccgaggaggacgtccgctacaccgacatgatgcagcggttcgacgagggcacgttcctccgccggctgaagacctccgacaacgggagcatcccctaccagctgcacctcgaggagatggtggccatcatcgagaaccagaagaccttctacccgttcctggaggagaacaaggagaagttcgagtccctggtgaccttccgcatcccctactacgtcggccccctcacgcagaagaacgcccggcccgacaaccacgggaacgcgcgcttcgcctggagccagcggaaggagggccaggagaacgcccgcgtgtacccgtggaactgggaggaggtgatcgaccggaagcagtccgccgccaagttcatggagcgcctgaccgggacctgcacctacatcctggaggagcccgtcctcccccggtacagcctgctgtacgaggagtactgcctcctgaacgagctgaacggggcgcgctggcgggacatgggcggggactggcaccgcttcgactacgagacgcggatggacatcatcgaggacctgttcaagaagaagaagggcaccgtgaagtacgccaccgtcgccgactggctcgtgcgcgagaagcaccggtcctgcgccgaggtgaagggcggccagggcgagaccgggttcgagagcaagctgtccagctacgtcttcttcaagggcgtgctgcacgtggacgagatcgacgaggcggacatccccatgatcgaggagctcatctggtggaacacgctgttcgaggaccgctccatcctgaaggagagcatcgaggacaagtacggggaccgcctcaacgacgagcagatcaaggccatctgcaagaagcggttcaccggctggggccgcctgtccaagaagctgctctgcgggatcaaggcccagaccgacaacggcccgtgcagcatcatggacgtcctgcgggaggggaaccccaacaacgacgcccgcagcgccaccatggtgttcatggagatcatccgggacgacaagttcggcttcacgaagctgatcgaggaggagaacaagaagcgcatctccagcgtggacgacttcgacgtcaacgacctccccgggtcccccgcggtgcggcgcaccgtgaaccaggccaagcggatcgtcgacgagatcgtgggcatcgccggctgcgccccgcagaacatcttcatcgaggtgacccgcgacgaggacgggcggaacaagggccgccggaccaagcgccggtacgacgccatccaggaggcggtcaaggtgctgaagaaggagcagaaggagtacttcgacgccaacgtggccgacctgctcaagaacaccgcccccgccgcgctggacgacgagcgcctggccctctacttcatgcagaacgggaagtgcatgtactgcggcaaggacctggacatcaaccagctggacaagtaccaggtcgaccacatcctcccccagagctacgtgaaggacgactccttcgagaacaaggccctggtgcacagcgacgacaaccagcggaagtccaacagcatgctgctcgacgactccatcatccgcaagatgaagccctactgggaggccctgcggagcgcggggctgatcggcgagaagaagttcaagaacctcacgcgcgtccgggtgtccgacaaggagctgggcgggttcatcgcccgccagatggtggagaccagccagtccatgaagctgaccagcctcctgctggagcaggcctacccggagacccaggtccgccccgtgaaggccggcttctccagcgacctccggcgccggctgaagctggtgaagtgccgcgagatcaacgactaccaccacgcccacgacgcgtacctcgcctgcgaggtcgggcagttcatcgccctgcggcacaacaagctgtacgagaaccccatcggctactcccacgccgtgaaggacttcatcgccaagcgcgcgaagtacgccagcgagcacgggaagccgatggacacgtacggcatgcccggcagctccagcttcgtgatctccagcttcatgacctccgggttcgacgaggagaccggcgagatcttcaaggacgcctgggacgccagcctcgccgcggtccggatccaccaggccctgaaccgcaaggactgctacatctcccggatgcccgaggagaccagcggggccttctgggacgccacgatctactcccccaagcagaccaagaagaagctgagcctcccgctgaagaagggcctggacccccagaagtacgggtcctacagccgcgagcagttcgcctacttcttcgtgtacgaggcgaagaagatcaagaagaaggaggagaccaaggagtacgtgttcgcctccgtccccgtccaggtggccgccctcgtggcggccgaccccaacgccctgatcgagttcgccaaggccgacgcggaggagcggggcctgaagttcgccaagatcgtgcgcgagaaggtgtacaagtaccagctcatcgaggtcaacgacgagcggttcttcgtgaccggcctgcgcacggtgcggaacgggctgcagatcgccttcagcgagcaggaccgcaacatcgtctccggcatcgtggaggggaacagctccaacaacaacctcctggacatctacgacaagatcaccaaccggtacgccctgtacgccagccgcttcggcaagctcctgaacctgtccggctaccgggagaacttcatccaggcgagcctcgaggaccaggagcgcgtggtcctggccctgatcagcctcttcaacgcccgcaccaacatgatcgacctgtccgccatcgggagctccaagaccgtgggcaacatgagcatgacgttcgccaaggagatggcgatggccgacaaccggttcgccttcatcgaccagtccgtgaccgggatgctggagcgcaagacctacctctga

SEQ ID NO: 2155 - RNA, 4251 nt, synthetic construct
  misc_feature 1..4251: note = Cas9 variant
  source 1..4251: mol_type = other RNA
atgggcagccgcatcatccccatgtcccaggacatcctgggggagttcggcaaggggaacagcgtgtcccagaccagcgagcggaccgcctaccgctccacgcggcgcctccgggagcgcttcctgctgcggcgcgagcggctccaccgcgtcctgaacatcctggacttcctcccgacccactacgccagccagatcgacttcaagaagcggctgggcaagttcaaggagaacaaggagcccaagatcgcgtacgacaacaagtccttcctgttcctcgacagcttcaacgagatgctgaaggacttcgagcaggagcagcccaacatgctgatcaacgagaagggggagaagaagctcatcccctacgactggaccctgtactacctgcgcaagaaggccctccgggagaagatctccaaggaggagctgagctggatcatcctgaacttcaaccagaagcgcggctactaccagctccggggcgaggacgaggaggagaacccgtccaagctggtggagttccacagcctgaccgtggtcgacgtggtgcccgacgagcccatcaaggggaagctcgagacgtggtactccatcatcctggacaacggctgggtctaccgccggagctccaagaccgagctgtacgactggaaggacaagatcaaggagttcatcgtgaccaccgacctcaactacgacgggacggtgaagaccgacaaggagggcaacgtcaagcgcagcttccgggccccctccgagaccgactggaccctgatcaagaagaagacggagtacgagatcgagcagagctccaagaccatcggggagtacatctacaacaccctgctcaagtacccggagcagaagatccgcggcaagctgatccggaccatcgagcgcaagtactacaaggaggagctgaagcagatcctcctgaagcagacggagttccacaacgagctgaaggacgacagcctctactacgactgcctgcgcgagctgtaccggaacaacgagagccaccagctgttcctggagaagaagaacttcgcccagctgttcatcgaggacatcatcttctaccagcgccccctccggtcccagaagtccctgatcagcaactgccccctggagttctacaagttcaaggacagcgtgggcaacgagaaggtgcagcacctcaaggccatccccaagtccaacccgttctaccaggagttccgcatctggcagtggatcagcaacctgtccatctacagcaagctggacgactccaacttcaccagccacttcttcgactccaccgacgactgggagagcctcttcgagatgctgaacgggcggaaggagatcgagcagaagcagctgctcaagttcctgctggagaagaagggcttcaaggggaagtccctgagctccgagatcgagaagtaccgctggaactacgtcgaggacaagaagtacccctgcaacgagacccggagcctcatccagtcccgcctggacaaggtggcgaacctgcccgagagcttcctcacgcggcacgtggagcaggagctgtggcacctgatctactccgtcaccgacaagatcgagttcgagaaggccctcgacaccttcagcaagaagtacaagatcgacacccccacgttcgtggacgccttcaagaagtgcccgcccttcaagagcgagtacggctccttcagcgagaaggccatcaagaagctgctgcccctcatgcgcaccggcaagtactgggacctggacaacatcgacaaggcgaccaagcagcggatcgagaagatcatctccggggagtacgacaaggacatccgcgaccgggtgcgcgagaaggccatcaacctgctcagcgagaccgacttcaaccggctgcagctgtggctcgcccagtacatcgtctacgaccgccactccgaggccacgagcctggacaagtgggagaccatcgacgacatcgtgacctacctgcactccttcaagcagcacagcctccggaaccccatcgtggagcaggtcatcaccgagacgatccgcgtggtgaaggacatctggtccaactacggcaacgggagcaaggactacttcaacgagatccacgtcgagctgggccgggagatgaagctgccggccgaggagcgcaagcgcatccaggagaagaactcccagaacgaggacaccaacctccggatcaaggcgctgctgagcgagatgcagaacgaccccaacgtggagaacgtccgcccctactcccccgtgcagcaggagatcctcaagatctacgaggagggggtgctgaacagcaacatcgagatcgccgacgacatcctgaagatctccaagaccgcccagccgagctccagcgacctcaagcggtacaagctgtggctggagcagaagtaccagagcccctacaccggcgagatcatccccctcaacaagctgttcacgcccgagtacgagatcgagcacatcatcccgcagtcccgctacttcgacgacagctacaacaacaaggtcatctgcgagtccgccgtgaacaagctgaaggacaacagcctcggctacgagttcatcaaggggtacaacggccagatcgtggagtgcgggttcggcaagaaggtcaagatcttctccatcgacgagtacgaggacttcgtgcagaagaactacgccaacaaccggagcaaggcgtcccgcctgatgatggccgacatccccgagaagatgatcgagcggcagctgaacgacacccgctacatcagcaagtacatctccaacatcctcagcaacatcgtgcggtccgagagcaacgacgacggggtcaactccaagaacctgatcagcgtgaacggcaagatcaccaccgtgctgaagaaggactggggcatgaacgacatctggaacgacctcatcctgccccgcttcatccggatgaaccagatcaccgactccgacagcttcacgacctggaacgagcgcttccagaagttcatcccgaccgtccccatcgagctgtccaagaacttcagcgccaagcggatcgaccaccgccaccacgccatggacgccctcgtgatcgcgtgcgccacccgggaccacgtgaacctgctgaacaacctctacgccaagtccagcgcccgctacgacctgaaccggaagctgcgcatcttcgagaagacgacctacaaggacatcaagaccgggcagatcatcgagcgggagatccccaaggccttcctcaagccctggcagaacttcaccacggacgcgaaggacgccatcgagagcatcatcgtctcctacaagcagagcctgcgcgtgatcaacaagtccaccaactactaccagaagtgggtggagaaggacggcatcgtcaagaaggagaagatcaagcaggaggggaagaactgggccatccggaagccgctgcacaaggacaccgtgagcggcctcgtgcagctgtcctgggtcaaggtgcccaaggggaaggtgatgaccgccacgcgcaagagcctggactccagcttcgacctcaagaccatcgcgaccatcaccgacacgggcatccagaagatcctgatcaagtacctggagtccaagggcaacaaccccgagagcgccttctcccccgaggggatcgaggacttcaacaacaacatccacctctacaacgacggcaagaagcaccgcccgatcaccaaggtccggctgtacgagatcgggagcaagttccccctgggcgagaagggcaacaagaacgccaagtacgtggaggccgccaaggggaccaacctcttcttcgcggtgtacgccaacaacaagggcgagcgctccttcgagaccatccccctgaacctggtcatcgaccggctcaagctggggctgagcgccgtgcccgagacgaacgagaagggcgacaacctcctgttccacctgtccccgaacgacctcgtgtacgtccccagcgaggacgagatggagaacctgaagctgatcaacctcgagcacatctccaaggaccagctgaaccgcatctacaagatggtgagctccaccagcaaccggtgcttcttcatcaagagcgagatcgccctgtccatcgtgaacaagatcgagtacagccccctcaacaagatggagaagtccatcgaggggatcatgatcaaggacgtctgcctgaagctccaggtgaaccgcatcggcaacctcgagcggtacttcagctga

SEQ ID NO: 2156 - RNA, 4257 nt, synthetic construct
  misc_feature 1..4257: note = Cas9 variant
  source 1..4257: mol_type = other RNA
atgaaggtgaagaacatcctgggcctcgacatcggggtcaccagcatcggcttcgcccacgtgaccgagaacgagaaggacaacaagtcccacatcaagcagctgggggtgcgcatcaaccccctgacggtcgacgagcagaccaacttcgagaagggccggccggccagcgtgaacgcggaccgcaccctcaagcgcggggcccggaagatgctgtcccggtacaaggaccgccggaagaacctgatcgagatcctcagcaagaccggcttcatcaactccgagagcatcctggccgaggacggcaagaacacgacccactccacctgggccctgcgcgccaaggcgagccgggagcgcatcgagaaggacgagctcgggcgggtgctgctggccatcaacaagaagcgcggctacaagtccagccggaaggccaagaacgaggacgaggggcaggccatcgacggcatggcgatcgccaagcgcctctacgaggagaacctgacccccgggcagctggtctaccagctcctgcgggagggcaagaagtacatccccgacttctaccgctccgacctgcaggacgagctcgacaaggtgtggaacttccagaagcagttccaccaggagatcctgacggacaccttctacaaggacatccagggcaaggggcagcgggccaccagcgcctccttctacggcgtgtacgggttcaacaccgccgagaacaagggcagccgcgaggagaagcggctgcaggcgtacgcctggcgctccgacgccctcacgaagcagctgacccgggaggaggtcgccttcgtgatcaccgagatcaacaacaacctgaacaacagctccggctacctcggggccatcagcgaccgctccaaggagctgttcttcaacaagaagaccgtgggccagtacctgtacgagcagctccagcagaacccccacacgcgcctgaagaaccaggtcttctaccggcaggactacctggacgagttcgagaccatctggaccatccagagccgctactacccggagctcaccgacgacctgaagcgggagatccgcgacgtggtgatcttctaccagcggaagctcaagagccagaaggggctcgtctccttctgcgagctggagagcaaggagatcatgatcgagaagaacggcaaggcggccgtgaagaagatcgggtccaaggtggcccccaagagcagccccctgttccaggagttcaagatctggcaggtcctccacaacgtggacatcaagaacaagaaggacaagacgaagcgccccctggacgactccgagaaggagtacctgttcaacgagctcaacatcaagggcaacctgaaggccgccaaggtgatccagctgctcaccctgaacaagaacgagaccgagctgaactacacccagctcgagggcaaccggacgcagaaggcgctgtacgaggcctacctgaagatcctcgacaccgaggggtacgacgtcaacaacctgctgggcatcaagtccaacaaggacgaggtgttcctggacgacctcgacgtgaacgccctggagatcaagaccatgatcaagcagatcttcaacgccctgaacatcaacaccgggatcctcgacttcgacgccgagctggacggcaaggcgttcgagcagcaggccagctaccacctgtggcacctcctgtactcctacgaggaggacgggagcaagtccggcaacgagcacctgtacaagctcctggagaacaagttcggcttcaagccggagcacgcccgcatcctggccgggatcacgctcagcgacgactacggcaacctgtccgcgaaggccatgcggaagatctacccccagatcaaggagaacaacttcagcaccgcctgcgagctggtcgggtaccgccactccaagaacagcctcaccaaggaggagaaccaggagcggcccctgaagaacaagctggagctcctgaagaagaactccctgcgccagcccgtggtcgagaagatcctcaaccagatgatcaacctggtgaacgagctgatcgacaagaacagcgagaaggacgagcagggctccatcatcgagtacttccggttcgacgagatccgcatcgagctcgcccgggagctgaagaagaacaccgacgagcgccgggacctggacgccgcgatccgcgaggggaacctccggaacgagaagatctacaagctgctgcaggcccagttcggcatcaagaacccgacgcgcaacgacatcatccgctaccggctctacgaggagctgaagaacaacggctacaaggacctgtacaccaacagctacatcccccaggagaagctgttcgggaaggagatcgacatcgaccacatcatcccccagagcaagctgttcgacgactccttcagcaacaagaccctgacctacaacacgaccaacaaggacaagggcaaccagaccgggttcgactacatcgagtccaagtacggcatcgacggcatcgaggcctacaccgcccgcatcgagaacctcttcgagagcgggaagaagaacaaggaggagggcgtgtccaaggccaagtaccagaagctgctgaagaaggagagcgagatcggggacggcttcatcgagcgggacctccgcgagtcccagtacatcgcgaagaaggccaaggagctgctgctccagatcacccggagcgtcgtggccacgtccgggagcatcaccgcccgcctgcgggaggactgggacctggtgaacgtcatgaaggagctcaacctgcccaagtaccgcgccctgggcctcaccgagatggaggagcggaagtacggccagaaggtggaggtgatcaaggactggaccaagcgcgacgaccaccggcaccacgcgatggacgccctgacgatcgccttcaccaagcacaaccacatccagtacctgaaccacctcaacgcccgcaaggacgagcagcacaaggagcacaagatcatcaacgcgatcgagaacaaggagaccatcctgatcaccgacaagtccgggaaccggaagcgcgtcttcaaggccccgatgcccaacttccggcagacggccaagcagtacctggaggaggtgctcatcagccacaaggccaagaacaaggtggtcaccaagaacaagaacaagatcctgggcaaggagaagatccaggagaccctgacgccccgcgggcagctccacgaccagaccatctacggcttcaactggtggtcccggatcaccctgagcaagaaggtgtcccgcaacgagatcgagaagatcatcgacaacaacaccaagttcttcctgcaggagttcatccagctcaaggggagcatcgccaaggcgttctccgacgccgagctgaacaagctgatgtacaagggcaagatcctcaaggagatcgaggtggccatcccctgctacacccagcggatcgacatcagcaaggtcttcacggacagccagaagtccaacagcgccaaggagaagaacatcaagaacatcctggacctgaaggtgcgcaacatcctccagaaccggctgtccgagttcaagggcgacttcaagaaggccttcagcgacctggacaagaacccgatctggttcaacaaggagaaggggatctccatcaagcgcgtgatcatcagcggcgtcaagaacgtggagcccctccactacaagaaggaccacctggggaacgacatcctggacggcaaggagaaccgcatccccgtggacttcatctccaccgggaacaaccaccacgtcgcgatctaccaggacgagaagggcaacctccaggagaaggtggtgagcctgttcgacgccgtcaagctggtgaacgccgacgagcccgtgatcgacaagacctacaaccagggcctcgggtggcagttcctgttcaccatgaagcagaacgagatgttcgtcttcccgaacgacaacacgggcttcgaccccaaggagatcgacctgctcgacccctccaacaagaagctgatcagccccaacctgttccgggtgcagtccatcagcatcgtgcagtacgggaacaacatcgtccgcgacttcaagttccggaaccacctcgagtccgtgctgaacgacgacaaggtgctgcacggcatcaccttccagcagatcaagagcctcgggccgctgctgaacatcgtcaaggtgcgcatcaaccacctcggcgacatcgtgtccgtcggcgagtactga

SEQ ID NO: 2157 - RNA, 4260 nt, synthetic construct
  misc_feature 1..4260: note = Cas9 variant
  source 1..4260: mol_type = other RNA
atggccaagccccagaactacaccatcggcctggacatcgggaccaacagcgtgggctggacggtcaccgacgaccagaacaacatcctccgcatcaagtccaagaaggccatcggggcgcggctgttcgaggagggcaaggtggccgccgagcgccggagcttccgcaccacccggcgccggctgtcccgccggaagtggcgcatcaagctcctggaggagctgttcgacgaggagatcagcaaggtggacccgaacttcttcgcccggtcccacgagagctggatctcccccaaggacaagcgcgagcggtacagcgccatcgtcttccccacgcccgaggaggacaagaagttccacaacgagtacccgaccatctaccacctccgcgaccggctgatgaaggacgaccagaagcacgacatccgcgagatctacgtggcgatccaccacatcatgaagtaccgggggaacttcctgcacgacgagtccatcgagacctaccgcagcggcatgtccagcctcggcgggggcgacgagcggaccatcctgaacacgaagatcctggacgacctcaacgacgccttcgccgacaacctggccacccaggggatctccgtgaacagcgcgtccgccgaccagatcaacgagatcgtcaccagcggccacctgaacgtggactcccagaaggccatcgccaagctcctgctgcccaccacgctcagctccgacgacaagaagcaggacaagaagatcaagaagctggccaccgacgcggccaagaacgtggccagcgcctggctggggtacaaggccaacttcgcggccatcctcaacatccaggaggtcgacaaggacaagaagaagatctacagcttcgccctgcagggcgccgacgaggaggacaaggtggagaccctggagtccgtgctcagccaggaccagatcgagatcgtcgaccgcatcatccggatccgccacgccatcgtgctgggcgagatcatccccgtggggatgaccctgtccgaggcgatgatcgagaagtacgaccagcacgccaaggacctcaagaacctgaagacggtcatccgcaacctgaaggaccggaagaacgccgtgaagctccaggccatctacgacctgtacgtgaacaaccgccacgccgacaccgcgaaggccatgaagctggccggcgtcaagaagcggaccgagctcctggagcccgaggagttcaacaagagcatcgagaagctgctcgacgactccccggtgagcgccgagatcaagaagcgcatcgcggagaaggacttcctgcccctgcagcggtccaacagcaacggggtgatccccaaccagctccaccagatcgagctggacgagatcatcaagaagcagtccaagtactaccccttcctgggcgagaccaacgagcacgccagcgccgacgtcgcccgcaaggccccgacgaagctcgaccagctgctgaccttccgggtgccctactacgtgggccccctcatcaccaaggaggagcaggaggagcaggacgggcactccttcgcgtggatgatccgcaagaaccccaaggaccacgagaagatcaccccgtggaacttcgacgagaaggtcgaccggatggccagcgccacgcagttcatcaagcgcatgaccaccaaggacacctacctgctgggcgaggacgtgctcccctccagctccctgaagtaccagctgttcacggtcctgaacgagctcaacaacctgcggatcaaccacaagaagctgacccgcgaggagaaggagcaggtcatcgaggacctcttcaagaagtacaagaccgtgaaggccgacaagttcaagaactactggcagaaggggcacgccggcctggacgtgaagatccaggggatggcggaccccgagaagttcaacagcaccatgtccacgtacatcgacctgcagaagatcttcggcgaccagctcgacgacgcccagcggcagaacgacttcgagaagatcatcgagtacagcaccatcttcgaggaccgcaagatcctgggcgagaagctgcgggccgacttcgtgtggctctccgaggaccagatcaagcgcctgtgccggctgcgcctccaggggtggggccggctgagcctgaagctcctgacccgcctgaccgacgccgacgggcagaacgtgctcgagcgcctgctgaacagcaacgacaacttcatgcagatcgtcaaggaccccgtgatcaaggccaagatcgagcagaagaaccagaagctcctgcgggcggactggtccgagaacgccacggagagcatcctggacgaggcctacacctccccgcagaacaagaaggccatccgccaggtgatgcgggtcgtgcacgacatcgtgaaggcgtgcgacggcaacctccccgccaagttcgccatcgagttcgcccgcagccaggacgacgaccccaagcggaccgtcgcccgcgcggaccggctgcagaagatctacgcccagatctccgacgaggtggtgagccagggggtcaaggaccagctgtccggcatgaagtccctcaaggaccgctactacctgtacttcatgcagggcgggcgggacgcctacaccggcaagcccctgaacatcgaccgcctcagcgactacgacatcgaccacatcatgccgcagagcttcatcaaggacgactccctggacaaccgggtgctggtgacccgcgccgtcaacaaccagaagtccgacaacgtgcccgtgctcctgtacgggaaccacctggtcgccgacctcggcatcacgatccgggagatgtgggaccgctggcagaagtccgggatgatcagcaagcggaagctggcgaacctgctcaccgaccccgccaccctgagcgagtaccgcgccgagggcttcatcaaccggcagctggtggagaccagccaggtgatcaagctcacggccaccatcctgcagtccgagttccccgacagcaagatcatcgaggtcccggccaagtacaacagcatcctgcgcaagcagttcgacctctacaagtcccgggaggtgaacgactaccaccacgcgatcgacgcctacctgagcaccatcgtgggcaactacctgtaccaggtctaccccaacctccgccggctgttcgtgtacggggagttcaagaagttctcccacggcgaggaggagagctcccaccaggccgtgcgccgcgtcaagagcatgaacttcctggacgacctcctgcgggggaagcacggcgacgacatctactgccgcgtgaccggcgaggtgatcttctcccggaaggacatcatcagcaagctgaagcaggcctactccttcaagcagatgctcgtcacgcaggaggtgttcaccaagaagtccgcgctgttcgaccagaccgtgtaccccagcccggcccgcgacagcaagacccggtccgggctgatcccccgcaagcagggcatggacacggagatctacgggggctacagcgggaacaaggacgcctacttcgtcctcgcccaggtggtgaagtccaagggccacaccctgcaggtcgtgggcgtgcccatccgggccctgcgcgcgctcgccaactgcagcaactactccgagcagctgctgaagatcgtcaaggcccaggtcctcttcaacaagaagaccgggaaggccaagaagggcatcagcgacgtgcggatcctgctggacaagatcccctaccgccagccggtgctcgacgggtccgccttctacatgctgggcagcagcacctacaagtacaacctgaagcagatctccctcagccagcagtccatgaagtacatcctggactacatcgacgaccccaacttcaacaagcacgagatgacgaagatcgaccagcagaacgagaaggagtgcctgctcagcgtgtacgacgagatcctggacaagatggacaagtacctgtccctctacgacatcaacgggttccggaagaagctgcacgtgggccgcgacaagttcatcaagctggaggtcgagaagcaggcggaggccatcaagaacgtgctccggggcttccacgccaacagcgacatgaccaagctgtccgacctggggctcagcacctccctgggcttcatgcaggccagcgacgggatcaagctgtccgacaacgccgtgttcatctaccagagccccaccggcctcttcgagcgccgggtcaaggtgtccgacctgctgaagtga

SEQ ID NO: 2158 - RNA, 4260 nt, synthetic construct
  misc_feature 1..4260: note = Cas9 variant
  source 1..4260: mol_type = other RNA
atgatgatcaagaacatcctgggcctcgacctggggaccaacagcatcggctgggccctgatcaagcagaacttcgagaacaagtacggggagatcctcggcatggggtcccgcatcatccccatgagccaggacgtgctgggcgagttcggcaaggggaactccgtcagccagaccgccgcgcggacgggctaccgcggggtgcggcgcctgcgggagcgcttcctcctgcggcgcgagcggctgcaccgcgtgctcaacgtcctgaacttcctgccggagcactacgcctcccagatcgacttcgagaagcggttcggcaagttcaagtacgagaccgagcccaagctcgcctacaacaacgacgggttcttcttcaagaacagcttcgacgagatgctgggcgacttcaaggaccaccagttccacctcctggagaacggccgcaaggtgccctacgactggaccatctactacctgcggaagaaggccctgtcccagaagatcgagaaggaggagctcgcctggatcctgctgaacttcaaccagaagcgcgggtactaccagctccggggcgaggacttcgaggaggagaaggaccgcgtgttcgtccggctgaaggtggaccgcgtggtcgacagcggggagaacatcaagggcaagatcctgtacgacgtgtacttcgagaacggctggaagtacgagaagcagatcgtgaagaccgaggactggatcgggcggacgaaggagttcatcgtcaccgagtccatcctcaagaacggcgacaccaagcgcaccttcaaggcggtggacagcgagaaggactggatcgccatcaagacgaagaccgagcaggagatcgacaagtcccacaagaccgtgggggcctacatctacgaggccctgctgcagaaccccaagcagaagatcaagggcaagctcgtccggaccatcgagcgcaagttctaccgcgaggagctgaagaagatcctggagcggcagaaggagttccacccggagctccagagcgacgacctgtacaacgactgcatccgcgagctgtaccggaacaacgaggcgcaccagatcacgctctccaagaaggacttcgtgcacctcctgctgaacgacctgatcttctaccagcgccccctgcggagccagaagtccagcgtgtccaactgcaccctcgagttccgcaagtacaaggacgagaacggggtcgagcacgcccagtacctgaagaccatccccaagagcaacccctactaccaggagttccgggtgtggcagtggatgttcaacctgaacatctaccgcaaggacgacgacaccaacgtgacgaaggagttcctctccagcaccgaggactacgagaccctgttcgagttcctgaacaaccggaaggaggtcgaccagaaggccctcctgcgccacttcaagctgaacgagaagacccaccggtggaactacgtggaggacaagaagtacccgtgcaacgagacgaagaccatgatcagcacccgcctcgagaaggtggagaactacccctccgacttcctgacccgggagatggagcagaacatctggcacatcatctacagcgtcaacgacaagatcgagtacgagaaggccctgaagtccttcgcccacaagaacaacctggacgagaacagcttcttcgaggcgttcaagaagttcccgcccttcaagtccgagtacggcagcttctccgagaaggccatcaagaagctcctgcccctgctccgcctgggcaagtactggaactgggagagcatcgaccggaagtcccaggggcgcatcgagaagatcatcacgggcgagttcgacgggaacatcaaggacaaggtgcgggagaaggccatccacctgaccgccgagaacgacttccagggcctccagctgtggctggcccagtacatcgtctacgggcgccacagcgaggcgtccatgatcggcaagtggaacagcgccgacgacctcgaggagttcctgaagggcttcaagcagcactccctgcggaaccccatcgtggagcaggtcatcaccgagaccctccgcgtggtgaaggacatctggctgaagtacgggaacggcgccaaggacttcttcagcgagatccacatcgagctggggcgcgagatgaagcagacgaaggacgagcgggtggacgccaccaagcgcatcaccgagaacgagaacaccaacctccggatcaaggccctgctggcggagatgatgaacgacaactccgtcgagaacatccgcccctacagccccatgcagcaggagatcctcaagatctacgaggacggcatcctgaagtccgacatcgagatcgacgacgacatcctgaagatcagcaagacggcccagccgtccagcagcgacctcaagcggtacaagctgtggctggagcagcgctacaagtccccctacaccgggcagatcatccccctcaacaagctgttcaccagcgagtacgagatcgagcacatcatcccccagtcccggtacttcgacgacagcttctccaacaagatcatctgcgagagcgccgtgaacaagctgaaggacaactacatcggcctcggcttcatcaagcagttcgggggcatgatcgtggagtgcgggttcggcaagtccgtcgagatcttcaaggccgaggagtacgaggacttcgtgaagaagcactacgccaacaaccgcagcaagcggaacaagctgctgctcgaggagatcccggagaagatgatcgaccgccagctgaacgacacccggcacatctccaagtacatcagcggcgtgctgtccaacatcgtccgccaggaggacgggacggacgagggcgtgaacagcaagaacatcgtgcccgggaacggcaagatcaccacccagctcaagcaggactgggggctgaacgacgtctggaacgagctgatcctcccccggttcgagcgcatgaaccagctgaccaactccaccgacttcacgagctggaacaagaaccaccagaagttcctgcccaccgtgccgatcgagttctccaagggcttcagcaagaagcggatcgaccaccgccaccacgcgatggacgccctcgtgatcgcctgcgccaccaaggaccacatcaacctgctgaacaaccagtccgccaagagcgacaccaagcggtacgacctcaagcgcaagctgatgaagttcgagcgggtcgtgtacagccactccaagacgggcgagaagatcgagaaggaggtgcccaagcagttcctgaagccctgggacaacttcaccgtcgacgcgaagaacaagatggagaccatcatcgtgagcttcaagcagaacctccgcgtgatcaacaaggccaccaaccactacgagaagtggatcgagaaggacgggatcaagcggaaggagctgatcaagcaggagggcacgaactgggccatccgcaagcccatgcacaaggagaccgtctccgggaaggtggacctgccgggcatcaagatccccaaggggaagatcctcaccgccacccgcaagagcctggacacgtccttcgacctgaagaccatcaacagcatcaccgacaccggcatccagaagatcctcaagaactacctggagttcaagggctccagcgagctggcgttctcccccgaggggatcgaggacatgaacaagaacatcgagaagttcaacgacggcaagccgcaccagagcatcaacaaggtgcggatcttcgagctcgggtccaagttcagcgtcggccagacggggaacaagaaggacaagtacgtggaggccgccaagggcaccaacctgttcttcgccgtgtacgaggacaagaacggcaagcgctcctacgagaccatccccctgaacgaggtcatcgagcggcagaagcaggggctcgacagcgtgtccttcaagaacaaggaggacttcctgctgtgccccaacgacctcgtgtacgtccccagcgaggacgagctggagaacatctacaacatcgacttcaagaacctgaccacggagaagaccggcaacatctacaaggtggtgtccttcagcgggaaccagatcttcttcatccgccaggacatcgccatctccatcgtcaacaaggcggagttcagcaccctcaacaagatggagcgggccatcgacggcagcatgatcaaggagaactgcatcaagctgaagatcgaccgcctggggaacatcgccaagatctga

SEQ ID NO: 2159 - RNA, 4263 nt, synthetic construct
  misc_feature 1..4263: note = Cas9 variant
  source 1..4263: mol_type = other RNA
atggccaagcccaaggactacaccatcggcctggacatcgggaccaacagcgtgggctgggtcgtgacggacgaccagaacaacatcctccgcatcaaggggaagaaggccatcggcgcgcggctgttcaccgaggggaaggtggccgccgagcgccggtccttccgcaccacccggcgccggctgagccgccggcgctggcggatcaagatgctcgaggagctgttcgacgaggagatcgccaaggtcgacccgtccttcttcgcccgcctgcacgagagctggatctcccccaaggacaagcggaagcgctacagcgcgatcgtgttcccctcccccgaggaggacaagaagttccacgagagctacccgacgatctaccacctccgggacaagctgatgaaggacgaccagaagcacgacatccgcgagatctacatcgccgtgcaccagatgatcaaggcccggggcaacttcctgcacgacgagtccgtcgagacctaccgcagcggcatgtccagcctcgggggccggtccgagcgcaccatcctgagcgtgcagaccctggaggagctcaacgacctgttcgccgagaacgaggggacggaggaggtggagctgaacgtcgcgtccgccgagcagatcaacgacatcctcaccggcgggcacctgaacgccgacagccagaaggagatctccaacctgctcctgcccagctccttccccagcttcgacgacaaggccaaggagaagcaggtcaagaagctgatcaacaacgtggccaccaacatcagcaaggcgtggctcggctacaaggccgacttctccaccatcctgaacctggccaaggtggacaaggaccagaagaagatcttcgccttcgccctccagggcgaggacgaggaggacaaggtgcaggagctggagagcctgctcgagcagtcccagacggacatcgtggaccggctgatcgagatccgccacgcgatcgtcctgagcgagatcgtgcccgtggggatgaccctctccgaggccatgatcgacaagtacgaccagcacaaggaggacctgatcaccctgaaggccgtcatccgcaacaccaaggacaagaagaaggccgccaagctccaggcgatctacgacctgtacgtgaagaaccggcacgccgacctggccaaggccatgaagctcacgggcatcaagaagcgcagcgagctgctggacccggaggagctcaagaaggggatctccagcctgctggacgactcccccgaggccgtggagatcaagcagcggctcgaggagaagaccttcctgcccctgcagcgcagcaacaacaacggcgtcatccccaaccagctccaccaggtggagctggacgagatcatcaagaagcagtccaagtactacccgttcctggcggagaagaaccccgacgagagcgaggaggcccagaagaaggcccccaccaagctcgacgccctgctgaccttccgggtgccctactacgtcggcccgatgatcacgaaggaggagcaggaggcgcagaacgggcactccttcgcctggatggtgcgccgggacccccaggaccacgaggccatcaccccctggaacttcgagaagaaggtcgacaagatggccagcgccacccagttcatcaagcgcatgaccacgaaggacacctacctgctcggcgaggacgtgctgcccgcgtccagcctgaagtaccagctgttcaccgtgctcaacgagctgaacaacctccgggtcaacgggaagaagctgacctccgacgagaaggagcaggtcatcgagggcctgttcaagaagcagaagacggtgaaggccgacaagttcgtgaagtactggcaggccaagcacatcggggccgacatcaaggtgaagggcctcagcgacccgtccaagttcaacagcaccatgagcacctacatcgacttcaagaagatcttcggcgaccagctgaacgacgtgaaccgccagaacgacttcgagaagatcatcgagtactccaccatcttcgaggaccggaagatcctggaggacaagctccgcgccgacttcgcgtggctgagcgaggagcagatcaagcagctgtgccggctccgcctgcaggggtggggccggctgtccgacaagctcctgacgcgcctgaccgacgccgacgggcagaacgtcctcgagcggctgtggaacagcaacgacaacttcgtgcagatcgtgtccgaccccaacatcaaggccaagatcgagcaggagaaccagaagctgctccgcgacagccagtccgacaacgccgtcgagagcatcctggacgacgcctacaccagcccccagaacaagaaggcgatccgccaggtgatgcgggtggtccacgacatcgtgaaggcctgcgacggcaacgtgcccgccaagttcgccatcgagttcgcgcgcagccaggaggacgacccgaagcggaccacggcccgcgtcaaccagatgcagaagatctacgaccagatctccgacgaggtggtgagccagggggtcaaggagcagctgtccggcatgaagtccctcaaggaccggtactacctgtacttcatgcagggcgggcgcgacgcctacaccggcgccaagctgaacatcgaccggctctccgactacgacgtggaccacatcatgccccagagcttcgtgaaggacgactccctggacaaccgcgtcctggtggcccgggcggtgaacaaccagaagtccgacaaggtccccgccctcctgttcgggaacaaggtggtggccgacctgggcatcaccgtccgcgagatgtgggacaagtggcagaagctcgggatgatcagcaagcggaagctgagcaacctgctcaccgaccccgacgccctgaccgagtaccgcgcccagggcttcatccggcgccagctggtggagacgagccaggtgatcaagctcaccgcgaccatcctgcagtccgagttcccggacagcaagatcatcgaggtccccgccaagtacaactccatcgtgcggaagcagttcgacctgtacaagagccgcgaggtgaacgacttccaccacgccatcgacgcctacctctccaccatcgtcggcaactacctgtaccaggtgtaccccaacctgcggcgcatgttcgtgtacggggagttcaagaagttcagctccaacgccgaggagagcgcgcacgacgtcgcccggcgcgtgaagtccatgaacttcctcgacgacctgctgcggggcacgcacggggacaacatctactgccgcagcaccggcgagatcgtgttcaaccggaacgacatcatctccaagctcaagcaggcctacagcttcaagcagatgctggtcacccaggaggtgttcacccgcaagtccgccctgttcgaccagacggtgtacccgagccccgagcgcgactccaagaagcggagcggcctcatcccccgcaagaaggggatggaccccgagatctacggcgggtacgcgcacaaccaggactcctacttcgtcctggccaagatcgagaaggtgaagggctacaccctgcagatcgtgggggtcccgatccggagcctcgagatcatcaacaaggccgaggacttcagcaccgccctgctggacatcatcaagtccaaggtgatgtacaacgagaagaccggccagcccaagcgcggcatcaagaacgtggagatcctcgtcaacaagctgccctaccggcagcccatcctggagaaggacgtgagctacatgctcgggtccagcgcctacaagtacaacatgaagcagatcacgctgtcccgccagagcatgaagtacatcctggactacatcgacgacccgaacttcaccaagcacgagatgaccatgatcgacgagcagaacgagcgggagtgcctcctgtccgtctacgacgagatcctggagaaggtggacaagtacctccccctgttcgacggcaacaagttccgcgagaagctgcacagcgcgcggaaggagttcgtgtccctcagcgtcgacgacgaggcctccgccatcgagaagatcctgcgcgggctgcacgccaacagcgagatgccctccctcgagaacctgaagatcaagcccgccctgggcttcttccagatgaagaacgggatcaccctcagcaacgacgcggtgctgctgtaccagtccccgacgggcctcttcgagcggcgcgtgaaggtcagcgacctgctgaagtga

SEQ ID NO: 2160 - RNA, 4263 nt, synthetic construct
  misc_feature 1..4263: note = Cas9 variant
  source 1..4263: mol_type = other RNA
atggccaagcccaaggactacaccatcggcctggacatcgggaccaacagcgtgggctgggtcgtgacggacgaccagaacaacatcctccgcatcaaggggaagaaggccatcggcgcgcggctgttcaccgaggggaaggtggccgccaagcgccggtccttccgcaccacccggcgccggctgagccgccggcgctggcggatcaagctcctggaggagctgttcgacgaggagatcgccaaggtcgacccgtccttcttcgcccgcctccacgagagctggatctcccccaaggacaagcggaagcgctacagcgcgatcgtgttcccctcccccgaggaggacaagaagttccacgagagctacccgacgatctaccacctccgggacaagctgatgaaggacgaccagaagcacgacatccgcgagatctacatcgccgtgcaccagatgatcaaggcccggggcaacttcctccacgacgagtccgtcgagacctaccgcagcggcatgtccagcctcgggggccggtccgagcgcaccatcctgagcgtgcagaccctggaggagctgaacgacctgttcgccgagaacgaggggacggaggaggtggagctcaacgtcgcgtccgccgagcagatcaacgacatcctgaccggcgggcacctgaacgccgacagccagaaggagatctccaacctcctgctgcccagctccttccccagcttcgacgacaaggccaaggagaagcaggtcaagaagctcatcaacaacgtggccaccaacatcagcaaggcgtggctgggctacaaggccgacttctccaccatcctgaacctcgccaaggtggacaaggaccagaagaagatcttcgccttcgccctgcagggcgaggacgaggaggacaaggtgcaggagctggagagcctcctggagcagtcccagacggacatcgtggaccggctgatcgagatccgccacgcgatcgtcctcagcgagatcgtgcccgtggggatgaccctgtccgaggccatgatcgacaagtacgaccagcacaaggaggacctgatcaccctcaaggccgtcatccgcaacaccaaggacaagaagaaggccgccaagctgcaggcgatctacgacctgtacgtgaagaaccggcacgccgacctcgccaaggccatgaagctgacgggcatcaagaagcgcagcgagctgctcgacccggaggagctgaagaaggggatctccagcctgctcgacgactcccccgaggccgtggagatcaagcagcggatcgaggagaagaccttcctgcccctgcagcgcagcaacaacaacggcgtcatccccaaccagctccaccaggtggagctggacgagatcatcaagaagcagtccaagtactacccgttcctggcggagaagaaccccgacgagagcgaggaggcccagaagaaggcccccaccaagctcgacgccctgctgaccttccgggtgccctactacgtcggcccgatgatcacgaaggaggagcaggaggcgcagaacgggcactccttcgcctggatggtgcgccgggacccccaggaccacgaggccatcaccccctggaacttcgagaagaaggtcgacaagatggccagcgccacccagttcatcaagcgcatgaccacgaaggacacctacctgctcggcgaggacgtgctgcccgcgtccagcctgaagtaccagctgttcaccgtgctgaacgagctgaacaacctccgggtcaacgggaagaagctgacctccgacgagaaggagcaggtcatcgagggcctgttcaagaagcagaagacggtgaaggccgacaagttcgtgaagtactggcaggccaagcacatcggggccgacatcaaggtgaagggcctcagcgacccgtccaagttcaacagcaccatgagcacctacatcgacttcaagaagatcttcggcgaccagctgaacgacgtgaaccgccagaacgacttcgagaagatcatcgagtactccaccatcttcgaggaccggaagatcctggaggacaagctccgcgtcgacttcgcctggctgagcgaggagcagatcaagcagctgtgccggctccgcctgcaggggtggggccggctgtccgacaagctcctgacgcgcctgaccgacgcggacgggcagaacgtgctcgagcggctgtggaacagcaacgacaacttcgtgcagatcgtctccgaccccaacatcaaggccaagatcgagcaggagaaccagaagctgctccgcgacagccagtccgacaacgccgtggagagcatcctggacgacgcctacaccagcccccagaacaagaaggccatccgccaggtgatgcgggtcgtgcacgacatcgtgaaggcgtgcgacggcaacgtccccgccaagttcgccatcgagttcgcccgcagccaggaggacgacccgaagcggaccacggcgcgcgtgaaccagatgcagaagatctacgaccagatctccgacgaggtggtcagccagggggtgaaggagcagctgtccggcatgaagtccctcaaggaccggtactacctgtacttcatgcagggcgggcgcgacgcctacaccggcgccaagctgaacatcgaccggctctccgactacgacgtggaccacatcatgccccagagcttcgtcaaggacgactccctggacaaccgcgtgctggtggcccgggccgtcaacaaccagaagtccgacaaggtgcccgcgctcctgttcgggaacaaggtggtcgccgacctgggcatcaccgtgcgcgagatgtgggacaagtggcagaagctcgggatgatcagcaagcggaagctgagcaacctgctcaccgaccccgacgccctgaccgagtaccgcgcccagggcttcatccggcgccagctggtggagacgagccaggtcatcaagctcaccgccaccatcctgcagtccgagttcccggacagcaagatcatcgaggtgcccgcgaagtacaactccatcgtgcggaagcagttcgacctgtacaagagccgcgaggtcaacgacttccaccacgccatcgacgcctacctctccaccatcgtgggcaactacctgtaccaggtgtaccccaacctgcggcgcatgttcgtctacggggagttcaagaagttcagctccaacgccgaggagagcgcccacgacgtggcgcggcgcgtgaagtccatgaacttcctcgacgacctgctgcggggcacgcacggggacaacatctactgccgcagcaccggcgagatcgtcttcaaccggaacgacatcatctccaagctcaagcaggcctacagcttcaagcagatgctggtgacccaggaggtgttcaccaagaagtccgccctgttcaaccagacggtctacccgagccccaagcgcgacggctccaagcgcagcgggctcatcccccggaagcgcggcatggaccccgagatctacgggggctacgcccacaaccaggactcccacttcgtgctggcgaagatcgagaaggtgaaggggtacaccctgcagatcgtcggcgtgccgatccggagcctcgagatcatcaacaaggccgaggacttcagcaccgccctgctggacatcatcaagtccaaggtgatgtacaacgagaagaccggccagcccaagcgcgggatcaagaacgtcgagatcctcgtgaacaagctgccctaccggcagcccatcctggagaaggacgtcagctacatgctcggctccagcgcctacaagtacaacatcaagcagatcacgctgtcccgccagagcatgaagtacatcctggactacatcgacgacccgaacttcaccaagcacgagatgaccatgatcgacgagcagaacgagcgggagtgcctcctgtccgtgtacgacgagatcctggagaaggtggacaagtacctccccctgttcgacgggaacaagttccgcgagaagctgcacagcgcccggaaggagttcgtctccctcagcgtggacgacgaggcgtccgccatcgagaagatcctgcgcggcctgcacgccaacagcgagatgccctccctcgagaacctgaagatcaagcccgccctggggttcttccagatgaagaacggcatcaccctcagcaacgacgccgtgctgctgtaccagtccccgacgggcctcttcgagcggcgcgtcaaggtgagcgacctgctgaagtga
